United States Patent 9,675,668 (MODIFIED POLYNUCLEOTIDES ENCODING HEPATITIS A VIRUS CELLULAR RECEPTOR 2) - sequence listing, part 15

SEQ ID NO: 29842 - DNA, 207 bp, Artificial Sequence
  Description of Artificial Sequence: Synthetic coding sequence
atggaccaggtgatgcagttcgtggagcccagtcggcagtttgtgaaggactcaatccgcctggtcaaaagatgcaccaagccagatcgtaaggaattccagaaaatcgctatggccaccgcaatcgggttcgccatcatggggttcatcggattcttcgtcaagcttattcacatccctattaacaatattattgtgggaggttag

SEQ ID NO: 29843 - DNA, 2610 bp, Artificial Sequence
  Description of Artificial Sequence: Synthetic coding sequence
atggcggccgttcctacccagccacaatcaaaagaaggcccttggagccctgaaagcgaatcaccaatgctccgcatcacggctccccttcccccggggccctctatggctgtgcccaccctgggtccgggcgaaatcgcaagcacaacaccaccatctcgggcatggacgcctacccaggaagggcccggcgacatgggaagaccatgggtggcggaagtagtgtctcaaggtgccggaatcggcatccagggcaccatcacctctagtaccgctagcggggacgatgaagagactactactacaacaactatcatcactacgactattaccaccgtgcaaactcccgggccttgcagctggaacttcagcggaccagaaggctcgcttgatagtcccaccgatctgagctcacccactgacgttgggttggactgtttcttctacatcagtgtctatccaggttacggcgttgaaataaaggtgcagaacattagcttacgggaaggagaaactgtcacagtggaaggactcggaggccctgaccctttaccacttgcaaaccaatcattcctgctaaggggccaggtcatccggagccccactcaccaggccgcacttcgcttccagtccctaccccctcccgccggacctggtactttccacttccattatcaagcatatctacttagttgccattttccccgacgcccggcttacggcgatgttactgtgacttcccttcaccccggaggatccgctcgatttcattgcgcaaccggataccaactaaagggcgcccgccacctaacctgcttaaatgcgactcaacctttttgggacagtaaggagccagtgtgcattgctgcctgcggcggcgtgatacgaaacgcaacaacagggagaattgtatctccagggtttcctggaaactactcaaacaatcttacatgtcactggttactagaagctccggaagggcaacggctacatctgcatttcgaaaaggtgagcctcgcagaagatgacgaccggttaattattcggaatggagataacgtggaagctcccccggtctacgactcctacgaggtggagtatttgcctatagaaggattgctttctagtggaaaacatttttttgtcgagctgtcaaccgactcttcaggggcagcggcaggcatggcactgaggtacgaagccttccagcagggccactgctacgaaccgttcgtgaaatacggcaactttagttcatcaacgcctacctacccagtgggaactacggttgagtttagttgtgacccgggttacacgttggaacaaggaagtattatcatcgaatgcgtggatccccacgatcctcagtggaacgaaacagaaccagcatgtcgagcagtgtgcagcggagagattacagactccgccggggtcgtgctatctcccaattggcctgagccatacggacggggacaagattgcatatggggagtgcacgttgaggaggacaagcgaatcatgctggacatcagagttctgcgcattgggcctggagacgtcctcaccttttacgacggggatgatctcacggcacgggttcttggccagtattccggaccacgcagccacttcaaacttttcacttccatggcagacgtaactatacaatttcagagcgacccaggcacgtctgtgctgggctaccagcagggcttcgtgatccacttttttgaagtcccccgcaatgacacctgcccagagctgcctgaaattcccaatggttggaagagtccatcacagccagaactcgtgcacggaaccgtcgtgacataccagtgttatcctggctaccaagtcgtgggctcctctgtcctcatgtgtcaatgggacctgacctggagcgaagatctgccctcttgtcaacgggtgacgagctgccatgatcccggagatgtcgagcattcccgtcgcctgattagctctcccaagttcccagttggcgcgacagttcagtacatttgcgaccagggcttcgtgctaatggggagctctatccttacatgtcatgatagacaggctggttcacctaaatggagcgatagagctccaaaatgtctgctggaacagctgaaaccctgccacggtctttccgccccagaaaatggggcaaggagtcccgagaaacagttacatcctgcaggagcaacaattcacttcagttgcgcgccaggatatgtcttgaaggggcaggccagcatcaagtgcgttcccggtcatccatctcactggtcggatcctccccccatctgtcgcgctgccagtctggatggcttctacaactccaggagtctggatgtggccaaggcgcccgcagctagcagcactctggacgcagcgcacatagctgccgcaatttttctgcccctggtggccatggtgctcctggttgggggcgtgtatttttacttctctaggctccaagggaaatcaagtctccagctaccacgccctcggccaagaccttacaataggattacaatagagtccgccttcgacaaccctacttatgaaaccggatccctgtctttcgccggagacgagcggatatag

SEQ ID NO: 29844 - DNA, 1527 bp, Artificial Sequence
  Description of Artificial Sequence: Synthetic coding sequence
atgaggccagtggctctgctgctcctccctagcttgctggcgctgctcgctcacgggctgtccctcgaggccccaaccgtaggtaaaggccaggccccggggatcgaggaaactgacggagagttgacagccgcacctacaccggagcagcctgagcgtggtgtgcacttcgttacgaccgccccaacattaaagctgctgaaccaccatccactgctggaagaatttctccaggagggacttgagaaaggggacgaggaattgcggccagcactgcccttccagcctgacccccccgcgccttttacaccttcgccgcttccgcgtctcgccaaccaggatagtcgacctgtcttcacgtcacccactcctgctatggctgcagtaccgactcaacctcagagtaaagaaggcccttggagtccagaaagcgagtcacctatgcttaggattactgcacctctgcctcctggtcctagtatggccgttcccactttggggcctggcgagattgccagtacaacacccccctctagggcgtggacgccaacccaagagggcccaggcgatatgggacggccttgggtcgccgaggttgtgagccaaggtgcggggattgggatccagggcacaatcaccagctcaactgcgtctggtgatgacgaagaaaccactacgaccacaaccattattaccactaccattaccaccgttcagacaccggggccctgcagttggaacttttccggacctgaggggagcctcgattctccaaccgatctttctagtcccactgacgtgggcctcgactgtttcttctatatttctgtgtatccaggatatggagtggagattaaagtgcagaacatctctctccgggaaggagagacagtcactgtcgaaggtctcggaggtccggacccactgcccctggcgaatcaatcgtttctactgcgcgggcaggttatacggtcccccacccatcaggccgcgcttagattccagtccctgccaccccccgccggacctgggaccttccattttcattatcaagcctatctgctctcttgtcacttcccacggagaccagcctacggggatgtgaccgtgactagtctgcaccctggagggtctgcacgctttcattgtgcgaccgggtatcagctcaaaggcgcccgacatctaacgtgtcttaacgccactcaaccattctgggattccaaggaacctgtttgcatagctgcttgcggaggcgtgataaggaacgccacaacgggtaggatcgtctccccaggcttccccggaaattactctaacaatcttacttgtcactggttgctggaagctcctgaggggcaaaggctgcatctccactttgagaaagtttctctggcagaggatgatgaccggctgattattcgcaatggggataatgtggaggccccacctgtatacgattcctacgaggtgactgctccgccacctccgccgcccctgcagccacattatcaccgggtgagcgtgtag

SEQ ID NO: 29845 - DNA, 2985 bp, Artificial Sequence
  Description of Artificial Sequence: Synthetic coding sequence
atgagaccggtggcactactcctcctgccaagcttgctggccctgctggcacatggcctgtctctagaggctcctactgtgggcaaaggtcaggcccctgggatcgaggagacagatggcgagctgactgctgcacccacaccagaacagccagaacggggggttcactttgtgactacagctccgacattgaagctgctcaatcatcatccactcttggaggagttcctccaggagggactggaaaaaggagacgaagagttacgtcctgctctgccttttcaacctgatcctcccgcaccgtttactcctagtcccctgcccagactggctaaccaggattctaggcccgtattcacctcaccgactcccgctatggccgctgtgcccacccagccacagagcaaggaaggcccatggagtccagaaagcgagtcacccatgctacgtattaccgctcctctacctcctgggccctccatggctgtgccaacactaggtcctggggaaattgcctctaccacacctccaagcagggcttggacacctactcaggagggccccggtgatatgggccgtccatgggttgctgaagttgtgtctcagggagctggcattggtattcagggaacgatcacctcatctacagctagtggggacgatgaggagacaacaaccaccacgaccattattactacaactataacaaccgttcagactcccgggccttgtagctggaacttctccggccctgagggctcccttgatagtcctacggacctctccagtcctactgacgtaggactggattgcttcttttacatctcggtctaccccggttatggcgtggaaattaaggtgcagaacatctccctgcgagagggggagaccgtgacagtcgagggactcggtggccccgaccctctgccactggccaatcagagcttcctcctacgaggacaggtcattcggtcgcctacccaccaagccgcccttcggttccagtctctccctcctccagccggcccagggacatttcattttcactaccaggcatacctcctttcttgccatttcccacggaggcctgcctacggcgacgttacagtcacatctctccatcctggtggctcggctcggtttcactgcgcaacaggctaccagctgaagggcgctcggcatctgacttgtctgaatgcgacccagcctttttgggatagtaaggagcctgtatgcattgctgcctgtggtggcgtaattagaaatgcaaccaccggacggatcgtgtctcctgggttccctggaaactactcaaacaacttaacctgccattggctcctggaggcccccgagggccagcgactgcaccttcactttgagaaggtctccctggccgaagatgacgatcgcctgatcatacgaaatggtgacaatgtcgaggccccgcccgtgtacgattcctatgaggtcgagtatttgccaatcgaagggctgctgtcctccggcaagcacttcttcgttgaactctccacggatagtagcggagccgccgccggaatggccctgcggtatgaggcattccaacaaggtcactgttacgaaccttttgtgaaatacggcaatttcagcagcagcactcctacctaccctgtcggaacaactgtggagttctcttgcgaccccggttacacacttgagcaaggttcaattattatagagtgtgtggatccacacgacccgcagtggaatgaaacagagcccgcgtgtcgggccgtgtgtagtggtgaaatcacggactcagccggcgtggttctaagtcctaattggcccgagccatatggacgcggacaggactgcatttggggagtgcacgtcgaggaggataaacgaataatgctcgacatacgggttctccgtataggccctggagacgtgctgactttctatgacggagatgacttaactgcccgcgtattaggacaatatagtggaccccgctcgcacttcaagctgtttacatcaatggcagacgtgacaatccagttccagagcgatcccggaacatccgtactgggatatcaacaagggttcgtcatacactttttcgaagttccaagaaacgacacatgtccagaacttcccgaaattccaaacggctggaaatccccctcacagccagagttggtgcacggaaccgttgtgacctaccagtgctacccagggtaccaggtcgtgggaagctctgtcctgatgtgccagtgggatctgacctggagcgaggatcttcctagctgccagcgtgtgacttcctgccacgatccaggcgacgtggagcattcaaggagactgatttcatcccctaaattccccgtgggggcgacggtccagtacatctgcgaccagggcttcgtgcttatggggagcagcattctcacatgtcatgaccggcaagcggggagtccaaaatggtctgatcgtgccccaaagtgccttcttgaacagctgaaaccttgccacggactatccgcaccagaaaacggcgctcgcagccccgaaaagcagctgcaccccgcaggggccaccattcacttcagttgtgcacccggttacgttttgaagggccaggcctccatcaaatgcgttccaggccatccaagccactggtctgacccacccccaatctgccgagcagccagtctcgacgggttctacaatagcaggtctttagacgtggccaaggccccggcggccagcagcactttagacgcagcccatatagccgctgcaatcttcttgcctctagtggcaatggttctgctggtagggggggtttatttctattttagtagactccaaggcaagtcttcactgcaactgccccgccctaggcccagaccctataatcgaattacaattgaaagcgccttcgataaccccacctatgaaaccggtagcctgtcgttcgccggcgatgaaaggatttag

SEQ ID NO: 29846 - DNA, 2982 bp, Artificial Sequence
  Description of Artificial Sequence: Synthetic coding sequence
atgcgacctgtggccctgttactgctacctagtctccttgcccttctggcacacggcttaagtctcgaggctccaactgtggggaagggccaagcccctggcatcgaggagaccgatggcgaactgacggctgctccaactcccgagcagccagagcgcggcgtccatttcgtgaccaccgcacctaccctcaagctgctcaatcatcatcccttactcgaggaattcctgcaggagggattggagaaaggtgatgaggaactgagaccggcactgcccttccagccggaccccccagcccctttcactcccagccctctgcctcgtcttgctaatcaggattcgcggcccgttttcacttcccccaccccagctatggctgccgtgcccacccagccacagagcaaagaaggcccatggagccctgagtcagaatcccccatgctgagaataaccgcacctctgccccccggcccgtcaatggccgtgcctactttgggacccggagaaatcgcttcaactaccccgccttccagagcatggacgcctactcaggagggtcccggcgacatgggacggccatgggtggccgaagttgtgtcccaaggcgccgggattgggatccaaggcactattaccagtagtacagctagtggcgatgacgaggaaacaacgaccacaaccaccattattaccactaccataacgaccgttcagaccccaggcccctgttcatggaactttagtgggcccgagggcagcctggacagccctaccgatcttagttcccctactgacgtgggtctggactgcttcttctatattagcgtgtaccccggctacggcgtcgagattaaggtacagaatatctcactccgagagggggaaactgtgacggtggaaggcttaggtggacctgaccctttacctctggctaaccagagcttcctcctgcggggacaggtcattcgtagccctacccatcaggctgcactgaggttccagtccttaccgcccccagcgggaccaggaacgttccacttccactatcaagcctatctgcttagctgccattttccacggcgtccggcatacggggacgtcaccgtgacctctcttcacccgggaggctccgcaaggttccattgcgcgaccggctatcagttgaaaggcgcaaggcaccttacttgcttgaatgcaacccagcctttctgggactctaaggaacctgtatgcattgctgcctgtggaggagtcatccggaatgccaccactggtagaatcgtgtccccgggctttccaggaaactacagtaataatcttacttgtcattggttgttggaggcccccgagggacagcggttgcacctgcatttcgagaaggtgagccttgctgaagatgatgataggttaatcatccggaatggcgataacgtggaggcccccccagtgtatgattcttacgaggttgaatatttgcccatagaaggactactatcatcgggtaagcatttcttcgtggaactttctaccgattcttcaggggccgctgccggtatggctcttcggtatgaggcatttcagcaggggcactgctacgaaccctttgtcaaatacgggaacttctcatcatccacacccacataccccgtgggcaccactgtggagttttcctgcgaccccggctacactctcgaacagggatccatcatcatcgagtgtgtggacccacatgaccctcagtggaacgaaacagagcccgcatgccgtgcggtgtgtagtggggaaatcaccgattcagccggggtcgtgctgtccccaaattggccagaaccatatggacgggggcaggactgcatttggggcgtacacgttgaagaggacaagcggattatgcttgatattcgtgtcctgaggatcggtccaggagacgtattaacattctacgacggcgatgatctcacggcgcgggtcctggggcagtattccgggccaaggtctcacttcaagctgttcactagcatggcagacgtgacgattcaattccagtccgaccccgggacctctgtcttaggataccaacagggttttgttatccatttctttgaagtgcccaggaacgatacttgccccgagctgcctgaaatacccaatggctggaagtcaccctctcaaccggagctggtgcacggaaccgtggttacatatcagtgctaccctgggtaccaggtcgtggggtccagcgtgttaatgtgccagtgggatctcacctggtcagaggatctgccatcctgtcaaagggtgacttcatgccacgacccaggggatgtggagcacagccgtcggttgatctcctcaccaaaattccccgtgggcgcaacggtccaatacatctgtgatcagggattcgtacttatgggcagcagtatcctgacttgccacgacagacaggcagggagcccaaaatggtcagatagggcccctaaatgcctgctcgaacaattaaaaccctgccacgggctgtctgctccagagaatggtgccagatccccggaaaaacagctccatcccgccggcgcgacaatacacttctcctgtgcacctgggtacgttctcaagggacaggctagtatcaagtgcgtgcccggccacccttcacattggagtgatcctccaccgatttgtcgcgcggcgtcactcgacgggttctacaattcccgctctctggacgtcgcaaaggcacctgccgcgagtagcacccttgatgctgcacacattgctgcagcaatctttctgcccctagtggcaatggttctgctagtcggcggtgtgtacttctactttagccgcctccaggggaagagctctctccagctgcctcggccacggccccgcccatacaatagaattactatcgagtctgcatttgacaatcccacatacgagacgggcgagacacgggagtacgaggtgagcatttag

SEQ ID NO: 29847 - DNA, 2733 bp, Artificial Sequence
  Description of Artificial Sequence: Synthetic coding sequence
atgggaactcccagggcccagcatccgccccccccccagctgctctttttgatcctgctctcctgcccgtggattcagggcctcccactgaaggaggaagagatccttccggagcctggctccgaaacacccaccgtcgcctcagaggccctcgctgagctgttacacggtgccctcctgcggcgaggacccgagatggggtaccttcctgggagtgatcgggaccccaccttagccacaccgcctgcggggcagactctggctgtcccgtcattaccacgggctacggagcccggaaccggacctctcactaccgcagtgacccctaacggggtgaggggcgccggcccgaccgcgcccgaacttttaactcccccgcctgggaccactgcaccgcctccacccagcccggccagtcctgggccccctcttgggcctgagggcggagaggaggaaacgacgaccaccatcataactaccacaactgtgactacgactgtgacaagtcctgttctgtgtaacaacaatatatctgagggcgaagggtatgtcgaatcccctgatctcggtagtccagttagcaggactctcggtcttctggactgtacttactctatccatgtgtatcccgggtacggaattgaaatccaagtacagaccctgaacctctcacaagaggaggaacttctagtactcgcaggggggggcagtcctggtctggcaccccggctgctggcaaacagtagtatgctcggagagggccaagttctgaggtctccgactaacagactgctcctgcactttcagagccctcgcgttccccggggcggtggatttaggattcattatcaggcttatctcctttcatgtggatttccccccagacctgcccacggggacgtgagcgtgactgacctgcaccccggcggcaccgcgactttccactgcgacagtggataccagctccaaggtgaggagaccctcatctgtcttaatgggactcggccctcttggaacggcgagacaccttcatgtatggcaagctgtggtggcactatccacaacgccaccctgggaaggatcgtatcaccggagccgggtggcgcagtcggtcccaacctgacctgtagatgggtgatagaggccgcagagggacggcggttacacttgcacttcgaaagggtaagccttgacgaggacaatgatcggcttatggttcggtccggcggctctccactctccccggtgatctacgacagcgacatggatgacgtgcccgaaaggggactcatttccgacgcccagtccctgtatgtggagctgttgtcggaaactcccgccaaccccttgctgctgtccctgcgctttgaggcattcgaggaagatcggtgttttgcaccattcctggcccatggcaatgtaaccaccacagatccagaatatcgaccaggagccctggcaacgttcagttgcctgccgggctacgcgctggagcctcccggtccaccaaatgcaatcgagtgtgtcgatcctacagaaccccactggaacgatacagagcccgcctgcaaagcgatgtgcgggggggagctctctgagcccgcaggtgtcgtgttatctcccgactggccacagagctactcgcctggccaagattgcgtttggggtgtgcatgtgcaagaagagaaacgcatcctcctccaggtggagattctgaatgtacgagaaggtgatatgttaacgcttttcgatggcgatgggccttccgcgcgcgtgttagcgcagcttaggggaccacagcctcggcgtaggctgctgtcctctggccctgatctgacccttcaattccaagctccaccaggaccccctaaccccggactcggacagggctttgttctgcatttcaaagaggtacctcggaacgacacatgtcctgagcttcctccacctgagtggggatggagaaccgcctcacacggtgatcttataaggggcaccgtccttacttatcagtgcgagcccgggtatgagctcctcggtagcgacatcctgacctgtcagtgggatctaagctggagtgccgcgccccctgcatgtcaaaaaatcatgacttgtgctgacccaggcgagatcgctaatggacaccgaacagcatctgacgctggattcccagtaggatcccacgtgcaataccgttgcctgcctggctacagcctggaaggggccgcaatgttgacttgttatagcagggacactggtacgcctaaatggagtgatagagtgccaaaatgcgcgcttaaatatgagccatgtttgaatcctggcgtacctgaaaatggctaccaaactctctacaaacatcattaccaggctggagagagtctacgtttcttttgttacgagggcttcgagttaataggggaagttacaattacttgtgttccaggccatccttctcagtggacgtctcagccacctctctgtaaggtgacccagactacagacccctcccgacagctagaaggaggtaacctggcactggccatcctcttgcccctggggctggtcattgtgctgggatctggggtatatatttattataccaaactgcagggtaaatcgctattcggcttctcaggctcacatagttacagtcccataaccgtcgagagtgacttttccaatcccctgtacgaagcgggagacacccgcgagtacgaggtgagtatctag

SEQ ID NO: 29848 - DNA, 2430 bp, Artificial Sequence
  Description of Artificial Sequence: Synthetic coding sequence
atgggcaccccacgggcacagcatccaccccctccacagctgttattcttgattctgctgagctgtccttggattcagggtctgccgcttaaggaggaagaaatactgcctgagcccggcagtgagacccccacggtggcctccgaggccctggcagagttactccatggagcactgcttaggaggggtcctgagatggggtatctgcccggtagcgaccgcgaccccactcttgcgacgccacctgcgggtcaaacattggccgtgccaagcctgcctagggcaacggaacctgggactggccctttaacaactgctgtaacacccaatggcgtgcggggagcaggccccaccgcccctgagctactgaccccaccacccggcaccaccgcccctcctccaccttcgcctgcctcccccggcccccccttggggccagagggcggcgaggaggagactaccactactatcattactaccacgacagtcacaaccaccgtcacctctccagcttacctcctctcctgtggattccctcctcgccccgcgcatggagacgtgtcggttactgacctacatcccggcggtacagccaccttccattgcgacagtgggtatcagctgcagggggaagaaaccctaatttgccttaacggcacgagaccctcttggaatggagagactccgtcttgcatggccagctgcgggggtacaatccacaatgcaacattgggccggatagtgtctcccgagcctggaggcgctgtcggcccgaacctcacatgcaggtgggtgatagaggccgcagagggtcgaagactgcacttgcactttgagagggtgagcctggacgaagataacgatcgcctgatggtcaggagcggcggctctcctcttagcccagttatatacgattcagacatggatgatgtgccagagcggggcttgatttctgacgcccagtcactgtacgtggaattactgtccgagacaccagcgaatcctttgttgttatcacttaggttcgaggcgtttgaggaggacagatgcttcgctcctttcctggcccacggaaacgtgacgacgaccgatcccgaatatcgaccaggcgccttggcaaccttctcgtgtttgcccggatatgctttagagccacctggtccccccaatgccattgaatgcgtagacccaactgagccccattggaacgataccgagcctgcctgcaaagccatgtgtggcggcgaactgtcagagccggcgggcgttgtattatcacccgattggcctcaatcctatagtcccggccaggattgtgtctggggcgttcacgtacaggaggaaaagcgcatcctccttcaggttgagatactgaacgtgagagagggagatatgctcacactcttcgacggggatgggccatctgctcgcgttctggcccagttacggggtccacagccccgcagacgtcttttgtcctccggtcctgacttgaccttgcagttccaagcgccccctggaccaccgaatccaggtctcggccagggctttgtgctccacttcaaggaggtccccagaaacgacacatgccctgaacttcctccgccagaatggggttggaggacagcatcccacggtgacttaattagaggaaccgtactcacataccagtgcgaaccgggctatgagcttcttggctcagacatcctcacctgtcagtgggacctgagctggagcgctgccccgcccgcctgtcaaaagatcatgacatgcgctgacccgggagaaatagctaacgggcaccggacagcatccgatgccggatttcctgtcggatctcacgtccagtaccggtgcctccccggctatagcctggaaggggcggcaatgcttacatgctactcccgtgacactggaactcctaagtggagcgatcgagtgccgaagtgcgcactcaaatatgagccctgtctgaatccaggtgttccagagaacggctaccagaccctgtacaaacatcattatcaggctggcgagtccctaagatttttttgttacgaaggctttgagttgatcggggaggtgaccataacatgcgtgcctgggcacccttcacagtggacatcccaaccccctctgtgtaaggtagcatatgaggagttgctggataatcgcaagttagaagtgacacaaaccacagatccttcccgacagttggaaggaggcaatctggctttagctatcctgctgccgctgggtcttgtcatagttcttggctctggggtgtacatttattacaccaagcttcaggggaaaagcctgtttggcttttcaggcagccactcatacagcccaataacagtagagtccgacttctccaatccgctctacgaggccggagataccagagaatatgaggttagtatctag

SEQ ID NO: 29849 - DNA, 2562 bp, Artificial Sequence
  Description of Artificial Sequence: Synthetic coding sequence
atgggtactccgagagctcagcatccgccaccacctcagctgctgtttctgatcctgctttcatgtccgtggattcagggcctccccctgaaggaggaagaaatccttccagaacctggctccgaaacccctaccgtggccagcgaggcactcgctgagctactgcatggcgccctgctgcgcaggggacccgagatgggatacctaccaggtcccccgctgggacccgaaggaggcgaggaagagacaacgacaacaataatcaccaccactacagtcactaccaccgttacatcccctgttctatgcaataataacatctcagaaggcgaagggtatgtcgagagccctgatttgggcagccctgtgagtcgcactctgggcctcctcgattgtacttatagcatacatgtctatccaggttacggaatcgaaatccaggttcagaccttaaacttgagtcaagaggaagagctgctggtgctggccgggggcggatccccgggcctcgcaccccgtctcctggccaattcaagcatgttgggggagggacaggtgcttagatcccccacaaatagactgctcctccacttccaaagccctagagttcctcggggaggcgggtttagaatccattatcaggcgtacctcctctcctgcggcttcccccccagaccggcacatggtgatgtgtccgtgactgacctccaccctggcggcactgccacattccattgtgacagcggctaccaactacagggcgaggagactctgatctgcctcaatgggactcggccctcatggaacggggagaccccttcttgtatggcctcttgtggaggcacaatccacaacgctaccctcggtcggatcgtgtcacctgagcccggcggtgcagtaggtcccaatctcacatgtaggtgggtcatcgaggcggccgaaggccgccggctccacctgcactttgaacgggtctctctagatgaagacaatgacagattgatggtgcggtctgggggtagtcctctgtcccctgtcatctacgatagcgacatggacgacgtaccagagaggggcttaatttccgatgcgcagtccctgtatgttgagctgctgagtgagactccagccaatccacttcttctctctcttcggttcgaggcatttgaggaggatcgctgctttgccccgttcttggcgcatgggaatgtcaccacgactgaccctgagtacaggcccggggctctggccaccttttcatgcctcccaggctatgccctggagccccctgggccccctaacgccattgagtgcgtagatcccaccgagccccactggaacgataccgaaccggcctgtaaagctatgtgcggcggcgagttatctgaacccgcaggagtggttttgtcacctgactggccacaaagctacagtcctgggcaagattgcgtatggggggtacacgtgcaggaggagaaacgcatcctgctccaagttgagattctcaacgtgcgggaaggtgacatgttgaccctgtttgatggagacggaccctccgccagagttctggcccagctcagaggcccccagccccggcgacggctcctctcttccggtccggatttgactttacagttccaggcccctcccggtcccccaaatccaggccttggacaaggattcgtactccactttaaggaagttcctagaaacgacacatgtccagagctacctccccccgaatgggggtggcggaccgctagccacggcgacctcattaggggaacagttctaacgtaccagtgcgaacccggatacgagctgcttggcagtgatatccttacctgccaatgggacctgtcttggtccgctgctcctcccgcctgccagaagattatgacatgcgccgatcccggggaaatagctaacggacaccgcaccgctagcgacgcaggatttccagttggttcccacgtacaataccgctgtctccctggctactctctggagggggctgcaatgttgacctgctattctagagataccggcacacctaaatggagtgatagagtgccaaaatgtgcattaaagtatgagccttgtctgaatccaggtgtgccggagaacgggtatcagacattgtataaacaccactatcaggcaggggagagtctccgatttttttgctatgaggggtttgagctgataggtgaggtgaccatcacttgcgtacctgggcatcccagccaatggaccagccagcctccactgtgcaaggtggcttacgaggagcttctggacaacagaaaattggaagttactcagacaactgacccctctagacagttggaggggggcaatcttgctttggccatccttctgcctctaggactggtcatcgtgttgggctctggggtgtacatctattatacaaaactccaaggtaaatccctcttcggcttttctggctcccacagctattcacccataaccgtggaatcggacttttcaaaccctctgtatgaggctggcgacacccgcgagtatgaagtctctatctag

SEQ ID NO: 29850 - DNA, 2640 bp, Artificial Sequence
  Description of Artificial Sequence: Synthetic coding sequence
atggggacaccacgggcccagcacccacctcccccacaattgctgtttttaattctgctgtcttgcccctggatccagggatcagaccgtgacccgacgttggccacgccacctgccgggcagactcttgcagttccttcactcccgagagcgaccgaacctggcacaggacccttgaccacagccgttacccctaacggcgtccgcggtgctgggccgaccgccccagagctcctgacccccccccctggtactacagccccacctccaccgtctcccgctagtccaggtcctccgctggggcctgaaggcggcgaggaggagacaacaacgacaatcatcactacgactaccgtgactaccaccgttacatctccagtcctctgcaacaacaatataagtgagggcgagggatacgtagagtctcctgaccttggcagcccagtgagcaggactttgggccttctcgattgtacctactctatccacgtttatcccgggtacggcattgaaatccaagtgcagacactcaatctcagtcaggaggaggagttgctggtccttgccggcggaggatctcccggcctggcgccgagactgttagctaatagctcaatgctcggagagggccaggtcctgagatcacctactaacaggcttctgttgcacttccagtccccgagggtgccaagaggaggggggtttagaattcactatcaggcttaccttttgagttgcgggttcccaccgcgaccggcccacggcgacgtgagtgttacagatttacatccagggggaaccgccacgtttcattgtgactctggttaccagctgcagggtgaagagactttgatctgcctgaacggcacccggccgtcttggaatggtgaaaccccctcatgcatggccagttgtgggggtacaatacacaatgcaactctggggagaatcgtgagtcctgagccgggcggagccgtcggaccaaacctgacctgtagatgggtgatagaagccgcagaaggtagaagacttcacctccattttgagagagtcagcctggacgaggataacgatagactgatggtaaggtcagggggcagccctctgtcacctgtcatatacgactctgatatggacgatgttcccgagcgtggtcttatatcagatgcccagagtctttatgtcgaactgttgtctgagacccccgcaaaccctctgctactcagcttgcggtttgaggctttcgaggaagaccgctgtttcgctcccttcctggcccatgggaatgtgacaaccaccgatcctgagtacaggcctggagcgctggctacgttcagctgtctacctggttacgcgttggaaccgcctggcccccccaacgctatagagtgcgttgacccaacagagcctcactggaacgatactgagcccgcctgcaaggcgatgtgcggcggggaactatcagagcccgctggtgttgttttaagccctgactggcctcagtcatatagtccgggccaagactgtgtgtggggggtacatgtccaggaggagaagagaatcttgttgcaggtggaaatcttgaatgttagagagggagacatgctgaccctcttcgatggcgacggtccctcagcaagagtgcttgcacaactgagggggcctcaacctcggaggcgcctcttgagctcgggtcctgacttgactctgcaattccaggcacctccagggccgcccaacccgggacttgggcaaggcttcgtcctccacttcaaggaggtcccaaggaacgacacctgccccgagctcccacctccggagtgggggtggcgcaccgctagccatggagaccttatcagaggcacggtgcttacctatcagtgtgaacccggctacgaactcctgggctccgatatactcacgtgtcagtgggacctttcatggtctgcagcacctcctgcgtgtcagaaaatcatgacatgtgctgacccgggcgaaatagccaatggacaccgaaccgctagcgacgccgggttccctgtaggctctcatgtgcagtacaggtgtctgcccgggtacagcttggagggtgctgctatgctgacctgttactctagggacaccgggactccgaagtggagcgatcgcgttcccaaatgtgctctgaaatacgaaccgtgtctaaatccaggagtgccagagaatggctaccaaactctgtacaagcatcattatcaagctggggagtcgcttcgctttttctgctacgaaggctttgaactgatcggcgaagtaaccataacctgcgtccccggccacccaagccagtggactagccagcctcccctatgtaaagtagcatacgaggagctgttggataacaggaagctggaggttacccagactactgatccctcccggcagctggaaggcggaaatttggctcttgcaatactgctgccactgggcctcgttatagtactcgggtctggcgtttacatttactacactaaactccagggaaaaagtctttttggcttttcggggtcccatagttactcccccattactgtggagtctgattttagcaatccattgtacgaggcaggcgatacacgggaatatgaggtttctatctag

SEQ ID NO: 29851 - DNA, 3294 bp, Artificial Sequence
  Description of Artificial Sequence: Synthetic coding sequence
atggccccgcgaccaaagaaacaaccagacaagaatccgctgcatggccgagaactgaacgtcgttcccagcttaggcagacaaacctcacttactactagtgtgatacccaaggctgagcagtcggtcgcctataaggattttatttactttacagtttttgaaggaaatgtgagaaatgttagtgaggtcagtgttgagtacctctgcagccagccttgtgtagtgaacctagaggcggtggtgtcctccgagtttagatcctctatcccggtatataagaaacgatggaaaaatgaaaagcacctacacacatccagaacacagatagtacatgttaagttcccaagcatcatggtgtacagggacgattatttcatccgtcattctatctccgtctccgcagtaattgtccgagcctggataacgcacaagtactccggccgcgattggaacgtcaaatgggaagagaacttgttgcacgcggttgccaagaactacaccctcctgcagaccattccccctttcgagagacccttcaaggaccatcaggtgtgcctggagtggaatatgggatatatctggaacctgcgagccaatagaatccctcagtgccccctggaaaacgatgtcgttgcactcctgggtttcccctatgccagttccggtgaaaacactggaatcgtgaagaagtttcctaggttcagaaaccgagagcttgaagccacccggcgccagcgtatggactatccagtgtttactgtctccctgtggttgtacctgcttcactactgtaaagccaatctctgcggaattctttatttcgtcgactctaacgagatgtatggcacacctagtgttttcctgactgaggagggttatctgcacattcagatgcacttagttaaaggagaagatcttgcagtgaaaactaagttcatcatacctctcaaggaatggtttcggttagatatcagcttcaacgggggacagatcgtggttaccacatccatcgggcaagacctgaaatcgtaccataaccagaccatctcatttagagaggattttcactataatgacaccgccggatacttcatcataggcggatcacgttatgtcgctggaatcgagggtttttttgggcctctgaagtactatagattaagatccctccatccggctcagatctttaatccccttctggaaaagcaacttgctgagcaaattaagctttactatgagcgatgcgccgaggtgcaggaaatcgtgagcgtgtatgcatcggcagctaaacacggcggagagcgacaagaggcatgccatctgcacaattcatacctggacctccagcggcgttacggccggccttcaatgtgccgggcttttccctgggaaaaggagctgaaggataagcatccctcacttttccaggcattgctggaaatggacctgctcacggttcccaggaaccagaatgaaagcgtcagtgagattggaggaaagattttcgagaaggccgttaaaaggttatccagcattgacggccttcaccagatctcctcaatcgtgccctttctcacagatagctcctgttgcgggtaccacaaggccagctactacctggccgtgttctatgagactgggctgaacgtcccacgggaccagctccagggcatgctgtatagtctggtgggagggcagggctccgaaaggctgagttcgatgaatctcgggtataagcactatcagggcatcgataattacccgttggactgggaactatcttatgcttattactcgaacattgcaacaaaaaccccactggaccaacacactctgcaaggagaccaggcttacgttgagaccatccgcttgaaggacgatgaaattctgaaggtgcagaccaaagaagacggagatgtctttatgtggctgaagcacgaagctacgcggggtaatgcagcggctcaacaaaggctggctcagatgctgttttgggggcagcagggtgttgcgaagaacccggaggccgcgatcgagtggtatgccaagggggctctggagaccgaagaccctgccttgatctacgactatgccatagtgctctttaaaggtcagggagttaagaagaacagacgcctggctctggaactgatgaaaaaagccgcttccaagggactgcatcaggcagtaaatggattgggttggtactaccataaatttaagaagaattacgctaaggcggccaagtactggcttaaggcagaggagatgggcaatcctgatgcttcctataatctgggagtcctccacttagatggcatctttcctggagtcccaggacgtaatcaaacattggcgggtgaatatttccacaaagctgcccaaggcggccacatggaaggaacgctgtggtgcagcctgtactatataaccggaaacctcgaaacattcccccgggaccccgaaaaggcggttgtctgggccaagcacgttgctgaaaaaaacgggtacttaggacacgtgattcggaaggggctcaacgcttacctggaaggctcctggcacgaagcattgctgtattatgtcctggcagctgagactggaattgaagtttctcagacaaacttagcacacatctgcgaagaaagacctgatcttgcgaggcgataccttggcgtgaactgtgtctggaggtactacaatttttccgtattccagatcgacgctccatcttttgcttatttgaagatgggagacttatattattatggacatcagaatcagagtcaggatttagaactgtccgtccagatgtacgcccaggctgctctcgatggagattcccagggttttttcaatctggcactgctcatcgaggagggaactattatcccgcaccatatccttgatttcctagagatagatagtactttgcattctaataacatcagcatactgcaggagctgtacgaacgttgctggtcacactccaacgaagagagttttagtccctgctctttagcatggctttacttacacctgcggctcctctggggggccatcctgcacagtgcactcatttattttctgggtacatttcttctctccattctcatagcttggaccgtccagtatttccagagcgtgtctgcgagtgacccccctccgagaccgagccaagctagtcccgatacagcaacatctacagcatccccagccgtcacgcctgcagctgacgcaagtgatcaagatcaacctaccgtgaccaacaaccctgagcctagaggctag

SEQ ID NO: 29852 - DNA, 3399 bp, Artificial Sequence
  Description of Artificial Sequence: Synthetic coding sequence
atgcaaaggcgaggagccgggctcggctggcctagacagcagcagcagcaaccccctccacttgcagtgggtccacgtgcagccgccatggtgccttccggaggagtgccccaaggcctcggaggaaggtcagcatgcgcactcttgctcctgtgttatttaaatgtcgtgccatcccttggtaggcagacctctctcacaaccagcgtgatccccaaggccgagcagagcgtggcatacaaggacttcatttattttactgtgttcgagggcaatgtgagaaatgttagtgaggtgtcagtcgaatatttatgctcccagccctgcgtggtaaacttggaagccgtagttagcagtgaattcagaagctctattccagtgtacaaaaagcgctggaagaatgagaaacatctgcacaccagtagaactcagatcgtgcacgtgaagtttcccagtatcatggtctatcgcgatgactattttattaggcacagtatctcagtgtcagcagtaattgtgcgggcttggataactcacaagtattctggccgtgattggaacgttaagtgggaagagaatctgctgcacgcggtcgcgaagaattatactttactgcaaacgattccgccatttgagagacctttcaaagaccaccaagtgtgtctcgagtggaacatggggtacatttggaacctaagggcaaatcgaatcccacagtgccctctggaaaatgacgtagtcgctttgctggggtttccatatgcgagctcgggtgagaacacgggaattgttaaaaagttcccccgattccgtaaccgggagctggaagccaccagacgacagcggatggattaccccgtatttaccgtgagtctctggctgtacctgttgcattattgcaaggcaaacctttgtggaatcctgtattttgtggactctaacgaaatgtacgggacaccttctgtatttctgaccgaagaaggatatttgcatatccagatgcacctggtcaaaggagaagacctggctgttaaaacaaaatttattataccactgaaggaatggttcaggttggatatctcctttaacggcggccaaattgttgtcacaacgtcaataggtcaggacctaaagtcctaccataatcagactataagcttcagggaagatttccactataacgatacggcggggtactttatcattggggggagcaggtacgtggctggtatcgaaggtttctttggaccactgaaatattacagattgaggagcctgcatccagcacaaatattcaatccgctactcgaaaaacagctcgccgagcagatcaaactgtactatgaaagatgcgctgaggttcaggagatcgtgtctgtgtatgcatcagcagcaaaacacggcggagagcgccaggaagcctgccaccttcacaattcttatctggacctccagcgccgatacggtcgccctagcatgtgtcgggccttcccttgggaaaaggagcttaaggacaaacatcccagtctgtttcaggctctgctcgagatggacctcctgacagtgccacggaaccaaaatgaaagcgtgagcgagattggcggaaagatttttgaaaaggctgtgaaacgattgtcctcaattgatgggctccatcaaattagcagtatcgtgccctttctaacggactcatcctgctgtggctaccataaggcttcatactacctcgctgtgttctacgagaccggtctgaatgtgccaagggatcagctgcaggggatgctgtactccctagttggcggccaaggcagcgaaaggttatcatcaatgaacctcggatacaaacactaccagggaatcgacaactaccctctggactgggagttgtcttacgcttactactccaacatcgccaccaagactcccctcgaccagcataccctgcaaggggaccaagcgtatgtcgagacaattcgccttaaggatgacgagatcctaaaagttcagacgaaggaagacggggatgttttcatgtggcttaaacatgaggctactcgaggtaatgctgctgcccagcagcgccttgcccagatgctgttttggggccagcagggggtggccaaaaaccccgaggccgcaattgagtggtacgcaaaaggagcgcttgagaccgaagaccccgcgctgatttacgattatgcaattgttctgttcaagggtcagggagtgaaaaaaaatcgacggcttgctctggaattgatgaaaaaagccgcgtccaaaggactccaccaggctgtaaacggactgggatggtattaccataagtttaaaaagaattatgctaaggcagctaaatactggttaaaagctgaggagatggggaacccggatgcctcctacaacttgggagttttacacctggatgggatatttcctggagtcccaggtcgaaaccaaaccctggcgggcgaatactttcacaaggctgcgcaggggggccatatggagggcaccctgtggtgtagtctctactacattactggaaacctcgaaacgttcccccgagaccccgagaaagcagtcgtgtgggccaagcacgtcgccgagaaaaatggctatttaggtcacgtgatacggaaaggtctcaatgcctaccttgagggatcttggcatgaggcccttttgtactatgttctggcagctgaaacaggcatcgaggtgagccagactaacttggcccacatctgcgaggaacgcccggacctggcccggaggtacttgggagtcaactgtgtctggcgctattacaactttagtgtctttcagattgacgccccttctttcgcatatttgaagatgggcgatttgtattactacgggcaccaaaatcaatctcaggatctggagctgtctgtgcagatgtacgcccaggccgccctcgacggcgatagccaaggatttttcaatctggccctgttgatcgaagagggtacaataattccccaccacatcctcgactttctggagattgattccacgttgcacagcaacaacatctctatactgcaagagctgtacgagagatgctggtcgcatagcaacgaggaatctttctccccctgcagcctggcctggctctacttacacctacggctgctctggggcgccattctgcattcagctctaatatacttccttggcacttttttgctgagcatcctcatcgcgtggaccgtgcagtactttcagagcgtctctgcctctgatccgcccccccggccttctcaggctagccctgataccgccaccagcacagccagccctgccgtgacgccagcagccgatgcctcagatcaggaccagcctacagtcaccaataatcctgagccgcggggctag

SEQ ID NO: 29853 - DNA, 2940 bp, Artificial Sequence
  Description of Artificial Sequence: Synthetic coding sequence
atggtctatcgcgatgactactttattcgtcacagtatctcagtcagtgctgtgatcgtgcgcgcatggataacacataaatattcaggccgagactggaatgtcaagtgggaggagaacttactgcacgcagtcgccaagaactacacattattgcagaccatccctccgtttgagaggccattcaaggatcatcaagtttgtctggaatggaatatgggatatatatggaacctgcgtgccaaccgcattccacagtgccccctggagaatgatgtggtcgcccttcttggatttccctatgcctcctcaggagaaaatactggaattgtaaagaagttcccccgttttagaaaccgcgaactcgaagcaactcggcgtcagcggatggattatccagtgttcactgtgagcctctggctgtatctgttgcattactgcaaagcgaacctgtgcggcattctgtactttgtcgactctaacgagatgtatgggacgccatcagtgttcctcacagaagagggctacttgcacattcagatgcatctggtcaagggggaggatcttgccgtcaagaccaaatttatcatacctcttaaggaatggttccgactggacatcagcttcaatggaggtcagatcgtggtgaccacaagcatcggacaggatttaaaatcataccataaccagactattagtttcagggaggactttcactataatgacactgccgggtatttcatcataggtgggtcccggtacgtagccggcattgagggcttctttggtccacttaagtactacaggctgagaagtctccatcccgcccagattttcaacccgcttctggagaagcagctggctgagcagatcaagctttactacgaacgctgcgcagaagtgcaggaaatcgtgagtgtatacgccagcgccgcaaaacacggtggggagaggcaggaagcctgccacctccataatagttatctggacctgcagaggaggtacgggagaccctctatgtgtagagctttcccctgggagaaggagctcaaggataaacacccctcgctgtttcaggccttgctggagatggatttgcttacagttccgcggaaccagaatgagtcagtctccgaaattggaggaaaaattttcgaaaaggctgtgaaacgtctcagctccatcgatggcctccaccagatttcaagtatcgtgcccttcctcaccgattcttcatgttgtggctaccacaaagcttcatattacctggccgtgttttatgagaccggtctgaacgtcccccgggaccagctccaggggatgctatactccctggtgggtgggcagggaagtgagcggttaagtagtatgaacctaggctacaagcactaccaaggcatcgacaactacccgctagactgggaacttagctacgcctattactccaacattgccacaaagacaccactcgatcagcataccctgcaaggggatcaggcgtatgtggaaactatcagactcaaggatgacgagattctgaaggtgcagaccaaggaggatggggacgttttcatgtggctgaagcacgaggctactagaggtaatgccgccgcgcagcaaaggctggcccaaatgttattttggggacaacagggagtggcaaaaaacccagaggccgctatcgagtggtatgccaagggcgcactggagacagaagatcccgctctgatttatgactacgcaattgtgctgttcaaggggcaaggagtaaaaaagaaccggagactcgcactcgaattgatgaagaaggctgcaagtaagggattacaccaagcggtgaatggccttggctggtattaccacaagtttaagaaaaactacgctaaggctgctaagtactggcttaaggctgaagagatgggtaaccccgacgcgagttacaacttaggagtcctgcacctcgacgggattttccctggggtccccggacgcaaccagacgctggcaggcgaatatttccataaagccgctcaggggggccacatggaaggaacactgtggtgcagcctttactacattaccgggaatctggagaccttccctcgggatccagaaaaggcggtggtctgggcgaagcacgtggccgagaagaacggctatctaggccatgtcatccgtaaaggactgaatgcctacttggagggcagctggcacgaagccctgctctattatgttctcgcggctgaaaccggcattgaggtgtcgcagaccaacttagcgcacatctgcgaggaacgacccgacttggcgcgccgctatttgggagtgaactgcgtctggagatactacaacttttccgtgtttcaaatagacgctccgtccttcgcgtacctgaaaatgggtgacctgtactactatggccatcaaaatcagagccaggacctggaactgtctgtccaaatgtatgcccaggcagccctcgacggtgattctcaggggttttttaatttggccctcctgatcgaggaggggactatcattccccaccacatcctcgactttttagaaattgacagcactttgcacagtaacaatatttccattcttcaggaactgtatgagaggtgttggagccactcgaacgaggaaagcttcagtccctgcagcctcgcctggttgtacctgcatctaaggttgttatggggagctattctgcatagtgccctaatttactttctgggaacttttttgctgagcattctgattgcctggactgtccagtactttcaatctgtctccgcttccgaccccccccctcggccatcacaagcttcacccgacacagcaacctccaccgcctcccccgctgttacacctgccgcagacgcctcagaccaggaccagccaacggtgacgaataatccagagcctaggggatag

SEQ ID NO: 29854 - DNA, 228 bp, Artificial Sequence
  Description of Artificial Sequence: Synthetic coding sequence
atggtgtatcgggatgactatttcatcaggcactctatcagcgtctccgcggtgatcgtacgcgcttggataactcacaagtactctgggcgggactggaatgtgaagtgggaggagaatctgctgcacgcagtggcaaagaactacactctccttcaaactatcccaccctttgagaggccttttaaggaccaccaggtctgcctagagtggaacatggggtattag

SEQ ID NO: 29855 - DNA, 189 bp, Artificial Sequence
  Description of Artificial Sequence: Synthetic coding sequence
atggtctacagggatgactactttatcagacattctatcagcgttagcgcggtaattgtgcgtgcatggataacccacaagtattcagggcgtgattggaacgtcaagtgggaagaaaatcttcttcatgctgtcgcaaagaattatacattgctgcagaccataccccctttcgaaagacctttttag

SEQ ID NO: 29856 - DNA, 108 bp, Artificial Sequence
  Description of Artificial Sequence: Synthetic coding sequence
atggtatatagggacgactactttatccggcactctatatctgttagcgccgtgattgtgcgcgcctggattacccacaagtatagtggtcgagactggaacgtttag

SEQ ID NO: 29857 - DNA, 570 bp, Artificial Sequence
  Description of Artificial Sequence: Synthetic coding sequence
  Description of Combined DNA/RNA Molecule: Synthetic coding sequence
atggagcgacaggaagagtcactgtccgctcgaccagctctcgagaccgagggtctccgatttttgcatacgactgtgggctcattgttagccacctacggatggtacatcgtgttctcctgtattcttctttacgtcgtatttcagaagctgtctgcacggttgagagcgctgcgccagagacagcttgatcgggctgccgctgctgttgaaccagatgtggtggtaaaacgccaggaagccctggccgccgcccgcctgaagatgcaagaggagcttaatgcgcaagtggaaaaacataaagagaaactgaagcaactggaggaagaaaagagaaggcagaaaatagagatgtgggattccatgcaggaagggaagtcttataaaggcaacgcaaaaaaaccccaggaggaagactcccctgggccttcaacgagttctgtgctcaaacgcaaaagtgatcgaaaaccactacgaggcggcggttataatcctctgagtggtgaaggtgggggggcttgctcttggcggccagggcgcagaggccccagttccgggggcugaggctag

SEQ ID NO: 29858 - DNA, 570 bp, Artificial Sequence
  Description of Artificial Sequence: Synthetic coding sequence
  Description of Combined DNA/RNA Molecule: Synthetic coding sequence
atggagagacaggaagaatccctgtcagcccggcccgccctggagacggaaggcttgcgttttctgcatacaacagtagggtctctgcttgctacttatggatggtatattgtcttttcctgtatcctgctgtacgtcgtctttcagaagctttcagccaggttgagggctctcagacagcgccaactcgatcgggccgcggcagcggtggaaccagacgtggtggttaagaggcaggaagcactggccgcagccaggctcaagatgcaggaggagctgaacgcccaggttgagaaacacaaagagaaactgaaacaactggaagaagagaaaagacgacagaaaatcgagatgtgggactcaatgcaggaaggaaaatcttataaggggaatgcaaaaaagccgcaggaagaggattcccctggcccctctacctcttctgtattgaagaggaaatccgacaggaagccactgcggggcgggggatataaccccctgtctggcgaggggggtggcgcatgtagctggcgccccggtcggcgagggccatcttcgggaggcugaggatag

SEQ ID NO: 29859 - DNA, 564 bp, Artificial Sequence
  Description of Artificial Sequence: Synthetic coding sequence
atggaacggcaggaggaaagtctttccgccagacccgccctcgagaccgagggcctgcgctttctgcacactactgtgggctccctattggccacatatgggtggtacattgtcttctcgtgtatcctgctgtacgttgtgttccagaagctttccgccagattacgtgctctacgtcagcgtcagctggacagggccgctgctgcagttgaacccgatgttgttgtcaaaaggcaggaggcactagccgccgcgaggttaaagatgcaagaagagctgaacgcacaggttgaaaaacacaaggaaaaactcaaacagctggaagaggaaaagaggaggcagaaaattgagatgtgggattctatgcaggagggcaaatcttataagggcaatgcgaagaaaccacaggaggaagacagcccggggcccagcacgagcagtgttctgaagaggaagagcgaccgtaagcctttaaggggcgggggctataaccctctgtccggcgagggcggaggtgcctgttcctggcgccccggccggcgtggccctagcagcggcggctag

SEQ ID NO: 29860 - DNA, 2667 bp, Artificial Sequence
  Description of Artificial Sequence: Synthetic coding sequence
atgcagacgcccagagcgagccctccaaggccggctttgctattacttttgctgctgttgggtggtgcacacggtctgtttccagaggaacctcccccgctgtccgtggctcctcgggactacctgaatcattatccggtgtttgtaggcagcggtccgggtagactcactccagccgaaggagctgacgacctgaatattcagagggtcctccgagtgaacaggacactgtttatcggagatagagataacctgtaccgggttgagctagagccacctacaagcacagaactaagatatcagagaaagctcacttggaggagtaacccctctgatatcaatgtgtgcaggatgaaggggaagcaagaaggtgagtgtagaaatttcgtgaaggtgttacttctgcgagatgaaagcacgctcttcgtctgcgggtcaaatgcctttaaccctgtgtgtgctaactacagcatcgacaccctgcagccagtcggcgataacatcagtggaatggctaggtgtccatacgatcctaagcacgctaacgttgcattgtttagcgatggcatgttattcacggccactgtgactgactttttagccattgacgccgtaatttacagaagtcttggtgaccgccccacactgagaaccgtaaagcacgacagcaagtggttcaaggagccctactttgtgcatgcggtcgagtggggttcccacgtgtatttttttttccgggagattgctatggaatttaattacctagagaaagtggtcgtgtcacgagtggcccgcgtgtgtaaaaacgacgtcggtggtagccctcgagtactggaaaaacagtggacaagctttctcaaagcgcggctgaactgtagcgtgcctggagattctcatttctactttaacgtacttcaagccgtaactggggtcgtgtctcttggtggcagacccgtagttctcgctgtcttcagtacccctagcaactctattccagggtcagccgtgtgcgccttcgatttgacacaggttgctgctgtgttcgaggggcgctttagggaacagaaaagccccgaatcaatatggactccagtccctgaggaccaggtgccccgcccaagacctgggtgttgtgcagcccccggaatgcagtacaatgcctcatctgcattgcccgacgatatccttaacttcgtgaaaactcatcccctaatggatgaagccgtaccaagcctcgggcatgccccgtggatcctaagaacgctcatgcggcaccagctgaccagagtggcagtggacgtcggagccgggccttggggaaaccagactgtggtgttcctcggctccgaggccggaactgtactgaagttcctcgtgcggccgaacgcctctacctccgggacaagtggccttagtgtgttcctcgaagaatttgagacgtatcgcccagaccggtgtggaagacccgggggtggggaaactggccaacggctgctatcactagaacttgacgccgctagcgggggcctgttggccgcctttccccgctgtgtggtgcgcgtgccagtggccaggtgtcaacagtactcaggctgcatgaaaaactgtattgggtctcaggatccctactgcggctgggcccccgatggctcttgcatcttcctttcacccggtacgcgagctgcttttgaacaagatgtgtcgggagctagtacgtccggattaggagattgcaccggattactacgggcgtcacttagcgaagaccgcgcaggattggtgtcggtcaacctccttgtgacgtcatccgttgcagctttcgtggtgggagccgtcgtgtccggtttcagtgtgggctggttcgtcggcctgagagaaagacgggaactggcacggcggaaggacaaagaagccattcttgcccacggggccggcgaagcggtgctcagtgtcagtcgcctgggggagcgaagggcacaggggcccggagggcggggaggaggtggaggtggcggtgcaggcgttccccccgaggccttgctggcccccttaatgcagaacggttgggctaaggctactcttttgcaggggggcccccacgacttggattccgggctgcttcccacccctgaacaaacccctttgccgcagaagcggttacccaccccacatccacatccacacgctcttggtccacgagcttgggaccacggacaccccctgcttccggcgtctgcatcctccagcctcttgctgctggctccagcacgcgcacccgagcaaccacccgcaccgggcgagcccacgcccgatggtcgcctctacgccgctcggcccggacgagctagccacggcgactttcccttgactccccatgcctctcccgataggcgccgggttgtatccgccccaacaggcccccttgatccagcgtccgccgcggatggactccctaggccgtggagtccaccacctaccggctctttacgaaggccgctcggtccccatgccccaccggccgctaccctgcgccgcactcataccttcaacagcggggaggcaagacccggcgatcgacatcgcggatgtcacgctcggccaggtactgacctcgcccacttgctcccatatgggggagccgaccgcactgccccaccagtcccttag

SEQ ID NO: 29861 - DNA, 2358 bp, Artificial Sequence
  Description of Artificial Sequence: Synthetic coding sequence
atgctcgtggccggcttgctgctttgggcctcgctcttgaccggtgcatggccctcattccctacacaagatcaccttcccgcgaccccccgggtacggctctcgttcaaagagcttaaggcaacaggtacagcccattttttcaactttctgctgaataccactgattatcgcatcctgctcaaagacgaagaccacgaccggatgtacgttggatcaaaggattacgtcttgagtctggatttgcatgatattaaccgcgagcctctgattatccactgggctgcctcaccccagaggattgaggagtgcgttctcagtgggaaggatgtaaacggcgagtgcggcaacttcgttcgcttaatccagccatggaatcgcactcacttatatgtgtgcggcaccggcgcctacaacccaatgtgcacgtatgtgaatagaggcaggcgagcccaggccactccctggacccagacacaggccgtgaggggacgaggctctcgtgctaccgatggcgcactccgtcctatgcctaccgccccgaggcaggattacatcttctatttagaacctgaaaggctggagtcaggcaaaggaaagtgtccttacgatcccaagctcgacacagcctccgcacttatcaatgaggagctttatgcaggcgtctacattgattttatggggactgacgctgcaatttttcgtacccttggaaagcagaccgctatgcgcactgaccagtacaattctcgctggctcaatgaccctagctttatacatgcggagctgatccctgatagtgccgaaaggaatgacgataaactctatttcttctttcgcgagaggagcgctgaggccccccagtcacccgctgtgtacgcccgcattggcagaatctgcctgaatgacgatggcgggcactgctgcctggtgaataaatggtccacgttcctcaaagcacggttagtgtgcagcgtgccaggggaagacggaatcgagacgcatttcgacgaactccaagacgtctttgttcagcagactcaggacgtgcggaaccccgtgatctatgctgtcttcaccagcagcggctctgtcttccggggttcagcagtgtgtgtgtacagcatggctgatatacggatggtctttaacggtccattcgcccacaaggaaggtccaaattatcagtggatgcccttcagcggcaagatgccttacccccggcccggtacttgtcctggcgggacctttactccctcgatgaaatctacaaaggactatccagacgaagtgatcaattttatgcgcagccaccctctgatgtatcaggccgtgtatcctcttcagcggcgtcccctcgttgtccgaacgggtgctccctaccggctcacgactattgctgtcgatcaagttgacgcagcggacggcagatacgaagttctattccttggcaccgacagaggaactgtccagaaagtcatcgtgcttcccaaagacgatcaggaacttgaagaacttatgcttgaggaggtggaagtgtttaaagaccctgcccccgtcaagacaatgacgatctcatctaagaggcagcagttgtacgtagcctcagcagtgggggtcacccacctctccctccacagatgccaagcctacggcgccgcctgcgcagactgctgtctggcccgcgacccatactgtgcctgggacgggcaggcttgctctagatataccgctagtagtaagcgccgatcccgccgccaggatgttcggcatggaaaccctataaggcagtgtcgcgggtttaactctaatgcaaataagaacgccgttgagagcgttcagtatggagttgctggttccgcagctttccttgaatgtcagccaaggtcgccccaagccaccgttaaatggctgtttcagcgggaccctggagataggcgccgggaaatccgggcagaggaccgtttccttcgcaccgagcagggactgttgttgcgagcattgcagcttagcgacaggggcttgtactcgtgcaccgcaactgagaataatttcaagcacgtggtgacgagggtacaactgcatgtgctgggtcgcgatgccgttcatgccgctttgttcccccccttatctatgtccgcccctccgccaccgggtgctggacctcctaccccaccgtaccaggaacttgctcaactcctggcacagcccgaggttgggctgatccaccagtactgccagggatactggaggcatgtgccaccctccccgagggaggcacctggcgcccccagatctccggaaccacaggaccagaagaaaccacgcaatcgacgacatcacccaccagatacatag

SEQ ID NO: 29862 - DNA, 795 bp, Artificial Sequence
  Description of Artificial Sequence: Synthetic coding sequence
atgcttgtggccgggctgctgctgtgggcaagcctccttactggcgcctggccttctttccctactcaagatcatctgcctgcaaccccacgagtcagactatctttcaaagagttaaaggctacggggacagctcacttcttcaatttcctgctcaacactaccgactaccgtatcctgctgaaagatgaagaccatgacagaatgtatgtcgggagtaaagattacgtcctgagcttggatctccacgacatcaatcgtgagcctctgataatacattgggcagcctcgccgcaacgtatcgaagaatgcgtcctgagcggtaaggacgtgaatggcgaatgtggaaactttgttcgcctgatccagccctggaatagaactcacctgtatgtttgtggcaccggagcgtacaaccccatgtgtacttacgtgaataggggacgcagagcacaagactatatcttctatctggagccggaaagattggagagcggtaagggcaagtgtccctacgacccgaaactggataccgccagcgcattgatcaatgaagagctctatgcaggcgtctacattgatttcatggggacagatgccgcaatcttcagaactctggggaagcagactgccatgcgtaccgaccagtacaatagtcgatggctgaatgacccatcctttattcacgccgaattgatacctgactccgccgagagaaatgatgacaaactatacttcttcttccgcgagaggagtgccgaagctcctcagtcaccagcagtgtacgcccgctag

SEQ ID NO: 29863 - DNA, 279 bp, Artificial Sequence
  Description of Artificial Sequence: Synthetic coding sequence
atgctagtggccggtctcctgctgtgggcatccctcctgactggggcatggccttcgttccccactcaggatcacctccccgctacacctagggtccgtctctctttcaaggagctcaaggccacggggacagctcacttcttcaactttctcctgaacaccacagactacagaatcttgctcaaagatgaggatcatgaccggatgtacgtgggttccaaggactacgttctatccctggatctgcatgatattaaccgcgagcccctgatcgtttag

SEQ ID NO: 29864 - DNA, 2265 bp, Artificial Sequence
  Description of Artificial Sequence: Synthetic coding sequence
atgctggttgccggtctgctgttgtgggcctctctgctgaccggcgcttggcctagtttccccacacaggaccacctcccagctacacctcgcgttcgcttaagcttcaaagagctgaaagccactggcaccgctcatttttttaatttcctgctcaataccacggactatagaatcttgttaaaggatgaggaccacgaccgtatgtatgtgggttctaaggactacgttctgtccttagacctccatgacatcaatcgagagccactaatcattcactgggccgcaagcccccagaggatcgaagaatgtgtcctgtcagggaaggatgtgaatggagagtgtggaaactttgttcggctgattcagccttggaatcggactcacttgtacgtatgtggaaccggcgcctacaatcctatgtgcacctatgtgaacagaggccggcgtgctcaggattatatcttttacctggagcctgaaagactcgaaagcggcaagggaaaatgcccatacgatccaaagctcgatacggcttccgctttaatcaacgaggaactttacgccggagtttacatcgactttatggggactgacgccgctattttcagaaccctggggaagcagaccgccatgaggaccgatcagtacaatagcaggtggctgaatgacccctcttttatccatgctgaactgattcccgatagcgccgagcgaaatgatgacaagctgtattttttctttagggaacgaagcgcagaggccccacagtcccccgccgtctacgcccgcattggcagaatttgtctcaacgatgatggcggacattgttgcctggtcaacaaatggtctacttttttaaaagcacgattggtttgcagtgtcccaggggaggacggaatagagactcacttcgatgagttgcaggatgtcttcgtgcagcagacacaggacgtaaggaaccctgtgatttatgctgtctttacatcctcaggtagcgtgtttaggggctctgcggtctgcgtatacagcatggccgacattcgcatggtgttcaatggaccatttgcacacaaggagggtcccaattatcagtggatgcccttttccggaaaaatgccttaccccaggcctggcacctgccccggtggtacctttacgccgagtatgaagtctaccaaagattatcctgacgaagttattaacttcatgcggtcccacccactgatgtatcaggcggtgtaccctctgcaaaggaggccactcgtcgtcaggactggggccccttaccgcttgacaacgatcgcagtcgaccaggtagacgcagcggatgggcgatacgaggtgctctttttgggaacagatcgaggcacagtccaaaaggtgattgtcctgcctaaggatgaccaagaactcgaggagctcatgctagaggaggtggaggtatttaaggatcccgccccggtgaaaaccatgacgatttcctcgaaaaggcagcagctttacgtggcctccgctgttggtgtgacccatcttagtctgcaccggtgccaagcctacggagctgcatgtgcggactgctgcctggctcgggacccatactgcgcctgggatgggcaggcatgtagtcggtacacagcttcttccaaaaggcgtagtagacggcaggatgtcagacatgggaatcctattcggcagtgcaggggctttaattctaatgcgaataagaacgccgttgaatctgtgcaatacggtgtggcgggctcagcagcattcctggaatgccagccccgctctcctcaagccacggtgaaatggctattccagcgcgatccaggggaccgcaggcgggaaataagagcagaggatcgctttttgaggacggagcaagggctcctcttgcgggcgctgcagctgagcgaccgcggcctctattcgtgtactgctacagaaaataacttcaagcacgtggtgacacgagtgcagctgcacgtgcttgggagagatgccgtgcacgccgctctcttcccaccactgtcgatgtcagctcctcctccacctggcgccgggcctcccaccccaccttaccaggagctggctcagctgctcgcccagcctgaggtcgggctgatacaccaatactgtcagggttactggcggcatgtaccgccttcccctcgagaggctcccggtgctcccagatccccggagccgcaagaccaaaagaagccgaggaaccgaagacatcacccgccagatacctag

SEQ ID NO: 29865 - DNA, 1143 bp, Artificial Sequence
  Description of Artificial Sequence: Synthetic coding sequence
atgctggtcgctggcctcctcctgtgggcatctctgctgacaggcgcatggccaagcttccctacacaggaccacctcccagctaccccccgggtgcgtctgagtttcaaagagctcaaagccaccgggacggctcacttctttaattttctcctcaacacaacagactacaggatcctgttgaaggatgaggaccatgacagaatgtacgttggctccaaagactacgtcctttccctggacctgcacgacattaacagggagcccctcattattcactgggcagcgtcgcctcagcgcatcgaagaatgcgtgctaagcgggaaagatgtcaacggagaatgcggtaacttcgttcggctaatccagccgtggaacagaacccatctgtacgtgtgtgggactggagcgtataaccctatgtgcacttacgtcaatagggggcggcgggcgcaggactatatcttctatctggaaccagaaagattagagtctggcaaaggcaagtgtccttatgaccctaagctcgacactgcgtccgctttgatcaatgaggagctgtatgctggcgtgtatatagattttatggggacagacgcggcgatttttaggacgctgggcaagcagaccgcaatgcggacagaccagtacaatagccggtggctaaacgatccaagtttcatccacgccgaactgattccagactcagccgagagaaacgatgacaagctttatttcttcttcagggagagaagcgccgaggctccacagtctcctgctgtctatgccagaatcggcaggatctgcctgaacgacgacggaggacactgctgtttagtcaacaagtggtctacattcttaaaggcaagactcgtttgctcagtgccaggcgaagatggtattgagacccacttcgacgaattgcaggatgtctttgtacaacagacccaggacgtgcgcaatcctgtgatttacgccgtattcacctcttcgggcagtgtgttccggggttctgccgtgtgtgtgtactctatggccgacatccgtatggtgttcaacgggcccttcgcacacaaagaaggcccaaactatcagtggatgccattctccgggaagatgccataccccagacctgggacctag

SEQ ID NO: 29866 - DNA, 2514 bp, Artificial Sequence
  Description of Artificial Sequence: Synthetic coding sequence
atgctgcgaactgctatgggcttgagatcttggctcgccgccccttggggtgctctaccaccgcggccacctctgctactgttgctgctgttattactgttactccagccccctcctcctacatgggcgctctctcctcggattagtctccctctaggatccgaagagcggccgttcctccgctttgaagcagaacatataagtaattacacggctctgctgctgagccgcgacggacgaacgctgtatgtgggagctagagaggcccttttcgcactgagctctaacctctcattccttccgggcggggaataccaggagctgctttggggcgcagacgccgaaaaaaaacaacagtgttctttcaaaggtaaggacccacagagggactgtcagaactacatcaagattctcttacccctgtctggcagtcatctttttacctgtgggacagctgctttctcccctatgtgtacctacattaacatggaaaacttcacccttgcccgcgatgaaaagggcaatgtgttgttagaagacggcaagggtagatgtcccttcgacccaaatttcaaatcgactgcgttggttgtagatggggagctgtacacgggcacggtgtctagttttcaaggcaatgaccctgcgatcagcaggtcacagtccctccggcccaccaaaaccgagagttccctgaactggctacaagaccctgcttttgttgctagcgcctacattcccgagagtctcggctctctgcagggggacgatgacaaaatctacttttttttctcggagacaggccaggagtttgagttttttgaaaacaccatcgtgtctcgcattgctagaatctgtaagggggacgaaggcggcgaaagggtgctccagcagcggtggacatcctttttgaaggcccaacttttgtgttcaaggccagatgatggtttcccgttcaacgtgctgcaggatgtgttcacactgtccccgtctcctcaggattggcgggacactctcttctacggggtgtttacctcacagtggcaccgtggcaccactgagggcagcgccgtctgtgtattcacaatgaaagacgtacagagggtattctctggcctttacaaggaagtaaaccgagagacgcaacagtggtacaccgtgacccatccagttcctactccccgacctggcgcatgtatcactaatagcgcaagagagaggaaaatcaatagctcccttcagcttccggaccgcgtgctgaatttcctgaaagaccatttcctgatggacggccaggtgagaagccggatgctgctcctccagcctcaggctaggtaccagcgggtggctgttcacagggtccctggattgcaccatacctatgacgtcctgttcttagggactggcgacggccggctgcacaaggcagtatcagtgggtccccgggtacatattattgaggaactgcagatcttcagctcagggcagcctgtgcaaaatttgctgttagacacccatagaggcttgctgtatgccgcgagtcattctggcgtcgttcaggtgcctatggccaactgcagcctttataggagctgcggagattgtctcctggcccgtgacccctattgcgcctggagcggctcatcctgtaagcacgtctcgctatatcaaccacaactcgccacccgcccatggatccaggacatagagggagcatcagccaaagacctatgtagcgcatcgagtgtcgtgtcaccgtctttcgtaccgaccggggagaagccttgtgagcaggtccaattccaacctaacaccgttaacaccctcgcatgcccgttgttgtcaaacctggctaccaggttgtggttacgcaatggcgctcccgttaacgcatctgccagttgtcatgttttaccaaccggggacctgctgcttgtggggacacagcaactgggcgagtttcaatgttggtctctcgaggagggctttcagcagctggtagcttcctattgccccgaagttgtcgaagatggcgttgcagatcagaccgatgaaggcggcagtgtgcccgtgatcatttcgacatcccgcgtgagcgcacccgcaggcggcaaggctagctggggggctgaccggtcttattggaaagaatttctggtcatgtgtacccttttcgtcctggccgtgctccttcctgtgctgtttttactttatagacacaggaattccatgaaagttttcttaaaacagggcgaatgcgcatcagtccatccaaagacctgccctgtcgtgttgccgccggaaacacgcccactgaatggcctcggcccgccatcaacgccactggaccacagaggatatcagagcctatcagacagcccacccggtagtagggtgttcactgaatcagaaaagcggccactttcaattcaggactcattcgtcgaggtgtcccctgtgtgtcctcgtccgagagtacgactcggttcagaaatccgcgactcagtagtctag

SEQ ID NO: 29867 - DNA, 2214 bp, Artificial Sequence
  Description of Artificial Sequence: Synthetic coding sequence
atgggcctgaggtcttggctggctgcaccatggggcgcgctgccacctcgtcccccattgcttctcctgctgctattgcttcttctcctccagcctcctccacctacatgggctttgtccccacgtatttcattgcctcttgggtcagaagagcgtccattcctcagatttgaagctgagcacatatcgaactacacagcacttttactctccagggatggacgaaccctttatgtcggggcccgagaagccctttttgctcttagttcgaacttatcgtttctgccggggggcgagtatcaagagctattgtggggtgccgacgccgaaaagaaacagcagtgttctttcaaggggaaagaccctcagcgagattgtcagaattatataaaaattttacttcccctgtccggtagtcaccttttcacttgtggcacagcggccttctctccaatgtgcacctacattaatatggagaactttacattagcgcgcgatgagaagggtaatgtactccttgaggatgggaagggccgctgccccttcgaccccaactttaaatctactgcacttgttgtcgacggtgaactttacaccgggacagtctcatcatttcaggggaacgacccggctataagtaggtctcaatctctgcggcccactaagacagagtcttccctaaactggcttcaggatcctgcttttgtggcatcagcttacattccagagtctctcgggtccctgcagggcgatgacgacaagatctacttcttcttttccgagactgggcaggagtttgaattctttgagaacaccatcgtatctagaatagcacgcatttgcaaaggcgacgaaggaggcgaacgagtgctgcagcagcggtggacatcgttcctcaaagcccaattgctgtgtagcagacctgatgacggttttccttttaatgttctccaggatgtgtttaccctgagcccgagcccccaggattggcgtgatacccttttttatggggtgtttacctctcagtggcatagggggactaccgaaggctccgcagtgtgcgtttttaccatgaaagatgtgcaaagggtgttttcaggcctctacaaagaggtgaatcgagaaacacagcagtggtataccgtgactcatcctgttcctacgccccggcctggagcttgcattacgaacagcgcacgcgaaaggaaaattaatagctctctgcaactgccagatcgtgtgctcaactttctgaaagaccatttcttgatggacggccaggtgcggtctaggatgctgttgctgcagccacaggcccggtaccagcgtgtagctgtccaccgggtgcctggtctgcatcacacctacgatgttctcttcctgggtactggggatggccggctgcataaagcagtcagcgtgggcccgcgagtgcacattatagaagagctgcagatcttcagctcaggtcaaccagtacagaatcttctactggatacgcaccggggattgctgtacgccgctagccacagtggcgtagtgcaggttccaatggccaattgctctctctacaggagttgcggggactgcctgcttgctagggacccgtactgcgcctggtcaggaagcagctgcaagcacgtatcactctatcagccccagctcgccactcgcccttggatccaggacatagagggagcttcagccaaggacttgtgtagtgcctcctctgtggtaagcccaagctttgtgccaactggggaaaagccctgtgaacaagtgcaattccaacctaacaccgtcaacactctggcctgccccctgctaagcaacctggccactcggctctggttacgcaacggtgctcccgttaatgctagtgccagctgtcacgtgctgcctaccggggacctcctcctggtgggcacacagcaactgggtgaattccaatgttggtcgcttgaggaaggattccagcagcttgtagcctcttattgccccgaggtggtggaagacggagtcgcagaccagaccgatgagggcggctctgtgccggtgatcatttcaacatcaagagtgagcgcacccgctggggggaaggcatcatggggagccgacaggagttgggcccgcactcagctgctggatcttagcagcctctaccaagctgtggctacaagggaggactctgccagcagcggcgagatctcctag

SEQ ID NO: 29868 - DNA, 2514 bp, Artificial Sequence
  Description of Artificial Sequence: Synthetic coding sequence
atgctgcggactgctatgggtctgcgttcatggctggccgccccttggggcgcacttccacccaggccaccgcttctgctgcttcttctcttactactgcttctacaaccccctccgccgacatgggccctgtctccgcggatcagcctgccgctggggagcgaggaacgaccttttttgagatttgaggcagaacacatttctaactacacagccttgttgctgtcccgagatggtcgcaccctgtatgttggcgcccgagaggccctcttcgcactatccagtaatttatcctttcttcctggtggcgaatatcaggagctgctatggggtgcagacgccgaaaagaaacagcagtgcagctttaaaggaaaggatccgcagagggattgtcaaaattatatcaagatccttctccccctttcgggatctcatcttttcacctgcggcaccgctgctttttctcccatgtgcacttacatcaatatggaaaactttacactggctagggatgaaaagggcaatgttctcctggaggatggcaaagggcggtgtccttttgatcccaattttaagtcaactgcgctggttgtggatggtgaactgtacactggcaccgtctcttctttccaaggaaatgatcccgccatctcccggtcacagtctttgcggcccactaagaccgagtcatccctgaattggctacaagaccctgcttttgtcgcctccgcttatattccggaaagcctcgggagtctacagggggacgacgacaagatttacttttttttctccgaaacaggacaggagttcgaattttttgaaaatactatcgtcagtagaattgctcgtatctgtaaaggcgacgaggggggcgagagagttctgcagcagagatggacttcttttctgaaggcgcaactcttgtgttctcgaccagatgatgggttcccatttaacgtgctccaggatgtgtttactctgagcccttctccgcaagactggcgagatactttgttctacggagtctttacttcccagtggcatcgaggcaccactgaggggtccgccgtgtgcgtttttactatgaaagatgttcagcgggtgtttagtggactgtacaaggaggtaaaccgagagacccagcaatggtacaccgtaactcatccagtacccacccctcgcccaggcgcttgtattacaaactcagcccgtgaacgcaaaatcaactcgtctctgcagctacccgaccgggttctgaacttcctcaaagaccacttcctcatggatggacaggtcagaagccggatgctccttctgcagcctcaggcccgttaccaaagagtcgcagttcaccgcgtgccggggttacaccacacgtacgacgtgctgtttctcggaactggtgacgggcgactacataaagccgtctctgttggaccgcgtgtgcatattatagaagaattgcaaatcttctcatcaggccagcccgtgcagaatctgctgctcgacactcatcggggtctgctgtacgcagcgagccattcaggcgtggtgcaggtgcccatggccaactgttccctctacagatcttgtggtgactgtctgctcgcgcgggacccttactgcgcctggtcaggcagtagctgtaagcacgtgagcctgtaccagcctcagctcgccacacggccctggatccaagacatcgaaggagcatccgccaaggacctgtgttccgcaagcagtgttgtttcaccaagctttgtgcccacgggtgagaagccgtgtgaacaggtgcaattccaacctaatactgtgaacacgctggcctgtcccttgctgtccaacctggcaactcggctgtggctacggaacggggcccccgtgaacgcaagcgcctcttgtcacgttctccctacaggcgatctcctgctagtcggtactcagcagctgggagaattccagtgttggtcactggaggaaggatttcagcagctggtagcctcttactgccccgaggtcgtcgaagacggcgtggctgatcagacagacgagggaggatccgtgcctgtgatcatttccacaagcagggtgtccgcccccgctgggggcaaggcctcatggggcgccgataggtcatactggaaggaattcctcgtcatgtgtacactcttcgttctggccgtgctgctgcccgttctttttttgctctatagacatcgtaattcaatgaaagtgttcctgaagcagggcgagtgcgcatctgttcatcccaagacgtgtccagtagtccttccccccgaaacaaggcctctaaatggacttgggccgcccagtacaccactggatcatagggggtatcaatcattgagcgactcacctcccgggtcccgggtgttcaccgaaagtgagaagcgacctctctccatccaagatagttttgttgaagtgagccctgtgtgcccacgcccaagggtacgactgggctcggagattcgagacagcgtcgtttag

SEQ ID NO: 29869 - DNA, 276 bp, Artificial Sequence
  Description of Artificial Sequence: Synthetic coding sequence
atgctacgcaccgcaatggggcttcgttcctggctggctgccccctggggcgcgctgccacccagaccacccttgctgcttctcttactgcttctcctgctattacagccccctccccctacttgggcactgagccccagaatctcgcttccattaggtagcgaagagcggcccttcctgcggtttgaggcagaacatatttctaattacaccgccttgcttcttagcagggatggccggactctgtacgtcggggctcgggaagcattgttctag

SEQ ID NO: 29870 - DNA, 345 bp, Artificial Sequence
  Description of Artificial Sequence: Synthetic coding sequence
atgctgcgaaccgccatgggcctgaggagctggctggcagccccttggggagccctgccaccgagaccccccctcctgctcctgctccttttacttcttctgctgcagccccctccccccacctgggcactttctccccgaatctctttgccactggggtcagaagaaaggccttttctgcgttttgaggccgaacacatttcgaattacaccgccctgctcttgtcccgcgacggcagaaccctgtacgtgggagcaagggaggctctgttcgctttgagctctaacttgtcttttcttccagggggtgagtatcaggaactcctctggggcgctgacgcgtag

SEQ ID NO: 29871 - DNA, 366 bp, Artificial Sequence
  Description of Artificial Sequence: Synthetic coding sequence
atgctgaggaccgcaatgggtctgcggtcctggctggcggccccatggggagcgctacccccaagaccacccctgctccttctactcttgctgcttctactgctgcagcccccaccaccaacatgggccctgagcccacggatttctcttcctctcggatctgaggagcgtcccttcctgcgattcgaggccgaacacatttcgaactacaccgctctgttgctcagcagggatggtcgaaccctgtacgttggagctcgagaggcactgttcgctcttagctccaatttaagcttcctgccagggggagaatatcaggaactcctgtggggcgccgatgctgaaaaaaaacaacagtgctcgtag

SEQ ID NO: 29872 - DNA, 2502 bp, Artificial Sequence
  Description of Artificial Sequence: Synthetic coding sequence
atggccccacactgggcagtctggctgctcgccgctaggctctggggtctgggcattggagctgaggtgtggtggaacctggtaccacgcaagacggtgtccagcggagagctggctaccgtggtcagacgcttttcccagaccggcatacaggattttcttactctaacccttaccgaacctacaggcctgctctatgtgggagcccgcgaggcactgttcgcgttctcaatggaggctctcgagctgcagggcgctatcagctgggaagcccccgttgagaaaaaaacggagtgtatacaaaaaggaaaaaacaaccagacagagtgtttcaacttcatccgctttcttcagccatacaacgctagccatctctacgtgtgcggcacgtacgccttccagccaaagtgtacctacgtcaacatgttaaccttcactctcgagcacggagaattcgaggacggtaaggggaagtgcccatacgatcccgctaaaggccacgctgggctgcttgtggatggcgagctgtattccgctacactcaacaactttctaggtacagagcccatcatactgaggaacatgggtccccaccattctatgaagactgagtacctggcattctggttgaacgaacctcatttcgttggcagcgcgtacgtgcctgaatcagtgggcagcttcaccggggatgatgataaggtctatttctttttccgagaacgagccgttgagtccgattgctacgctgaacaggtagtggctcgcgtagcccgtgtatgcaaaggcgatatgggcggcgctcgcacattgcagcggaagtggactacatttctgaaagcgagactggcctgcagtgctccaaactggcagctgtacttcaaccagctccaggctatgcacactctccaggatacttcctggcacaacacaactttcttcggcgtgttccaggctcagtggggcgacatgtatctctctgccatttgcgagtatcagctcgaggaaatccaacgcgtgtttgagggtccatataaagaataccatgaagaggcgcaaaagtgggatcggtacacagacccagttccttcacctagacctggctcctgtattaacaactggcacagacgtcacggctacacctcatcgctcgaactgcctgacaatatcctgaactttgttaaaaaacatccactgatggaagaacaagttgggcctaggtggagtaggcccttgctggtcaagaaaggtacgaattttacccacctggttgccgacagagtcacggggttggatggagccacatataccgttttgttcattggcaccggagatggctggctccttaaagcagtgtctctgggaccctgggtgcacctcattgaggagttgcagctgtttgatcaggagccaatgaggtcgttggtcctatcccaaagcaaaaagctcttattcgccggaagccggtcacagctcgtccagctgcctgtagctgattgcatgaaatatcggtcttgcgcggactgtgtgctggcgagggacccatattgcgcatggagtgtgaatacatcaaggtgtgtcgctgtgggcgggcactcagggagcctcctcatccagcatgtgatgacctctgatacaagcggaatttgtaacctacgcggaagtaagaaagtgcgccccacccccaaaaacataacggtcgtcgccggcactgacctggtgctcccatgtcacctgtcttctaatctggctcacgctcggtggactttcggcggtagagacctccccgcagaacaacccgggtcgttcctttacgatgccagactgcaggcccttgttgtcatggcagcccaacctaggcacgccggagcctaccattgcttctcagaagaacaaggggcaaggcttgccgccgaaggttacctcgtggcagtggtggctggtccctcagtgactctggaggcacgggctcccctcgaaaatttgggcctggtttggcttgcagtagtggccctaggcgctgtctgtctagtgctgctgctcctggtgctatccctcagaagacggctgagagaggagctggagaaaggagcaaaagctacggagaggactctcgtgtatccacttgaactgcctaaggagccgacttcccctcccttccggccatgtcctgaaccagacgagaagctgtgggaccctgtcggctattattacagcgatggaagcctgaagattgtgcccggccacgcccgatgtcagcccgggggcggacctccatcacctccacccggtatcccggggcagccgctgccctcacctactagattgcaccttggcggggggagaaattcaaacgctaatggttacgttcggctgcaattgggcggggaagatcggggaggactgggtcaccctttaccagaactggctgatgaacttcggcgcaagctacagcaacggcagcctctccctgatagcaaccctgaggaatcctccgtttag

SEQ ID NO: 29873 - DNA, 606 bp, Artificial Sequence
  Description of Artificial Sequence: Synthetic coding sequence
atggccccccactgggccgtttggcttctcgcggcacgactctgggggctcgggatcggtgcagaagtgtggtggaacctggtcccccgtaaaacagtctcctctggggagctggcgaccgtggtgcggagattctctcagaccggaatccaggactttctgacactgactctcaccgaaccaacgggattattgtacgtgggcgccagagaggcactgttcgccttcagcatggaggccctggaactgcagggtgctatttcctgggaagcccccgtcgaaaagaaaacagagtgtatacagaaagggaaaaacaatcagactgaatgcttcaatttcataaggttcctgcagccatataacgcctcgcatttgtacgtgtgcgggacatacgcattccagccaaagtgtacctatgttaacatgctgacctttactttggaacacggcgaatttgaggatggtaaggggaaatgcccatacgatcctgcaaaggggcacgccggcctcttagttgacggggaactctatagtgccacactgaataactttctgggtactgaacccattatcctacggaatatgggccctcaccattcgatgtag

SEQ ID NO: 29874 - DNA, 423 bp, Artificial Sequence
  Description of Artificial Sequence: Synthetic coding sequence
atggcaccccactgggcagtatggttattggcggcccggctctggggacttgggatcggggccgaagtatggtggaaccttgttccaagaaaaacagtttcgagcggtgagctcgctacggtagttaggcgtttctctcagaccggcatccaggactttctcacacttacactgacagagcccactggcctgttgtatgtgggtgccagagaagcgctgttcgctttctcaatggaagcgctggagttgcagggcgcgatttcctgggaggctccggtggagaagaaaaccgaatgtattcagaaaggcaaaaataatcagacagaatgttttaatttcatcaggttcttgcagccatacaacgccagccacctttacgtgtgtggcacttacgcctttcaacccaaatgcacttacgtctag

SEQ ID NO: 29875 - DNA, 2217 bp, Artificial Sequence
  Description of Artificial Sequence: Synthetic coding sequence
atgagaatgtgtacccccatccggggattgctgatggcgcttgccgtgatgttcggaaccgctatggcctttgcccctattccccggatcacatgggaacaccgagaggtccatctggtccagttccatgagccggatatttataattattctgcacttttgctgtctgaagacaaggatacactctacataggggctagggaggctgtctttgccgtgaacgccctgaatataagcgaaaagcagcatgaggtgtattggaaggtgagcgaggataaaaaagcaaaatgcgctgaaaaaggaaaaagcaagcagactgagtgcctgaactacatcagagtcttgcagccacttagtgcaacctctctttatgtgtgtgggaccaacgcatttcagccagcgtgtgaccatcttaaccttacatcattcaaattccttggaaaaaatgaagacggaaaagggagatgtcccttcgatccggcccattcatacaccagtgtcatggttgatggtgagctgtactcaggaacatcatacaacttcctggggagcgaaccaatcatctcccggaactcttcccattcccctttgaggaccgagtacgctatcccttggctcaacgagccctcctttgtttttgccgacgttatcagaaagagtcctgattcgcctgacggcgaagatgacagagtgtatttcttctttactgaggtgtccgtcgagtacgagttcgtcttcagagtgctgatccccagaatcgcaagagtgtgcaagggcgatcagggcggactaagaaccctgcagaagaagtggaccagtttcctcaaagccagactcatatgttctcggcctgatagcgggctggtttttaatgtcctcagggacgtgtttgtgctgagatctccgggcctgaaggtgcccgttttttacgccctgttcacacctcaactcaacaacgttggcctgagcgcggtctgcgcctacaatttgagcacagcagaagaagtgttttcccacggtaagtacatgcagtctaccacagtggagcagtcccacacaaagtgggtccgctataatgggcccgtccctaaacctcggcccggagcttgcatcgacagtgaggctagggcggccaattacaccagttcattaaacctcccagacaaaacacttcagttcgtcaaggaccatccattgatggacgattcagtcactcccatcgataataggccaaggctcatcaagaaggatgttaactatacccagatcgttgttgatcgaacacaggccctggacgggactgtctatgacgtcatgtttgttagcactgatagaggggccctccacaaagccatttcgctcgagcacgccgtgcacattatcgaggagacccaactctttcaggactttgagccggttcaaactctcctcttaagcagcaagaagggtaatcgtttcgtgtacgcagggtcaaatagcggggttgtgcaagcccctctggccttttgtgggaagcacggaacctgtgaggattgtgtgttggccagagacccctactgtgcttggtcgcccccaactgccacttgtgtggccttgcatcagaccgagtcacctagccgagggttgattcaggaaatgagtggagatgcatcagtatgcccagcatccagtcctaaacctctgcctccccccggatccagttctctcagctgtctaggacacgttggagatcgcagactcagcagcccttggactccttggcccgcctctggcgccggtcctgactcgtcctcaagagtgtcactcttaccccccttcttgtccgaccaggctcagcatgttcatgcattaggcaacttttaccttttctgccaggctacaggtccagctgatatcagatttgtgtgggaaaaaaacggccgcgccttagagacatgtgtacccgtccaaacccacgcactgcccgatggacgtgcacacgcgctctcctggctccaggacgcaattagggagagtgcagagtacagatgtagtgtgttatcctccgctggcaataagacctctaaagtgcaagtggcagtcatgcggccagaggtcacccatcaagaaagatggacacgggaattatcagcttggagagccgtggccggcgaacacgataggatgatgcagagctggcggaaagcctgggaatcctgctctaaagacacactttag

SEQ ID NO: 29876 - DNA, 2589 bp, Artificial Sequence
  Description of Artificial Sequence: Synthetic coding sequence
atgcggatgtgcacgccaatccgcggactcctcatggcactcgctgtgatgttcggcaccgccatggcctttgccccgatcccgcggatcacctgggagcaccgtgaagtgcacctggttcagttccatgaacctgatatttataattatagcgcgctactgctaagcgaggacaaggacaccctgtacatcggcgcacgggaagccgtctttgccgtgaacgctctgaacatcagtgagaaacagcatgaggtgtattggaaagttagtgaggataagaaggctaagtgtgctgaaaaggggaagagcaagcaaaccgagtgccttaattatatccgcgtcctgcagcctttaagcgctacctctctgtacgtgtgcgggacaaacgctttccaacctgcctgcgaccatcttaaccttacctcctttaagtttctgggtaagaatgaagatggtaagggacgatgcccatttgaccccgcccactcttacactagtgttatggtggacggcgagctgtactctggcacgagttataattttcttggtagtgaacccatcatttccaggaactcaagtcactcccctcttcgaactgaatacgcaataccttggctcaacgaaccaagcttcgttttcgccgacgtaatcaggaagtcccccgactcgcctgacggcgaagatgaccgcgtatactttttcttcacagaggttagtgtcgaatatgagttcgtgtttcgcgtgctgatcccaaggatcgcacgggtttgtaaaggggaccagggcgggttgagaaccttgcagaagaaatggacatcattcctaaaggccagactcatttgtagtcggccggattctgggttagtgttcaatgttttaagagacgtgttcgttttgaggtcccccggtttgaaggtgccagtcttttacgccctatttacaccccagctgaataatgtaggattgtctgccgtgtgtgcatacaacttgtctaccgcggaggaagtcttctcccatgggaagtatatgcaaagcactactgttgagcagtcgcacaccaaatgggtccggtataatggacctgtgccaaagcctcggcccggcgcatgtatagacagtgaagctagggctgctaattacacgagctctttgaacctaccagataagactttacagttcgtcaaggatcaccccttaatggatgacagcgtaacgcccatcgataaccgtccccggctgatcaagaaggatgtgaactatactcaaatagtggtcgaccgcacccaagccttggatgggaccgtatatgatgtaatgtttgtaagcaccgacagaggagctctgcacaaggccatctcactggaacacgctgtgcatatcattgaagaaacgcagttatttcaggattttgaacccgtccagacactactccttagcagtaagaagggtaaccgattcgtttacgctggctcgaactctggcgtggtccaggctcctctcgctttctgcggaaagcacggaacttgtgaggattgtgtcttagcacgggacccttactgcgcttggtctccaccaactgctacgtgcgtggccctccatcagactgaatcaccgtcacgcggcctgattcaggagatgtcaggcgacgcgtcggtatgccccgacaagtctaagggctcctataggcagcactttttcaaacatggcggaaccgcagagctcaaatgcagccagaaatcaaatctcgccagggtgttctggaagttccagaacggagtgctcaaagcagagtcaccaaagtacggcctcatgggccgaaaaaatctactcatctttaacctgagtgaaggggattctggggtatatcaatgcctgagcgaggaaagggtaaagaataagacagtgttccaagtcgtggcaaagcatgtgttggaggtgaaggtggtccccaagcctgttgtggctccaacgctcagcgtggttcagactgaggggtctcgaattgcgacaaaggtgctggttgcgtctacacaagggtccagtcctcccactcccgcagtgcaagctacaagtagcggcgccatcaccctgccccccaagcctgcaccaactggcacatcctgcgaaccaaagatcgtcatcaatacagtgccccagcttcatagcgaaaagacaatgtaccttaagtcatctgacaatagactgttgatgtccctgtttctgtttttttttgttctgtttctctgcttgtttttctataattgttataaaggatacctgccaaggcagtgcctgaaattccgctcagctctgcttattggcaagaaaaagccgaagtctgatttttgcgacagggaacagagtctgaaagagaccctggtggaacccggttcatttagtcagcagaatggtgaacacccgaagcctgccttagataccggttacgagactgagcaagatacaatcacctctaaggtgccaaccgaccgagaggatagccagagaattgatgatctgtcagcccgggataagcccttcgatgtcaaatgtgagctgaaatttgccgatagtgatgcagacggtgattag

SEQ ID NO: 29877 - DNA, 180 bp, Artificial Sequence
  Description of Artificial Sequence: Synthetic coding sequence
atgcgcatgtgtactcccatccgaggcctgctcatggcactcgccgtgatgtttggcacggccatggccttcgcacccattccccggattacttgggagcaccgcgaggtgcacctggtgcagtttcacgaacccgatatctacaactactcagctcttctattgtctgaggacaagtag

SEQ ID NO: 29878 - DNA, 372 bp, Artificial Sequence
  Description of Artificial Sequence: Synthetic coding sequence
atgtggacccagagatggaagcgcagcgtatcgcctggtcctgccgacattaggtttgtgtgggagaaaaacggtagggccctggagacctgtgtgcccgttcagactcacgcgctgcccgacggtagggcccacgctctcagttggcttcaggatgctattagagagtctgccgagtatagatgttcagtcctatctagcgctggtaataagacttccaaagttcaggtggcggtaatgagacctgaggttactcaccaagagcgatggactcgcgaactcagcgcttggcgcgccgtggccggcgaacacgatcggatgatgcagtcatggcgcaaagcatgggagagttgcagcaaggatacgctctag

SEQ ID NO: 29879 - DNA, 6 bp, Artificial Sequence
  Description of Artificial Sequence: Synthetic coding sequence
atgtag

SEQ ID NO: 29880 - DNA, 441 bp, Artificial Sequence
  Description of Artificial Sequence: Synthetic coding sequence
atgagaatgtgcactcccatcagaggcctccttatggccctagcagtcatgttcgggacagccatggcttttgctccgattcccagaatcacctgggagcaccgcgaagtccacctagtgcaattccacgaacccgacatctataattacagcgcactgctgttatccgaggataaggacacactgtatatcggcgctcgcgaagctgtatttgctgtgaacgccttgaatatcagtgagaagcagcatgaggtgtactggaaggtgagcgaggataaaaaggcaaagtgcgcggagaaagggaaatctaaacaaactgagtgtcttaactacattagggtactgcagcccctcagcgccacgtccttgtatgtatgtggtacaaacgcattccaacccgcgtgtgaccatctgaatttgacttccttcaagttcctttag

SEQ ID NO: 29881 - DNA, 2217 bp, Artificial Sequence
  Description of Artificial Sequence: Synthetic coding sequence
atgcggatgtgcacccctataaggggcctgttaatggccctcgcagtgatgtttggaaccgccatggcctttgctcccatccctagaatcacttgggagcatagagaggtacatttggttcagttccacgagcccgacatttataattattcagccctacttctgtctgaagacaaagataccctctacatcggagcccgggaagccgtatttgctgtcaatgccctcaacattagcgagaaacagcatgaagtgtattggaaagtgtctgaagacaaaaaggccaaatgcgctgagaaaggcaagtcaaagcaaacagagtgtcttaattacatccgagtgctccagccgctgtcggccacttccctgtatgtgtgcgggactaacgcgtttcaaccagcttgtgaccatctcaacctgacatcctttaaatttcttgggaagaacgaggatggaaaaggtcgctgcccattcgatccggcccactcttacacatctgtcatggttgatggagagctgtactctggcaccagttataacttcctgggaagtgagcctattatctcgagaaatagcagtcactccccacttcggactgaatatgctataccctggttgaatgagccctctttcgtgttcgcagacgtgattcggaaatcacccgattccccggacggggaagacgatcgggtctactttttcttcaccgaagtgtctgtggagtacgagttcgttttcagggtgctgattcccagaattgctagggtttgtaaaggagatcagggggggctccggacccttcagaagaaatggacctctttcctcaaggcccggctgatctgttccaggcctgacagcggactcgtttttaacgtgcttagggatgtgttcgtcctgagatctccaggactgaaggttcctgtattttacgctctttttacaccgcaactgaacaacgtcggcctgtccgcagtctgcgcttacaatttgtcaaccgcagaagaagttttttctcacggaaagtatatgcagagtacaacagtagaacagtcccatacgaagtgggtgcgctacaacgggcccgtgcccaagccccgacctggagcttgtatcgattcagaggctagggccgctaattacacaagcagccttaatctcccggataagacactgcagttcgtcaaggaccatcccctgatggatgattccgtgacccccattgacaaccggccgagactcattaagaaggatgtgaattacacacaaatcgtcgtggatagaacgcaggccctggacggaacagtgtatgatgtgatgttcgtgtccactgatcgcggcgccctacataaagcaatttccctcgagcacgctgtgcacatcatcgaggaaacgcagcttttccaggactttgagcctgtacagaccctgctgctatcatcaaagaaagggaaccgatttgtgtacgcgggaagcaactcaggagtggtgcaagccccactggctttctgtggaaagcatggcacttgtgaagactgcgtgctagctcgagatccttattgcgcctggtctccacctacggctacatgcgtggctctgcatcaaaccgagtccccttcccgcgggctcatccaggaaatgtccggggacgccagcgtgtgccctgcgtccagcccgaaacctctgcccccaccaggttcttcgtccctgtcatgcctaggccacgtgggcgatcgccgtctctcttctccatggaccccctggcctgcctcaggagccggcccagactcttcttctcgagtgtcactcctccccccattcctgtctgaccaggctcagcatgtgcatgcactcggcaacttctaccttttctgccaggctaccggaccagctgatatccgatttgtatgggagaaaaatggacgggctttggagacctgtgtccctgtgcagactcatgctctgccagatggacgggctcacgccctgtcctggttgcaagatgcgatcagagagtcagccgagtaccgttgcagcgtactgagctccgctggaaacaagaccagcaaagtacaggtggcagtgatgagacctgaggtgacccatcaggaacgctggacccgtgagctcagtgcttggcgagccgtggccggagagcatgacagaatgatgcagagttggaggaaagcctgggaatcctgctccaaagacacattgtag

SEQ ID NO: 29882 - DNA, 2589 bp, Artificial Sequence
  Description of Artificial Sequence: Synthetic coding sequence
atgagaatgtgcacccccatccgcgggctgctgatggcactggcagtgatgtttggcacagcaatggctttcgcccctatccctagaattacgtgggagcatagagaggtacacctcgtccagtttcatgaacctgacatatataattactctgcgctcctcctgagcgaggataaagacaccctgtacataggagccagggaggccgtgtttgctgtgaatgccttaaatattagtgaaaagcaacacgaagtatattggaaagttagtgaggacaaaaaggctaagtgcgcagaaaaaggtaagtcaaaacagaccgagtgcctgaattacattagggtgctccagcctctgtccgccacatccctgtatgtttgcggtactaacgcgtttcagcccgcctgtgaccatctgaatcttacttcctttaaattcttgggtaaaaatgaagacggtaaggggaggtgcccgttcgaccccgcccactcatacacctctgtgatggtggacggcgaactctatagcggtacatcatataactttctgggaagcgagcccatcatatcgcgcaacagtagccactcgcctttgagaaccgagtacgccatcccctggttgaatgagccaagttttgtgttcgctgatgtcatcaggaaatcgcccgattcgcctgatggagaagacgacagagtatattttttcttcacagaggtcagcgtcgaatacgagttcgtcttcagagtcctcattccaaggatcgcccgagtgtgcaagggggaccagggcggcctgcgcaccctacagaaaaagtggacttcattcttaaaagcgcgcctgatttgctctcggccagacagcggcctggtgtttaatgtgcttcgggatgtttttgtgctgcgtagccccggactgaaggtccctgtgttctatgcactctttactccacagctaaacaatgtcggtctttcggccgtctgtgcctataatctcagcacagccgaagaagtcttctcccacggaaagtacatgcaatccaccacagtggaacagtcccacactaagtgggttcgatataatggacctgtccccaagccccgtccaggcgcctgcatcgatagtgaagcaagagccgccaattacactagctctctcaatctccccgataaaaccttgcagtttgttaaagaccaccccttgatggacgatagtgtgactcccatagataaccgccctaggctcatcaaaaaggacgtgaattatacacagattgtggtagatcgaacccaggccctcgatgggaccgtgtatgacgtgatgttcgtttctaccgaccgcggcgcactgcacaaagccatcagcctggagcatgccgttcacatcattgaggaaacacaattattccaggactttgaaccagtccagacgcttcttctatcatcgaaaaaagggaaccgttttgtgtatgccggaagcaacagtggtgtagtacaggccccattggcattttgtggaaagcacggcacatgcgaagattgcgttctggctcgggacccatattgtgcttggagccctcctactgccacctgcgttgctcttcaccagaccgagagtcccagtcgtggactcatccaagaaatgtcaggagatgcctcagtgtgcccggacaagtccaagggatcttaccgacagcacttcttcaagcatggtggtacagctgagctgaaatgttctcagaaatccaatcttgcccgggttttttggaaatttcagaatggcgtactcaaggctgaaagtcccaagtacgggttgatgggaagaaaaaacttgctaatttttaatctcagtgaaggagactctggtgtttaccaatgcctgagtgaagaaagagtgaagaacaagaccgtgttccaagtcgtcgcgaagcatgtcctggaagtcaaagtggtgcctaaacccgtggtggcccctaccctgtccgtggtccagacagaaggttctagaatcgccaccaaagtgcttgtcgctagcactcagggatcgagccctcctacgcccgctgtgcaagcaacaagttcgggagccattaccttgcccccgaagccagcccccacagggaccagctgcgaaccaaagatcgtcatcaacacggtgccacagctgcactctgaaaaaactatgtatctcaagtcttccgacaacaggctgcttatgagcttatttctgttcttcttcgtattgtttttgtgtctgttcttttacaattgttataaaggatatctccccaggcagtgtctcaagttcaggtccgctctgctgattggcaagaagaaaccaaaatctgatttctgcgatcgggaacagagtctgaaggagacattggtggagccgggcagcttctctcaacagaatggagagcatcctaagccggccttggacactggctacgaaacagagcaggacactatcacgagtaaagtccccacggatagggaggatagtcagcgaatcgacgacttatccgctcgagacaaacccttcgatgtaaagtgtgaactcaagttcgctgatagcgatgcagacggggactag

SEQ ID NO: 29883 - DNA, 231 bp, Artificial Sequence
  Description of Artificial Sequence: Synthetic coding sequence
atgcggatgtgtacaccaatccgtggcctgctgatggccctcgctgtaatgtttgggactgctatggcatttgctcccattccacgtattacgtgggagcatcgggaggttcatctcgtgcagtttcacgagcccgacatctataattacagcgcccttctcctctccgaagacaaggataccctgtacataggtgcccgtgaggccgtcttcgccgtcaacgctctttag

SEQ ID NO: 29884 - DNA, 2589 bp, Artificial Sequence
  Description of Artificial Sequence: Synthetic coding sequence
atgcggatgtgcacgcctattcgaggcctgctgatggccctggccgtgatgtttggaactgctatggccttcgcccccataccacgcataacttgggagcaccgggaggttcatctggtgcagtttcatgaacccgatatttataattatagtgccctgctcctgtctgaggacaaggatacactctacatcggcgcccgcgaggccgtctttgccgttaatgcccttaatatatccgagaaacagcacgaggtctattggaaggtttcagaggacaagaaagcaaaatgcgctgaaaaaggtaagagcaaacagacagagtgtctcaactacatccgtgtgctgcaaccattgtctgccacctccctttacgtgtgtggtaccaatgcatttcagcctgcctgcgaccacttgaacctgacttctttcaagtttttagggaagaatgaggacggcaaggggagatgtccctttgacccggcacactcctacacatcagtgatggttgacggagagctgtattcggggacttcatacaactttttgggaagcgaacctatcattagtaggaacagcagtcacagccctctgcggaccgaatacgccatcccttggttgaatgaaccttcctttgtcttcgctgacgtaattaggaagagcccagacagccccgatggcgaggacgatcgggtctacttcttttttaccgaagtgagtgtggagtatgagtttgtgtttagagtgctgattccccgaatcgcaagagtctgcaagggcgatcagggagggctcaggaccctgcagaaaaaatggaccagtttcctcaaagcccgtctgatatgtagccgccctgactcagggctggtgttcaatgtgttacgcgatgttttcgtgctgcggtcaccgggtctgaaagtccctgtattctacgcactgttcaccccacagctgaacaacgtgggcttgtccgccgtgtgcgcatataatctgagcacagcagaggaagttttctcgcatggaaagtacatgcaaagcaccacagtagaacagagccatacaaagtgggtacggtacaacggcccagtccccaaacctcgcccaggggcgtgcatcgattccgaggcccgcgcggcaaactacacctccagcctgaatctacctgacaaaaccctccaatttgtgaaagaccaccctctgatggatgactcagtgactccaatcgacaaccgcccacgactgatcaagaaggatgtgaactatactcagatcgtggtcgaccgcacacaagccctcgatggcacagtgtatgatgtgatgttcgtttctacagacagaggggccctgcataaggcgatttctctggaacacgccgttcacatcatcgaagaaacacagttattccaagatttcgagccggtgcagactttgcttctcagctcaaaaaaaggtaatcgattcgtttacgcgggctcgaattcgggagtcgtccaggcccctcttgccttttgtgggaaacacgggacctgtgaggactgcgtgctagctagggacccatattgtgcatggtccccccccactgcaacttgcgtcgccttgcatcagacggagagccctagcagaggtctgatccaggaaatgtcaggggacgctagcgtgtgccctgataagagtaaaggaagctataggcaacacttctttaaacacgggggcacagctgaactcaaatgcagccagaagagtaatcttgcccgggtgttctggaagttccagaatggcgtcctaaaggctgaatcccccaaatatgggctaatgggaaggaaaaacctgctcatttttaacctgtccgaaggagattctggagtttatcagtgtctatccgaggaaagagtgaaaaacaaaacagtgttccaggtggtggcaaaacacgtgttagaggttaaggtggttcccaagccggtggtcgctcccactctgagcgtggtacagacagagggctcgcgtatcgccactaaggttctggtggcttccacccagggcagttccccgccgacaccagcagtgcaagccacaagctcaggagccatcacgctgccacctaagcccgcacccactggaacttcttgtgaaccaaaaatcgtgatcaatacagtccctcagttacactcagagaaaacaatgtatctcaagtcaagtgacaatcgacttctgatgtcactcttcctgtttttcttcgtcttgttcctctgtctgttcttttacaactgttataagggctacctcccccgccaatgtctcaaatttagatccgccttattaatcgggaagaaaaaaccaaaatcagacttctgcgatcgcgaacagtctctgaaggaaacacttgtggagccggggtccttttcgcagcagaacggggagcaccccaaacccgcgcttgacaccgggtacgagactgagcaggatacgatcacaagtaaagtcccaaccgaccgtgaagacagccaaaggatcgacgatctgagtgcaagggataaaccttttgatgttaaatgtgagttgaaattcgccgattccgatgctgatggagactag

SEQ ID NO: 29885 - DNA, 2589 bp, Artificial Sequence
  Description of Artificial Sequence: Synthetic coding sequence
atgaggatgtgcacccccatcagaggactgctcatggctcttgctgtgatgttcggaactgccatggctttcgcgcccatcccccgcatcacatgggaacaccgggaagttcatcttgttcagtttcatgagccagatatttataactactctgctctcttgctaagcgaagacaaggacactctgtacattggcgccagggaggccgtgttcgccgttaacgccctgaatatctcggagaaacagcatgaggtttactggaaggtgagcgaggacaagaaagctaagtgcgcggaaaagggtaagagcaagcagacagaatgccttaactatatccgtgttctgcagcctctgagcgccacttccttgtacgtttgcggcaccaatgcttttcagccggcttgcgatcatctgaatctcacatcttttaagtttttggggaaaaacgaggacggtaagggtcggtgccccttcgatcctgcccatagctatactagcgttatggtcgatggcgaactgtattctggcacttcatacaatttcctgggtagtgagcctatcatttctcgcaattctagccacagccccctacgaaccgagtacgctatcccttggcttaatgagcctagctttgtgtttgccgatgttattagaaaaagtcctgatagccccgacggtgaagacgacagagtttatttttttttcaccgaggtgtccgtcgaatatgaattcgtgttccgagtgcttatcccaagaatcgcacgggtgtgtaagggcgaccaaggaggcctgcggactctccaaaagaaatggaccagttttctcaaggccagactcatctgctcacggcccgattccggactggtgttcaatgtgctgcgggacgtgtttgtcttgcggtcaccaggtctcaaagtgcccgtgttttacgcccttttcacgccccaattgaacaatgtcggcctctctgcagtgtgcgcctataacctgtctacagcagaggaggtgttctctcacgggaaatacatgcagagcactacagtggaacagagccataccaagtgggtccggtataatgggcctgtcccaaaacctagacccggggcctgtattgattcggaggcacgtgccgcaaactacaccagtagccttaatctccccgataagactcttcagtttgtaaaagaccacccactgatggacgattcggtcacgcccatcgacaatcgccctcggcttattaagaaggacgtgaactacactcagatagttgttgaccgcactcaggccctggatggtaccgtctatgatgtcatgttcgtgagcactgatcggggggcgctgcacaaggcgatctctctggagcatgcggtgcacataattgaggagacacagctgttccaggacttcgaacccgtccagacccttctgctctctagtaagaagggaaacagattcgtctacgccggctccaactctggagttgtgcaggccccccttgcgttttgtggcaagcacggaacatgtgaggattgcgtcttggcccgcgacccctattgtgcttggtcccccccaaccgcaacctgtgttgcactgcatcagaccgagtccccctctcgcggcctcatccaagaaatgtccggcgatgctagcgtctgccctgacaagtccaaaggctcctacagacagcacttttttaaacacggaggcacggctgaattgaagtgttctcagaaatcaaatctggcgcgcgttttttggaaatttcagaatggggtgttaaaagctgagtcccctaaatacggtttgatggggaggaaaaatctgctgatattcaaccttagtgaaggcgattcaggcgtttaccagtgcctttccgaggagagggtaaagaacaagaccgtgtttcaggttgttgcaaagcacgtgctagaggtaaaagtcgtcccaaagcctgtcgtagctcctacccttagcgtggtacagactgagggtagccgtatcgccacaaaagtcctggtcgcctcgactcaggggagtagccctcctacacccgccgtgcaggctacttcctcgggcgccatcacactgccccctaagccagccccgactggaacatcctgcgaacccaaaattgtcatcaacaccgtgcctcaactgcacagcgaaaagaccatgtatctcaaaagttccgacaaccggctgctaatgagtctattcctcttttttttcgtgctatttctgtgcctgtttttttacaactgctacaaaggttatttgccccgtcagtgtctcaaattccgctccgctctactgataggaaagaagaaaccaaaatcagacttctgcgatcgcgagcagagcctcaaagaaacgctcgtggagccgggctcctttagtcaacagaatggggaacaccctaaacccgcgctcgatacgggctatgaaacggaacaagatacaattaccagtaaggttcccactgaccgcgaggactcccagcggattgatgatctaagtgctagagataagcccttcgatgtaaaatgtgagctgaagtttgccgatagcgatgccgatggcgattag

SEQ ID NO: 29886 - DNA, 201 bp, Artificial Sequence
  Description of Artificial Sequence: Synthetic coding sequence
atgagaatgtgcactcctatccgagggctactgatggctttagccgtgatgttcggcactgccatggccttcgcccctatcccaagaattacctgggagcatagagaggtccatctagttcagttccacgagcccgacatctacaattattctgcgctgctgctgtcagaggacaaggacacactctatatcggagcatag

SEQ ID NO: 29887 - DNA, 2313 bp, Artificial Sequence
  Description of Artificial Sequence: Synthetic coding sequence
atgcctgcaagtgcggcacggccccgaccggggcctggccaacccaccgcatcccctttcccgttgttattactggctgtgctgtctggacctgtgtccgggagagtgccacgatctgttccccgcacatcactacccatctcagaggcggatagctgcctcacacgttttgccgtcccccacacctataattattctgtcctgttagtagacccagcttcccatacactgtacgtgggagcccgcgataccattttcgcgttatccctgcctttctccggcgagagaccacggcggattgactggatggtacctgaagctcatcggcaaaactgtagaaagaagggcaagaaggaggatgaatgccataacttcgtgcagattctcgctatagcaaatgccagccacctgcttacatgcggaaccttcgctttcgaccctaagtgtggcgtcatagatgtcagtcgatttcagcaggtagaacgcctggagtccggaaggggcaagtgccctttcgaacctgcacagcggtccgccgccgtaatggcagggggcgtcctctatgcggcaacggtgaaaaattatctgggaacagaaccaataattaccagggccgttggcagagccgaggattggatccggacggataccctgccatcttggttaaacgcccctgcgttcgtggcagctgttgcactgtccccagctgagtggggcgacgaggatggcgatgacgaaatttattttttttttacagagacatctagagcctttgactcctacgaacggataaaagtgccaagagtggctcgggtgtgcgccggagacctgggcggacggaaaaccctgcagcagcgatggactaccttcctgaaggctgacctgctctgtccaggacccgagcacggacgtgcaagtagcgtgctccaggatgttgcagtgctgagacccgaactgggagcagggacccccatattctacggtatcttctccagccagtgggaaggggcgaccatttcggccgtgtgcgcctttcgacctcaagatatccgcactgttttgaacggcccttttagggagttgaaacacgattgtaataggggcctaccggtggtcgataatgacgtgccccagccacggcccggggaatgcatcactaataacatgaagttacgacattttggatccagcctgagtctacccgaccgagtgctgaccttcattcgggatcaccccctaatggatcgccctgtgttcccagccgatggccatccccttttagtcacgactgacactgcttacctccgagtggtggcccacagagttacctccctgagcggcaaagagtacgatgtattgtatctgggcactgaggacgggcacctgcaccgcgctgttcgtatcggtgcacagctatccgtcctggaagacctggccctgttcccagagccacaacccgtagagaacatgaaactgtatcatagttggctgctggttggctcaagaacagaggtcacccaagttaacaccaccaactgtggaagacttcagtcttgctcggaatgtattctggctcaagacccagtttgtgcctggtcattccgccttgacgagtgcgttgcacatgctggggagcatagaggactggttcaagacattgaaagcgcagacgtttcctccctgtgccccaaggagcccggagaaagacccgtggtgtttgaggtacccgttgcaaccgctgcacacgtcgttctcccttgctcaccctcatccgcatgggccagctgcgtgtggcaccagccctccggggtgacagcactgactccgcgacgtgacggactggaggtggtagtaaccccaggcgccatgggagcatacgcgtgcgaatgccaagaagggggtgccgcgcacgtggtggccgcgtattccctggtgtggggaagccaacgtgacgcgccatccagagcccatacggtgggcgctggtctggccggattttttttggggattctcgctgccagccttaccctgatactgatcggacggcgacagcagcgcaggcggcagagggagcttctcgcgcgtgacaaagtcggtctcgatttaggcgcaccaccaagcgggaccacttcttactcgcaggatccccctagtcccagtccagaggatgagagacttcctttggcattggcaaagcgcggctccgggtttgggggctttagcccgccatttctcctggatccttgccccagccccgcgcacatacgcctaacaggggctcccttggcaacttgtgatgagaccagcatttag

SEQ ID NO: 29888 - DNA, 384 bp, Artificial Sequence
  Description of Artificial Sequence: Synthetic coding sequence
atgcctgcctctgctgcccggccacgcccgggtcccggtcaacccaccgctagcccctttccactgctcttgctggctgtgctgagcggacctgtgtccgggcgggtccctcgttccgtccccagaacaagcctgccaatctctgaagctgacagttgtctgacccgatttgccgttccgcacacctataattattctgtgttactggtggaccccgcatcccataccctctatgtcggggccagagacactatcttcgccctatcacttccttttagtggcgaacgccctcgtagaatcgactggatggtgcctgaagctcaccgccaaaactgccggaaaaaagggaagaaagaaggtggtagctctatgctgccactttag

SEQ ID NO: 29889 - DNA, 1080 bp, Artificial Sequence
  Description of Artificial Sequence: Synthetic coding sequence
atgcctttagaactagagctgtgcccaggtcgatgggtcggcggccagcatccctgcttcatcatcgctgaaatcggacagaaccatcagggagatctggacgtggcgaagcgaatgatccgcatggccaaggagtgtggagccgattgtgcaaaatttcaaaaatccgagctggaattcaagttcaatcgcaaagcccttgaacggccctataccagcaaacacagttgggggaaaacctacggagagcataaacgacacctggaatttagtcacgaccagtatcgcgaactgcagcgttacgccgaggaagtgggtatcttcttcacggccagtggtatggatgagatggccgtggagtttctgcatgagctcaatgtcccctttttcaaagttggcagcggagatacaaacaatttcccatatctcgaaaagaccgcaaagaagggaaggcccatggtgatcagctcagggatgcagagcatggatactatgaagcaggtgtatcagattgtgaagccgctgaacccaaatttttgctttttgcagtgcacctctgcttatccgcttcagccagaagacgtcaacctgcgagtcatttccgaatatcagaagctgtttccagatattccgatcggttatagtggacacgaaactgggatcgcgatcagcgttgctgcggtggccctcggcgcaaaagtcctggaacgccatattacattagataaaacctggaaaggttccgaccactcggctagcctagaaccaggcgaacttgcagagctagtgaggtctgtaagactcgttgagagggccctcggctccccaactaagcagctgcttccctgcgagatggcttgcaatgagaagctgggcaaatccgtggtggccaaggttaaaatccccgaagggacaattctaaccatggacatgctgaccgtgaaggtcggagagcccaaaggttacccgcctgaagacatatttaacctggtgggcaaaaaggtccttgtgaccgtggaagaagatgacacaattatggaggagctcgtggataaccacggaaagaaaataaaatcttag

SEQ ID NO: 29890 - DNA, 2517 bp, Artificial Sequence
  Description of Artificial Sequence: Synthetic coding sequence
atgtggggtaggctttggcctctgctgttaagcattctgacagccaccgccgtacccgggcccagtctcaggaggccttcccgagagctggacgcaacaccccggatgaccatcccttatgaggaattgtcggggacgaggcattttaagggccaagctcaaaattactcgacattgctgctggaagaggcaagcgccagactcctggttggagcgcgcggggccctctttagcttatccgccaatgacatcggcgacggtgcacacaaagaaatccattgggaggcatccccagagatgcagagcaaatgccaccagaagggtaagaataaccagacagaatgctttaaccacgtaaggttcctacagagattgaattctacacacctgtatgcatgcggtacccacgcttttcagcccctgtgcgcagcaatcgacgccgaggcctttacactgccaacgtcattcgaggaaggcaaggagaaatgtccttatgacccagctaggggatttaccgggctcatcatagatgggggactctacacggccacacgctatgaattccggtcaatacctgacattcgccggtcgcggcaccctcactcactgcgtaccgaggaaactccaatgcattggttaaacgatgcggaatttgtcttttctgttctcgtccgcgagtccaaggcatcagcagttggggacgatgataaggtgtactacttctttacggagcgtgccactgaagaagggagcgggagttttacccaatctcgctcctcccacagggtggcccgagtggccagagtgtgtaagggggatttgggcggtaagaagattctgcagaaaaagtggacctcattcttgaaggctcgtctcatatgtcacatccccctgtacgaaacacttcgcggggtttgctctctggatgccgagacatcttctagaacacacttttatgccgcgtttactctctcaacccaatggaagactctggaggcctccgcaatctgtcgatacgacctggctgaaattcaggccgtgttcgcgggcccctacatggaatatcaggacggaagcagaaggtggggaaggtatgagggcggggtacccgagcctcgcccaggcagctgtatcacagactctctacggagccagggctacaatagctcccaagacttgccgagcctggttctggactttgtcaagctgcatcctctcatggcacgaccagtggtccctacccgcggacgcccattattactcaagaggaacataaggtacactcacttgactgggacaccagtcaccactcctgccggtcccacctatgacctcctgtttcttggaactgccgacggctggatccataaggccgtggtcctcggatctggaatgcacatcatagaagagacgcaggtgttccgcgagagccagtcagttgagaacctggtgatatcgctgcttcagcattccctgtacgttggagctccgtcaggcgtgatccaattacctctcagcagctgtagcaggtacaggtcctgctacgactgcatcctcgccagggacccgtattgcggctgggacccgggcactcatgcttgtgccgcagcaacaacaatcgccaatcgcactgcattgattcaggatattgaacgcggcaaccggggctgcgagagtagcagggataccggaccacctcctccattgaagacccggagcgtcttacggggtgacgacgtgctcctaccgtgcgatcagccctccaatcttgcacgcgcactgtggctcctgaatgggagcatggggctatccgatggccagggagggtatagagtaggggtcgatggccttttagtgaccgatgctcagcccgagcacagcggcaattatggatgttatgctgaagaaaacggattgaggacacttctggcctcctatagtctgacggtcaggcccgcaacaccagcgcccgctcctaaggcacctgctaccccaggcgcccagctggccccagatgtaagactactgtatgtactggccatcgccgcgctggggggattatgtctgatcctggccagctccttactctacgtcgcctgcttgcgcgaaggcaggcgggggaggaggcgtaagtatagcctagggagagcctcaagggccgggggctccgcagtgcaacttcaaaccgttagcggtcaatgtccgggtgaggaagatgaaggcgacgatgagggtgcaggcgggctggaaggcagttgcttgcagattatcccaggggaaggcgcccctgcaccccccccccccccccccccaccacctcctgctgagctgactaatgggctcgtggctctgccaagtaggctccgtaggatgaacggcaacagctacgtcttgctgcgccaatcgaacaatggtgtgccagcaggcccatgcagtttcgccgaggagttgtctagaatcctggagaagcgaaagcacacccagctagtggaacaactcgacgagagcagtgtttag

SEQ ID NO: 29891 - DNA, 1659 bp, Artificial Sequence
  Description of Artificial Sequence: Synthetic coding sequence
atgtggggccgtctgtggccacttctcctgagtatcttgacagccaccgctgttcctggaccatctttacggagaccatctagagaactggatgccactccaagaatgaccattccctacgaggagctctctggaacccgccatttcaagggccaggctcaaaattacagcacactgctcctggaagaagcaagcgctcgacttctggtgggcgcgcgcggagcgctgttttctctctcagcaaacgatatcggagatggcgctcacaaggaaatccactgggaagcgagtccagagatgcagtctaaatgtcaccagaaaggtaaaaacaatcaaacagagtgcttcaatcacgtcagattcctgcagcgccttaattccacccatctttatgcttgcggcacccatgctttccaacccctctgcgcggcaatcgacgctgaggccttcacgttgcctacgagcttcgaggaagggaaagaaaaatgcccctatgacccagccagaggctttactggattaattatcgacggtgggctttatactgccacacgctatgagttccggtccatccccgatatcaggcgctctcgccacccccattccctgaggactgaagagactcccatgcactggctgaacgacgcggagtttgtattcagcgtgttggttcgggaaagtaaagcttctgctgtcggggatgacgataaggtgtactatttctttaccgaacgggccacggaggaaggtagcggcagtttcacccagagccggagctcccatagggtcgcccgggtagcacgggtgtgtaagggcgatctgggcgggaaaaaaattctgcagaaaaaatggacttcctttcttaaggccaggctgatttgtcacatcccactgtacgagacacttcggggcgtgtgcagtctggatgcagaaactagcagcaggactcacttctacgcagctttcacgctctcaacccaatggaaaacccttgaggctagcgcaatctgtcgctacgatctggcagaaatacaggccgtgtttgcagggccctatatggagtaccaggacggttcaaggaggtgggggagatatgaaggcggggtacctgaacccaggcctggatcatgcatcacagactctttgcgaagccaggggtacaacagttctcaggatttgccttctctggtccttgatttcgttaagttgcatcccctcatggcacggcctgtcgttccaactcgggggcgcccattgttgctgaagcggaacatccgttacacacatcttactgggacaccagtgacgacccccgcggggcctacttacgacctgttgtttctgggcactgccgatggctggatccacaaagcagtagtattagggtctggaatgcacatcatcgaggaaacccaagttttcagggagtcacaatctgtagagaatctcgttatctctctgctgcagcatagtctatatgtgggcgccccctccggcgtgattcaattgcccctatcaagttgctcccgctatcggtcttgctacgactgcatcctggcacgcgacccatattgtcatatactgtctggccctcttccccagccgcacgtggtgactagcctgtcccgcgcttgggaaagggcctcactaggaagatag

SEQ ID NO: 29892 - DNA, 2109 bp, Artificial Sequence
  Description of Artificial Sequence: Synthetic coding sequence
atgtgggggcggctgtggccgttgctgctcagcatcctcacagcaactgccgtcccaggcccctctctgcggagaccctccagggagctggacgccaccccaagaatgactataccttatgaggagctgtccggtactaggcatttcaaaggacaggctcaaaactacagtacacttcttctggaagaggcatcagcgcgtctcttggttggcgctagaggagcgctattctcactttcggcgaacgatatcggcgacggcgctcacaaggagattcactgggaggcgtctccggaaatgcagagcaagtgtcaccagaaggggaagaataaccaaactgagtgctttaatcacgtccgcttcctgcaacggctgaattccacacacctatacgcttgcggaacccatgctttccagccactgtgcgctgctattgacgcggaggcattcaccctacccaccagcttcgaagaaggaaaggaaaagtgcccatacgatcccgcccggggctttacaggcttgattattgacggggggctgtatactgctaccagatatgagttcaggtccatccccgacatccggagaagtcggcacccccatagcttgaggaccgaggagacccccatgcactggctcaatgatgcagagttcgtgttctcagtactggttcgggagtccaaggcatcagccgtcggtgatgacgacaaggtgtactacttttttaccgagagggctacggaggaaggatccgggtccttcacccagtcaagatccagtcatagagtggcccgcgtcgctcgtgtttgtaagggggacctgggcggaaaaaaaattctgcagaagaagtggacatctttcctcaaggcaaggttgatttgccacattcctctctacgagacactgcggggagtatgcagtcttgacgcagagaccagcagtcggacgcatttctacgctgccttcactttgagcacccagtggaagactctggaagcatccgccatttgtcgatacgacctagctgaaatacaagctgtcttcgcgggaccctacatggagtaccaggacggaagtcgccggtgggggagatatgagggaggcgtgcccgagcctagacccggctcatgcatcacagactccctccgctctcagggttacaactcctctcaggacctaccatccctggtgcttgactttgtgaaactccatcctttgatggctagaccagttgtgcctacccgcggaagaccactactgttgaaaaggaatattagatatacccacttgacgggcacacccgttacaaccccagccggccctacctacgatctgctgttcctggggacagctgatggctggattcacaaagccgttgtcttgggtagcgggatgcatatcatcgaggagacccaggtctttcgagaatcgcaaagtgtcgagaatctggtcatctccctcctgcagcactccctgtatgttggcgccccgtcaggcgtcattcagcttcccttatcatcctgctccaggtatcgctcctgttatgattgtatcctggccagggatccatattgtgggtgggacccaggtacccacgcctgtgccgccgctacaactatagcgaacaggagccagggttcccggaccgccctgattcaggacatagaaagaggaaatagaggctgcgaatctagtcgggacaccggcagggctttacaggttcatatgggatcaatgagtccaccgtcagcctggccgtgtgtgctagacggccctgagacccgacaagatctctgtcaaccacctaagccctgcgtccattcacatgctcacatggaggagtgcctaagtgcaggactgcagtgcccccacccacacctcctgttggtgcactcatgttttataccagcaagcggactgggtgttccgtctcagcttccgcaccctatctggagcagttcccccgctccttgcggggacctttttgtgaaaagcttgggtacaggccaaccaggcgaggtcagacttcaccacagtcctcccttgcctagctgcgtggcattggtcaaccagccaccccactccccttggagcttcagcagggtttag

SEQ ID NO: 29893 - DNA, 513 bp, Artificial Sequence
  Description of Artificial Sequence: Synthetic coding sequence
atgtggggccgtctgtggccgttgttactctccatccttactgctactgccgtacccggcccatctctgcgtaggcctagtagagagctggatgcaacccctcgcatgacgataccctacgaggagctgtcaggcacccggcacttcaaaggccaggcgcagaactacagtaccctgctcctagaagaggcgtctgctaggcttttggtaggcgcacgcggggccctgttttcactatccgccaacgacatcggagatggcgcccataaagagatccactgggaggcctcccccgaaatgcagtctaagtgccaccagaagggcaaaaataatcagactgagtgcttcaaccatgtcaggttcctgcaacgactcaattccacacatttgtacgcatgcgggacccatgcttttcaaccgctctgtgccgccattgacgccgaagcgttcacactgcccactagctttgaagaggggaaagaaaaatgcccttatgatcctgctagggggtag

SEQ ID NO: 29894 - DNA, 1569 bp, Artificial Sequence
  Description of Artificial Sequence: Synthetic coding sequence
atgtggggaagactttggcccttacttctgtcaatcctgacagcaacagcggtgcctgggcccagtctccgccggccatcacgcgaactggatgcgacgccacggatgactattccctacgaggagctgtctggcaccaggcatttcaagggccaggctcagaactactcgaccttgctgcttgaagaggcgtcggcaaggctgcttgttggcgctaggggtgccctcttcagtctgtcagctaatgacattggagatggagcccacaaggagatccactgggaagcctcccccgagatgcagtccaaatgtcaccaaaaagggaaaaacaaccagacagaatgtttcaatcacgtgaggttcctccagaggctgaacagcactcatctttatgcctgcgggacacatgctttccaaccactttgcgctgctatcgatgccgaagccttcactcttccgacaagcttcgaggaaggcaaagaaaaatgtccttatgatcctgctagagggttcaccggattgattatcgacggcggactgtatactgccacccggtatgagttccgatctatacccgatatccggcgatccagacacccccacagccttcggacagaagagacccctatgcattggctgaacgatgcagaattcgtttttagcgtgttagtcagggagtccaaggcatccgctgtgggtgacgatgacaaagtctactacttcttcacagaaagggccacggaagaaggatctggttctttcacccagtcacgttcctctcatagggtagcccgtgtagcaagggtgtgtaaaggagacttgggaggcaagaaaatactgcagaaaaagtggacatcattccttaaggcccgcttgatttgtcacatacctctgtatgagaccctgcgcggagtgtgcagtctcgacgctgaaacatcttcccgcacacacttttacgcagcctttaccttgtctacacagtggaagactctagaagcatctgctatttgtcgttacgacttagcagaaattcaggcagtatttgcagggccctacatggagtaccaggacggcagtagaagatggggcaggtacgaggggggcgttcctgagccgcggccaggttcttgcatcaccgatagcctgagatcacaggggtacaattcctcccaggatctcccaagtctagtgctcgatttcgtgaaattacatcctctgatggcgcgacccgtggtgccaacacgcggacggccattacttttgaagcgtaacattcgctacacacatctgaccggcacaccagtgaccacccccgcaggacctacctacgatttgctgttcctcgggacagctgatggatggatccacaaggccgttgtcctgggttctggcatgcacatcatcgaagaaacccaggtattccgcgagtcccaatccgtggaaaacctggtcataagtctgcttcagcactctttatatgtgggcgctcccagtggagtaattcagctgcctctgagcagctgtagtagataccgatcttgttatgactgtattctggccagggattag

SEQ ID NO: 29895 - DNA, 2517 bp, Artificial Sequence
  Description of Artificial Sequence: Synthetic coding sequence
atgtgggggagactgtggcccctgcttctgtccattttgactgcgaccgcggtgcctggtcctagcctccgacgaccatcccgggagcttgatgctacaccaaggatgacgattccatacgaagaactgtctggcacccggcatttcaaggggcaggcgcaaaattattctactttactcctcgaggaggcatccgccagactgctcgttggagccagaggtgctctcttctcgctgagcgcaaatgatatcggcgatggtgcacacaaggagatacactgggaggcttcacctgagatgcagtctaaatgccatcagaaggggaaaaataatcagaccgagtgttttaatcatgtccgctttcttcagagactgaattcgactcatctctatgcatgcggaactcatgcattccagccgctctgtgctgcaatcgacgctgaggcttttaccctgccaaccagtttcgaagaaggcaaagaaaaatgtccatacgaccctgctaggggatttactggtctgatcatcgacggcggtctgtataccgccacccggtatgagtttagatcaatccccgatatcagacgatcccgccatccacatagcctgaggacagaagagacaccaatgcattggttgaacgacgccgaatttgttttttccgtcctggttcgtgagtctaaggcaagtgcggtcggcgacgatgacaaggtatattatttctttacagagcgcgccaccgaggagggcagcgggtcctttacacagtcacgttccagccatcgagtggcccgtgtagcacgtgtttgtaaaggagacttgggcgggaaaaaaattcttcaaaaaaagtggacctctttcctgaaggctcgactcatctgtcacatccccctgtacgagacattgaggggtgtgtgttctcttgacgctgaaaccagttctcgtactcacttttatgccgcatttacattatccactcaatggaagaccctggaggcgagtgcaatttgtagatatgacctggctgagattcaggctgtatttgccgggccatatatggaataccaagatgggtcgaggcggtggggtagatacgaaggcggcgttcccgagcctcgacctggcagctgcatcaccgacagtttacggtcacagggctacaattcaagccaggacctcccgtcactggtgctggactttgtgaaactgcaccctttaatggcacgcccagtggtccctaccagggggagaccactgctgctcaaacggaacatccgatatacgcacttaaccgggacacccgtgacaacacccgctgggccgacttatgacctgctgtttttaggcaccgctgatggctggatccataaagcagtcgtactgggaagcggtatgcacataatcgaggaaacccaggtgttccgggagagtcagtctgtggaaaatctggtgattagcttgctacaacattccctgtacgtgggtgctccatccggagtcatccagctgccactttctagctgctcacggtatagatcttgttatgactgtatcctcgctagggacccatactgtggctgggacccaggcacacatgcgtgtgccgccgctactaccattgccaacaggaccgccctgatccaggatatcgagcgcggtaaccgcggctgcgagtcctccagggacaccggacctccgccccctctgaagactagaagcgttcttcgcggggacgatgtgcttttaccttgtgaccaaccgagcaaccttgcccgcgctctgtggctccttaacggaagcatggggcttagcgatgggcagggcggttacagagtgggagtcgacggccttttggtcacggatgcacagcccgagcactcggggaactatgggtgttatgctgaggagaacggcctgagaactctgctggcctcttactctttgaccgtgcgtcccgcgacccccgctcctgcacctaaggccccagccacccccggcgcgcagcttgccccagatgtgcgcctgctctatgtgctggctatcgcggccctcggcggtctctgcctgatcctagcatccagtctcttgtacgtagcctgccttcgcgagggtcgaagaggcagaaggagaaagtatagcctcgggcgggcgagtcgagccgggggtagtgccgtgcagctccagaccgtcagtggccaatgccctggtgaagaggacgaaggggatgatgagggtgccggggggttggaggggagttgcctgcagatcattcctggcgagggagcgcctgcacccccaccgcctcccccaccaccaccccccgcagaactcacgaatggtctagtcgccctgccgtccaggcttaggcggatgaacggcaattcatacgtgcttctgcgacagtctaacaatggtgtacccgccggcccatgttcttttgctgaggagcttagcagaatcctggagaagaggaaacacacccagttggtcgagcagttggatgaatcttccgtttag

SEQ ID NO: 29896 - DNA, 3279 bp, Artificial Sequence
  Description of Artificial Sequence: Synthetic coding sequence
atgccctgtggttttagcccctccccggtcgcacaccatttggtacctgggccacccgatacccctgcccaacagctgcgctgcggatggaccgtgggtgggtggctactgagcttagtgagaggcctcctcccctgtctccctccgggcgcacgcacagccgaaggacccatcatggtcttggccggccctctcgccgttagccttctgttgccatcccttactctcctcgtctcccacctttcctcctctcaagatgttagctcagagccaagctctgaacaacaactatgtgcactgagcaaacaccctaccgtggccttcgaggatttacagccgtgggtctccaacttcacctatccaggcgccagagacttctctcaacttgctctggatccatcggggaaccagttgattgtaggcgctcgaaattatctctttcggttgagtctggcgaatgtcagtttgttacaagccacggagtgggcatcctcggaggacacccggcgctcatgccagtctaaaggaaagacagaagaggaatgccaaaactatgtaagggtactaatcgttgccggaaggaaagtgtttatgtgcgggaccaatgcattcagtcctatgtgtacctcccgacaggttggaaatctttcccgcactatcgaaaagatcaacggggtcgcccgatgtccatacgatccaaggcataattccactgcagtgatatccagtcaaggcgagttatacgccgcgacggtgatcgacttcagcgggcgagacccagccatctaccggagtctgggaagtggcccaccattgcggaccgcccaatacaattctaaatggctgaacgaacctaatttcgtagctgcgtatgatatcggactgttcgcctacttctttctgcgggagaacgccgtggagcatgattgcggcagaaccgtgtactcacgggttgcccgcgtctgcaagaatgatgtgggaggaagatttttgctagaggacacatggacgaccttcatgaaggctcgtctgaattgctctcgccccggggaagtgcctttttattataatgaactacagtcagccttccacctccccgagcaagacctgatttatggcgtgttcactactaacgtgaactccatagctgcctcagccgtctgcgcgtttaatctgagcgccatcagccaggcatttaatgggccatttcggtatcaggaaaatcctagagctgcttggctccccattgccaaccccatccctaattttcagtgcggcacattaccggaaacagggccgaatgaaaatttgacggaacgatcccttcaggacgcacagaggctatttctgatgtccgaggcagtgcagcccgtaacccctgagccatgcgtaacccaggactccgtgaggtttagtcacctggttgtcgacctggtgcaggccaaagacacactgtaccacgttctctatattgggactgagagcggaactatcctgaaggcactgagcactgccagccgtagtctgcacggctgttacctcgaagagctgcatgtgctaccgccgggccgtagagaaccactgcggtccctgcggatcctgcactcagcccgcgctttgtttgtgggcctccgagatggcgtgcttcgagtgccgttagaaaggtgtgctgcctacaggagccaaggggcctgcctcggtgcccgggacccctactgcggctgggatggcaagcagcaaagatgttctaccctggaggattcctccaatatgtccctctggacccaaaatatcacggcctgtcctgtgagaaacgttacccgagacggaggctttggaccctggtctccatggcagccctgcgaacacttggacggcgataattcgggatcctgtttatgccgtgcgagaagctgtgatagccctaggcctcggtgtgggggcctcgattgccttggacctgccattcatatcgctaactgcagcaggaatggggcctggaccccctggagttcttgggctttatgctcgacttcatgtggtattgggttccaggtgagacaacggtcttgttccaatcccgccccgcggcacggggggcgtatatgcgtgggaaagtcaagagaggagcgcttctgtaatgaaaacactccttgtccagtccctattttttgggcgtcttggggtagctggtcgaagtgttctagcaattgtggagggggcatgcaatcacggaggcgagcatgcgagaatgggaatagttgtctcgggtgcggtgaatttaagacctgtaatcctgaaggatgccccgaggtcagaagaaacacgccatggacaccctggctgcccgtaaacgtgactcagggaggcgcaagacaggaacagcggtttaggtttacatgtcgagcacccttggccgaccctcacggcctgcaattcggaagaagaagaactgagacccgaacctgtccagctgatgggtctggttcctgcgacaccgacgctctggttgaggtcctgctgagatctggcagtacctcaccgcataccgtctcagggggctgggctgcgtgggggccgtggtcgtcatgttctagagattgtgagcttggcttccgggtgaggaaacgcacttgcactaacccagaaccaaggaacggcggactgccatgcgtgggcgacgccgctgagtaccaggattgtaatccccaggcctgtcccgtgagaggagcatggagctgctggacctcctggtccccttgcagtgcctcctgcggcggtggccactaccaaaggacacgctcttgcacgagccccgcacctagtcctggcgaagacatctgcttagggctgcacactgaggaggctttgtgtgccacgcaggcctgtccggggtggtcaccctggagcgaatggtctaagtgcactgatgacggggcccagagcaggtctagacactgcgaggagttgttgcctggtagtagcgcctgcgcggggaacagcagccagagccggccctgtccatacagcgagatccctgtaattttgccagcatcctcaatggaagaagccactgactgtgcaggcaagcggaacaggacctacttgatgctgcgctccagtcagccttccggtacacctctgcagtctctggactccttccacatcctacttcagactgctaagctttgttgggggccccactgttttgagatgggatcgatttcctcgacatggtggccacgcgcaagccccgcgtcctgggccctcgggtcttag

SEQ ID NO: 29897 - DNA, 3456 bp, Artificial Sequence
  Description of Artificial Sequence: Synthetic coding sequence
atgccttgtggtttttccccaagccccgttgctcatcacctggtgccaggtcctccagacacacccgcacagcaactgcgatgcggttggactgttggcgggtggttgctaagtctagtgcgggggcttcttccctgcctgcctcctggggctaggacagccgaaggccctatcatggtgctggcagggccgctcgcagtgagtctgctgttaccaagccttaccctcctggtatcccatctgtcatcttcccaggacgtgagctccgagcccagctctgagcagcaattgtgcgccctcagcaagcatcctacagtcgccttcgaagacttgcagccttgggtgtccaacttcacttacccaggagcacgagatttttcacagctagcactggacccttccggaaatcagttgatcgttggagccagaaactacctgttccgcctcagcctggccaatgtgtcccttctgcaggctacagagtgggctagctcagaggatacacgtcggtcatgtcagtcaaaaggaaaaacagaggaggagtgccagaattacgttagagtcctaatagttgcgggacgaaaggtctttatgtgcgggaccaatgccttctcacccatgtgtactagtcgccaagtaggtaacttgtcgaggacgatagaaaagattaatggagtggccagatgcccatatgatcccagacacaactccaccgcagtcatctcgtctcagggagaactgtacgctgctacagtgatcgatttttctggtcgggatccggctatatacagatcattggggtctggccccccactgcgcaccgcgcagtacaattcaaaatggctgaatgagccaaatttcgtagcagcctacgatatcgggctttttgcctatttcttcctgcgcgagaatgcggtggaacacgactgtggaagaactgtatatagccgggtggctcgcgtgtgtaagaacgatgtcggcggtcggttcttactggaagatacttggaccacttttatgaaggcccggctgaactgctccagacccggcgaggtgccattttattataatgaattgcaaagtgccttccatctaccggagcaagatctgatctatggagtcttcacaacaaatgtgaacagcattgcggcctccgccgtgtgtgcgtttaatctaagcgcgatttcccaggcatttaacgggccctttcggtaccaggagaacccacgggcagcgtggcttcccatcgccaaccccataccaaattttcagtgtggtaccctgcccgaaacgggacccaacgagaacctcacagaacgctcactgcaggacgcccaaaggttgttcctgatgtcagaagcagtgcagccagtgactcctgagccctgcgttacccaggactccgttcgtttttcccacttagtcgtggacctcgtacaggctaaagatactctctaccatgtgttgtacattgggactgagtctggtacaattctaaaggcactgtcaacagcatccagatcactccacggctgctacctggaggagctgcatgtcctccctccgggccggagggaacctcttagatccttaagaatcttacactctgcaagagctttgtttgtggggctgcgagatggagtgttgagggtaccccttgagcgctgcgcagcatacagaagtcagggcgcctgcttaggagcaagagatccctactgcggttgggatggcaaacagcagaggtgtagtacccttgaagatagttcaaatatgtcactctggactcaaaacattacggcttgtcccgtgcgcaatgttacccgcgatggaggttttggcccctggtcaccctggcagccctgtgaacatttggatggcgacaactcaggctcctgcctttgccgcgcccgaagctgtgacagtccacggccaaggtgtggcggcctagactgtctggggcctgctatccacattgcaaactgctcgcgtaacggcgcctggaccccttggtctagctgggctctgtgctctacatcatgcggaatcgggtttcaggtccgccagaggtcatgtagtaatcccgccccccggcacgggggacgaatctgcgtgggtaagtccagagaagaacgattctgcaacgagaacaccccatgcccggtgccgatcttttgggcctcatggggctcctggtctaagtgctccagtaattgtgggggaggcatgcaaagtcgacggcgcgcgtgcgagaacgggaatagttgccttggatgtggcgtagaattcaaaacatgtaaccccgaaggatgccccgaggtacgccgtaacaccccatggacgccctggctaccggtgaatgttacacagggaggagcacggcaggagcagcgatttcgctttacctgccgggcccccttagcggacccccatggcctgcagttcggcagacgtaggaccgagactcgcacatgtcctgccgacggatctgggtcatgcgacacggacgctttggttgaggtcttgctgaggtccggcagcaccagcccgcatacagtgagcggcggctgggcagcctggggaccctggtcttcttgtagcagagattgtgagctcggcttccgtgtaagaaagagaacgtgcactaaccccgagcctcgcaacggtggtctgccatgtgtaggggacgccgccgagtaccaggattgcaaccctcaagcttgcccagtaaggggcgcatggtcgtgttggaccagttggagcccctgttcagctagctgtggaggcggacattaccaacgaaccaggagctgcactagtcctgcaccctcgcccggcgaagacatttgcctgggcctgcatactgaagaggccctttgtgcaacacaggcctgtcctgagggctggtccccatggtccgaatggagcaagtgcacggacgatggggcccagtctcgcagtagacattgcgaggagttgttacccgggtccagcgcctgcgccggcaacagctcgcagagccggccatgtccgtactccgagatccctgtcattttacctgcttcctccatggaggaggctacagattgcgccggcttcaacctgatacatctcgtcgccaccggtatcagctgtttccttggctcaggactgcttaccctcgccgtttacctgagttgtcagcactgccagcggcaaagccaggagtccaccctggtccatcccgcgaccccaaatcacttgcactacaagggcggcggcactcccaagaacgaaaagtatactccgatggaattcaagaccctgaataagaacaatctcatcccggatgatagagctaacttttaccctctccagcagacgaatgtctataccaccacttactatccctctccgctgaataagcactcctttcggcccgaggcaagtcctggtcagagatgctttccgaacagctag

SEQ ID NO: 29898 - DNA, 3267 bp, Artificial Sequence
  Description of Artificial Sequence: Synthetic coding sequence
atgccgtgtggcttcagcccttcccccgtggctcatcatcttgtacctggcccgcctgacacacccgcacaacagcttaggtgcgggtggacagtgggaggctggctattaagcctggtgaggggattactgccgtgcctccctcctggggcgaggactgcggaggggcccattatggtgctggccggccccctcgcagtgtcgctgctgctgccttcattgaccctgctggtgagtcacctgtcttcctctcaggatgtgtcctcagagccaagctccgagcagcagctctgtgcactgagcaaacacccaacagtggccttcgaggatctgcagccttgggtcagcaacttcacttatccaggagctagggacttttctcaactggccttggaccccagcggcaaccagcttattgttggcgcgagaaactatctgttcagattgtccctcgcgaatgtctcactcctccaggcaaccgaatgggcctcatcagaggacacacgccgctcctgccaaagcaaaggtaaaacagaggaagagtgtcagaactatgttcgcgtgctgatcgtggccggacgtaaagtgtttatgtgtggaacaaatgcgtttagcccaatgtgtacaagcaggcaggttggcaatctctcccggaccatcgagaagatcaacggtgtcgcacgatgtccatatgacccgagacataactccaccgctgtaatctcaagccaaggagagttatacgcagctactgtgattgactttagcggccgcgatccagccatttaccgtagcctgggcagcggtccaccccttcgaacagctcaatacaacagtaaatggctgaacgaacctaacttcgtcgcggcctatgatatcgggttgtttgcctatttcttcctcagggagaacgccgtcgagcatgactgtggaagaacagtgtactcccgggtcgcgagggtctgtaagaatgacgttgggggtcggttccttctagaggacacctggaccacttttatgaaagctcgcctgaattgctcacgccctggggaagtccccttttactataatgaactgcagtccgcatttcatctcccggaacaggatctgatttacggagtattcacaacaaatgtgaactctatcgctgcctctgctgtatgcgccttcaatctcagtgctatatctcaagcctttaatgggccctttagataccaggagaatcccagggcggcatggctgccaattgccaatcctattccaaacttccaatgcggcacgctcccagaaaccgggcctaatgagaacttaaccgagcgcagcctgcaagatgcccagcgcctgttccttatgagtgaggccgtgcagcccgtcaccccagagccttgcgttacccaagattctgtcaggtttagtcatttggtcgtggacctggtgcaggccaaagatacactgtatcatgtgctgtacatcggcacagaatctggaaccatcttgaaggctctctccactgcgtctcgaagtttgcatggatgctatttagaggaactgcacgttctccctccaggcaggagagagccacttcgctctctgcgaatattacatagcgctagagcgctgttcgtgggattgagagacggcgtgctcagagtgccattggaaaggtgcgcggcttatagatcccagggagcctgcctcggtgccagagatccatactgcgggtgggatggaaaacagcagagatgctcaacactggaagactccagcaacatgtcactatggacccagaacatcactgcatgccctgttcgcaatgtcactagggatggcggattcgggccctggagcccctggcaaccttgtgaacacttggacggtgacaactcaggctcatgcctgtgcagagcacgcagttgtgacagcccccgccctaggtgcggaggcctagattgtctcgggcctgctattcatattgccaactgctctaggaacggggcatggacaccatggtcctcatgggccctttgtagcacgagctgcggaattgggtttcaggtgagacagaggagttgctccaatccggccccccggcacgggggccgaatttgtgtcggaaaatcacgtgaagaacgtttttgtaacgagaatactccatgccccgtacctatcttctgggcctcatggggttcttggtctaagtgctccagcaattgtggcgggggaatgcagagtcggcggcgcgcatgcgagaatggtaacagctgtcttgggtgcggcgtcgagtttaaaacttgtaatccagaaggctgtccagaagtgcgcagaaatacgccatggactccttggctccctgtgaacgtcacacagggtggcgcccgccaggagcagaggttcagatttacctgtcgggcacccttagcggacccgcacgggctccaatttggcaggcgccgcacagaaactcgcacttgccccgccgatggttccggttcctgcgatacagatgccttggtggaggtactcctgagaagcggttccaccagccctcacacagtgagtgggggttgggcggcctggggaccctggtcttcctgttctagggattgcgagctgggttttagagtacgcaaacgaacatgtacaaaccccgaaccaaggaatggcgggctcccatgtgtcggagacgctgctgaataccaggattgcaacccccaggcgtgtccggttcggggcgcgtggagttgttggacttcatggtctccatgttcagcgagttgtggaggtgggcattaccaacgcactcggtcctgcacatcccccgctccttcaccgggggaagatatttgtctgggactacacacagaggaggctctctgtgcgactcaagcctgtcccgaaggatggagcccatggtcagaatggagcaagtgtactgacgacggggcccagagccgtagccggcactgcgaagagctcttgcctggcagtagtgcatgtgctgggaacagctcgcagtctcgtccgtgtccctactcagagataccggtgatcctcccggcatccagcatggaggaggccacagattgtgccgggtttaaccttatccaccttgtcgctaccgggatctcatgtttcctgggatccggcctgctgactctggcagtgtatctgagctgtcaacattgccagcggcagagccaggagtccacgttggttcacccagccacaccgaaccacttacactataaaggcggagggactccctag

SEQ ID NO: 29899 - DNA, 3174 bp, Artificial Sequence
  Description of Artificial Sequence: Synthetic coding sequence
atggtgctcgcgggtccactggccgtgagtcttttactcccctcactgaccctgctggtgtctcatttgagctctagccaagatgtctcaagcgagcctagttctgagcaacagctgtgcgcgttatcgaagcacccaactgtggcattcgaagatttgcagccctgggtcagcaatttcacatacccaggcgctcgtgacttctctcaactcgctctggatcctagcggaaatcagctgattgtgggggctcgcaactacctcttcaggcttagtctggcgaacgtgagcttgctccaagcaactgaatgggcatcctcagaggacaccagacggagctgtcagtccaagggcaagacagaggaagagtgccagaactatgtcagagtacttatcgtagcaggacgaaaagtcttcatgtgtggtaccaacgcgtttagccccatgtgcacatcacggcaagtagggaatttgtccagaaccattgaaaaaatcaatggtgtggcacgttgcccatatgatcctaggcacaacagcactgctgttatttctagtcagggcgagctctatgctgctaccgttattgatttcagcggccgtgacccagccatctatagaagcctgggaagcggcccaccactccgcacggctcagtacaacagtaagtggctgaacgagccgaacttcgtagctgcatacgatatcggcctgttcgcatacttctttctgcgtgaaaatgccgtagagcatgactgtggacgcaccgtgtacagtcgagttgccagggtctgtaagaatgacgtcggtggcagatttctgctggaagacacttggaccaccttcatgaaggcacgactgaattgctctcgtcccggggaggtccctttttattacaacgaactacagtccgcattccatctaccagagcaggatctcatttacggtgtgttcacaaccaacgttaactccattgccgcctcagcggtgtgcgcatttaacttgagcgcgatcagccaagcattcaatggcccctttcgatatcaagagaaccctcgagccgcttggctgccaatagccaacccaatccctaattttcagtgtggaactctgcccgagacaggtccaaatgagaatctgacagaacgatccttgcaggatgcccagagactcttcctgatgagcgaggccgtgcagcccgttacccccgaaccctgcgtcactcaggacagtgtccggttctctcacttggtggtggatctggttcaggctaaagacacactctaccacgtcctgtacatcggtaccgaaagcggcacgattctaaaagcactcagtacagctagcaggagcctgcatggatgctatctggaggagttgcatgtcctgccgccaggaaggcgagagcctctgcggagcttacgaatcctccacagcgcccgtgccctgttcgtggggcttagagatggagttctcagagtacctctggagcggtgtgccgcctaccgcagccagggcgcctgcctcggtgcgagagatccttattgtgggtgggatggcaagcagcagaggtgctctaccttggaagactcctctaatatgtcactgtggacccagaatatcactgcatgtcccgtgagaaacgttactcgggacggcggctttgggccttggagcccatggcagccctgtgaacacctggacggcgacaatagtggctcctgtttgtgtagagcccgaagctgcgacagcccgcgacctagatgtggaggactagattgtctcgggcccgcgatacacatagccaactgttctcgcaacggtgcatggacaccgtggtcttcctgggccctatgcagcacatcctgtggcatcggatttcaggtgaggcagagatcatgctccaatccagctccgcgccatggagggcggatatgcgtggggaagtcaagggaggagcggttctgcaacgagaacacaccttgccctgtgcccatattttgggcttcctggggaagctggtctaaatgctcaagcaactgtggcgggggtatgcagtccagacgacgcgcttgtgaaaatggtaatagttgtctgggttgcggagtggagttcaagacctgcaacccagaaggctgtcccgaagtcagacgtaataccccctggactccatggctgcctgtgaatgtgacacaaggtggcgcccgacaggagcagaggttcaggtttacgtgtcgtgccccactggcggacccacacggcttacaatttggccggcgcaggactgagacaaggacgtgcccagccgatggctcgggttcttgtgacaccgatgcactggtcgaggtgctgctgcggtctggatctacctcgccacatactgtctccggagggtgggctgcctggggaccatggtcaagttgtagccgagactgtgagctgggatttcgcgtccggaaacggacctgcacaaacccggagcccagaaacggcggtctcccttgtgttggtgatgcagccgaatatcaggattgtaacccccaggcatgtcctggcgaggacatctgcttgggactccacactgaggaggcattatgcgccacccaggcttgcccggaggggtggtccccctggtctgagtggtctaaatgtacagacgatggagcccagagcaggtcgcggcactgtgaggagcttcttccaggctcctccgcttgtgctggtaattcttcccagtctagaccttgcccctacagcgagatccctgttattctgccagcgtcctcaatggaggaggccaccgattgcgcgggtttcaacctgatccacctcgtcgctacgggcatctcttgttttctgggatccgggctgctgacactggcagtgtatctctcatgtcagcactgtcagcgccagagtcaagagagcactttggtccatccggcaacccctaaccatttgcactataagggaggggggacgcctaaaaatgaaaagtacacacccatggagtttaaaacacttaataaaaacaatctgattcctgatgatcgagctaacttctaccctttgcagcaaactaacgtgtacactaccacatactatccctcacccctaaataagcacagtttccgcccagaggcttcacctggccagcgctgtttcccaaatagctag

SEQ ID NO: 29900 - DNA, 429 bp, Artificial Sequence
  Description of Artificial Sequence: Synthetic coding sequence
atgccgtgcggattctcacccagtcccgtggcccaccacttagtgcctggaccccccgacacgcccgcacaacagcttagatgtggctggaccgtgggtggatggctattaagcttagtgcgtggcctcctcccttgtcttccccctggcgccaggacagcagagggcccaattatggtgctcgccgggcctctggccgtgagcttactgttgccatctctgactctgctggtctctcacttgtcatcttcacaggatgtcagtagtgagcctagcagcgagcaacagctgtgcgccctgagcaagcaccccaccgtggcatttgaggacctgcagccatgggtgagtaacttcacctaccccggcgctcgggatttctcccagctggccctggatccttccgggaaccaactgattgtgggggcctag

SEQ ID NO: 29901 - DNA, 255 bp, Artificial Sequence
  Description of Artificial Sequence: Synthetic coding sequence
atgccttgtggattttccccatctcctgtcgcccatcatctcgtgcccggaccacctgatacaccagcccagcaactacgatgcggttggacagttggcggatggctcctgtccctggtgaggggcctactcccttgccttccgcccggcgcgcggaccgctgagggacccattatggtactggcaggaccactggccgtgagcctcctgttgccctccctgaccttactggtgagccatttatcctccagctag

SEQ ID NO: 29902 - DNA, 3618 bp, Artificial Sequence
  Description of Artificial Sequence: Synthetic coding sequence
atgctgcacctaagcgccgaagaagctattgggtgcgtcagagtgcgacgctcattcatcgacgaactggccttcggccgcggccattcaaccggcaccgggaagcagaagagaagggaccgggtcagcggatcttcttggtgtcttgcctgcgtgagctggatgccctgtggcttcagcccatcgcccgttgcacatcaccttgtgccagggccccccgacactccagcgcagcagctgcggtgcggatggactgtaggaggatggctgttgagcctggtccgggggcttctgccctgcctacctcccggagccagaaccgctgagggacctataatggtgctggccgggcctctggccgtcagtcttctgcttccctcccttacgctcctggtgtcccacctttcctcctcacaggatgtttcttcggagccttcatctgagcagcaactctgcgcactcagtaaacaccccaccgtggccttcgaagacttacagccgtgggtcagtaatttcacataccccggcgcacgggacttttcccagctcgcgctagatccaagtgggaatcagctcattgtgggcgctcgaaattacctctttcgcctcagcctggccaacgtgagcctgctgcaggcaacggagtgggctagctccgaagacacaagaaggagctgtcagtccaaaggtaagactgaagaggagtgtcaaaactatgtgagggtgctgatcgtggccggccgtaaggtgttcatgtgtggcacgaacgcattctctccaatgtgcacaagccggcaggtagggaatctttcacggactatcgaaaagatcaacggtgtggctcggtgcccctatgatcctaggcataatagtaccgccgtcatttccagccagggagaattgtacgcagcaactgtgattgacttttcaggtcgcgaccctgccatctaccgctcattggggagtggtcccccactcaggactgctcagtacaattcgaagtggctgaacgaacctaatttcgtcgcagcctacgacattggactctttgcttatttcttcctccgcgagaacgccgtcgaacatgattgcgggcggacagtctactcacgcgtggctagggtgtgtaagaatgacgtggggggtaggttcctgttagaagacacctggaccacttttatgaaggccaggctcaattgtagcaggcccggtgaagtgcctttctattacaacgagttgcagtctgcattccacctgccagagcaggatcttatctacggggtttttaccactaacgtcaattctatcgcagcttccgcagtgtgtgccttcaacctctccgcaatctctcaggcttttaatggtccgttccgctaccaagaaaatccacgcgctgcatggctgccaatagctaacccgatccccaacttccagtgcggaaccctgccagaaactggcccaaacgaaaacctgaccgagaggagccttcaagacgcacagagacttttcctgatgagtgaggcagttcagcccgtcacccccgagccttgcgtaacacaagacagcgttcgctttagtcatctggtcgtcgaccttgtacaggccaaagacactttatatcacgtcctctatattggtacagagagcgggactatactgaaagctctcagcactgcgtccaggtctctgcacggctgctatttagaagaactacatgtcttgcctccaggcaggcgcgagcctctacggtctctgagaatcttgcatagcgctcgcgccctgttcgtcggcctgagagacggagtgctgagagttccactggagaggtgtgccgcctaccgcagtcagggagcttgtctgggagcacgcgacccctattgtgggtgggacgggaaacaacagcgctgttcaacattggaggactcttcaaatatgtccctgtggacacagaacattaccgcgtgccctgtgaggaatgtaacaagggatggaggcttcggaccttggtctccctggcagccatgtgagcacctggatggtgacaatagcggatcttgtctgtgcagggcgcgctcttgcgacagcccgaggccacggtgcgggggccttgactgcctggggcccgctatacacatagctaattgctccaggaatggtgcgtggaccccttggtcctcatgggccttgtgctccacatcttgtggaatcggattccaggtgcgacaacgaagctgctctaaccccgctcctagacacggtggccggatttgtgttggtaaatctagggaggagagattctgtaacgagaacaccccctgcccggtgcccattttctgggcttcttggggctcttggtccaagtgctcatcaaattgtggcggcggcatgcagtctagaagaagggcctgcgagaacggaaacagctgccttggttgtggcgtggagttcaaaacctgcaaccctgaggggtgtcctgaggtgcgccgcaatacgccatggacaccgtggcttccagtcaatgtcactcagggcggagcaaggcaggaacagcgattccggtttacgtgtcgtgcacctctagccgatccccatggcctccagttcgggagacgacgaaccgagacaaggacttgccctgctgacggatccggttcatgtgatacagatgccttagtggaggtcttgctgagaagcggcagcacatccccccacaccgtgtccggtggctgggcggcttggggcccatggtcttcttgctctagagattgcgagctgggctttcgggttaggaaacgaacatgtacaaatcccgagcctcggaacggtggcttgccttgcgtcggcgacgcagccgagtaccaggactgcaacccacaagcatgtcccgttcgaggcgcttggtcctgctggaccagctggagtccctgctccgctagttgcggaggaggtcattaccagagaactagaagctgtaccagccccgcgccaagtcccggggaggatatatgtctcggcctccatacggaggaagctctatgcgctacacaggcatgtccggaagggtggtcaccctggtcagagtggtccaagtgtacggatgatggcgctcagtccaggtcccgtcactgtgaggagttgctccccggttcatcagcttgtgccggcaattcatcccagagccggccttgcccctattccgagattccagtaatactgcctgccagttccatggaagaagcaaccgactgcgccggctttaatctcattcatctagtggctacggggatttcctgcttcctcggttctggcctactcacgctggctgtgtacctgagctgccagcattgccagcggcagagccaggagtccactctcgttcacccagccacccccaatcatctgcattataagggaggagggacacccaaaaatgaaaaatataccccaatggagtttaagacactaaataagaataatctgatccctgatgaccgggccaatttctaccccctccagcagactaacgtctataccactacatactacccctcccctctgaataagcattcattccggccggaagcctctccggggcagagatgtttcccaaattcttag

SEQ ID NO: 29903 - DNA, 3144 bp, Artificial Sequence
  Description of Artificial Sequence: Synthetic coding sequence
atgaggtccgaggccttgctcctgtattttaccttgttacatttcgccggggctggcttccccgaggacagtgagccgatttctatctctcatggcaattatacaaagcagtaccccgtttttgttggtcacaaacccggacggaacacaacccagaggcaccgtctagacattcagatgattatgattatgaacggcaccctgtacatcgccgccagagatcacatatacactgtcgacatagacacttcccataccgaagagatttattgctcaaagaaactaacctggaaaagtcgacaggcagacgtcgacacttgtcgcatgaaaggtaaacacaaggacgaatgtcacaattttatcaaggttctgctcaagaagaatgacgacgctttgttcgtctgcggcaccaatgcatttaatccaagctgcaggaattacaaaatggacaccctggagcctttcggcgatgagttctcaggcatggcacggtgcccatatgacgctaaacacgcgaacgttgctctcttcgcagatggcaagctttatagtgccacggtgacagactttctggccatcgatgctgtgatctacaggtccttgggggagtcccctaccctgagaaccgttaagcacgactcaaaatggctgaaagagccctattttgtgcaggccgtagattatggcgactacatctattttttcttccgagagatagctgtggaatacaataccatgggcaaagtggtgttcccacgggtggcacaggtgtgtaaaaatgatatgggcggttctcagcgagtcctggagaagcagtggacctcattccttaaagcccggttaaactgttccgtccctggagattcccacttctactttaacattcttcaggcagtgactgatgtgatccggattaatggtagagacgttgtgttagccacgttcagtacaccttataattctatccctggatccgctgtctgcgcttatgacatgctggacattgctagcgtatttacaggaaggttcaaggaacagaaatccccagactccacctggacacccgtccccgacgagcgagtcccaaagcctagaccgggatgttgcgccggttcatctagtctggaaagatatgccacatccaatgagttccctgatgacactctcaatttcatcaagacgcatcccctgatggatgaggctgtcccatccatattcaaccggccgtggttcctgcgcacaatggtgaggtatcgattgaccaagattgcagtagacacagcagccggaccctatcagaatcacaccgtcgttttcctgggctccgagaaggggataatcttgaagtttctggcacgcatcggcaactcaggcttcctcaatgacagcttgtttcttgaagagatgtctgtgtataattctgagaagtgctcttacgatggcgtggaggataaaaggattatggggatgcaattggatcgggcaagcagcagcctgtacgtggcattttctacttgtgtgatcaaggtcccccttgggaggtgtgagcgttatggtaagtgtaaaaagacctgtatagcctctcgagacccctactgcggatggatcaaggagggtggtgcttgttcgcatctgtcgcccaatagtaggttaacattcgaacaggacatcgagaggggcaacaccgatgggcttggcgattgtcacaactccttcgtggctctcaatgacatcagcacgcccctgcccgacaacgaaatgtcctataatacagtttatggacattcctcctccctcttaccttctactaccacttctgattcgaccgcccaggaagggtatgagagtagaggcgggatgctggattggaagcacctcctggactccccagattctaccgatccattaggcgcagtctcttcccacaaccatcaggacaagaaaggggtcattcgtgagtcctacctgaaagggcatgatcaactggtgcccgtaacccttcttgcaatcgcggtgatccttgcattcgtgatgggcgctgtgttctctggcatcactgtttactgcgtctgcgaccatcgacggaaggatgtggcagtggttcaacgcaaagaaaaggaactaacacatagcaggaggggatctatgagctctgtgacaaaactcagtggactgttcggagatacacagtctaaggacccgaagcctgaagccatcttaacccctttgatgcacaacggaaaacttgcgactccgggaaacacggccaaaatgctgatcaaagctgaccagcaccaccttgatctcacagcccttccaaccccagagagtacccccaccctgcaacagaagcgcaagcccagtagggggagtcgagaatgggaacggaatcaaaatctgataaacgcctgtacgaaggatatgccccccatgggaagtcccgtgattccaacagacctgccactacgggcaagtcccagccacatcccgagcgtagttgtcctcccaataacccagcagggctaccagcacgaatatgtggaccaaccaaagatgtcagaagtagcacagatggccctggaagatcaggctgctaccttggagtacaaaaccattaaggagcatctgtcgagtaagtcacccaatcacggcgtcaacctggtggaaaatcttgatagcttaccacccaaagtgcctcaacgggaagccagtttggggcccccaggtgcgtccttatctcagaccggcctgtcaaagcgcctcgagatgcaccattctagctcttacggggttgactacaaaagatcttaccccaccaacagtctcactaggtcacaccaagccacgaccttgaagcggaataacacgaacagttcaaacagctcccacctttctaggaaccagagctttggtaggggagataacccacctcccgccccccaacgtgtggactctattcaggttcacagctcccagccctccgggcaggctgtcaccgtctcccgtcagccctccctaaacgcttataatagccttaccagatcagggctgaaacggacaccaagtttgaagccagacgtccccccgaaaccctccttcgcgccattatccactagtatgaaacccaacgacgcttgtacgtag

SEQ ID NO: 29904 - DNA, 1524 bp, Artificial Sequence
  Description of Artificial Sequence: Synthetic coding sequence
atgagcgtctacaattcagagaaatgttcatatgacggcgtggaagacaagcgtattatgggcatgcagttagaccgagcaagttcgtctttatacgtggcgtttagtacttgcgtgatcaaggtacccctgggtcgctgtgagcgttacggaaagtgtaagaagacttgcatcgcctcccgcgacccatactgcggatggatcaaagaaggcggcgcctgttctcatttaagccccaatagccgcttgacattcgagcaggacattgaaaggggcaacaccgacggcttaggtgattgccataatagttttgttgcacttaacggtgtgatcagagaatcttatctaaagggccacgatcagttggttcctgtcactcttctggctatcgctgtgattcttgctttcgttatgggagctgtgttttcagggattaccgtatactgtgtctgcgaccatcgtaggaaggatgtggcagtggttcaacggaaggaaaaagagctgacacattctcggcggggcagcatgtcatcagtgacaaaactgtcgggtctttttggggacacgcaaagtaaggacccaaagcccgaggccatactgacgcctctaatgcacaacggtaagctagccacacctggaaacactgcgaaaatgcttatcaaagcagatcagcaccacctcgatttaacagcgttgcctacacccgagtccacaccaacactgcagcaaaaacgaaagccaagccgtggctctagggaatgggagcgcaatcaaaatctgatcaatgcgtgcacaaaggacatgcccccaatgggaagtcctgtcatacccaccgatctgccactacgggcgagcccatcacacatcccatctgtcgtcgtgttacctattactcagcagggctaccagcatgagtacgttgaccagcccaaaatgagcgaggtcgcgcagatggcactggaagatcaggccgccaccctggagtataaaactattaaggaacatctgtcctcaaagtctcccaaccatggtgtaaaccttgtggaaaaccttgacagtcttccacctaaggtaccccagcgagaggccagcctaggcccccctggcgccagcctgagccagactgggttatcaaaaagactcgaaatgcatcattcctcttcgtacggcgtggattataaacgctcttaccccaccaatagtctcacgaggagccaccaggcaacaacactgaagcgcaacaacaccaacagctctaatagctcccatcttagccggaaccagtcttttgggaggggggacaaccctccaccggcaccccaaagagtggacagtatacaggtccacagtagtcagcccagcgggcaggccgtaacggtgtctcggcagccctctctcaatgcttacaattcactgaccagaagtggtctgaagcgcaccccaagccttaaaccagacgtcccgcctaagccttcctttgcacctctgagcacctctatgaagcccaacgatgcgtgtacctag

SEQ ID NO: 29905 - DNA, 3093 bp, Artificial Sequence
  Description of Artificial Sequence: Synthetic coding sequence
atgcggtctgaggcactgctgctctactttaccttactgcacttcgcgggcgccggatttccagaagattcagaacccattagcatctcccacggaaactacaccaaacagtatcctgtattcgttggtcacaagccgggtcggaatacgacccagcggcaccgattggacatccagatgatcatgatcatgaacggcactctctatatagctgccagagatcatatctatactgtcgacattgatacatcccacaccgaagaaatctactgcagtaaaaaactcacatggaagtctcgccaggccgacgtcgatacatgcaggatgaaaggcaaacacaaggatgaatgtcataactttattaaggtcctgttgaagaagaatgatgatgcactgtttgtctgcgggactaacgccttcaacccttcttgccgtaactataaaatggacaccttagagccgttcggcgacgagttcagtggaatggctcgctgtccctacgacgccaaacatgccaacgtggctctcttcgccgacggcaagctctatagcgccaccgtcacagatttcctggcaatcgacgctgtgatttacagatccctcggtgaatcgccaacactcaggacagtcaaacacgacagcaaatggttgaaagagccttactttgtacaggccgtggactatggcgactatatctacttcttcttccgggagatagccgtagaatacaacaccatgggaaaggtagtgttccctagagtggcacaggtttgtaagaatgatatggggggcagtcagagagttctagagaaacagtggacgtcattcctgaaggccaggcttaattgcagtgtgcctggggacagccatttttatttcaacatccttcaggcagtgacggacgttattaggatcaatggtcgagacgtcgtgctggccaccttctctaccccatacaacagcattccgggttctgctgtgtgcgcatatgacatgctggacatcgctagcgtttttaccggacgattcaaggagcagaaatctccagactctacatggacccccgtaccagatgaacgcgttccgaaaccaagacccggctgctgtgctggatcatcctctcttgagaggtacgcgacctctaacgaatttcctgacgataccctaaactttatcaagacccacccactcatggacgaggcagtaccatctatttttaaccggccatggttcctgcgcaccatggtgcgctatcgtctgactaaaattgccgtcgatactgcggcaggaccctaccaaaatcatacagtggtgtttctgggttcggagaaagggattattcttaagttcttggctcgcattggcaactctggttttttgaatgacagcctctttttggaggagatgagcgtatacaactctgaaaagtgctcttacgacggggtcgaggataaacgcataatgggtatgcaactcgatagagcctcttcttctttgtacgtcgcttttagtacttgtgttattaaggtgccacttggccgctgcgagcgctacggtaaatgcaaaaagacctgcatcgcatccagggatccctactgcggttggattaaggagggaggggcctgtagtcatctttcccccaattctaggcttacattcgagcaggacattgagcgggggaataccgacggcctgggagactgccataactcattcgttgccctgaatgggcactccagctcactactgccaagcacgaccacaagtgacagcaccgcccaggagggctacgaatctcgggggggtatgctcgactggaaacacctgttggacagccccgatagtacagaccctcttggagccgttagcagtcacaatcaccaggataaaaaaggcgttatcagggagagctacctgaaaggacatgatcagctcgtcccagtaaccttgctggccatagctgttatactggcattcgtgatgggagctgtgtttagcggaatcactgtttactgcgtatgtgaccaccgcagaaaagatgtggccgtcgtccaacgcaaagaaaaagaattaacccatagccgccggggttcaatgtcatctgttacaaaactcagcggcctctttggcgatacccagtccaaggatcccaaacccgaggctattctaacgccgctgatgcacaacggtaagctcgcaactcccggaaacacagctaagatgctgatcaaggccgatcagcaccacctggacctcacagcccttcccaccccggagagcaccccaactttacagcaaaagaggaagccaagccggggcagccgtgaatgggaacgtaatcagaatctaatcaatgcttgtacgaaagatatgccccctatgggaagccccgtcattcctactgacctgccccttagggcaagtccctcccatattccgtctgtggtcgtccttccaataacacaacagggctaccagcacgagtatgtagatcagcctaaaatgagtgaagtagcccagatggcgctggaggatcaagccgcaactttggagtacaagacaattaaagaacacctgtcttcgaagtccccaaatcacggggtcaacctggtggagaatttagattcacttccccccaaggtgccacagcgtgaggccagccttggaccgcccggcgcgtccctgagccagaccgggctctccaagaggctcgagatgcatcattctagtagctatggtgttgattacaagcggtcctatcccacgaattccttgacaaggtcacatcaggctaccaccctgaagaggaacaatacgaattccagtaatagctcccacttaagccggaatcagagttttgggaggggagataaccccccccccgctccacaaagagtagactcgatacaagtgcactcatcccagccgagcggacaggccgtgactgtatcccgccagcctagcctaaatgcctacaactcacttacgaggagtggcctcaagcggacaccttcccttaagccagatgtgcctcccaaaccctctttcgcgcccctgtccacctccatgaagccaaatgacgcctgtacttag

SEQ ID NO: 29906 - DNA, 1230 bp, Artificial Sequence
  Description of Artificial Sequence: Synthetic coding sequence
atgaagaatgcttcccctgagacgcgggaaggggttataagggagagctacttgaaggggcacgaccagctcgtgccagtgacactcctggcgattgcggtgattctagctttcgtgatgggcgccgtgttttccggcatcaccgtgtattgcgtgtgcgaccacaggagaaaggacgtggccgtggtccagcggaaggagaaggagctcactcacagcaggaggggttcaatgtcttcagtgacgaaattgtcaggattatttggagacacacaatccaaagatcccaaacctgaggccatactaaccccacttatgcacaatgggaagctggccacccctggtaacaccgccaaaatgctgatcaaagccgatcagcaccatctagatttgacagcgctgccgaccccagagtctacaccaacgctccagcagaagagaaaaccatctagggggtctagagaatgggagcgcaatcagaatctgataaatgcctgcaccaaagacatgccacctatgggttcccccgtgatacccaccgacctcccgctgcgcgcctcaccctcccatatcccttccgtggtggtacttcctattacacaacaggggtatcagcacgaatacgttgaccagcccaagatgtcagaggtcgctcagatggccttggaagatcaggccgccaccctggaatataaaaccatcaaggagcacctgtcttcaaaatctcctaatcacggagtgaacttagtggagaatctcgacagtctgccacccaaagtgccccagcgcgaggcatctcttggcccccccggagccagcctgagccagaccggcctgtcgaagcgactggagatgcatcactcctcaagttacggcgttgattacaagcgttcttatccaaccaattccctgactcggtcacatcaggcaactaccttgaagagaaataataccaactcctcgaactcttctcatctttcacgcaatcagtctttcggacgcggtgataaccccccacctgcaccccaaagggtagatagtatccaggtccattcctctcagcccagcgggcaggcggttacggtgtctagacaacctagcttgaacgcttataacagtttaactcggtcgggcctgaagcgaaccccaagtcttaaacctgatgtgccaccgaaacccagcttcgcacctctttccaccagtatgaagcccaacgatgcctgcacgtag

SEQ ID NO: 29907 - DNA, 345 bp, Artificial Sequence
  Description of Artificial Sequence: Synthetic coding sequence
atgcggagtgaggccctccttctctacttcaccctcctgcacttcgctggagcaggattcccagaggatagtgagcctatctccatctcacacgggaactatactaaacagtatccggtcttcgtggggcataagccgggcagaaataccacccagagacacaggcttgatatacagatgatcatgattatgaatggtacgctctatatcgcggctcgcgaccatatttacacagtagacattgatacttcccatacagaggagatatattgcagcaaaaaactgacatggaagtctagacaggccgatgttgacacatgcagaatgaaggggaagcacaaatag

SEQ ID NO: 29908 - DNA, 3093 bp, Artificial Sequence
  Description of Artificial Sequence: Synthetic coding sequence
atgcgatctgaggcgcttctcctatacttcaccttgctgcatttcgctggcgccggcttcccagaggacagtgaaccgataagtatttcacacggaaattatacaaagcagtacccggttttcgtggggcacaagcccggtagaaatactactcagcgccacagattggacatccagatgatcatgatcatgaatggcacactttatattgcagcccgcgaccacatctataccgttgacattgacacctcacacaccgaagagatctattgctctaagaagttaacgtggaaaagtagacaggctgatgtcgatacgtgtaggatgaaaggaaagcataaggatgagtgtcataactttattaaggttttgctgaaaaagaatgacgatgctttattcgtgtgcgggacaaacgcttttaatccttcatgccgcaattataagatggatacactggagcctttcggcgatgagttcagtggcatggcacggtgtccttatgatgctaaacatgctaatgtggccctgtttgctgacggtaaactctattctgccacagtcaccgacttcttggctattgacgctgtcatctatcggtccttaggggagagcccgactctgaggaccgtgaaacacgatagtaagtggttgaaagagccatactttgtccaggcagtggattacggagactatatttacttcttttttcgagagatagccgtggagtacaacacaatgggaaaggtggtcttcccaagggttgcccaggtgtgcaaaaacgacatggggggatctcagcgagtgttggaaaaacagtggactagctttctgaaagcccgacttaactgtagcgtgccaggcgactcccacttttactttaatatccttcaggccgtcaccgatgtgattcggatcaacgggagggacgtggtgcttgccacattctctacaccctacaacagcattcccggatccgccgtatgtgcttatgacatgctcgatatagccagtgttttcactggacgattcaaagagcaaaaatcccccgatagcacctggacaccagtgccggatgaaagagtcccaaaacctcgcccaggctgttgcgctggctccagtagtttggagaggtatgcaacatctaacgaatttccagatgatacgctgaatttcatcaaaacacatcccctgatggacgaggcagtgccttcaatcttcaatcggccatggtttctccgaaccatggttcgctacagattaactaagattgcagtggacactgctgctggtccatatcagaaccatactgttgttttcctggggtccgagaagggcattatcctcaaatttctagcaaggatcggaaatagcggttttctaaacgacagtttatttctggaggaaatgagcgtttacaactctgaaaaatgttcttacgacggtgtcgaggacaagagaatcatggggatgcaactagatagagccagcagttccctctatgtggccttcagtacctgtgtcatcaaggtgcccctcggccgctgcgaacggtacgggaaatgtaaaaagacatgcatcgcgtctcgagatccgtattgcggctggataaaagaaggaggtgcttgctcgcatctatcaccaaattcaaggctgacattcgagcaagacattgagagaggaaacacagacggcctcggagactgccacaactcatttgtcgcgcttaatggacacagctctagccttctgccctctactactacgtcagactctaccgcccaagaggggtacgaaagtagaggaggcatgctggactggaaacatttgctggactcacctgattctaccgaccctctcggtgcagtctcttctcataaccaccaggataagaagggggtcattcgagaatcttacctcaaagggcacgaccaactggtccctgtgacgttgctcgccattgctgtaatcctggctttcgtgatgggagctgtcttctccggtatcaccgtgtactgcgtgtgcgatcaccgaagaaaggacgtagctgtggtccaacgaaaggagaaagaattaacacattctcgtcgcggatccatgtcctctgttacaaaactgtccggtctctttggcgacacgcagagcaaagatccaaaaccagaagccatactcacacctttgatgcataacgggaagttggcaactcccggcaatactgccaagatgctgatcaaagccgatcagcaccatctggatctcaccgctctaccaactcctgagtccacccctacccttcagcagaagagaaagccgtcaaggggctcacgtgagtgggaaaggaatcaaaatctcataaatgcatgtaccaaggacatgccaccgatggggagccccgtgatccccactgacctcccactgagagccagcccctctcacattccctctgtcgtggtgttgccgatcacccagcaggggtaccagcacgagtacgtggaccagcctaagatgtcggaggtggcgcagatggccttggaagaccaggcggctacgttggagtacaaaactatcaaggaacacctgtcgagcaaatcccccaatcatggcgtcaatctggtggagaatttagacagtctgccacctaaggtaccacagcgagaagcttctctcggcccccccggggcctctctctctcagacgggactctcgaagcggctcgaaatgcaccacagtagctcttatggagtggattacaagcgatcctatcctaccaactccctaactcggtcacatcaggctaccacgcttaagcgtaacaacaccaactctagcaattcctctcatctgagccgcaaccagagcttcggacggggggacaacccccccccagcccctcagcgtgtggactctattcaggtacactcgagtcagccatccgggcaggcagtaacagtttcacggcagcctagtttgaacgcctataacagcctgacgcggagcggactaaagcgcactccaagtttaaagcccgatgtgcctcctaaaccaagcttcgcacctctctccacttccatgaaaccaaatgacgcttgcacctag

SEQ ID NO: 29909 - DNA, 1374 bp, Artificial Sequence
  Description of Artificial Sequence: Synthetic coding sequence
atgaaaaccggtcacagcagctcactactccccagcactacgacatctgacagtaccgcccaggaagggtacgaatcacgcggggggatgctcgattggaaacacttgctcgatagtccggattcgactgaccccctcggtgctgtatcgtctcataatcaccaggacaagaagggtgtaatcagagaaagctacctaaagggccacgatcaactagtgcctgtgacgctgctcgctattgcagtcatcctagcattcgtcatgggagctgtattctctgggataactgtttactgcgtctgcgatcatcgccgcaaggatgtggccgttgtgcagcggaaggaaaaagagctgacgcattcacgcagaggaagtatgtcctcagtgacaaaactgtccggtctgtttggcgatacccagagcaaggatcccaagcctgaagccattttgacccccttgatgcacaatgggaaactggcgacgcctggcaatacggccaaaatgctcataaaagctgatcagcatcatttggacctgaccgcactcccaaccccggaatccaccccaaccctgcaacagaagcgtaagccaagtaggggttcccgcgaatgggagcggaatcagaaccttataaacgcctgcacgaaagatatgccacctatgggcagccctgtcattcccaccgacctgcccctccgcgccagtccttcacacatcccatcagtggtcgtgttgccaatcactcagcaagggtatcaacatgaatatgtcgaccagccgaagatgtccgaagtggcacaaatggccctggaggaccaagcggccacactggaatacaagaccataaaagagcacctgtctagcaaatctccaaatcacggcgtcaacttggtcgaaaacttagatagcctcccccccaaagtccctcaacgggaagccagcttgggcccacccggagctagcctcagccaaacaggcttgagtaaaagactggagatgcatcactccagctcatatggtgtcgactataagcgctcctaccctactaattctctcacacggtctcatcaggccaccacattgaagcgtaataatactaacagttcgaatagtagccatctatctaggaaccagtcatttggacgcggcgacaacccgccccccgcaccacagagagttgattcaattcaagtgcactcctcccagccttccggtcaggctgtaacagtgtcccggcagcccagcctgaatgcatataatagtctgacccggagcggcctgaaaagaaccccgtcactgaaaccagatgtgccccccaagccaagctttgcccccctaagcacctcaatgaagccaaatgatgcctgcacctag

SEQ ID NO: 29910 - DNA, 480 bp, Artificial Sequence
  Description of Artificial Sequence: Synthetic coding sequence
atgaggtcagaggccctgctgctgtactttacgctgctgcactttgctggagccggttttcccgaagactcggagcccatctccatttcccacggtaactataccaaacagtatccagtgtttgtcgggcataaacctggacggaatacaacccagaggcaccgactcgatattcaaatgattatgatcatgaacggcacactctacatagccgcccgggaccatatttatactgtggacattgacacatcccacactgaggagatctactgctccaagaagctgacatggaagtcaagacaggctgacgtagacacctgcaggatgaagggcaaacacaaggatgaatgccacaatttcataaaggtgcttctaaaaaagaacgacgacgctctcttcgtatgtggaactaacgcatttaatcctagttgtagaaattataagatggacactctggagccttttggagatgaattttag

SEQ ID NO: 29911 - DNA, 2049 bp, Artificial Sequence
  Description of Artificial Sequence: Synthetic coding sequence
atgcagacaccacgcgccagccctccccgacccgccctcttgctccttctgctgctccttgggggcgctcacgggctttttcccgaggaacccccccccctctccgttgcaccaagggactatctcaaccattatccagtgttcgtcggttcaggtcccgggcgtttaaccccagcggagggcgccgacgatctgaacatacagagggtgttgagagtgaaccggactctgttcatcggcgatagggataacctgtatcgggtggagctggagccccccacatccaccgaacttaggtatcagcgaaaactaacctggcggagtaacccaagcgacattaatgtttgccggatgaaaggaaagcaagagggcgagtgccgaaacttcgtgaaggttctactgctgagggatgagtctactttgttcgtctgtggcagcaacgcttttaaccctgtttgtgccaactacagcatcgataccctgcagcccgttggcgataatatcagtgggatggcccgctgcccttacgatcccaagcacgccaatgttgctctgttttccgatggcatgctgtttacagcgacagttactgacttccttgccattgacgccgtaatttatcggtctctgggggataggcccacactcaggactgtgaagcacgactccaagtggtttaaggagccatattttgttcacgcagtggagtgggggagccacgtctacttcttcttcagagaaattgctatggagtttaactacctggagaaagttgtggtctcccgggtcgcaagggtctgtaagaacgatgttggcggatctccccgcgtgctggagaagcagtggacatcgttcctgaaggctcgactgaactgttcagtgccgggggattctcacttctacttcaacgtgcttcaggctgtaacaggagtggtgtcgttgggaggccgccccgtggttctggctgttttttctactccatcaaattcaatccctggttctgcagtgtgtgcctttgacttaacacaggtggctgccgtatttgaggggcgattcagagaacagaaaagcccagaaagtatttggacaccagtgcctgaagaccaggtcccacggccccgccctggctgctgcgccgcacccgggatgcagtacaacgccagcagcgctctacccgacgatatactgaactttgtgaagacccacccgctgatggatgaagccgtgccgtccctgggccacgctccctggatcctgcggaccctcatgagacaccaactcactagggttgcggttgacgtcggcgccggaccctggggcaatcagaccgtcgtgttccttgggtccgaagctgggacagtactcaagttcctagtgcgcccgaacgcctctaccagcgggacaagtggtctgtctgtatttttggaggagttcgagacctatcgacccgataggtgtggtcggcctggcggcggcgaaactggtcagcggctcctgtctctcgagctagatgcagccagtggagggctcctggcggcctttccccgctgcgtggtcagggtgccagtcgcgcgttgccaacagtatagtgggtgtatgaagaactgcatcggcagtcaggacccctactgcggttgggctcccgatggatcttgcatttttctctcccctggaacccgcgctgcatttgaacaagacgtgtctggagcgtccacttcaggactgggggattgcacagggcttctgcgggcatccttaagcgaagaccgcgctggtttggtttcggtcaacctgctggtcacttcaagtgtggccgcttttgtggtcggggccgtggtgtcgggctttagcgtgggttggttcgttggactgagggagagaagggaactcgcccggaggaaggacaaggaggctatcctagctcacggggctggcgaggctgtgctgagcgttagccggttaggggagcgtcgggcccagggaccaggatcccgtcgttgggggtttcagaaagcgagaggatccccgagatgtagactgggagtgtag

SEQ ID NO: 29912 - DNA, 2667 bp, Artificial Sequence
  Description of Artificial Sequence: Synthetic coding sequence
atgcaaactccaagggcaagtccaccccgcccggcccttctactgctcctgctcctgcttggcggagcccacggactctttcccgaggagccgccccctttgtcagtcgccccccgggattatctgaaccactaccccgtattcgttgggtccggacccggcaggctgacccccgcagagggcgctgacgacctgaatatacagagagtgctgagagtgaataggacgctctttattggggatagagataatttgtatagggttgagcttgagccccccacctcaactgagctgagatatcagcggaaactgacctggcggtctaaccccagcgatattaacgtgtgccgaatgaagggaaaacaggaaggagagtgccgtaacttcgtgaaagtactgctgttaagggatgagtctactctgttcgtgtgcgggtccaatgcctttaacccagtttgcgctaattactccatagacactctccagccagttggtgacaatattagcggtatggcacgttgcccttacgatcccaaacacgctaatgtcgctttgttttccgacgggatgctattcacagccactgtcaccgatttcctggccatagacgccgtgatttataggtctttaggcgaccgaccaactcttcgcactgtgaagcacgattcaaagtggttcaaggaaccctactttgtccatgccgtggagtgggggagtcacgtctactttttctttcgcgaaatcgcgatggagttcaactacttagagaaggttgtcgtgagtcgagtggccagagtctgtaaaaacgacgtgggcggatctccccgcgtactcgagaaacagtggacatctttccttaaagctcggcttaattgttcagtccccggtgactctcacttctatttcaacgttcttcaggctgttactggcgtggttagcctgggggggagacccgtggtgctagctgttttttcaactcccagtaattccatacccggctcagctgtgtgtgctttcgatcttactcaggtggctgcggtgtttgagggccggtttagggagcagaaatccccagaaagcatttggacaccagtgccagaggatcaggtaccccgacccagacccggttgttgcgcggcccctggcatgcaatataatgcaagttctgccttgccggatgacatcctgaactttgtaaaaacccatcctctgatggacgaggcagtccctagtttaggccatgccccttggatactccggacattgatgcgacatcagcttactagggtcgccgttgacgtaggagcggggccatggggcaatcaaactgtagtgtttcttgggagcgaagcaggcactgttctgaagttcttggtcagacccaacgcttctacaagcggaacctccgggctaagcgtgtttctggaagagttcgaaacgtaccgcccagatcggtgtggaagacccggtggcggtgaaaccggccagcgcttgttgtccttagagctcgatgcagcgtctggtgggctgctggcagcgtttccacggtgcgtcgttcgggtgccagtagcccggtgtcaacagtactcaggttgcatgaagaattgtattggctctcaggacccttattgcggatgggcccctgatgggtcctgcatcttcctttcacccggcacaagagctgcctttgaacaggacgtctcgggcgcatccaccagcggccttggcgactgcaccggcctgctccgcgcatcattgtccgaagaccgcgcggggctagtgtcagtgaacctgctcgtgacaagctccgtggctgccttcgtcgtgggagcagttgtgagtggcttctccgtgggatggtttgttggcctccgcgagcgccgcgagttggccaggcggaaagacaaggaagcgatcttagcccatggagccggtgaggccgtgctgtccgtgagccgcctgggtgagcgtcgcgcccagggaccaggtggcaggggaggggggggggggggcggggctggcgtgcctccagaggcactgctggcgccactgatgcaaaacggatgggccaaagccacactgttgcagggcggaccccatgacctggactcaggtctgctgcctacgcctgagcaaacccccttgccacagaagcggttgcccaccccacatcctcacccccacgccttaggaccgcgggcatgggaccacggccatcctctgctacccgcttcggcctcatcaagcctactgttgttggcccccgcacgggctccagagcagcctcctgcgcccggtgaacccacccccgatggacgtctgtacgcagcacgccctgggcgcgcttcacacggcgacttccctctgacaccccatgccagtccagaccgcagaagagtggtgtctgctcccactggccccttggatcctgcctcagccgctgacggcctgccccggccatggagtccaccgcccaccggtagcttacgaaggccccttgggccacatgcccctcctgctgcaacgttgcgacggactcacacattcaactccggagaggcaaggcctggagacaggcaccggggttgccacgcacgacccggaaccgaccttgctcatcttcttccctacgggggagctgatcgaaccgccccacccgtaccctag

SEQ ID NO: 29913 - DNA, 2793 bp, Artificial Sequence
  Description of Artificial Sequence: Synthetic coding sequence
atgcctagagccccccatttcatgcctctgctactgctgcttcttctgctgtccttgccacatacccaggcggccttcccccaggaccccctgccacttctaatctcagacctgcagggtaccagcccactctcttggttccggggactggaggacgacgcggtcgccgccgaattgggcctggactttcagagattcctgacactgaacaggaccctgctggtagctgctagagaccacgtcttctcctttgatctgcaggctgaggaagaaggtgaagggctcgtccccaacaagtacctgacctggcgaagccaggatgtggagaactgcgctgtaagaggtaaactgactgacgaatgttataactatatccgggtgctcgttccgtgggacagccaaaccctcctggcctgcggtactaattccttctccccggtgtgtcgctcctacggaattacatctctccagcaggagggcgaggaactgagtggccaggcccgatgtcctttcgacgctacccagtcaaatgtggccatatttgccgagggttctttgtacagcgccaccgctgcagacttccaggccagcgatgctgttgtgtaccgatctctgggcccccagcccccattgcgcagtgccaaatacgactcaaagtggctgagagaaccccacttcgtgcaagctctggagcacggcgatcacgtctacttcttcttcagggaggtatccgtcgaagatgcaagactaggtagagtccaattttcccgggtggcgcgcgtgtgtaagagggacatgggtgggtcaccacgggccctggatcgccattggacttcctttctgaaactgaggctgaattgcagcgtgcctggtgacagtacgttttattttgatgttctccaggctctgacaggtcctgttaacttacacgggcggagtgctctgtttggagtcttcacgacccagacgaattcaatcccgggctccgcggtgtgtgcgttttacctggatgaaatcgagcgcggatttgaaggcaaatttaaggaacaacgcagcctggacggcgcttggactccagtgtcggaggacagagttccatcccctcggcctggcagctgcgctggggtgggcggggccgctctgttcagctctagccgcgatctgcccgatgatgtgctcacctttattaaggcgcatccactgctggacccggccgtgccccctgttacacaccagccattgctgactctgacaagcagggcgcttctcacccaggtggcagtcgacggaatggccggcccccacagtaacataacagtgatgttcctcgggtcaaatgatggaactgtcctcaaggtcctcacgccgggaggcagaagcggcggacccgagccgattctactcgaggagatcgatgcctatagtcctgctcggtgctctggaaaaaggaccgcccagactgcgaggcgcattatcggactcgagctggatacggagggtcaccgactgttcgtggctttttcaggttgcatcgtgtacctgccgctgagtcggtgtgctcggcatggcgcctgccagcggtcttgtctcgctagtcaagacccatactgcggttggcacagctcaaggggatgcgtggacatcagaggttcagggggcacggatgtggatcaggctgggaatcaggagagcatggagcatggcgactgtcaggacggagctacagggagtcagagcgggccaggggactctgcatatggggtgaggcgggatttgcctcccgcttctgcctcccgatcagttcccattcccttactgcttgcaagcgtagctgcggcattcgcactgggcgccagtgtctccggcctgctggtctcctgcgcctgccgaagagcgcaccgtcgtcgtggcaaagatatcgagacgccggggctgccccgtccgctgagcctcagatccctggcacgactgcatggcggtgggcctgagcctcccccaccatcaaaggatggagatgcggtccagacacctcaactttacaccacgttccttcctcctccggaaggggtccctccccccgaactggcctgccttcctacgccggagtctacgcctgagctacccgtaaaacatttgcgggccgcaggggacccctgggaatggaatcagaacaggaataatgcaaaggaagggccaggtagaagccgaggcggccacgcagcgggtggccctgccccccgcgttctggtgcggccgccaccacccggctgccctggacaggccgttgaagtcacgactctcgaagaactgctgcgatacctgcacggtccacagccaccgcgcaaaggtgccgagcctcctgcacctctgacgtcccgcgccctgcccccagagcctgccccagccctgctggggggcccatcgcctcgtcctcatgagtgtgcctcccccctgcggcttgatgtgccgcccgaagggcgatgtgccagcgcgccagcccggcctgcactgtccgcccctgcccctagactgggcgtgggcggaggccggcgcctaccgttttccggtcatcgagctccccccgcacttctgacacgggtaccaagcggggggccatcacggtactcaggcggacctggaaagcatcttctgtacctgggtaggccagagggctaccgagggagggccctcaaaagagtcgatgttgagaagcctcagctctctttaaaaccccccctggtgggcccctcctctagacaggcagtacccaacggaggcaggtttaacttttag

SEQ ID NO: 29914 - DNA, 2769 bp, Artificial Sequence
  Description of Artificial Sequence: Synthetic coding sequence
atgccacgcgctcctcacttcatgcctctgctcctcctcctgctattgctcagcttgccccatactcaggccgctttccctcaagatccactcccactccttatttccgacctgcagggtacttcccccctttcttggtttcgtggcctggaggatgatgcagtggcggcagagctcggcctggatttccaacggtttctgacattaaaccgcaccctgctcgtggccgcaagggatcacgtattcagcttcgacctgcaggccgaggaagagggtgaaggactggtgcctaataaatacttaacctggagaagtcaggacgttgagaattgcgccgttcggggaaaactcactgacgagtgttacaattacattcgggtactggtgccctgggatagtcagaccctcctagcatgcggcaccaattcattctcccctgtgtgtaggagctacggaattacatcgttgcagcaggaaggggaagagctgagtgggcaagcacgatgtccattcgacgccacacagagcaatgtggccatctttgccgagccccacttcgtgcaggctctggaacacggtgatcacgtatactttttcttcagggaagtgagcgtggaggatgcccgcttgggccgagtgcagttttccagggtcgcccgcgtgtgcaaacgcgacatgggtggatcaccgcgggccttggacagacactggaccagctttctaaaactccgcctgaattgctccgttccaggggattctaccttctactttgatgtccttcaggctttaaccggcccggtaaacctacacgggcggtccgcgttgttcggagtgtttaccacccaaactaacagcatcccaggatctgcagtatgtgcattttaccttgacgaaattgagcggggattcgaaggcaagttcaaggaacagcgaagtcttgacggagcctggactccggtctctgaggatcgggttcctagtccacgtcccggcagctgcgcaggggtaggcggtgcagctctgttttcatcttcccgcgatttacccgatgacgtcctcacgttcatcaaagcacatcctttgctggaccccgccgttccacccgtgacccatcagcctctgctgaccctcacctctagggcgttgcttacacaggtagctgtggacggcatggcagggccgcatagtaatataaccgtcatgtttttgggatccaacgatggtactgtgctgaaggtgctcacacccgggggaaggtccgggggccctgaacctattctgctggaggaaatcgatgcctacagccctgccaggtgtagcgggaagcgtaccgcacagaccgctcgacgcatcattggtcttgaactggacaccgaagggcatagactattcgttgcatttagcgggtgtattgtctacctgcccctctcccgctgcgctaggcatggagcttgccaacggagctgcctggcctcccaggatccctattgtgggtggcactcttctcggggctgtgtggatatccggggttcaggaggtacagacgtcgaccaagctggcaaccaagaatccatggagcatggagattgccaggacggggctacaggatcacagtccggtccaggcgattccgcctacgtgctgcccggcccaggaccttcccccgggaccccgtctccccccagcgacgcgcatccaaggccacagtcttccaccctgggcgtgcacactcgcggggtgcggcgagatttgccccctgcttccgctagccgatcggtgccgatcccactgttattagcttcagttgcagccgccttcgctctcggggctagcgtgtctggcctgctcgtgagttgcgcttgtcgtagggctcaccgacggcgggggaaggacattgagactcccggattacccaggcctctgagtctaagaagcctggcccgactgcacgggggtggacctgagccaccgccccctagtaaggacggcgacgccgtacagacccctcagctgtacacaaccttcttaccacctcctgaaggtgtgcccccgcccgaactggcttgtcttccaacacctgagagcacgccagagctgcccgttaagcaccttcgggcagccggggatccctgggagtggaaccagaatcgcaataatgccaaggaggggcctggacgaagccgcggaggtcacgcagcaggggggccggcacccagggtgcttgtccggcctccccctccaggttgccccggtcaagccgtggaggttacaaccctggaagaattactgcggtacttacacggcccgcagcctccaagaaaaggggctgaacctcctgccccactgaccagcagagcacttcctcctgagccagccccagccctcctcggcggaccttctcccaggccccatgagtgcgcgagtcctttgcgactcgacgtccctcccgaagggcggtgcgcctctgcgccagctcgccccgccctgtctgctcctgcccctaggctgggtgttggtggcggccgtagactgccattttcaggacatcgtgccccccctgctttgctgaccagggtgccctcgggtggcccttctcgctactcgggcggacccggaaagcatctgctctacctgggacggcctgagggttacaggggcagggccttgaagcgggtcgatgtcgagaagccgcagctgagcctgaagcctccgttggtggggcccagctccaggcaggctgtcccaaatggcggtcgttttaatttttag

SEQ ID NO: 29915 - DNA, 2889 bp, Artificial Sequence
  Description of Artificial Sequence: Synthetic coding sequence
atgccacgcgccccccatttcatgccgctgcttctcctgcttctgctgttaagtctcccccatacccaggctgcttttccacaggatcccctgccgctgctcatcagtgaccttcaagggacatcgccactgtcttggttccgaggtttggaagatgacgctgtcgccgccgagctgggcttggactttcaacgctttttaacactaaatcgaacactgctggtggctgcgagggatcacgtgttttcattcgatttgcaagccgaagaggaaggagaaggcttggtgccaaacaaatatctgacgtggcgttcccaggatgtggagaattgcgccgttaggggcaaactaacagacgagtgttacaactatattagggtgctcgtgccatgggactctcagaccctcctcgcttgtggcactaatagcttttcaccagtttgcagatcctatgggatcactagtctgcagcaagagggcgaggaactcagtggccaggctaggtgccctttcgacgccacacagtctaacgtcgcaatcttcgcagaaggatctctgtacagcgccacagccgctgactttcaggctagcgatgccgtcgtgtaccggtccctgggaccgcaaccgcctttgagatctgccaagtatgatagcaagtggctaagagaacctcacttcgtccaggcgttggagcacggagaccacgtttatttcttttttcgggaggtttctgtagaggacgccagactgggaagggtgcagttttcccgcgttgcccgtgtgtgtaaacgcgacatgggggggagtccgcgggcactcgatcgccattggacatcctttctgaagctaaggctcaattgttccgtacccggagattccaccttttatttcgatgtcctccaagcactgacaggacctgttaacctccacggccggtctgctctgtttggtgtgtttacaactcagacaaattcaatcccaggttctgctgtgtgtgctttctatctcgacgagatcgagcgtgggttcgaaggaaagtttaaggagcagcgttctctcgatggggcctggacacctgtctccgaagatagagtcccctcccctaggcctggttcctgcgccggcgtggggggcgccgcgctgttctcgtcgtcacgtgacctcccagatgatgtgttaactttcattaaggcccacccacttctcgacccagcggtgcctcccgtgacccaccagcctctcctgactctcactagtcgggctctgctgacccaggttgcagtggacggtatggccgggcctcattctaacatcaccgtcatgttcctcggatctaacgatggcaccgtcttgaaagtcctaacccccggaggaagaagtggtggacccgaacctatccttcttgaagagattgacgcctacagcccagccaggtgcagcggtaagagaactgcacagacggcccgacgcatcataggactggagttggatacggaggggcataggcttttcgtggcattctccgggtgcattgtatacctccccctctctcgctgtgctagacacggagcgtgtcagagatcgtgcttagcttcccaggatccttactgtggttggcactccagccgcgggtgtgtggacatccgaggcagcggcggtacggacgtcgatcaggcagggaatcaagagtccatggagcacggcgactgtcaggatggcgcaacgggaagtcagtccggtcccggggactctgcatatgtgcttcccggccccggcccatctcctggcaccccatcacctcctagcgacgctcacccgcggccccagagttctactcttggcgtacacacaagaggggtgcggagagacctccctcctgcatcggcatccaggtccgtccccattccattgttattggcatctgtcgctgccgcctttgccctgggagcttctgtctcgggactgctggtgtcctgtgcctgccggagagctcatcggcggagaggaaaggacatcgaaacacccggacttccgcgaccactgtcactgcgctctttggccagactacacggggggggacccgagccccccccgccgagcaaagacggtgacgccgttcagaccccccaactgtataccaccttcttaccacctccagagggagtgcctcccccagaactggcttgcctgccaacacctgagtctacccctgaattacccgtgaagcacctccgcgctgccggtgacccatgggaatggaatcagaataggaacaacgccaaggaaggccctggtagatcccgaggaggccatgccgcgggcggacctgcaccccgagtgctggtcagacccccacccccgggttgccctgggcaagccgtggaggttactacactcgaggagttgttacgatacctgcacggcccacagccaccaaggaagggggcggagccgccagccccgctcacctctagggccctgccaccagaacctgcccctgcactcctggggggtccatcaccgaggccacatgagtgtgcatccccactgcggctggatgtcccgccagagggcagatgcgcatcggcgccagcaaggcctgccctgtcagcaccagcaccccgactcggcgtagggggtggccgtcggctgccattcagtggccacagagcacctcccgccttactcactagggtcccctcaggaggcccctcccggtacagcggcgggcccggaaaacacctactctaccttgggaggcccgagggctacaggggcagggctttaaagagggtggacgttgagaagccccagctttcccttaagccaccactggtcggtccttccagtcgccaggccgtcccaaacggaggccggttcaacttctag

SEQ ID NO: 29916 - DNA, 2793 bp, Artificial Sequence
  Description of Artificial Sequence: Synthetic coding sequence
atgcctagagctccacacttcatgccactcctgctgctccttcttctactgagcttgccccacacgcaggcagcattcccccaggacccactgccattgctgatctcagatctgcaaggaacatctcccctgtcctggttcagaggcctggaagacgatgccgtggccgctgaattgggactggatttccagcgcttcctgacgttaaaccgcacactactggtggccgcacgcgaccatgtattttctttcgacctgcaggcagaagaggagggcgaagggctcgtgccgaataaatacctcacatggaggtcccaggacgtggaaaattgtgcggtccgtgggaagctgaccgacgaatgttataactatatacgcgtgctcgttccttgggactcccagaccctgctggcctgtggcacaaatagttttagtcctgtgtgtagatcctatggcatcacgagcctgcaacaggagggggaagaactctccgggcaggcacgctgtccttttgacgccacacaatctaatgtggccattttcgccgaaggcagtctgtacagtgctactgcagccgatttccaagcctctgatgccgttgtgtatcgcagcctgggtccccagccccccctccgttccgccaagtacgactcaaagtggctccgagaaccccatttcgttcaggccttggagcatggagatcacgtttacttcttttttagagaagtgtcagtggaggacgcccggcttggcagagtccagttttcccgcgtggctagagtgtgcaagcgcgacatggggggaagccctcgcgccttggacagacactggacatcatttctgaagctgcgcctaaattgctccgtacccggcgattccactttctacttcgatgtactacaagctctcacaggtcctgtcaatctgcacggaagatctgcactttttggggtttttacaactcagacaaatagcatcccaggtagtgcagtttgcgctttttatctggacgagattgaacgtgggtttgaaggaaagttcaaagagcagagaagccttgatggcgcctggactcctgtttcagaagatagagtccccagccccagacccggctcatgtgcaggggttgggggggcagccctgttctcttcaagccgtgacctgccagatgacgtactcacatttatcaaggctcaccccttattggatcctgctgtgccacccgtcacacaccagcctctgctgacgctgacctctagggcccttctcactcaggtcgccgtggacggtatggcaggtccacactccaacataactgttatgttcctcggctccaacgatgggacagtgctcaaagtgctgactcccggcgggagatctggcggacccgagcccatcctgttagaggagatcgatgcctactccccggcccgatgctccggtaaacgcaccgcacagacagctaggcgcattattggcttggaactagacaccgagggacaccggctcttcgtcgctttttcaggctgcattgtgtatctaccgctgtccagatgcgcccgccacggtgcttgccagcgttcgtgcttggcgtcccaagatccgtattgtggatggcattcctcacgtggctgcgtagatattcgtggctccgggggcacagacgtcgaccaagccggaaatcaggagagtatggagcatggcgattgccaggatggcgcaacaggctcccagagtggcccaggagacagcgcctatggcgtccggagagacctcccgcccgcttccgccagccgcagtgtccccattcctctgttactggcaagcgtggctgcagcctttgccttaggcgcatcagtcagcggactcctggtgtcttgcgcttgccgccgagcccatcgtaggcgaggaaaagatattgaaaccccaggcctccctcgccccctgtctcttcgcagtctagcccgcttgcacggcggaggcccagaacccccaccccccagtaaagacggagatgccgtccaaacccctcagctgtacactacctttctaccccctcccgaaggggttcctccccccgagctggcctgtctccccacccctgagtctacacccgagcttcccgtcaagcatctccgggccgcaggagacccatgggaatggaaccagaaccgcaacaacgcgaaggagggacctggcagaagccgaggtgggcatgccgctggagggcctgcgccccgggtgctggtccgacctccccctcctgggtgccccggtcaggcggtcgaggttactaccttggaggaattgctgaggtatctgcatggcccacaaccgcctaggaaaggggccgagccacccgctcccctgacttccagggctctacctccagagccagcaccggctttattggggggacccagcccccggccacatgaatgtgcttcacccctccggttagacgtcccacctgagggaaggtgcgcctcagcacctgcaagaccagccctctccgcgcctgccccgaggcttggtgtcggcgggggcaggcggctgccgttttccgggcatcgagcacctcccgcactccttacaagggtgccatcaggcggaccaagccgctatagtgggggacccggtaagcatttattatacttgggccgcccagagggctaccggggacgcgcactcaaaagggtagatgtcgagaagccacagctttcccttaaaccaccactggtgggccccagctcgcgccaggcggtgccaaacggaggacgctttaacttctag

SEQ ID NO: 29917 - DNA, 1614 bp, Artificial Sequence
  Description of Artificial Sequence: Synthetic coding sequence
atgccacgggccccacactttatgccactcctgcttttgctcctcctcctatctctgccacacacacaggctgcttttccacaggacccactgccgctcctcattagtgacttgcagggaacgtcccccttgagttggtttcggggcctggaggatgacgctgtggccgccgaactggggctggattttcagaggtttctgacacttaatcgcactcttctggtggccgctagggatcacgtgttcagcttcgatctgcaggccgaggaagaaggcgagggcctggttcctaataaatacctgacgtggcgcagccaagatgttgagaactgcgctgttagaggcaagttaaccgatgaatgctacaattacattcgcgtgctagtgccctgggactcccagacactgctggcgtgcgggacaaacagtttttcacccgtgtgtcgatcttatggaattacttccttgcagcaggagggcgaggaactgagcgggcaggccaggtgtccctttgatgcaacccagtctaacgtggccatctttgccgagggcagcctgtattcagccaccgccgcggattttcaagcctccgatgcagtcgtgtaccggtccctcggccctcagccccccttgcgctctgcaaaatatgactcaaagtggctgagagaaccacacttcgtgcaggctctggagcatggtgatcacgtgtacttcttctttcgggaggtgagcgtggaggacgcccggctggggcgtgtgcagttctctcgcgtagctcgagtgtgcaagcgcgacatgggcgggagtcctagggccctggatagacactggaccagcttcttgaaactgaggctcaattgtagcgttccgggagacagtaccttttattttgacgtgctccaggccctgaccggccccgtcaacctccatggccggagcgcactcttcggagtgtttaccactcaaaccaattcgattcccgggtctgccgtgtgcgccttctacctagatgaaatcgaacgcggtttcgaggggaaatttaaagagcaaaggtcccttgacggggcttggacccccgtcagtgaagacagggtgccctcacctagacctggttcctgcccagcacacagctctcctctgggtcgatccctccaggtgctgagggggagcagggaagccccgcccgtcccgggacccgcgcggggacttcccgggccccgccctgagaaggggggacgtcgcgaagcccctgtggttccggaagcttctccaagaagagctctgcttccgccgggcaggccagagcgcaggccttttcagctgcttaaaggcgctgcccacggcctgcagaggggcgagaggccctcgcccctcggccatgagctggacgcgctgcaggatgtctccccccccccccggcccgctccacccgcttttcccactcgtagagtctcccggggtccattttcgcctagagtctacctcttgacagtctttcctcccgtactcgaccggagagtgggcggtgagaaacctgtgtcctctgtcagtcagcacttccgtggctcttggcgcacccccaccccccggtccttgccagcaaagctcccatag

SEQ ID NO: 29918 - DNA, 3222 bp, Artificial Sequence
  Description of Artificial Sequence: Synthetic coding sequence
atgagggtcttcctgctttgcgcctacattctcctgctcatggtgtcccaactccgtgctgtgagcttcccagaggacgatgagcctttaaacactgttgactatcactattcgcggcagtaccccgtgttcagaggacgaccttctggcaacgagtcacagcaccggcttgactttcaactgatgctgaaaatcagagatacattgtacatcgcaggccgagatcaggtttacacggtgaatctgaatgaaatgcccaagaccgaagtcattcccaataaaaaattgacctggcgctccaggcagcaggaccgcgagaactgcgctatgaaaggcaaacacaaagacgagtgccataactttatcaaagtcttcgtgcccagaaatgacgagatggtttttgtctgtgggacaaatgcttttaaccctatgtgccgctactacaggctaagcacccttgagtacgatggggaggagatttcaggtcttgctcggtgtccttttgacgctaggcagacaaatgttgctttattcgcagatggaaagctgtattctgcaaccgtcgcggacttcctggcctctgacgccgtgatctaccggtccatgggagacggttctgcactcaggacaatcaagtatgattctaagtggattaaggagccacacttcctgcatgcaatcgaatacggtaactacgtatacttcttctttagggaaattgccgtggagcacaataatctaggcaaggccgtttattcccgcgtggccaggatatgcaaaaatgatatgggagggagtcagcgcgtcttggagaaacactggacttcgtttcttaaggctcggctgaactgctccgtgccaggggactcattcttttacttcgacgtattgcagagcatcactgatattatacaaattaatggaatcccgacagttgtgggagtgtttacaacccagctcaactctatacctggctctgccgtctgtgcctttagtatggacgacatcgaaaaggttttcaaaggtaggttcaaggagcaaaagactccagacagcgtatggaccgcagttcccgaagacaaagtgccaaagcctcgacctggctgttgcgcgaaacatggcctagctgaagcatacaagacctccatcgattttcccgacgagacactgtcttttattaagtcccatcccctcatggatagcgctgtgccccctattgccgatgaaccctggttcacaaagactcgtgtgcgctacagactgacggccataagtgtggatcattcagcaggaccctaccagaactacaccgtgatattcgtgggcagtgaggcaggaatggtgcttaaggtccttgctaagacatctcccttcagtctaaatgatagcgttctgcttgaggaaatcgaggcctacaatcacgccaagtgtagtgcagagaatgaagaggataaaaaggtaattagcttacaactggataaagaccatcacgcattgtatgtggcttttagctcttgtattattcgcattcctctcagtcgttgcgaacggtacggcagctgcaaaaaaagttgcatcgcatcacgcgatccctactgtgggtggttgtcgcaaggaagttgcggcagagtcacccccggcatgctcgctgagggctacgaacaggacacggagttcgggaacacggcccatttaggagattgtcacgagatcttgcctactagcacaacacccgattacaagatctttggtggacccacgagtgacatggaggtgtccagcagtagcgtcactactatggcttccatcccagagattacccccaaagtcattgacacatggaggccaaagctgacgtcatctagaaagttcgtcgtccaggatgaccccaatacctccgatttcaccgaccctctttccggaatcccaaagggggtcagatgggaggtgcagtccggtgaatctaatcagatggttcatatgaatgtgttgattacctgtgtgttcgctgcattcgtcctgggagcctttattgccggggtggcggtgtactgctaccgggacatgttcgttcgcaaaaatagaaagattcataaggatgccgagtctgcgcaaagctgtacagattcatcgggttcattcgcaaaactcaacggtctgtttgactcgccagtgaaagagtaccaacaaaacatcgactccccaaaactgtactccaacttgctgacctcccgcaaagaacttcctccgaatggggataccaagtccatggtgatggaccaccgcggacagcctccagaattagctgcattgccgaccccggagagtacacccgtcctgcatcaaaaaacactacaagccatgaaatctcacagcgagaaagcccatggccatggcgcatcgcggaaggagaccccgcagttctttccgtccagccccccaccacactctcctctgtctcacggtcatatcccatcagctattgtcctccctaacgcgacacacgattacaacacgagcttcagtaatagtaacgctcataaggcagagaaaaagcttcagaatatcgaccatcctttgaccaaaagcagcagtaaaagggaccatcgccggtctgttgacagccgcaacacgcttaatgatctgctgaagcatctgaatgatccaaactccaaccctaaagctatcatgggggatatccagatggcccaccagaacctcatgttagatccaatggggagcatgagcgaagtaccccctaaagtccctaatcgcgaggccagtctctactcccctccttcaaccctgccccgcaatagccccacaaagcgcgttgacgtgcccaccaccccaggagtcccaatgacctctctggaacgccaacgagggtaccataaaaacagtagccagaggcacagcatcagcgctatgccaaaaaaccttaacagtccgaacggggtgctcctgagccgacagccttccatgaataggggagggtatatgcccacccctaccggggccaaagtggactacattcagggaacacccgtttccgttcacctccagccatctctctctcgacagagttcctatacctctaacggcacattgcccagaacaggcctcaagaggacaccgagcctgaagccagacgttccaccaaagcccagcttcgtaccccagactcctagcgtcagacccctcaataagtatacttattag

SEQ ID NO: 29919 - DNA, 3054 bp, Artificial Sequence
  Description of Artificial Sequence: Synthetic coding sequence
atgcgagtgttcctcctctgtgcctacattctgttgctgatggtgtctcaactgcgcgctgtgtccttccctgaagacgacgagcctctgaatacagtagattaccattatagtcgccagtaccccgttttccgcggccgaccaagtggcaatgagtcacagcatcgactggattttcagctcatgctgaaaatccgtgacaccctctacatagcaggtcgcgatcaggtatacacggttaatttgaacgaaatgccaaaaaccgaggtgatcccaaataaaaagctcacctggagatcccggcagcaggaccgtgagaactgcgccatgaaaggcaaacacaaagacgagtgtcataactttattaaggtgtttgtgccacggaatgatgagatggtcttcgtctgcggcactaatgcattcaatccaatgtgcaggtattataggctgagcactttggaatacgacggggaggaaatctctggccttgcgcgctgccccttcgatgctcgtcagacaaatgtggctcttttcgcagatggcaagctttactccgccaccgtcgccgactttctggcgtctgatgccgtgatctatcgttcaatgggcgacggttctgcccttaggacaataaaatatgattccaagtggatcaaggaaccccacttcctacacgcaatcgagtatgggaattatgtgtatttcttctttcgagagatcgccgttgagcacaataacttgggtaaagctgtgtactctcgtgtggcaagaatctgtaagaacgatatgggcggctcccagcgagtactggagaaacactggacatcctttttgaaagctcggttgaactgcagcgtgcccggcgacagttttttctactttgacgtgctccagtccattactgatattattcagattaacggcatccctactgtggttggcgtctttactacacagctgaatagtattccggggagtgctgtttgtgccttttccatggatgatattgagaaggtattcaaaggccgattcaaggagcagaagacccctgactccgtatggacagctgtgcctgaagataaggtccccaaacccagaccaggatgctgcgctaagcatgggctggcagaggcctataaaacttccattgacttccccgatgagaccctaagttttattaagtcccatcccctgatggactcagccgtccccccaattgctgatgagccttggtttacaaagacaagagtgaggtatcgactcaccgccataagtgtagaccactccgcaggaccttaccagaattacacagtcatattcgtgggtagtgaggccggtatggttctgaaggtgttagcaaagacatctcccttttccctcaacgactcagtgttgctcgaggagattgaggcttataaccacgcgaaatgctcagccgagaatgaagaagataaaaaagtgattagccttcagctcgacaaggatcatcacgccttatacgttgctttctcgtcctgtatcattaggattcccctgtccagatgcgaacggtacgggtcatgtaaaaagtcctgcatagcgtcccgtgacccatactgcggctggctgtctcaaggttcctgtggcagagtgaccccggggatgcttgctgaaggatacgaacaagatacagagttcggaaataccgcacatctgggcgactgtcatgagatccttcccacctctactacccctgattacaaaatctttggtgggcccacaagcggtgtgcgatgggaggtccagtctggcgaatctaatcagatggtgcatatgaacgtgttaattacatgcgtttttgccgcgttcgtcctcggtgcgttcattgcaggggttgctgtatactgttacagggacatgttcgtgaggaagaataggaagatacataaagacgcagagagcgctcagtcatgcactgactccagtgggagctttgccaagctgaatgggctttttgactcgccagtcaaggaatatcagcaaaatatagattcacctaaactttatagtaacctgctgacatctcggaaagagctgccaccaaacggtgacactaagtcgatggtcatggaccaccgcggacagccaccagaattagccgctctgccaacacccgagtctactccagtgctgcaccagaagactcttcaagcaatgaaatcgcactcagagaaggctcacggccatggggcgtccagaaaagagacaccccagtttttccctagtagcccacctccccacagccccctgtcgcatggacatatcccttcggctatcgtgctgcctaatgccacgcatgactataatacatctttctccaatagcaacgcacacaaggcagaaaagaagcttcagaacattgaccatcccctgaccaaatcatctagcaagcgggatcatcgtagatctgtggattcccgcaatactctgaacgacctgctgaagcatctgaatgatcctaatagcaaccccaaagccattatgggcgacattcagatggcccaccagaatcttatgctggatccgatgggttctatgtccgaggttccaccaaaggtgccgaaccgcgaagcatccctgtactctcctccctctacacttcctaggaattctccgactaagcgggtagacgtgccaactactcctggtgtaccaatgacctctctggagcgccaacgagggtaccataagaattcatcgcagcgtcactcgatctctgcaatgccaaagaatctgaattcacccaacggtgtactgctgtctcgccaaccttccatgaaccgcggcggctatatgccgaccccaaccggcgccaaagtggactatatacagggaacccctgtctccgtgcacctgcagccaagcctgtccaggcaatcatcctacactagcaacggtacacttcctaggactggtcttaaacgtaccccttccctcaaacctgacgttcccccgaagccttcattcgtccctcagacacctagcgtccggccccttaacaaatatacctactag

SEQ ID NO: 29920 - DNA, 1794 bp, Artificial Sequence
  Description of Artificial Sequence: Synthetic coding sequence
atgcgggtctttcttttgtgcgcctatattttgctactgatggtgagccaactgagggctgtaagctttccggaagatgacgagcctttgaacaccgtagactaccattattccagacaatatccagtcttccggggccggccaagcggaaacgagtcgcagcatagactggacttccaattgatgctgaagatacgggacacactctacatagccggcagggatcaggtgtatactgttaaccttaacgaaatgcccaagacggaggtgattcctaataagaagctaacctggagatcgcggcagcaggatcgcgaaaactgcgccatgaagggcaagcacaaagacgaatgtcacaacttcattaaggtgttcgtgccgagaaatgacgaaatggtcttcgtttgtggcacaaacgctttcaaccccatgtgcagatactatcggttgagtaccctggagtatgacggagaggaaatctctgggcttgccaggtgtcccttcgacgctagacaaactaacgtagcacttttcgctgacggcaaactctattccgccactgtggctgacttcctggcttcagatgcagtgatctatcgatctatgggcgacggatcagccctccgaactatcaaatatgactccaaatggattaaggaaccacactttcttcatgccatcgaatatggcaattacgtgtatttttttttccgggagattgccgtagagcacaacaacctgggcaaagcagtttactctcgggtggcacggatctgtaagaacgacatgggcggcagtcaacgcgtgcttgagaagcactggacttctttcctgaaagcccggctaaattgttcagtccctggcgattcgtttttttattttgatgtcctgcagtccattactgacatcatccagattaatgggattcccacagttgtcggagtatttaccacgcagttgaactccattccaggatccgcagtctgcgcctttagcatggatgacatcgaaaaagtgttcaaagggaggtttaaagagcagaaaaccccagactcagtttggacagcagtgccggaggacaaagttcccaaaccccggccaggctgctgcgccaaacatggactggccgaggcctacaaaacttccatcgattttccagacgagaccttatctttcatcaagtcccacccactaatggactcggctgtgccacccatcgccgatgaaccgtggttcaccaagacccgagtgagatacaggctcaccgcaattagcgtggaccatagcgcgggcccgtatcagaattataccgtaatttttgtgggcagcgaggcaggaatggtgctgaaagtactggcaaaaacctcgcctttctctctaaatgacagcgtcctattagaggagattgaagcatacaaccacgcaaaatgttcagccgagaatgaagaggacaaaaaggttatctctcttcagctcgacaaagaccaccatgcactctacgtggctttctctagttgcataattcggatacccctgtcaaggtgcgaacgctacggtagttgcaagaaatcttgcattgcctcccgcgatccttactgtggatggcttagccagggaagttgcggacgcgtgacacctggaatgctggctgagggctacgaacaagataccgaattcggtaataccgctcatcttggggactgtcatgatatggaagtgtcctcctcttccgtgaccactatggtttacgatggtaaaagctctttagaatcacccacccggtggtcgacttag

SEQ ID NO: 29921 - DNA, 3036 bp, Artificial Sequence
  Description of Artificial Sequence: Synthetic coding sequence
atgagggtgttcctcctgtgtgcctatattctgctgttgatggtgtctcagctcagggcagtgagttttcctgaagacgacgagcccttaaatacagttgactatcattacagcagacagtatcccgtgtttcggggtcgtccatcgggaaatgagagtcagcaccgccttgatttccagctaatgctgaagatcagagatactctctacatagcaggccgggatcaggtgtatactgtcaacctaaatgagatgcctaaaaccgaagtgattccaaataagaaactgacctggcgaagtaggcagcaagacagggaaaattgcgccatgaaagggaagcataaggatgagtgccacaattttattaaggtgtttgtcccacgcaatgatgagatggtgtttgtgtgtgggactaacgcctttaacccaatgtgccgctattatcggctgagcaccctagaatacgacggcgaggagattagcgggcttgctcgctgtccattcgacgcacggcagacaaacgttgcattgtttgctgatggaaaactctatagcgccaccgtggctgactttcttgcttccgacgctgtgatttatcgcagcatgggcgatggctcagcgctgcgcactattaagtatgatagtaagtggattaaagagcctcattttctccacgccatcgagtacggcaattatgtttacttcttttttcgcgaaatcgctgttgagcataataatctgggaaaggccgtctatagtagggtggcgaggatttgtaaaaacgacatgggcggttcccagcgagtgttggagaagcattggacttctttccttaaagccaggcttaactgcagcgttcctggtgactcctttttctattttgacgtcctgcaaagtatcacagacatcatccaaattaatggtatcccaaccgttgtgggagttttcactacccagctgaatagtatccccgggtccgccgtttgcgctttctccatggacgacattgaaaaggtgtttaagggccgttttaaagaacaaaaaacgcctgattccgtctggacagccgtcccagaggacaaggtaccaaaacccagacctggctgctgcgcaaaacacggtcttgccgaggcctacaagacctccattgattttccggatgaaaccctcagctttattaaatcccatccactaatggactccgctgtgccccccattgctgatgagccttggttcactaaaactagggtgagatacaggttgactgctatcagcgtggaccattccgctgggccctaccagaactacactgtgatcttcgtcggatcggaagccggaatggtactcaaggtcctggccaagacttccccatttagccttaacgatagcgtgctactggaagaaattgaagcttataatcacgccaagtgttctgccgagaatgaggaagataagaaggtgattagtttgcagctagacaaggaccatcatgcactgtatgtggcttttagcagctgcattatccgcataccactttctagatgcgaaagatatggcagttgtaagaaaagttgcattgcgtcaagggatccctactgtggctggttatcacaggggtcctgtggacgcgtcactcccggaatgttgcttctcacggaggacttcttcgctttccacaaccatagcgccgagggttatgagcaggatacagaattcgggaacacagcccatctcggcgactgccatggtgtgcggtgggaggtgcaatctggcgagtctaaccagatggtgcacatgaacgtcctaattacctgtgtgtttgcagcgtttgtcctgggcgcgttcatagccggagtggctgtgtattgttatcgagacatgttcgtgagaaagaacagaaagatccataaggatgccgaatccgctcaatcttgcactgactccagtggctctttcgcaaaacttaacggactgttcgactcccctgtgaaagagtatcagcagaacattgactctccaaagctttattctaacctcctcacgtcgcgtaaagaactgccacctaacggagacacaaagtcaatggtgatggatcatcggggccagcctccagagctagctgccctgcccactcctgaatccacacccgtactgcatcagaagacactccaggcgatgaaatcacattcagaaaaggctcatggacatggtgcctcccggaaggagacaccacagttcttcccatcatcaccacctccgcacagccccctcagtcacgggcatattccatccgctatcgtattgccaaatgcaactcatgattataacacaagtttcagcaacagcaatgcacacaaggcggaaaagaagctccagaatattgatcatcctctcacgaagtcctcatccaagagagaccataggcgaagcgttgactcccggaatactctgaatgaccttttaaagcatctcaatgatcccaactctaatcctaaggcaatcatgggtgacatccaaatggctcaccagaacctaatgcttgacccaatgggctcaatgagcgaagtacccccaaaggtgcccaaccgggaggcctccttatacagccccccttcaacccttcctaggaacagcccaaccaagagggtggacgtgcccacaaccccaggcgtcccaatgacttcattagagagacagcgcgggtatcataagaactcatcacaacgccacagcatctcagccatgcctaagaacttgaactccccaaacggagttctgttaagtcgtcagccttctatgaaccgtgggggttacatgcctacacccacgggggctaaagtggattatattcagggcactcctgtaagtgtgcaccttcagcccagtttgtccaggcagagttcttatacgtcaaatggtactctgccacgcacaggactcaaacggacaccatcattgaaacctgatgttcctcccaaaccgtcgtttgtcccacagacgccttccgtgcggcctttgaataagtacacatattag

SEQ ID NO: 29922 - DNA, 1431 bp, Artificial Sequence
  Description of Artificial Sequence: Synthetic coding sequence
atgagggtgttcctcttatgcgcgtatattctgttgttgatggtgagtcaacttagggccgtaagcttcccagaagacgacgagcctttgaataccgtcgattaccattatagcagacaatacccggtttttcgcggaaggccgtccgggaatgagtcccaacaccgattagatttccagcttatgttgaaaattagagatacactctacattgcgggtcgtgaccaagtgtataccgtcaatttaaatgaaatgcccaagactgaagttattccaaataagaaactgacttggagatcacgccagcaggaccgggagaactgtgcaatgaagggaaagcacaaagatgagtgccacaactttataaaggtgttcgtcccccggaacgacgaaatggtattcgtatgcggtacaaacgcattcaaccccatgtgtcggtactataggctctctacattggaatatgatggagaagagattagtggcttggcacgctgtccctttgatgccagacagacgaacgttgcgttatttgccgatggcaagctgtactccgccacggtcgctgactttctcgcttctgacgccgtgatttatcgctcaatgggcgacgggtccgcgctccggacaattaagtacgactccaagtggatcaaagagcctcacttcctgcatgccatcgagtatggaaattatgtctacttctttttccgggaaatcgcagtcgaacacaataaccttgggaaggctgtctacagtagagttgctagaatttgcaagaacgacatgggcggcagccagagggtccttgaaaagcattggacaagctttcttaaggcccgtctgaactgctccgtacccggcgactcgttcttctatttcgacgtgttacagtctattacagacatcattcaaattaatggcattccaacagtagtcggtgtgtttacaacacagctgaacagtatccctggctctgccgtgtgtgccttcagcatggatgatatagagaaggtgttcaagggacgctttaaggagcagaaaactcccgatagcgtgtggaccgctgtcccagaagataaagttccaaagcctcggccggggtgttgtgcaaagcacggcctggccgaggcatataagaccagcatcgattttcctgacgaaacattatcttttatcaagtcgcatcctctcatggatagcgcagttccccctattgcagacgagccgtggttcacgaagactcgtgtaagatatagactcacagccatttcagttgaccacagcgccggaccataccagaattacaccgtgatatttgttggctcggaagctggaatggtgctcaaggtgctggcgaagacatcgcccttttccctgaacgacagcgtcctgttggaagagattgaggcctacaaccacgcaaaatag

SEQ ID NO: 29923 - DNA, 2997 bp, Artificial Sequence
  Description of Artificial Sequence: Synthetic coding sequence
atgcgggttttccttctgtgtgcctatattctgcttttgatggtgtcgcagctgcgcgccgtgagtttccctgaagacgatgagcctttaaacacagtagattaccattattcacgtcaatatcccgtgttcagagggcggccttcaggaaacgagtcccagcataggcttgattttcagttgatgcttaagattcgcgacacactgtatatagcaggcagagaccaggtatacacagtaaatctgaatgagatgccaaagacagaggtgatccctaacaaaaagctgacgtggcgctcccggcaacaggaccgagaaaactgtgcgatgaaggggaagcataaggacgagtgtcacaacttcatcaaagtcttcgtgcctcgaaacgatgagatggtgttcgtgtgcggtacgaacgcattcaaccctatgtgtcgctactacaggctgagtactctggagtacgatggtgaggagatcagcggccttgccaggtgcccctttgatgccaggcagacaaatgtcgcactgtttgccgacggtaagctttactcggccacagtggctgactttctcgcctcagacgctgtgatttatcgatccatgggtgatggaagcgctctacgcactatcaaatacgacagcaagtggataaaagagcctcactttcttcacgcaatcgagtatggaaactacgtgtatttttttttccgcgaaatcgccgtggaacacaacaacctgggcaaggccgtctattcaagagtagcacgtatctgcaagaatgatatgggcggttcccaaagggtgctggaaaagcattggaccagctttctgaaagctcgacttaattgcagtgtaccgggcgactcgttcttttatttcgacgtattgcagtctattacagatatcatacagatcaacggcattcccactgtggtgggggtcttcaccactcagttgaatagcatcccaggctctgctgtgtgcgccttttcaatggacgacattgaaaaggtctttaaggggcgtttcaaggagcagaaaacccccgattccgtgtggacggcagttcccgaggacaaggtgcccaagccacgccctggatgctgtgcgaagcatggactagctgaggcctacaaaacatctattgactttcccgacgagaccctatcctttattaagtcccacccgctcatggacagcgctgtaccacccatagctgacgaaccatggttcacaaagactagagtgaggtatagactgaccgccatttctgttgaccactccgctggaccttatcagaattacacagtgatcttcgtggggtctgaagctggcatggtgctaaaagtgctggctaagacctcccctttctccctcaatgatagtgtgctgctcgaagagattgaggcgtacaaccatgcaaagtgctcagccgagaatgaggaggataagaaggttatctccctccagttggataaggaccaccatgccttgtatgtcgcatttagtagctgcatcatcagaatcccactctcacgctgcgaacgatatgggtcttgtaagaagagttgtatcgcttcacgagatccttactgcggttggttatcacagggatcttgtggcagggtgacccctggcatgttggcggaaggctatgagcaggacacagagtttggcaataccgcacatcttggcgattgtcacggagtgcggtgggaggtgcagtctggtgagtccaaccagatggtgcacatgaatgtcctaataacatgcgtattcgccgcctttgtgctgggggcttttatcgccggcgtagccgtgtactgctatagagatatgtttgtgaggaagaatcggaagattcacaaggacgcagagtcagcccagtcctgtactgactccagcggctcttttgccaagctgaacggtctgtttgatagtcccgtgaaagaatatcagcaaaacatagacagtccgaagctatactccaacttactcacctctcgcaaggaactacctcctaatggcgacaccaagagcatggtgatggatcacagagggcagccccccgagttggcagctttaccgacccctgagtctacacccgtgcttcatcaaaaaacactgcaggccatgaaaagccattccgagaaggctcacggtcatggcgcttctaggaaagaaaccccacagttctttcctagctctccccccccccactcacccctctctcacgggcacatcccaagtgcaattgtcctgcctaacgccacccacgactacaacacctcgttttcgaactccaacgcccacaaagccgagaagaagcttcagaatattgatcatccccttaccaaatcttcttctaaacgggatcatcgacgatccgttgattcccggaacacattgaacgatctattaaagcacctgaatgatcccaactcaaacccgaaggctattatgggtgacatacagatggcacaccagaatctcatgctggatccaatggggtcgatgagcgaggtacctcctaaagtcccaaatcgggaggcaagcctctatagcccgcccagcaccctcccccgcaacagtcctactaagagagtggacgttcccacaactccaggggtgccgatgaccagcttagaacggcagcgtggttatcacaagaatagctcccagagacacagcatttccgcgatgcctaaaaatttgaactctcctaacggcgttctgttgagcaggcaacccagtatgaatcgaggaggctatatgccaacccccaccggggccaaggtcgattacatccagggcactcccgttagcgtccatctgcaaccaagcctgtccagacagagcagctatacgtctaacggtacgctacctaggaccggtctaaaaaggactccctcgcttaaaccggacgttcctcctaagccgtccttcgtgccgcagactccgtccgtcaggcctctgaataaatatacatactag

SEQ ID NO: 29924 - DNA, 3093 bp, Artificial Sequence
  Description of Artificial Sequence: Synthetic coding sequence
atgcgtgttttcctgttgtgcgcatacatcctgctgctgatggtcagccagcttcgggcagtgtcttttccagaggatgatgaacctctgaatactgttgactaccactattctagacagtaccccgtgttccgcggaagaccttcggggaatgaatctcagcaccggctggacttccaactaatgttaaaaatacgggacacactgtatatcgcgggaagggatcaggtctatactgtcaacctgaacgagatgcctaagacagaagtgatccccaataagaagctaacctggcggtcccggcaacaggacagagaaaactgcgcaatgaagggcaagcacaaggacgagtgccataacttcatcaaagtgttcgtcccaagaaacgatgagatggtatttgtctgcggtacaaacgcattcaatcctatgtgcaggtattaccgcttatcaactctggaatacgacggcgaggagatcagtggtctcgcccgctgccctttcgatgcgaggcagactaacgtcgcgctctttgcagacggcaaactctattccgctaccgtggcagactttctggcttcagatgcagtgatctaccgttcaatgggagatggctctgcactgcggaccatcaagtacgactctaagtggataaaagaaccacatttcctccacgccattgagtacgggaattatgtgtacttctttttcagagaaattgccgttgagcacaataatcttggaaaagcggtgtacagccgagtggcccgcatctgcaagaatgatatgggggggagccagcgggtgcttgaaaagcattggacatcctttctgaaggccaggctaaactgctcggtacccggggattcttttttttactttgacgtcctgcagtcgattaccgacattatacagatcaatggaatccccaccgtggttggagtgtttactacgcaactgaattccatccccggctcggcggtctgcgctttctccatggacgacattgaaaaagtgttcaagggtaggttcaaagagcagaagaccccagatagcgtctggacggctgtccccgaggacaaggtacctaagcctagacccggctgttgcgcaaagcacggactcgccgaggcttacaaaacttctattgattttcccgacgagacattatctttcatcaaatcccacccgctaatggactccgctgtaccgcccatcgctgatgaaccgtggtttactaagactagagtccggtacagactcacagcaatcagcgtcgaccacagcgcagggccgtaccagaactacacagtgatcttcgtcgggtcggaggccgggatggtcctaaaagtcttagcaaagacctcaccgttttccctgaacgactcagtgctgcttgaagagattgaagcttacaaccatgccaagtgcagtgccgagaatgaggaggacaaaaaagtcatttctctgcagcttgataaggatcaccatgctctctatgtggcgtttagttcctgtatcattcgcatacctctatcgcgttgtgagaggtacggatcgtgtaagaaatcttgtatcgctagccgtgatccatactgcgggtggctgtcccaagggagctgtggacgggtaacacctgggatgttgctcctgactgaagacttcttcgcctttcataatcacagcgcagagggctatgagcaggacaccgaattcggcaacactgctcacctcggggactgtcacgagattctaccaacatcaacgaccccggattacaagattttcggcggcccaacgtccggcgtccggtgggaagtgcagtccggcgaatctaaccagatggtccatatgaacgttttaatcacctgcgtattcgccgcattcgtgctgggagccttcatcgcaggggtggcggtctattgctatcgggatatgttcgtgcgtaagaacaggaagattcacaaggacgcagaaagcgcacagagctgcactgacagtagtggatcttttgcaaagctgaacggactctttgactcaccggttaaggagtatcagcagaatatcgactccccgaaactgtacagcaacctcttgaccagtcggaaagagcttccaccaaatggcgacacgaagagcatggtgatggaccatcgaggtcagccgcccgaactcgctgcactccccacgcccgagtccactcccgtgttgcaccagaaaacactacaggccatgaagtcccacagtgagaaggcgcacgggcacggagccagtaggaaggaaactccccagttcttcccctcaagtcctccgccacactctcccctttcacacgggcacattcccagcgcaattgttctcccaaatgctacacacgactataatacgagcttctctaattcgaacgcccacaaggcggagaagaagctgcaaaacattgaccatccacttacaaagagctccagtaagcgcgaccatcgacgctctgtggactctcggaatactcttaatgatctattgaagcatcttaacgatcctaactcaaaccctaaggccataatgggtgatatccagatggcccatcagaatctaatgttagatcccatggggtctatgagcgaggttccccctaaggtacctaatagggaggctagcttgtattcacccccatccactctcccgagaaatagtcctaccaaacgtgtggacgtccccaccacccctggggtgcccatgaccagcctggagaggcaacgaggctatcacaagaattccagccagaggcattcaatctctgcaatgcctaagaacctcaacagtccaaacggtgtgctgctgagcagacagccgtccatgaacagggggggatacatgcccacccccaccggggccaaggtggactacattcaaggcacacccgtgagtgtgcatttacagccatccttgtctcgtcagtccagctatacatcaaatggcactctcccccgaacaggccttaagagaacgcctagtctcaaacccgacgttccccccaagccgagctttgtgccacagacaccttctgttagacccctgaataagtacacatattag

SEQ ID NO: 29925 - DNA, 3165 bp, Artificial Sequence
  Description of Artificial Sequence: Synthetic coding sequence
atgagagtctttctcttgtgcgcctacatcctattactgatggtgagccagttgcgggcagtgtcttttcccgaagacgacgaacctctgaacacagtagattatcactactctaggcaatatcccgtttttagaggcaggccctcgggcaacgaatcccagcaccggttggactttcagcttatgctcaagatcagagatacgctgtatatcgccggccgcgaccaggtctataccgtgaatctgaacgagatgcctaagaccgaagtaataccaaataaaaagctaacctggcgctcacggcagcaggatcgggaaaactgcgcgatgaaaggtaagcataaagacgagtgccacaacttcataaaagttttcgtgcctaggaacgacgagatggtgttcgtgtgcggtaccaacgcctttaatcccatgtgcaggtactaccgcctgagcactcttgagtacgatggtgaggagatcagcggtctggcacgctgcccattcgacgccaggcagacaaacgtggccctgtttgctgacgggaagttatactccgccacggtggcagatttccttgcctctgacgccgtgatctaccgaagcatgggagatggcagcgctctgagaacaatcaaatacgattcaaagtggatcaaggagccccacttcctgcacgcaattgagtacggaaattacgtgtacttcttttttcgtgagatcgccgtggagcataacaaccttggcaaagccgtatactcccgggtggctcgcatctgtaaaaacgatatgggaggttcacagcgcgtgcttgagaaacactggacaagtttcctaaaagcacgcctgaattgttcagttcctggggattcgttcttctactttgatgttctgcagagcataactgatattatccagattaatggaattcctactgtggtgggtgtgtttacaacacagcttaatagcataccgggcagtgcagtctgtgccttctcgatggacgatatcgaaaaggtgtttaaaggaagattcaaggagcagaagaccccggatagcgtatggacggcagtaccggaggacaaagtccccaagccacggccgggctgttgtgccaagcacggactcgccgaagcttataagactagtatcgatttccctgatgaaacactgagctttatcaagtctcatccattgatggattccgctgtgccccccattgctgacgaaccatggtttactaaaacccgcgtgaggtatcggttgacagctatcagtgtagaccacagcgctggtccataccaaaactatactgtaattttcgttggaagtgaggccggtatggtgctaaaagtgctggcaaaaacaagcccatttagcctgaacgattcagtgcttctcgaagaaatagaggcttataatcatgcaaagtgtagcgctgagaatgaggaggacaaaaaagtgatatctctacagctggataaggatcaccacgccctgtacgtggctttttcttcttgtattattagaatacctctttcaaggtgcgaaaggtacggcagttgtaaaaagagctgcattgcctctcgggacccttattgtggttggctctcccaagggtcatgcggccgcgtaacacccggaatgctagccgagggctatgaacaggacaccgaattcggcaacactgctcatctaggggactgccacgacatggaggtgtccagctcctccgtaactaccatggctagcattcctgagataactcccaaagtgatagacacatggcggccaaaactcacgtcaagtcgaaaatttgtggtgcaggacgaccccaacactagtgactttactgatcctctgtccggcatccccaagggggtcagatgggaggtccaatcgggcgagagtaaccagatggtgcatatgaatgtgctcattacatgtgtgttcgccgccttcgtcctcggggcctttatagccggcgtggccgtatattgctaccgtgacatgttcgtacgtaagaatcggaagatccataaagatgctgaaagtgcgcagtcttgtacggactcctctggcagctttgccaaactgaatgggcttttcgacagtcctgtgaaagaataccaacagaacattgacagtccaaaactgtattccaacttactcacttcgcgcaaagagctgccgcctaacggagataccaagtccatggtaatggaccaccggggtcagccccccgagctggctgcactgcccactccagaatctacgccggtgctgcatcaaaagactcttcaggccatgaagtcccacagcgagaaggcccacggccacggcgcctcgagaaaagaaaccccacagttcttcccatcaagcccacctccacattctccgctcagccacggacatattccctcggcaatcgtgctgcccaacgcaacacatgattataacacatcattctctaactctaacgcccataaggccgaaaagaagctgcagaacattgaccaccccctgacaaagagttcctccaaaagagaccatcggcgatcagttgactctagaaatactctaaacgatctcttgaagcatcttaacgatcctaactcaaaccctaaggcaattatgggtgatattcagatggcacatcagaatctgatgttagatccaatgggctctatgtcagaagtgcccccgaaagtgcccaacagggaagccagcctttattcaccaccctccactttgccacggaacagcccaacgaagcgcgtcgatgtccctacgacgcccggggtgcctatgacatctctagagcggcagagggggtatcataagaactcgtcacagaggcacagcatttcagcgatgcctaaaaacttaaacagcccaaatggtgtattgctctctagacagccctccatgaataggggtggctacatgcctacccccaccggagccaaagtcgattatattcagggtacacccgttagcgtccacctccagccctccctgtctcggcagtcttcttacaccagtaatggtactctaccacgtacaggcctgaaacgcacaccctcgcttaaacctgatgtacctcctaagccaagctttgtcccccaaaccccctcagtccgccccttgaataaatacacatattag

SEQ ID NO: 29926 - DNA, 3222 bp, Artificial Sequence
  Description of Artificial Sequence: Synthetic coding sequence
atgagggtcttcctcctttgcgcctacattttgctccttatggtttcgcaactgagagcagtgtcgtttcctgaggacgacgagccgctgaatacagtggactatcactacagccgccagtaccctgtcttcaggggtagaccaagcggcaacgagagccagcaccgactggactttcagctcatgcttaaaatacgggacacgctttacatcgcagggagagatcaggtctacaccgtgaatctgaacgaaatgcccaagactgaggtaatccccaacaagaaattgacctggagatctcgacaacaggatagggaaaactgtgccatgaagggcaagcacaaggacgagtgtcacaatttcatcaaagtgtttgttcctcgaaacgacgaaatggtattcgtgtgcgggacaaacgcctttaatccaatgtgtcggtattataggttgtctactcttgagtatgatggggaggaaataagtggcttagctaggtgtccgtttgatgcccggcagacaaatgttgccttatttgcggacggcaagttgtactctgctaccgtggctgacttcctcgctagtgatgccgtgatttacaggagcatgggagacggcagcgctctcagaactataaagtacgacagtaagtggattaaggaaccccatttcttgcatgcaatcgagtatggcaactacgtgtattttttcttccgggagattgcggtagagcacaacaatctcgggaaggcggtctacagccgcgttgcacgcatttgtaagaacgatatgggaggttcacagcgggttttggagaaacattggacaagcttcctgaaagcgcggctcaactgcagcgtgcccggcgactctttcttctattttgacgtactccagagcattaccgatattatccaaataaatggcattcctacggtagtaggggttttcacaacccagctaaactccattccaggatctgccgtatgtgccttctctatggacgatattgaaaaggtattcaaaggacggttcaaggagcaaaaaactccggattcggtgtggacagcagtcccagaggataaggtgcccaaaccacgacctggctgttgcgctaaacacggactcgcggaggcctataagacctcaatcgacttccccgacgaaaccctgtcattcatcaaaagtcacccactgatggacagcgctgttcctcccattgctgatgaaccgtggtttaccaagacaagggtccggtaccgattgactgcaatttccgttgaccactccgctggcccttaccagaattacactgttattttcgtcggctccgaggccgggatggtgctgaaggtcctggcaaaaacctcccctttcagcttgaacgattcagtcctgctcgaggaaatagaagcttataaccacgctaagtgtagcgctgaaaatgaggaggataagaaagtgatctcattgcagctggacaaggatcaccacgccctttatgtggcctttagcagttgtattatccggatccccctgtctcgatgcgagcgctacgggtcctgcaagaagagctgcatcgcatctcgcgacccgtactgcggttggctcagccagggctcttgcggacgcgtaactcccgggatgctcgccgagggttacgaacaagatacggagttcggtaatacggcccatcttggggactgtcacgagatcctgcccacctccactactcccgactacaaaatctttggaggcccaacttctgacatggaagtttccagcagcagcgtgaccacaatggcatccattccggagataacaccgaaggttatagatacgtggcgcccaaaactcacctccagccgtaagtttgtcgtccaagacgatccaaacactagcgacttcactgatccacttagtggaatccctaagggcgtgcgctgggaagtacagtctggcgagagtaatcagatggttcacatgaacgttctcatcacatgcgtgttcgcggctttcgtgttgggtgcgtttatcgcgggtgtagccgtgtactgttaccgcgatatgtttgtgcgtaaaaacagaaagattcataaggacgcagagagtgctcaaagttgtactgactcctcagggagctttgcaaagttaaatggtctgtttgacagcccagtgaaggagtatcaacagaacattgattccccaaagctgtactcgaacttgctgactagccgtaaggagctgccccccaatggagacaccaaatcaatggtgatggatcaccgggggcaaccacctgaactcgccgctcttccaactcccgagtctacccccgtgctacatcaaaaaacattacaggctatgaagtcccactcagagaaggcacacggtcatggagcctcaaggaaagaaacacctcagttctttccatccagtcctcctccgcacagtccgctgtcgcatggccatattccaagtgccatcgtgctgcccaacgccactcacgattataacaccagtttttccaattcgaatgcccacaaagctgagaagaaattgcagaacatagaccaccccctcacgaagtccagctccaagagagaccataggcgtagcgtggactcacgcaatacccttaacgaccttttaaagcacctcaatgaccccaattcaaaccccaaggccatcatgggcgacatccaaatggcccaccaaaacctgatgttggatcctatgggaagcatgagtgaagtcccccctaaagtcccaaaccgagaggcatccctatattcaccaccatccacactccccagaaattcccctaccaagagagtggatgtgcccactacccccggcgttccaatgacaagtctggagcggcaacgcgggtaccacaagaactcttcgcagaggcactctataagtgccatgccaaagaacctgaactcccctaatggcgtgctcctcagtcgccagccgtcaatgaatcggggaggctatatgcctacacccacaggagctaaggtggattacatccaaggcacgccggtcagtgttcacctgcagcccagcctgagccgacaaagttcttacacttccaacggtactctacctaggacaggactgaaacggactccgtcgctgaagccagacgtgccaccaaagccaagttttgtcccccagaccccttcagtgcggcccctcaataaatacacctattag

SEQ ID NO: 29927 - DNA, 3036 bp, Artificial Sequence
  Description of Artificial Sequence: Synthetic coding sequence
atgcgggtattcctactgtgcgcttacatcctgctcctgatggtctcacagctgcgggcggtcagttttcctgaagatgacgagccactcaacaccgtcgactatcactacagtcgccaatatcccgtgttccggggcagaccttctggtaacgagtcacagcacagactggatttccaactgatgctcaagattcgtgacaccctctatatcgccggtagggaccaggtgtacacagtgaacctaaatgagatgccaaaaaccgaagtgatcccgaataaaaagctgacatggaggtcccggcagcaggatagagaaaactgcgcaatgaaaggcaaacataaggacgagtgtcacaattttattaaggtgttcgtgcctcgcaacgacgaaatggtctttgtgtgtggcacaaacgctttcaaccctatgtgcaggtactatcgcctcagcacactagagtatgacggagaggagatctccggcctggcgaggtgtccgtttgacgcccggcagacaaatgtggcactgttcgccgatggcaagctttacagcgctactgtggctgattttctggcatcagacgctgtgatctacaggtcaatgggggatggttctgcactgcggacaattaagtatgatagcaagtggattaaggagccccacttcctgcacgcaatcgagtatggtaactacgtgtactttttcttccgcgaaattgccgtggagcataacaatctgggcaaagccgtgtactcaagagtggctcggatatgcaagaatgatatggggggatcccagcgggtgcttgagaaacattggacatctttcctcaaagcgaggctcaactgctcagtacctggtgacagcttcttttacttcgacgtgcttcagtccattaccgatattatccagatcaatggaataccaaccgtggtaggtgtctttacaacacagctcaacagcattcccgggagcgcagtatgtgcttttagcatggatgatatagagaaggtgtttaaaggacgatttaaggagcagaagacccctgactctgtctggactgcagtccctgaggataaggtgcccaaaccccgccctggctgttgtgcaaagcatggcctggccgaggcttataaaacaagcattgactttcctgacgaaactctgtccttcataaagagccacccactcatggattccgctgtgccacccatagccgacgagccctggttcaccaaaactcgcgtgaggtatcggctcaccgccatcagcgttgaccattcggctggcccttatcagaattataccgtcatcttcgtgggttccgaggccggcatggtcctgaaggtcttagcaaagacgagtccattctccctgaatgactccgtgcttctcgaagaaattgaggcttacaatcacgcaaaatgctccgcggagaacgaggaagacaagaaagtaatatcacttcaactcgataaggatcatcatgccctttacgtggcctttagcagttgtataatccgaattccattgtctcggtgcgagcggtatggttcttgcaagaagtcgtgtatagcctctcgagatccttactgcggatggctctctcagggctcttgtggccgcgttactcccgggatgctcctgttgacagaagatttctttgcattccacaatcattctgcagaaggctacgagcaggataccgaattcggtaatacggcccacctaggagattgtcacggagtgagatgggaggtccagagtggcgaatctaaccagatggtccatatgaatgtgcttattacatgtgtgttcgcagctttcgttctgggagcctttatagctggagttgctgtgtactgctaccgagatatgttcgtgcggaagaaccggaagattcataaagatgccgaatcggcacaatcctgcacagattcatccgggtctttcgccaagcttaatgggttgtttgacagccccgttaaagaataccagcaaaacatcgactctcctaagctctattcaaatctcctgacgagtcgcaaggaactccctcccaatggggataccaaaagcatggtgatggatcaccggggacagcctcccgagcttgccgcactccccaccccggaatcaacaccagtgctccatcagaaaaccctccaggccatgaaatcgcactcagagaaagcacacggtcacggcgctagccggaaagagactccacagttcttcccaagcagccctcctccacatagtcccctctctcacgggcacattccctccgccattgttcttccaaacgcaacccatgattataatacctccttcagcaacagcaacgcccataaagcagagaaaaaattacaaaacatagaccaccccctcacgaagagcagctcaaaaagagatcacagacggagcgtggactcaagaaatacccttaatgacctccttaaacacctcaatgacccgaacagtaaccctaaggcaattatgggggacatccagatggcccaccagaatctgatgctggatcccatgggaagcatgagtgaggttcctccaaaggtgccgaacagggaagcgtctctatactcccctccgagtacactgcctaggaactccccaactaaaagggttgacgtacctactacaccaggcgttccaatgacgtcactggagcgacagcgggggtatcacaaaaattcgagccagcgccactccataagcgccatgcccaagaatctcaacagccccaatggagttctgctgtccagacaaccctcaatgaaccgcgggggctacatgccgaccccaactggcgctaaagtggactatatccaggggacaccggtttctgttcatttacagccatcactgtcacgccagagttcttacacctccaacggtaccctgccacgaactggcctgaagcgaactccttccctaaagccagacgtgccgcctaagccatcctttgtgcctcagactccatcggtgagacccctgaataaatatacctactag

SEQ ID NO: 29928 - DNA, 3036 bp, Artificial Sequence
  Description of Artificial Sequence: Synthetic coding sequence
atgcgcgttttcctcttgtgcgcatatatcttgctactgatggtctcccagctccgagccgtgtccttccctgaggacgacgagcctttaaacacggtggactaccattactcccggcaatacccggtctttaggggccgtccatccgggaacgagtcccagcatcgcttggacttccagcttatgctgaagataagggatactctttacatcgccgggagagatcaggtgtacacagtgaacctcaatgaaatgccaaagacggaagtgatccccaataagaaattaacgtggaggtcccggcagcaggaccgcgagaattgcgctatgaagggaaaacataaagacgagtgtcataatttcataaaagtgtttgtgccacggaatgacgagatggtgttcgtgtgtggtactaatgccttcaatcccatgtgtagatattacaggttgtccaccttggagtacgatggagaagagatttctggactcgctcgatgtccatttgacgcgcgccagaccaacgttgccctgttcgcagatggcaagctgtatagcgccactgtagcagacttcctcgcctctgatgccgtcatctatcgcagtatgggggacgggagcgcactcaggactattaaatatgatagtaagtggattaaagagccacacttcttgcacgcaatcgagtacggaaattacgtatattttttttttcgagaaatcgccgtggaacacaacaatctcgggaaggcggtgtatagtcgtgtcgctagaatttgcaagaatgatatgggaggcagtcagcgggttctggagaagcactggacgagcttcctgaaggccagattaaattgctcagtgcccggggactcattcttttattttgacgtcctgcagtcaatcacagatattatacagatcaacggtatccccactgtggtaggagtgtttaccacccaactcaacagcatccccggatccgccgtttgcgctttctcaatggatgatattgaaaaagtatttaaaggcaggttcaaagaacagaaaacgcccgacagcgtgtggaccgccgtccccgaggacaaggtgcctaagccccgtccgggatgctgcgcaaagcatggtctagccgaagcttacaagacttcaatagactttccagacgagacactgtcatttataaaatcccacccgttgatggatagcgcagtgcctcctatagccgacgagccctggtttactaagacacgcgtgcggtatcggctcactgcaatctcagtagaccacagtgccgggccatatcagaactacaccgtcatattcgtgggaagcgaagccgggatggtgctcaaagttctggcaaagacctcaccattctcacttaatgattcagtgctgctcgaagaaatcgaggcatataatcatgcaaagtgttccgctgagaacgaagaagataagaaggtgatttccctgcagctggacaaggaccaccatgctctgtatgtggctttttcttcttgcatcatcaggattcctctttcccgttgcgagaggtacggaagctgtaagaagagctgtatcgcgtccagggatccctattgtggctggctgtctcagggatcctgtggccgtgtaacccctgggatgctgctgttgaccgaagactttttcgcgtttcacaaccattctgccgaggggtatgagcaggacactgaatttggaaatacagcccacttgggggattgccacggcgtgcgctgggaggtgcagtcgggtgaatctaaccagatggtgcatatgaatgtgctcatcacttgtgtcttcgccgcattcgtacttggcgcattcatcgctggcgtcgccgtctactgttatcgcgacatgtttgtccgcaaaaaccgaaagatacacaaggacgctgaatcagcccagtcatgtaccgactctagcggcagttttgccaaactgaatggattgtttgactctccagtgaaagagtaccagcaaaatatcgatagcccaaagttatactctaatctgttgactagtcggaaagagttaccccccaacggggatacaaagtcgatggtcatggaccatcgcggacagcccccagagttggctgcccttcctactcctgagagcactcccgtgttgcatcagaaaaccctccaggcgatgaaaagccacagcgagaaagcgcacggccatggtgcctcgcgcaaagagaccccgcagttcttcccctcatcccctcccccccactcccctcttagccatggtcacattccctccgccattgtgctgcctaacgccacccatgattataatacatctttctccaatagcaacgcccataaggctgagaagaagctccagaacatagaccatcctctgactaaatcaagctccaaacgtgaccaccgtcggagtgtggactcacgtaataccctcaatgatctgctcaaacacctcaatgaccccaatagcaatcccaaagcgatcatgggggacatccaaatggctcaccaaaatctgatgctggatcccatggggtctatgtccgaagtccctcccaaagtgcccaacagagaagccagcttatacagtcctccctcaacacttccccgcaattccccaacaaagagggtggatgtccctacaactccaggcgtgccaatgacatcgcttgagagacagcggggatatcacaaaaatagtagtcaaaggcattccattagtgcgatgccaaagaacttgaactctccaaatggagtcttattatcacggcaaccttccatgaatcggggaggctacatgcccacaccaactggggccaaggtggactatatccaaggcaccccagtgagcgtgcacttgcagccttctctgtcacgtcagagttcttacacttctaacggaactctgcctagaacgggactgaaaagaactccgtctctgaaacctgatgtcccccctaaaccctctttcgtgccccagacaccctcggtgcggcctctgaacaagtatacatactag

SEQ ID NO: 29929 - DNA, 1794 bp, Artificial Sequence
  Description of Artificial Sequence: Synthetic coding sequence
atgcgtgtctttctactctgtgcgtacattttactcttaatggtgagccaacttagggctgtcagctttcccgaagacgatgagcctctaaataccgtagactatcactattcccgccagtaccctgtctttcgcggccggcctagtgggaatgagtctcagcacagactggactttcaactcatgctaaaaatccgggatacactgtacatcgccggcagggaccaagtgtacaccgtgaacttgaacgaaatgccgaagacagaagtcatacctaacaagaaactgacctggcgaagccggcaacaagaccgtgagaattgcgcaatgaagggaaagcataaggacgaatgtcacaatttcattaaggtcttcgtcccccggaatgacgagatggtgttcgtctgcgggacgaacgcatttaatccgatgtgccggtattataggctatctacactggagtatgatggcgaggagatttctggtctggcccggtgtccctttgacgctagacaaacaaacgtggccctctttgccgacggaaagttgtattcagccactgtggctgacttccttgcgagcgacgctgtcatttaccgatccatgggcgacggatctgcactgcgcacgattaagtacgactcaaagtggatcaaagaaccgcacttcctgcatgccatagagtacggaaattatgtttattttttctttagggaaatcgccgtggagcacaacaatctggggaaggccgtctactccagagttgcccgaatctgcaaaaacgatatgggaggatctcagcgggttctcgaaaaacactggaccagctttctgaaggcccggctgaattgtagcgtgcccggcgactccttcttttatttcgatgtgttacagagcattaccgatatcatccagatcaacggaattcccaccgttgtcggggtgttcacaacacagctgaattctattccgggatccgccgtttgcgctttttcgatggacgatatagagaaggtgtttaaaggccggtttaaagagcagaagacgcctgacagcgtttggacggctgtgcctgaagacaaggtgcccaaaccgcgtcccgggtgttgtgcaaaacacggcctggcagaagcctataaaacctccatagatttccccgatgaaacgcttagcttcatcaagtcccaccctctgatggatagtgctgtcccccctattgcagatgagccttggttcaccaagactagagtacgctatcggttaaccgctatctctgttgatcattccgctggaccctatcagaattatacagtaatttttgtaggatctgaggcaggtatggtgctcaaggtgcttgcaaagacgagtcccttctctttgaatgattccgtattgctggaggaaattgaggcatacaatcacgccaagtgtagtgctgagaacgaggaagacaagaaggtgatctccctgcagctggataaagaccatcacgccctttacgttgctttttcatcctgcataatccggataccccttagccgctgcgagcggtatgggtcctgcaaaaaatcgtgcattgccagccgtgacccgtattgcgggtggttgagccaaggctcatgtggtagggtaacgcctggcatgctggcagagggctacgagcaagacacagaatttggtaacacagcacatctgggggattgccacgatatggaagtatcttcttcatccgtaaccacgatggtctacgatggaaagtcgtcccttgaatctcctacccgctggtcaacctag

SEQ ID NO: 29930 - DNA, 69 bp, Artificial Sequence
  Description of Artificial Sequence: Synthetic coding sequence
atgagggtattcctcctgtgcgcctacatcctactgctgatggtctcacaactcagagccgtgtcctag

SEQ ID NO: 29931 - DNA, 660 bp, Artificial Sequence
  Description of Artificial Sequence: Synthetic coding sequence
atgcgagtgttcctgctatgcgcttacatcctgctactgatggtctctcaactccgcgctgtttcattcccagaggacgatgagcctttgaacaccgtagactaccactactcccgccaatatcctgtgttccgtggccgcccatcggggaacgagtctcaacaccggctggactttcagctaatgctgaagataagagacactctttatattgctggccgggaccaggtgtacactgttaatctgaacgagatgccaaaaacggaggtgattccgaacaagaaacttacctggaggtcgagacaacaggacagagaaaactgcgcgatgaaggggaaacataaggacgagtgtcacaactttattaaggtgttcgtccctaggaatgatgagatggtatttgtgtgtgggaccaacgcgttcaatccaatgtgccggtattacagactgagcacgctcgagtatgatggtgaagagattagcggccttgcccgctgcccttttgatgccagacagactaacgtggctctattcgccgacggcaagctgtacagtgccacggtggctgacttcctagcatctgacgcagtaatctacagatccatgggcgacggatcggcactccggacaatcaagtacgattccaagtggatcaaatag

SEQ ID NO: 29932 - DNA, 6 bp, Artificial Sequence
  Description of Artificial Sequence: Synthetic coding sequence
atgtag

SEQ ID NO: 29933 - DNA, 447 bp, Artificial Sequence
  Description of Artificial Sequence: Synthetic coding sequence
atgcgagtatttctactgtgcgcctatatcctattgctgatggtctcccaactgcgcgccgtgtcttttccagaggacgacgaaccgctcaataccgtggattaccactactctcgacagtaccctgtgtttagaggccggccttcaggcaacgagtctcagcatcgccttgactttcagctcatgcttaagattagggatacactgtacatagctgggcgcgaccaggtgtataccgtcaatctaaatgagatgcccaagactgaggtaataccaaataagaagctgacatggagatcacgccagcaggaccgggagaattgtgcaatgaagggaaagcacaaagacgaatgccacaactttattaaagtgtttgtcccacggaatgatgaaatggttttcgtgtgcgggaccaacgcgttcaaccccatgtgtcgatattactag

SEQ ID NO: 29934 - DNA, 990 bp, Artificial Sequence
  Description of Artificial Sequence: Synthetic coding sequence
atggatggaccggttgctgaacatgctaagcaggagccattccacgtagtcactcctcttctggaatcctgggctctgtcccaagtggccgggatgccagttttcttgaaatgcgaaaacgtccagccaagtggcagcttcaaaattcgcggaatcggtcatttttgtcaggagatggcgaagaaagggtgccgacacctagtctgttcctctggtggaaacgccgggattgcagctgcatacgccgccagaaagctgggaatccctgccactatcgtcctgcctgaatcaacatccctgcaggtggtacagaggctacagggggagggcgctgaggtccaactcactgggaaggtttgggacgaagccaacctgcgcgcgcaggagttagcgaaaagagacggttgggagaacgtaccacccttcgaccacccattgatttggaagggacacgcttctcttgtccaggagctgaaagcagtgctgagaacgccccctggtgcactggtgctcgcagtcggaggtggaggactgctggccggcgtggttgctggattgctcgaagtcggatggcagcatgtgcccatcatcgccatggaaacccacggcgcacattgctttaatgcagccattacagccgggaagctcgtgaccctgcctgacataaccagcgtggctaaatctctgggggcaaaaactgtggcagcgcgagctctggagtgtatgcaagtgtgcaagattcatagcgaagttgtagaggacaccgaggccgtgagcgccgttcagcaactgctcgatgatgagcggatgctcgtcgagcccgcttgcggggccgcactcgccgccatctattccggcttgctgcggaggctccaggctgagggctgtctgcctcccagcctcacgtccgtcgtggtgattgtgtgcggaggaaataatatcaattcccgcgaactgcaggcgctcaagacccatcttgggcaagtctag

SEQ ID NO: 29935 - DNA, 990 bp, Artificial Sequence
  Description of Artificial Sequence: Synthetic coding sequence
atggatggacccgtggcggaacacgctaaacaagaaccgttccacgttgtgacccccctgctcgagtcgtgggctctctcccaagttgccggcatgcctgttttcctcaaatgcgaaaacgtgcagcccagcggatcttttaagattaggggcatcgggcatttctgtcaagaaatggccaagaaggggtgtagacacttagtgtgctccagcgggggtaacgccggtatcgctgccgcctacgccgctcgaaagttggggatccctgcaaccatagtgctcccggagagcacttcactgcaagtggtgcagcggctgcagggagagggcgccgaagtccaattaaccggaaaagtttgggatgaggccaacctccgggcgcaggaactcgctaagagggacgggtgggagaacgtcccaccttttgaccatcctctgatatggaagggacacgccagcttggtgcaagaactaaaggctgtcctgagaacacctccaggcgctctggtcttagctgttggggggggaggactcctggcaggtgtggtcgctggcctgcttgaagtgggatggcagcatgtcccaattattgccatggagacccacggcgcacattgctttaacgccgcaatcactgcaggcaagctggttacgttgcccgacataacctctgttgccaaatcgctgggtgcaaaaacagtggcagctagagctctagagtgcatgcaagtctgtaaaatacacagtgaggtcgtcgaggacacagaagcggtgtcggccgttcagcagctgctagatgatgaacggatgctcgttgagccggcctgtggcgccgccctggcggccatctacagtgggctccttagaaggctacaagccgagggttgcctgccccctagcctcacaagtgtggttgttattgtgtgtgggggcaataatattaacagccgcgaacttcaagcactgaagacccaccttgggcaggtgtag

SEQ ID NO: 29936 - DNA, 90 bp, Artificial Sequence
  Description of Artificial Sequence: Synthetic coding sequence
atggacggacccgtggccgaacatgcaaagcaggaaccattccacgtggtcacgcccctgttggagtcctgggccctcagtcaagtttag

SEQ ID NO: 29937 - DNA, 1362 bp, Artificial Sequence
  Description of Artificial Sequence: Synthetic coding sequence
atgggttccgtcctcgggctgtgctctatggcctcctggattccatgcctctgcggctccgctccgtgcttactgtgcagatgctgcccgagtggaaacaattcaaccgttacacggcttatttacgctttgtttctgcttgtgggggtgtgtgtggcctgtgtcatgctcatccccgggatggaggagcaacttaataagatccccggcttttgcgagaacgagaagggtgtggttccttgtaatatcctggtgggatataaggctgtgtacagactgtgctttggcctcgcaatgttctatctgctgctgtcgctgctgatgattaaggttaaaagctcgtcagatcccagggccgccgttcacaacggcttttggttcttcaagtttgctgccgctatcgccatcataatcggagcctttttcatcccagagggtacattcaccacggtgtggttttacgtgggaatggcaggggctttttgttttattctaatccagctggtcttgttgatcgactttgcccatagctggaacgagtcctgggttgagaaaatggaagaaggtaacagcaggtgctggtatgcggcccttttgtctgctactgccctgaattacctgcttagcctggtggctatagtgttatttttcgtctattacactcatccagcatcctgctccgagaacaaggcgttcatttcggtgaatatgctgctttgcgtaggtgcatcggttatgagtatcctgcctaagattcaggagagccagccgcggagtggattgctgcagagttccgtgataacagtgtacactatgtatctgacatggagcgcaatgacaaatgaacccgaaacaaattgcaatccttccttgctgtccataataggttacaacacgaccagcacagtgccaaaggagggacagagtgtccaatggtggcacgcccagggcataatagggctgatcctattcctgctctgcgtgttttatagttctattcgcacaagtaataactcccaggtgaacaaactgaccctcacctcagatgagtccacactaatcgaagacgggggcgcacggtccgacggctctctcgaagatggggacgacgttcatagagccgtcgataatgagcgtgacggcgtgacttacagctattccttctttcactttatgttgttcctcgctagcttgtatattatgatgaccctcaccaattggtacagatatgaaccatctagggagatgaagagccagtggaccgctgtgtgggtgaagatcagcagctcttggattggcatcgtcctttacgtgtggacactggttgctcctttagtgctcaccaatcgcgattttgattag

SEQ ID NO: 29938 - DNA, 1362 bp, Artificial Sequence
  Description of Artificial Sequence: Synthetic coding sequence
atgggatcagtgttgggtctgtgctctatggcaagttggataccctgcctctgtgggtctgcaccatgtttgctctgtcgctgttgtccaagtggaaataacagtactgtcacacggctaatctacgctttgttcctcttagtgggtgtgtgcgtggcgtgcgtgatgctcatcccaggcatggaagagcagctgaataagattcccggattctgcgagaatgaaaagggagtcgtgccttgtaacattctcgtgggctataaggcagtgtatagactatgtttcggcttggccatgttttatctgctcctctcactgctcatgatcaaagtaaaaagcagctctgatcctcgcgccgccgtccataatggattttggtttttcaaattcgcagccgcaatcgctatcattattggcgccttcttcatacctgaggggactttcactactgtttggttctatgtggggatggctggagcgttctgttttatcttgatccaacttgtgttgctgatagatttcgctcattcttggaatgagagctgggtcgaaaaaatggaggaaggtaactcaaggtgttggtatgcggcgctcctctccgctactgccctaaactacctgctgtcattggtggctatcgttctgttttttgtctactatacacaccccgcttcctgttccgagaataaagctttcatttcggtcaatatgctcttgtgtgttggtgcaagcgtaatgagtatacttccaaaaatccaggaatctcaaccgcgctccgggctcctccagtcgagcgttattacggtgtatacgatgtatttgacttggtccgctatgacaaatgaaccggaaactaactgtaacccttccctgttgtccattatcggctacaatactacaagcacagtccccaaggagggtcagtctgtacagtggtggcatgctcaggggattattggcctgatcctgtttctgctatgcgtgttctacagcagcatccgcacttctaataattctcaggtgaataaattaacccttactagcgacgagtctaccctgattgaggatgggggtgcacggtctgacgggagtcttgaagatggggacgatgtgcaccgagcagtggataatgagagagatggtgtgacctacagttactccttctttcacttcatgctgttcctggcctcgttgtatataatgatgaccctcaccaattggtacaggtacgagccttcgcgcgaaatgaagtcccaatggaccgccgtatgggtgaaaatatcctcatcctggataggtattgttctttacgtttggactctggtggccccactggttctgacaaatagggactttgattag

SEQ ID NO: 29939 - DNA, 1368 bp, Artificial Sequence
  Description of Artificial Sequence: Synthetic coding sequence
atgggtgcatgtctcggcgcttgtagtttgctcagctgcgctagctgcctatgcggtagtgccccttgtatcctctgctcttgctgccctgcttctagaaactcaacagtatcccgcctgattttcacgttttttttgttcttaggtgtgctagttagcatcattatgctatcaccgggcgtggagagccagctgtacaaattaccttgggtctgtgaagagggggccgggatacccacagtgctccaggggcacattgactgcggatccctgctaggttatcgggcagtgtaccggatgtgcttcgctacggcggctttttttttctttttcactctcctcatgttatgtgtgagctcaagccgcgatccaagggccgcgattcagaatgggttttggttctttaaatttctgattctggtgggcctcactgtgggcgccttctacatcccagatggctcgttcaccaatatttggttttatttcggcgtggtgggctccttcctttttattttgatacagctggtattgctcattgactttgcacattcctggaatcagcgctggttaggcaaggctgaagagtgcgattctcgcgcatggtacgctggactgttcttcttcactctgcttttctacttactgtctattgccgctgtggccctgatgtttatgtattacaccgaaccatcaggatgccacgaaggcaaggttttcataagccttaacctaactttctgcgtgtgtgtcagcattgctgctgtgctccctaaggtgcaggacgcacagccaaactccggattactacaggccagcgtgatcactttgtatactatgttcgtcacttggtctgcactttcttccataccggaacagaaatgtaacccgcacctgcccacacaacttggaaacgaaactgtggtcgcaggtccagagggctacgaaacgcaatggtgggacgccccctccatcgtgggtctaattattttcttactatgtacactgttcatttctctccgctcgtctgatcacaggcaagtgaatagcctcatgcagaccgaggaatgtccccccatgctcgatgccacccaacagcaacagcaggtggccgcttgtgaagggagagcattcgacaatgaacaggacggcgtgacttactcttactcctttttccatttctgccttgtactggctagcctccatgtgatgatgacattgaccaactggtacaagccgggggagacgagaaagatgatctccacctggactgccgtttgggtcaagatttgtgccagttgggccggcctgctgctttatctgtggacccttgtggcccccctgctcctaagaaaccgcgacttctcatag

SEQ ID NO: 29940 - DNA, 1395 bp, Artificial Sequence
  Description of Artificial Sequence: Synthetic coding sequence
atggatggtcgaatgatgcggagcatgcggctgcgagaggaagaaagccctggtccctcccacactgccagctgtctgtgcggctccgctccatgcattctttgttcctgttgtccagcgtctcgcaatagtaccgtttcacgacttatctttaccttctttctgtttctgggggtgcttgtgagcatcattatgctctcccccggagtagagtctcagctttataagctaccatgggtttgtgaggagggtgctggtattcccactgtgttacaggggcacattgactgcggctctctcctgggataccgggcggtttatcgtatgtgctttgcaacggccgcgtttttctttttcttcactctactcatgttatgcgtcagctcctccagggaccctagagccgcaatccagaatgggttttggttcttcaagtttctgatcctcgtgggcctgactgtgggggctttctatatccccgacggaagcttcaccaatatatggttctatttcggggtcgtgggctccttcctgtttattctcatccagctggtactcttgatcgacttcgcccactcttggaaccagaggtggctgggtaaggcggaggaatgcgatagcagggcgtggtatgccggcctattcttcttcacactcctgttttaccttctgtcaatcgcagcagtggctctgatgttcatgtactatacagaaccatccggttgtcacgagggaaaagtctttatatcgctgaatctcaccttctgtgtatgtgtatccatcgcagccgtcttgcccaaggtgcaagatgctcagccgaactccggcctcctgcaggcatcagtgattaccttatacactatgttcgtaacatggtccgctctaagtagcattccagaacagaagtgcaatccacacctgcccacacaacttggcaacgagacagtcgttgccggaccagagggctacgagacacagtggtgggatgccccctccatagtaggactcataattttcttgctgtgcacactttttattagcctgagatcgtccgaccatcgtcaggtgaattcactgatgcaaaccgaagagtgtccccctatgttagacgccacccagcagcagcagcaagtagctgcctgtgagggccgggcatttgacaacgagcaggacggcgtgacttattcttatagtttctttcacttctgcctggttttggcatcgcttcacgtgatgatgaccctcacaaactggtacaagcctggagaaactaggaaaatgattagtacctggactgccgtgtgggtcaaaatttgcgcatcctgggccgggctcctgctctatctctggaccctggtggctcctctcctactacgaaacagagacttcagttag

SEQ ID NO: 29941 - DNA, 1380 bp, Artificial Sequence
  Description of Artificial Sequence: Synthetic coding sequence
atgggcgccgaaggcgcccccgactttctgagttgtcctagggtgcgaagggctagttgcctttgtggatctgccccatgcatcttatgttcctgctgccccgcgagccgcaattccacggtgagtaggctgatctttaccttcttccttttcctgggagtgctcgtgagcattatcatgcttagtcccggagtagaatcccaactctataaactaccttgggtatgcgaggaaggagcaggcatacctacagtgctgcaagggcatatagattgtggaagcctgctcggctacagagcagtttatcgaatgtgcttcgcaaccgctgcattcttttttttctttaccttactgatgttgtgcgtgagcagtagtcgggatccgagggccgctatccagaacgggttttggttttttaagtttctgatcctggtggggctgacggtgggcgccttttacatacctgatgggtcatttacaaatatctggttctatttcggggttgtcggcagcttcctgtttatcctgattcagctcgttctgttgatcgacttcgcccactcatggaaccagagatggctcggtaaagccgaagagtgcgactctcgggcgtggtacgccggtctattctttttcactttgctcttttatctgctcagtatagcagcggtcgctcttatgtttatgtactacactgagccttccggatgccacgagggaaaggtgtttatctccctcaatttgactttttgtgtctgtgttagcatcgctgccgttttacctaaggtgcaggatgcccagcccaattccggcttactacaagcgtctgtaattacgctgtataccatgttcgtcacatggagcgccctaagtagcattccagagcagaaatgtaacccccacctgcccacccagctggggaatgagacggtcgtcgctggccctgagggatacgaaacccagtggtgggatgcccctagcattgtcgggttgattatttttttgctgtgcacactgttcatctcacttaggtcttccgaccatcggcaggtaaatagtctgatgcaaactgaggaatgtccgccaatgctggacgcgacccaacagcagcagcaagtggccgcttgcgaaggaagagcatttgacaacgagcaggacggcgttacctatagttattctttctttcacttctgtctcgtgctggccagcctgcacgtgatgatgactctgaccaattggtataagccgggcgagacccgtaagatgatttccacctggacggctgtgtgggtgaaaatctgtgcatcttgggccgggctcctgctctatttgtggaccctcgtggctcccctgcttttgcgcaacagagatttctcttag

SEQ ID NO: 29942 - DNA, 1380 bp, Artificial Sequence
  Description of Artificial Sequence: Synthetic coding sequence
atgcgttccatgaggctccgggaggaggaatcccccggacctagtcataccgcgtcttgcctttgtgggtccgctccttgtattctgtgctcctgttgtccagcctcccgcaatagtaccgtgtcaagactgatctttactttctttttgttcctgggagtgcttgtctcaatcataatgttgtcgcctggggtcgagtctcaactgtacaagctgccctgggtatgtgaagagggggcaggaattccaactgtcctgcagggccacatcgattgcgggtccctccttggctaccgggcagtgtaccgcatgtgcttcgccaccgcggcgtttttcttttttttcactcttctgatgctgtgcgtgagctctagccgcgatcctcgtgccgcgatccagaatgggttctggtttttcaagttcttaatcttagtcgggctaactgttggggctttttatattcccgacggctctttcaccaatatttggttctattttggcgtggttggttctttcttgtttattctcatccagttagtactgctgattgatttcgctcacagctggaaccagcggtggcttggaaaagctgaggagtgcgattccagagcatggtatgccggcttgttcttcttcaccctgctgttttatctcctatcaattgcagctgtggccctgatgttcatgtactataccgagcccagcgggtgccacgaaggaaaggtgtttatttcccttaatctaacattctgtgtgtgtgtgtctatcgctgcagtgttacccaaggtccaggatgcgcagccaaatagtgggttgctccaagcctctgtaatcaccctctacacaatgttcgtcacgtggagcgccttaagttctattcccgaacaaaaatgcaatccccatcttccaacgcagttgggcaacgagactgtcgttgccggcccagaaggatacgagactcaatggtgggacgctcctagcatcgtaggtctgattatctttttactgtgcacactgtttatatcgctgagaagcagcgaccatcggcaggtgaattcgctaatgcaaacggaggaatgccctcctatgttggacgcaacccaacagcaacagcaagttgcagcttgcgagggtcgagcctttgacaacgaacaggacggagtgacctactcttactcattctttcacttctgtcttgtactggccagtcttcacgtgatgatgacccttactaattggtacaagcctggtgaaacccgaaagatgatctctacatggaccgcagtctgggtaaaaatctgcgctagttgggctggactgctcctgtatctgtggactctggtggcccccctattactgagaaatagggatttctcatag

SEQ ID NO: 29943 - DNA, 825 bp, Artificial Sequence
  Description of Artificial Sequence: Synthetic coding sequence
atgtccatctcttcacagcacggcattacccttgcctctgtggaagccctccattcatcctactgctcttggtgcctcttacagcttcttcccattcccggtacacgcaccgaacagccgagatcaggcctgctgcaagcttccgtcatcagctgttatatcatgtaccttacatttagcgctctttcctctaggcctccagagagagtaatcctgcaggggcagaaccacaccctctgtctgccagggctgagcaagatggaaccccagacgcccgatatttctctggctatgctgagtgccagcatcatgtacgcgtgcgtgctgttcgcatgtaatgaggcctcatacctggcagaggtattcggccccttgtggatcgtaaaggtatactcgtatgagttccagaaaccaagtctgtgtttctgctgtcccgaaaccgtcgaagctgataaaggacagcgtggcggagccgcccgccctgcggatcaggagaccccaccagctcctcccgtgcaggtccaacatctgagttacaattattccgccttccatttcgtgtttttcttggcttctctctacgtcatggtgacactgaccaattggttttcttacgaaggtgcagaactggagaagacttttattaaaggtagctgggctacgttttgggtgaaggttgcgtcatgctgggcatgcgtgctgctttacctggggctattgttggcacctctgtgttggccaccaactcagaaaccacaacccttgattctgaggcgccggagacatagaatcatcagtcccgataataaatatccacccgtgtag

SEQ ID NO: 29944 - DNA, 1557 bp, Artificial Sequence
  Description of Artificial Sequence: Synthetic coding sequence
atggtgggcgcaaaagcaggccctagtcccgggacctcgttaggacttgcccagcagcatagcggcggctcgtcagtgttggtgaagagcccgttttgccaagtgtgttgctgtgggccagccccctgcgccagctgttgccatagccgctggcccagccttaccgcttctacatgtagcagactgttctatattctgcttcatgtaggtgcatccgcgatctgttgcctgttattgagtaggaccgtggtggagagagtatggggcaagacacaccggattcaaatgccatccggcctctgcgcacacctattcggactgtcagactgtcccgtgctgagcggctctggagctgtgtatagagtgtgcgctggcacggcaacatttcaccttctgcaagccgtactcctcgtccaccttcatagtccaactagccctcgcgctcagctgcataatagcttttggttgttgaagttgctttttctgctgggcctttgcgccatcgccttttgtatacctgacgaacacctgtttcctgcctggcactatatcggtatttgtggaggattcgcctttatcctcctgcagttggtactgattacagcttttgctcacagctggaacaagaactggcaaacaggggctgcgcaggactgttcctggttcctagcagtactgctggccacccttggcttttattccatggctggagtgggcgctgtgctgctctttcattattacacgcaccccgctgggtgtctgctgaacaagatgctcctgtcccttcatctctgtttctgtgggctgatctctttccttagcattgcaccctgtatacgcctgaaacaacccaggagcgggctacttcaagcttctgtcatctcctgctacattatgtaccttacttttagcgcactgagtagcagaccacccgaacgcgtgatccttcaaggtcaaaatcacactttgtgcctccccggcctgagcaaaatggagccgcagaccccagatatttcactggctatgctttccgccagcattatgtatgcctgtgttctcttcgcatgcaacgaagccagctacctggcagaagtttttggccctctctggatcgttaaggtgtactcctacgaattccagaaaccttccctgtgtttctgttgtcctgagaccgtcgaggctgacaaaggccagagaggcggggctgctcgacctgcggaccaggaaacaccccccgctccgcccgtgcaagttcagcatctctcatataactactcagcctttcactttgtgttttttcttgcaagcctctacgtgatggttactctcaccaattggttctcgtatgagggcgcagagctagagaaaaccttcatcaagggatcatgggccaccttttgggtaaaagttgccagctgctgggcttgtgtcctgctctacctcggactccttctggccccgctgtgctggcctcctacacagaaaccacaaccactcatccttagacggcgccgccaccgaatcatctctcctgacaacaagtaccctcctgtctag

SEQ ID NO: 29945 - DNA, 291 bp, Artificial Sequence
  Description of Artificial Sequence: Synthetic coding sequence
atggtgggtgctaaggctgggccctctcctggcacatctttagggctggcccagcagcacagtggtgggagcagcgtgctcgttaaatcccctttctgccagcaggtgtcgacctcactgccctgtatttgcagcacccccaggtgtgccgctgtcggcctgctcctcgtacctgccgctgccactctgggcgggcctctctctcctcatcccctggcagcagcctgtagtacaagcagcagtatgtggggaccccaacaatcagctgcatcctgctgccagggtcagtag

SEQ ID NO: 29946 - DNA, 1269 bp, Artificial Sequence
  Description of Artificial Sequence: Synthetic coding sequence
accggatcgtgctgcgtagaccagctggcctgctgctgtggaagcgccggctgctccctctgttgcgactgttgcccacgtatccgccaatccctgtccaccaggttcatgtatgctctgtatttcatactggtggtcgttctgtgttgtatcatgatgagcacaacagtcgctcacaaaatgaaggagcacattccattttttgaggacatgtgcaaagggatcaaggctggggacacatgcgagaaacttgtcggatactctgccgtgtaccgcgtgtgtttcggaatggcttgcttctttttcatcttttgcctgctgacgctgaagataaacaactccaagtcctgccgggcccatatccataatggattctggtttttcaagctgctgctgcttggcgcgatgtgtagcggagctttctttattccagatcaagatactttcctgaatgcctggcgctatgtgggggctgttggagggttcctcttcatcggcatccagttgctgctgctcgttgagtttgcccacaaatggaataagaattggaccgcgggcacagctagtaataaactgtggtacgcgtcacttgcccttgtgactctcatcatgtatagcatcgccacagggggtctggtgctgatggctgtcttttatacccaaaaggacagttgcatggagaataagatcctgttaggtgttaatggaggactgtgcctgctgatctccctggttgcgatttctccatgggttcaaaacagacaaccgcattccggactgctgcaatccggggtgatttcctgctacgtgacctacctcacattctccgctttaagtagcaaacctgcggaagtggtgctagatgagcacggaaagaatgtgactatctgcgtgcctgacttcggacaagatctttaccgggacgagaacctggtgacgatcctgggaacctccctactgattggatgtatcctgtatagctgtctgacatcaacgactcggagcagctccgatgcactgcagggaagatacgcagcccccgaactggaaattgcacgatgttgcttttgctttagcccaggtggagaggacacggaagagcagcagcctggcaaggaggggcccagggttatctatgacgagaagaaggggacagtatatatttatagctactttcacttcgtcttttttctggcgtccctgtacgtgatgatgacggtcactaactggttcaaccacgtccggagtgctttccacctgcttccttag

SEQ ID NO: 29947 - DNA, 1272 bp, Artificial Sequence
  Description of Artificial Sequence: Synthetic coding sequence
atgagcgcccagtgttgtgccggccaactggcctgctgctgcgggagtgccgggtgctccctgtgttgcgactgctgtccgcggatccgccagtcgttatcaaccaggttcatgtacgctctgtacttcattctggtggttgtgctatgctgtataatgatgtcaacaacagtggcccacaagatgaaagaacacatcccattcttcgaagacatgtgcaagggcatcaaggctggagatacttgcgagaaacttgtcggctactcggccgtctatcgagtatgttttggaatggcttgtttcttcttcatcttttgccttctaaccctgaaaatcaacaattcaaagagctgccgtgcccacatacacaatggtttttggttctttaaactgcttttgctgggtgcgatgtgtagcggtgccttcttcatcccagaccaggacacttttctgaacgcgtggcgatatgtcggggccgttggcggatttttgttcattgggatccagttgcttctattggtggaatttgcgcacaagtggaataagaactggactgcaggcacagcatctaataaattgtggtacgcttctctagcccttgtgacactgatcatgtattccattgccaccggcgggctcgtgctaatggctgtgttttatacccagaaggacagctgtatggagaacaagatcctgcttggcgtcaacggcggcctgtgcttgctgatctctctggttgcgatctccccctgggtccagaatcggcagccccatagtgggctacttcagtcaggggtgattagctgctatgttacctacctcactttctctgctctgtcctccaaacccgctgaagtggtgcttgacgaacacggcaagaacgtgacaatatgtgtccctgattttggacaagacctataccgggacgagaacctggtcaccattctggggaccagcctgctgattggatgtatcctgtacagttgtctgacttcgaccaccagatctagctccgatgcacttcaggggcgttatgctgcacctgagctggaaattgcacgctgctgcttctgttttagccctggcggcgaagatacagaagaacaacagcctgggaaggaaggaccacgtgtgatttacgacgaaaagaaaggtacagtctacatttatagctactttcatttcgtgtttttcctggccagtctgtacgtgatgatgactgtgacaaattggtttaatcacgtgcgatctgccttccatcttttgccatag

SEQ ID NO: 29948 - DNA, 1371 bp, Artificial Sequence
  Description of Artificial Sequence: Synthetic coding sequence
atgtctgcgcagtgctgcgcaggacagcttgcctgctgttgcgggagcgccggttgttcactgtgttgcgactgttgtccccgaattaggcagtcgctcagtacaaggtttatgtacgccctgtatttcatacttgtagtagtgctgtgctgcatcatgatgtccacaaccgtcgcacacaagatgaaggaacacattcctttctttgaggatatgtgcaaagggataaaagctggggacacgtgcgagaaactggtgggctactctgccgtttacagagtttgctttgggatggcatgtttctttttcattttttgtctgctgacactgaaaatcaataatagcaaatcatgtcgcgcccacattcataatggtttctggttcttcaagttattgctcttaggagcgatgtgctccggcgccttcttcattcccgaccaggacactttcctgaacgcttggcgctatgtgggcgcagtaggggggttcctgttcattggaatacagctgctgctgctggtcgagtttgcccataagtggaacaaaaactggactgctggaaccgcgtcaaacaaattgtggtacgcatctctggctctcgtgaccctgataatgtactcgatcgccaccggtggcctggttctgatggccgtcttctatacccaaaaagattcctgcatggagaacaaaatcttactgggcgttaatggagggctctgcctgctgatctctctggtggcgattagcccttgggttcaaaatcggcagcctcactcggggcttctgcagtcaggggtaatctcgtgctacgtcacatacctgactttctctgccctgtcttctaagccggccgaagttgacgaacatggtaaaaatgttaccatatgtgtgcctgacttcgggcaggacctgtaccgagacgagaatctggttactatcttaggcacaagtctactcattggttgcatcctgtattcttgtctgacttcaacaacacgttcctcaagcgatgcgctccaggggagatacgcagctccagaattagaaattgcaaggtgttgcttctgcttttcccctgggggggaggacaccgaagaacagcagccaggcaaagaaggccccagagtaatctatgatgaaaagaaaggcactgtttacatctatagctatttccattttgtgttctttctggcctccctctatgtgatgatgaccgttacaaactggttcaagtggagtcctaccttattgccaaggctggaatatagcggaatgattcttgcccactgtaatctacatcttcctgacgtgaagcgattcagttgtctgtcactaccctcgagctggggatatcgccatgtgcccccgtag

SEQ ID NO: 29949 - DNA, 1386 bp, Artificial Sequence
  Description of Artificial Sequence: Synthetic coding sequence
atgtcggcccagtgttgcgcgggccagctggcctgttgctgcggcagcgccggctgttccttgtgttgtgactgttgcccacgcatccggcaaagtctgtcaacaaggttcatgtacgccctgtacttcatcctggtagtcgtcctctgttgcatcatgatgtctactactgtggcccataagatgaaggaacacattccattctttgaagatatgtgcaaaggaattaaggcaggtgatacctgtgagaaactagttggctactcagcggtttatagagtctgcttcggcatggcctgtttcttttttattttctgtttgcttacactcaagattaacaactccaaatcttgtagggcccatatccacaacggcttctggttcttcaaactgctgctgctgggagccatgtgttctggggctttcttcattcctgatcaggacacattcctgaatgcatggcggtacgtcggagccgtgggcggttttctttttattggcattcaacttctgctacttgtagaattcgctcataagtggaataaaaattggaccgccggcactgcctcaaataagctttggtatgcgtccttagcattagttaccctgatcatgtacagcatagccactggtggattggtgctcatggcggtattttatacgcagaaggatagctgcatggagaataaaattctgctcggcgtgaacggagggctctgcctgcttatttctctagtggctatctccccatgggtacagaatcggcaaccccactctggactcctccagagtggtgtgatttcctgctatgtgacttatctgaccttctccgctctgtctagtaaaccagcggaggtcgtgttggacgagcacgggaagaacgtgactatttgcgtgcctgactttgggcaagatctctatagagacgagaacctggtcacgatcctcgggacctccctcctcattggctgtatcctctacagctgtttaacaagtaccaccaggagctctagcgatgctctgcagggccgctatgccgcccccgagctggaaatcgctcgctgctgcttttgtttttcacccggcggggaagataccgaagagcagcaacccggtaaagaaggcccccgcgtgatctatgacgagaagaaaggtacggtgtacatctacagttactttcacttcgtcttcttcttagcatcgttgtatgttatgatgaccgttacaaattggttcaactatgaatccgcaaatatcgagtccttcttctcagggtcttggtccattttctgggtgaaaatggccagttgctggatatgcgtactgctgtacctttgcacgctggtcgctcctctgtgttgtcccactcgggaattttctgtgtag

SEQ ID NO: 29950 - DNA, 216 bp, Artificial Sequence
  Description of Artificial Sequence: Synthetic coding sequence
atggctggcatggctcttgcacgcgcctggaagcagatgtcatggttttactaccagtatcttttggtaactgcactgtatatgctggagccatgggagcgcactgtgttcaactccatgcttgtctccattgttgggatggccttgtacacaggctatgtctttatgcctcaacacatcatggcaatcctgcactacttcgaaattgtgcagtag

SEQ ID NO: 29951 - DNA, 231 bp, Artificial Sequence
  Description of Artificial Sequence: Synthetic coding sequence
atggacctcaggagggtgaaagagtatttctcatggctatactatcagtaccagatcatttcatgctgcgcagtgctggagccttgggaacggtccatgttcaacaccatcttactgaccatcatcgctatggtggtgtacaccgcatacgtatttattccaattcacatccgactcgcttgggagtttttttcaaagatttgtggttaccatagtactatctccaactag

SEQ ID NO: 29952 - DNA, 231 bp, Artificial Sequence
  Description of Artificial Sequence: Synthetic coding sequence
atggatcttagacgggtgaaagagtatttttcttggctctattaccagtatcagattatttcatgctgtgcagttctggaaccctgggagcggtctatgtttaacacaatccttctcacaattattgcaatggtggtgtacacagcttacgtatttatacccatacacatacgactcgcctgggaatttttttcaaagatttgcggatatcattcaactatttcaaactag

SEQ ID NO: 29953 - DNA, 918 bp, Artificial Sequence
  Description of Artificial Sequence: Synthetic coding sequence
atggggcatgccctatgtgtgtgctcccgggggacagtgattatagataataagcggtacctcttcatacaaaagcttggcgagggaggcttttcttatgtcgatctcgtggaaggcctgcacgacggccacttctacgcgctgaaacggattttgtgccacgagcaacaagacagagaagaggctcagagggaggctgatatgcatagattgttcaatcacccaaatatcctcagattagtggcgtattgcttgcgggagcgaggggctaaacacgaggcttggctgctcctgcctttcttcaaaagaggaacactgtggaatgagatcgaacggttgaaagataagggaaatttcttaaccgaggatcagatcctgtggcttctgctgggtatttgcagggggctggaagcaatccatgccaaaggttatgcacacagagacctcaagccgactaatatactccttggcgatgaggggcagcccgtactcatggatttgggtagtatgaatcaggcctgcatccatgtagagggcagtaggcaggccctgaccctgcaggattgggccgcccagcgctgtaccatatcatacagggccccggagctgttctcagttcagtcacactgtgttattgatgagaggaccgacgtgtggtccctcgggtgtgtgttatacgctatgatgttcggcgagggcccatacgatatggtgtttcagaaaggggattccgtcgccctggccgtccagaaccagttgtccattcctcagtctccccggcactcgtccgctctcagacagctgctgaactcaatgatgaccgtcgacccccaccaacgtccacatatccccttgctgctgtctcagcttgaggcgctgcaaccacccgccccaggccagcacactacacaaatttag

SEQ ID NO: 29954 - DNA, 918 bp, Artificial Sequence
  Description of Artificial Sequence: Synthetic coding sequence
atgggacatgccctttgcgtgtgctccagaggtacagtgattatcgataataagcgttatctgttcattcagaaattgggggagggagggttttcatatgtcgatctggtggaagggctccacgatggacatttctatgccctgaaacgcatcctgtgtcacgaacagcaggaccgcgaagaggcccagagagaggctgatatgcatagactgtttaatcaccctaacatcttaagacttgtggcttattgtctgcgagaacggggcgctaagcacgaagcttggttgctgctgccattcttcaaaaggggcacgctttggaacgagattgaacggctgaaggataagggtaattttctaacggaggaccagattctttggctacttcttggcatatgtagaggcctcgaggccatccatgcaaagggctatgcacacagagacctgaaacctaccaacattctgctgggggacgaggggcagcccgtgttaatggacttaggctctatgaatcaggcttgcatccatgtggaaggctcgaggcaagcactcaccctgcaagattgggctgcgcagcgctgtacaatttcttaccgggcaccggagttgttctccgtgcagtctcattgcgtgatagatgaacgcacggacgtgtggtctctgggctgcgtgctgtacgctatgatgttcggggagggtccatacgacatggtcttccagaagggagacagtgtggccctggcagtacaaaaccagttgtctatcccacaatcccctagacattcttccgcacttcgccaactgctcaactccatgatgactgtggacccccaccaaaggccacacattcccctcctgctttcccaactggaggccctgcagcccccggcccctgggcagcacacaactcagatttag

SEQ ID NO: 29955 - DNA, 1269 bp, Artificial Sequence
  Description of Artificial Sequence: Synthetic coding sequence
atgggtatgacccgaatgctcttggaatgctcactttctgacaagttatgcgtgattcaggagaaacagtatgaggtgataattgtgccgacccttctggtgactatcttcctcattctgcttggtgttatcctgtggctgttcatcagagaacagcggacgcaacagcagaggtcaggtccccagggcattgctcccgtgccccctccccgcgacctgtcctgggaggccgggcatggaggtaacgtggcactgcccctgaaggagacatccgttgaaaacttcctgggggcgaccacccctgcactggcaaaactgcaagtgcctagggaacagctatcagaagtgcttgagcaaatctgctcgggctcctgcggcccaatcttccgtgcaaacatgaacaccggcgaccccagcaagccaaagtctgtgatcctcaaagccttaaaggagcccgctggcctgcatgaggttcaggattttctgggcagaatccagtttcatcaatacctcggcaaacacaagaacttagtgcaactagagggttgttgtactgaaaaactgccgctctacatggtgttagaggacgtggcacagggagacctcctgtcctttctctggacctgccgcagagatgtcatgaccatggatggattgctttatgacttgacagagaaacaggtctatcatatcggaaagcaggttttactggccctggaattcttgcaggagaaacacctgttccacggcgatgttgctgcccgcaacatcctcatgcagtcagatctcacagctaaactctgtgggttgggtctggcttacgaagtttacactcgtggcgctatcagcagcacccagactatcccacttaaatggctcgctccagaaagacttctgctccggcccgctagtatccgggccgacgtgtggtcgttcggcatcctgctgtacgagatggtaacccttggggctcccccatatcctgaggtacccccaacatccattttagaacaccttcagcgacggaagatcatgaagaggccgtcgagctgtactcacactatgtacagcataatgaaaagttgttggcggtggcgggaagcagaccgtccatctccaagagagctcaggcttagactggaggcagccattaaaacagctgacgacgaggcagttttacaggtacctgagttggtagtgcccgagctgtacgccgccgtcgctggaatacgggtggagtccttgttttacaactactctatgttgtag

SEQ ID NO: 29956 - DNA, 198 bp, Artificial Sequence
  Description of Artificial Sequence: Synthetic coding sequence
atggggatgacccggatgcttctggagtgctccctatctgataaactgtgtgttattcaggagaaacaatatgaagtcattattgtaccaaccctgctagtcactatttttctcatcctgctcggcgtgattctatggctgttcatcagagaacagaggacacagcagcaacggtccggcccacagggaaaggcttag

SEQ ID NO: 29957 - DNA, 252 bp, Artificial Sequence
  Description of Artificial Sequence: Synthetic coding sequence
atgggaatgaccagaatgctgttggagtgctccctgagcgacaagctctgtgtaatccaagagaaacagtacgaggtgattatagtcccaactctcctggtaactatttttttgatcctgctcggcgtgattttatggctgttcattagggagcagcggacccagcagcagagatctggaccccagggcattgccccggttccacctccacgggacctgagctgggaggcaggtcacgggggcaacgtgtag

SEQ ID NO: 29958 - DNA, 126 bp, Artificial Sequence
  Description of Artificial Sequence: Synthetic coding sequence
atgggaatgacacgaatgctccttgaatgttcattgagtgataagctgtgcgtgatacaggagaagcaatatgaggtcatcattgtgcccacactcttggttactattttcttaatcctcctgtag

SEQ ID NO: 29959 - DNA, 264 bp, Artificial Sequence
  Description of Artificial Sequence: Synthetic coding sequence
atggggatgacaaggatgctcttggaatgctccctttcagacaagttgtgcgtaatccaggagaagcaatacgaggtgatcatcgtccctacactgctggtcaccatttttcttatactcctgggtgtcatactgtggctgttcatacgagaacaacgcacacagcagcagagaagcggtccccagggaattgctcccgtacccccgccccgcgacctcagctgggaagctgggcacgggggtaatgttgcgctgccgttatag

SEQ ID NO: 29960 - DNA, 324 bp, Artificial Sequence
  Description of Artificial Sequence: Synthetic coding sequence
atgtcagagcccgacacctccagcggattctcaggcagcgtggaaaacggcacatttctggaactgtttcctacctcccttagcaccagtgtagatccctcctctgggcacctaagcaacgtttacatttatgtcagcatcttcctgtcattgcttgctttccttctgctgctgctgattatcgcactgcaaagattaaaaaatatcattagttcctctagtagttatcctgagtaccctagtgatgctggttctagcttcaccaatctggaagtgtgttccatcagcagccagagatctactttttctaacctctcctcttag

SEQ ID NO: 29961 - DNA, 1182 bp, Artificial Sequence
  Description of Artificial Sequence: Synthetic coding sequence
atgcctggccacctgcaggaaggcttcggctgtgtagtcaccaacaggtttgaccaactctttgacgatgaatccgacccattcgaggttttgaaggcagctgagaacaaaaagaaggaggctgggggagggggcgttggcgggcccggagcaaaaagtgcagcgcaagcagctgcacagacaaacagcaacgctgctgggaagcagttgcggaaggaaagccagaaggatagaaagaatccactcccaccctctgtgggagtagttgataaaaaagaggagactcagcctcctgtggccctgaaaaaagaggggatcaggcgtgtggggcgcagacccgaccagcagctgcagggtgagggaaaaattatcgatagaaggccggagcgccggcctccacgcgaacgtaggttcgagaaaccgttggaagagaagggagagggaggggagtttagcgtagatcggccaatcatcgacaggcccatcagggggcgaggcggtctgggccggggaagggggggaaggggtagaggcatgggtaggggagacggctttgattctcgggggaagcgcgagttcgaccgccactccggctctgatcgttcatcattcagccactatagtgggcttaagcatgaggacaaacgtggcggaagcggctctcataactgggggaccgtcaaggatgaactgacagaccttgatcagagtaacgtaactgaggagaccccagagggggaggagcatcatcccgtggcagacacagaaaacaaggagaatgaagttgaagaagtcaaggaagaagggcccaaagagatgaccctggatgaatggaaggcaattcagaataaggaccgcgcaaaagtggaattcaatatcaggaaacctaatgagggagcggatggccagtggaagaagggatttgtcttgcataagagcaagagtgaagaagcacacgccgaggactccgttatggaccatcacttccgcaagccggccaacgacattacaagccagctagaaattaattttggtgatttaggtcgaccgggccggggcggaaggggcgggcgcgggggaagagggcggggtggtcgccccaatcgcggctcaagaactgacaagagttcagcaagcgctccagacgttgatgatcccgaggccttccctgctttagcatag

SEQ ID NO: 29962 - DNA, 1209 bp, Artificial Sequence
  Description of Artificial Sequence: Synthetic coding sequence
atgccaggccacctacaggaagggtttggctgcgtggtgaccaatagattcgatcagttgttcgatgatgagtccgaccctttcgaggtgctaaaagccgctgagaacaagaaaaaagaagccggcgggggcggggtggggggaccaggcgctaagtctgcagctcaggcagccgctcagactaattccaatgccgctggaaaacaattgcggaaagagagtcaaaaagacagaaagaacccacttcctccttctgttggggtcgtggataaaaaggaagagacccagcctcccgtagctctaaaaaaggaaggaattcggagggtggggaggcgtccagaccaacaacttcagggagaaggcaaaatcatcgataggcgaccagagagaagacctcctcgtgaacggcggtttgagaagccccttgaagaaaagggagagggtggggaattttctgtggaccgcccaatcattgacaggccgattaggggccgtgggggtctcggacgaggacgcggcggccggggcagggggatgggacggggggatgggttcgattctcggggtaaaagagaatttgaccgacacagtggatctgaccgttctgggctgaagcacgaagacaaacgcgggggcagcggcagccacaattggggcactgtaaaagacgagttgaccgaaagtcctaagtatatacagaagcagatctcatacaactattctgacctggaccagagcaatgttacagaggaaacaccagagggagaggaacatcacccagtggcggacacggagaataaggagaatgaggtggaggaggtgaaagaggagggacccaaggagatgacactcgatgaatggaaagctatccaaaataaggaccgcgcaaaggtggagtttaacatccgtaagccaaacgaaggtgctgacggccagtggaagaagggatttgtattgcataaatcgaagagcgaggaagcacacgccgaggactcagtcatggatcaccactttcgaaagcctgccaacgacatcacctctcagttggagattaacttcggcgatctgggccggccaggacgcggcggcaggggtgggagaggaggccgggggagagggggccgtcccaacagaggaagtaggaccgacaaatcttctgcttccgcccctgacgtcgacgaccctgaagcttttcctgccctggcctag

SEQ ID NO: 29963 - DNA, 1164 bp, Artificial Sequence
  Description of Artificial Sequence: Synthetic coding sequence
atgcctggccacctgcaggagggctttggctgtgtcgtgaccaacaggttcgaccagctgtttgatgatgaatccgatcccttcgaggtcctgaaagccgccgagaacaagaaaaaggaagctggaggggggggagtaggcgggcctggagctaaatcagccgctcaggcagcagcccagaccaactctaacgccgccggcaagcagcttcggaaggagagtcagaaagacaggaagaacccattgccaccatccgtcggcgtcgtggacaagaaagaggaaacacagccccctgtcgccctgaagaaagaaggaattcgcagggtaggtagaaggcctgatcagcagctccagggtgaggggaagatcattgaccgacgtccggagaggagacctccacgagaaagaagattcgaaaagccactcgaagaaaaaggggaaggcggggaattctcggtagatcgacccataattgacaggccaatcagagggcgcggtggcctagggcggggcaggggggggaggggccgcggaatgggcagaggagatgggttcgactctagaggtaagagggaattcgacagacattccggatccgatcgaagcgggctcaaacatgaggacaaaaggggcggaagtggaagtcacaattgggggacagtgaaggatgagctgaccgatcttgaccaaagcaacgtcacagaagagacccctgaaggcgaagagcatcaccctgtggccgatactgaaaataaggaaaatgaagtcgaggaagtgaaggaagagggtcccaaagaaatgactctggacgagtggaaggctatacaaaacaaggaccgggctaaggtcgagttcaatattaggaagcctaatgagggtgccgacggacagtggaagaaaggcttcgtcctgcacaaatctaagagtgaagaagcgcatgcggaggactccgtaatggaccaccattttcggaaacctgccaatgatatcacaagccagctcgagatcaacttcggcgatttagggagacccggccggggcgggaggggaggccggggcggaaggggtcgaggaggccgacccaacaggggctctaggactgacaaatcatctgcttctgctcccgatgtagatgaccccgaggccttcccagccttggcttag

SEQ ID NO: 29964 - DNA, 1227 bp, Artificial Sequence
  Description of Artificial Sequence: Synthetic coding sequence
atgcccgggcatctgcaggaaggtttcgggtgcgtcgttactaaccgtttcgaccagttgttcgacgacgagtctgatccgtttgaggtgctgaaagccgccgagaataaaaaaaaggaggcaggtggtgggggagtggggggccccggagcgaagagcgctgcacaggcagccgcccagactaattcgaatgccgccggcaaacagctgcggaaggaaagccagaaggatagaaaaaatcccctgcctcccagtgtgggagtggtcgacaagaaggaggaaacccagcccccagtggcgctcaaaaaagagggaatcagaagggtcggacgccgtccagaccagcagctgcaaggagagggaaaaataattgatcgtcgccctgagcgccgcccacccagggagcgccggttcgagaagccgctagaggagaagggagagggaggcgaattttcggtggacagacctataatcgaccgacccattcggggcaggggcggcctcgggcgaggtcggggcggacgcggaagaggaatgggaagaggggacggttttgattcccgtggcaaaagagaattcgatagacacagcggatcggataggagcagcttctctcattattccggcttgaagcatgaagacaaacgcggcgggtcaggaagtcataactggggaacagtgaaagatgagctcaccgagagtcccaaatacattcaaaagcaaatctcttacaattactcggatctcgatcagtctaacgtgacggaagaaacgccagagggggaggagcaccacccggtcgccgacaccgagaacaaagagaatgaggtggaagaagttaaggaggaagggccaaaggagatgactctggacgaatggaaagcaatccagaacaaggaccgcgctaaagtcgaattcaatattagaaagcctaatgaaggggctgacgggcagtggaagaagggatttgtcttgcacaagagcaagtctgaggaagcccatgctgaagactcagtgatggatcaccattttcgcaagcccgctaacgacattacatcacagctggagatcaactttggagatctggggcgccctggtaggggtggccggggtggacggggaggccgcgggcgaggcggacggcccaacaggggaagcagaaccgataagagcagtgcatcggcccccgacgtcgacgatccggaggcctttcccgccctcgcatag

SEQ ID NO: 29965 - DNA, 813 bp, Artificial Sequence
  Description of Artificial Sequence: Synthetic coding sequence
atgttttttagcttacaccgcgaaactcccaaggaagggatgtttggagccaatctcaccacttttcaccccactctctttatcctcctcgggattccaggactagaacagtaccatatttggctgagcataccattctatctgatgtacataaccgcagtgctaggcaatggcgctctaatcttggtcgtgcttagcgaacatacactacacgtgttcctcagtatgctggctggaactgacattctgctttccaccacgacggtgcccaaggccttggcgatattttgggtccatgcgggagaaatcgcctttgacgcatgtataacacagatgttttttatccacgtggcctttgtggcagagtccggtatccttctagcaatggcctttgactcctacgtggccatatgcacacccttaagatatactacaattctcacctctatggtcaacggcaagatgaccctcacaatctggggtcaaagtatcggaaccattttcccagtcatcttcctgctcaaacgcctgccctactgtcagacaaatatcattcctcattcatattgcgagcatatcggcgtggcacaactggcatgtgctgacataaccgtgaacatttggtatggctttagcgtgcccatggcctcagtgttggtagacgtggcctttattggctttagttatactctcattctacaggccgtgttccgtttgccttctcaagaatcccagcataaggctctaaacacatgtggatcgacactggagctttttagctcctcttccagccaccattttttgctgagctag

SEQ ID NO: 29966 - DNA, 678 bp, Artificial Sequence
  Description of Artificial Sequence: Synthetic coding sequence
atgttcgcgggaatggacactttcttgctggccgtcatcgcttatgaccggtttgtggcgatttgccacccactgcagtacatggttatcataaatccccacctttgtgggctgttagtactcgcctcatggttcatcattttttggttttccctagtccacatcctcttaatgaagcggcttactttttcaactggcaccgagattccacactttttttgtgagcttgcccaggtgcttaaggtggcccggtcagacgctctcctcattaacatcgtcctgtacgtagccatggccttactgggggtgtttcccgtcgccggtatcttattctcctactcccagatagttagtagcctcatgagaatgagcagcactgagggaaagtataaggctttttccacctgcggcagtcatctgtgcgtcgtgtctctgttttatggcacaggcctgggtgtgtacctgtccagtgccgtgacccacagttctcagtcttcttccatggcatctgttatgtacgcaatggtcactcctatgcttaacccttttatttacagtttgcggaacaaggatgtgaagggagccctggggcggctgctgtcccgagccgctagctgtctgctgaggtacactacctccgagctccgcgggtgctacggatctctaaaacagatgtag

SEQ ID NO: 29967 - DNA, 480 bp, Artificial Sequence
  Description of Artificial Sequence: Synthetic coding sequence
atggagaagctgcgcagagtgctgtccgggcaagatgatgaggaacagggcctgacagcccaggttcttgacgccagttccctgtcgttcaatactagattgaagtggttcgccatttgtttcgtgtgtggagtgtttttttccattctaggtaccgggctactatggctccctggaggcattaaactgttcgcagttttttacactttaggaaatctggcagccctagcctctacctgttttctgatgggaccggtcaaacaactcaagaaaatgttcgaggcaacacggctcctcgcaaccattgtcatgctgctgtgcttcatctttaccctgtgtgcagcactgtggtggcataaaaagggtctagccgtgttattttgcatcctacagttccttagcatgacctggtacagtctgtcatatatcccatatgcaagggacgccgtcatcaaatgctgctcttctttacttagctag

SEQ ID NO: 29968 - DNA, 483 bp, Artificial Sequence
  Description of Artificial Sequence: Synthetic coding sequence
atggacaagctaaagaaggtcctttccggccaagacaccgaagaccgctctggcttgtccgaggtcgtggaggcctcttcactctcatggtcaacacggatcaaggggtttatagcttgttttgccatcggaattctgtgttccctgctgggcactgtgctgctctgggttcctcggaagggtttgcacctctttgcggttttctataccttcgggaacatcgcatccatcggcagtacgatattcctcatggggcctgtcaagcagctgaagcggatgtttgagcccacaagactaatagcaacaatcatggtgctcctgtgctttgcgctaacgttgtgctccgccttctggtggcacaataaagggctggccctgatattctgcattctgcaaagccttgccctgacctggtattcactgtctttcattccattcgccagggatgcagtcaagaagtgcttcgctgtgtgtctcgcctag

SEQ ID NO: 29969 - DNA, 327 bp, Artificial Sequence
  Description of Artificial Sequence: Synthetic coding sequence
atggacaagctgaaaaaagtgttgtccggtcaggatactgaggaccgttctggtctgagtgaagtggtcgaggcctcttctctgagttggtcaacccggatcaaagggtttatagcatgcttcgctattgggatactttgttcgctgctcgggaccgtcctgctgtgggtgccccgaaaggggcttcacctgttcgcagtgttctacacattcggcaatatcgccagtattggatcttgtgtgctgcaccttccatgcgtgctgccgtttggcggaatcacgagagatctccacctgtcctctgctttttgttccctgtggcactag

SEQ ID NO: 29970 - DNA, 327 bp, Artificial Sequence
  Description of Artificial Sequence: Synthetic coding sequence
atggataagttaaaaaaagtcctcagcggacaggacacagaagatagaagtgggctctcggaggtggttgaggcttcaagcctgtcctggagcacccgcatcaaaggcttcattgcttgtttcgctatcgggatcctatgttctctgctgggtacagtcctcctttgggtgcctaggaaaggtttgcacctgttcgccgtcttttatacattcggcaatattgccagtatcggtagctgcgttttgcatctgccctgcgttctgcccttcgggggtatcactcgggatctacatctgtcatcagcgttctgcagtctatggcactag

SEQ ID NO: 29971 - DNA, 648 bp, Artificial Sequence
  Description of Artificial Sequence: Synthetic coding sequence
atggccgatctgcaccggcagcttcaggagtacctagcacaagggaaggctgggggcccagcagccgcagagccgttgttagccgccgagaaggccgaagagccaggtgatcggccagccgaggagtggctcggacgagctggcctgcgctggacatgggcaagaagcccagcggagtccgcagctgccggcctaacctgcttacctagcgtgacgagagggcaacgcctcgccgccggcggagggtgtttgttgttagctgccctgtgcttcgggctagcagcactttacgcccccgtgttgcttctacgcgctcggaagttcgccctgctatggtcgcttgggtctgcccttgcgctcgcgggctccgccctgctcagaggtggggctgcctgcgggcggctcttgaggtgcgaggaagcacccagccgcccagctctcctctatatggccgccttaggcgccacattgttcgcggctctcgggctccggtctacactcctgacagtcttgggggctggcgcccaagtggccgcattactggcagcactggtgggtcttctgccttggggtgggggcactgcgttacgcctggcgttgggtcgattggggagaggagctggattggccaaggttctccccgtgtag

SEQ ID NO: 29972 - DNA, 6486 bp, Artificial Sequence
  Description of Artificial Sequence: Synthetic coding sequence
atgacccactcccccgctacatccgaggacgaagagagacacagtgccagcgaatgcccggaaggtggatccgagagcgattcttctcctgatggccccggcagaggacctcgcgggactcgtggacaaggatccggcgctccaggctctctcgctagcgtccggggcctacaaggtcgatcaatgagtgtgccagacgacgcccacttttccatgatggtctttcggattggtattcctgacctacaccagactaagtgtctccgcttcaaccccgatgccactatttggacagccaagcagcaagttttatgcgcactgagcgagtctctgcaggatgtgttgaattatgggctgtttcagcctgctacttctggtagggacgctaactttctggaagaggaaagactcctgagagaatacccccaaagtttcgaaaaaggcgtcccctatttagagttccggtataaaacaagggtctataagcagactaacctggatgaaaaacagctggccaaactgcacaccaaaaccggcctaaagaagtttctggagtatgtccagctaggcaccagcgacaaggtggcccgacttctggataagggattagaccctaattatcacgactcagacagcggcgagacacctctgactctggcagcccagactgagggctccgtggaggtgatccgaacactgtgcttgggtggagctcacatcgacttccgagctcgggacggtatgaccgccttgcataaggcagcctgtgctaggcactgcctagcgctgacagccctcctcgatttaggaggcagccctaattataaggaccgaagaggcctgaccccgctatttcacactgccatggtgggtggcgacccgaggtgctgcgagctgctgttgtttaatcgggcccagttgggcattgctgatgaaaacgggtggcaggaaatccaccaggcatgtcagcggggccacagccagcacctggagcatctcctcttttatggcgcagaacccggcgctcagaatgcctccgggaacactgcgcttcatatctgtgctctttataacaaggagacctgcgccagaattctgctgtaccgtggtgctgacaaagacgtgaaaaacaacaacgggcagaccccgtttcaggtcgccgtcattgccggcaattttgagcttggcgagctgatccgcaaccatcgcgaacaggacgtggtcccctttcaggagtcacccaagtatgccgcacggaggagaggaccgcccggcacaggtctgactgtgccaccggccctactgcgggcgaattctgatacatctatggccctccccgactggatggtcttcagcgcccctggcgctgcatccagtggcgcccccggtcctacatcaggttcccagggccagtctcagcccagtgcaccaaccacaaaactttctagtggcacactgcgttcagcctcgagccctcggggcgcccgtgcacgatcaccttctagagggaggcaccccgaagacgctaaaaggcagcccaggggaaggccctctagtagtggaaccccacgcgagggccctgccggcgggaccggagggtcaggagggcctggggggtcacttggatctagaggacggcgtaggaaattatattccgcggtaccaggcaggagtttcatggccgtgaagagttatcaggcccaggctgagggagagatcagtctgtctaagggagaaaaaatcaaggtgctgtccatcggggaagggggcttctgggagggccaggtcaagggcagggttggatggtttccttcagactgtctagaggaggtggctaacaggagtcaggagtctaaacaggagtctaggtccgacaaggcaaaacggctgttcagacactacaccgtaggcagctatgattccttcgacgccccatcactcatggacgggataggaccaggctccgactacattataaaagagaaaacagttctcctgcaaaagaaggactcagaaggctttgggttcgtgcttcgtggggctaaagcccagacacccatcgaagagtttacacctacccctgccttccccgcgctgcagtacttagaatcagtggatgaggggggtgtcgcttggagggctggcctgcggatgggtgacttcctgatcgaagtgaacgggcagaacgtggtgaaagtgggtcaccgtcaggttgttaacatgatccggcagggcggaaacaccctgatggtgaaggtggtcatggtgactcggcacccggacatggatgaggcagtccataagaaggctccacagcaggccaagaggttaccgccccctacgattagcctcagatcaaagtcaatgacaagcgagttggaggagatggagtatgagcagcagcccgcacccgtgccctccatggagaagaagcgtaccgtatatcagatggctcttaataagctggacgagatattagctgccgcccagcaaactatcagcgccagtgagagcccagggccaggggggctggcttctttgggtaaacacaggccgaagggattcttcgccaccgaatcatcttttgacccgcaccatagggcgcagccgagctatgaacgcccctcctttcttcctcctgggccggggctgatgctccgccagaagtccatcggcgctgccgaggacgacagaccataccttgctccacccgccatgaaattttccagatctctttctgtgcccgggtccgaggatatccctcccccgcccacaacatcgccaccggaacctccctatagcacaccacctgtgccttcatctagtggacgccttactccctcccctagggggggcccttttaatcccggcagtggcggacccttgcctgcttccagtccagcatcttttgacggaccctcccctccagacactcgggtaggctctcgggagaagagcctatatcactccgggcccctgccccctgcgcaccaccaccctccgcatcatcatcatcaccacgccccacccccccagccccaccatcatcacgcccacccgccccatcctcccgaaatggagaccggcggatcccccgatgaccctcccccacgcctcgctctcggaccgcaaccatcacttcgcggttggcggggaggaggacccagtccgacacccggcgctccaagtccttcacatcacggctctgcaggcggggggggtggatcatctcaaggccccgctctcaggtacttccagttgccacctagggccgccagcgccgcaatgtacgtccctgcaaggtcaggaagaggacgcaaaggacctctggtgaagcaaacaaaagtggagggcgagcctcagaagggaggcggcttaccccctgcacccagtccgacaagccctgcaagtccccaacctccacccgcagtggcagctccgagtgaaaagaacagtattccgattcccacaattatcatcaaagctccatctaccagctcttctgggagatcttcacaaggctcgtctacagaggccgaacctcccacacagcctgaacccaccgggggtggaggcggcggaggatcgtccccatctcctgctcctgctatgtcccctgtgcctccgtctccatccccagtccccacacccgccagtccaagcggacctgccacactggatttcacatcccaatttggagcagccctggtgggcgctgccagacgggagggcggatggcaaaatgaggctaggcggagaagcactctgttcctctcaaccgatgcaggcgatgaggatggaggcgatggaggactggggaccggggccgctcctggcccaagactccgccattcaaaatccatagacgaagggatgtttagtgccgagccctatctgcggctggagtccgcagggtctggtgcaggttacgggggctacggtgccgggagcagggcttacggaggtggagggggctccagcgcctttacgtcattcctccccccgagacctctcgtgcacccactgactgggaaagcccttgaccccgccagccccttaggcttggctctggcagcccgcgagagagctctcaaagagagttcagagggaggaggagctcctcagcctcccccgcgcccgccctccccaagatatgaggctccgcccccaactccgcaccatcactccccacacgcccaccacgagccggtcctccggctttggggagccagtccacctgacccggctagaagagagctcggctacagggccgggctgggatcacaggaaaagagtctgccggccagcccccccgcagcaagacgctccctgcttcatcggctgccccccaccgccccaggggtcggcccattactgctgcagctaggcaccgagccacctgctcctcaccctggagtttcaaagccatggagaagtgcagcccccgaggagccggagcggctgccattgcacgtgagatttttggaaaattgtcagcctcgcgcccccgtaactagcgggcgtggccctccgtccgaagacggacctggagtgcctcctccctcaccgcgcaggtccgtccccccgagcccgacttccccaagagcctcggaagagaacgggctgcccctgctcgtcctgccgcctccagccccgagcgtggacgtcgaggatggggaatttctgtttgtggaaccactacctcctcccttggagttttccaatagcttcgaaaaaccagaaagccccctaacaccgggacccccccaccctcttcccgatactcccgctcctgctactccgctcccccccgtccctcctcccgccgtcgccgcagccccgccaaccttggacagtactgcaagctccttgactagttatgatagcgaagtggctacactgacacagggagcctctgctgctccaggagatcctcaccccccaggaccccctgcccccgctgccccagccccagcagctcctcaacccggcccagatcctcctccaggcaccgatagcggtattgaggaggtcgattcccgtagcagcagcgatcaccctcttgaaaccatctcttctgctagtacgctctccagcctgtccgccgagggtggcggttccgcaggcggagggggcggcgcgggagctggggtcgcatcgggcccagaactcttagacacgtatgtagcctacttggacggacaggcgttcggcgggtcatcgacccccggccctccttatccaccccagcttatgacgccctccaagctgcgaggtagagccctgggcgcgtccggaggcttgagacccggtcccagcggcggattgcgggaccctgtcactcctactagcccaactgttagcgtgacaggtgcaggaaccgacggcctcttggctctccgtgcctgtagtggaccaccaacagccggagtggccggcggtcccgtcgccgttgagcctgaggtgccacctgttcctttgcccacagcgtcatctctcccacggaagctgctgccttgggaggaggggccagggccaccacctccgcccctgccaggcccattggcacagccccaggcctcagccttggctaccgttaaggcctcaattatcagcgaactgtcctccaagttgcagcagtttggcgggtcatccgcggcaggtggcgcactcccctgggcaaggggggggtcgggcgggggaggagatagccatcatggaggcgcaagttatgtgcctgagaggacaagttcgctacaaagacaaagactcagcgatgatagccaatccagtttactgagcaaaccagtgtccagcttatttcagaattggcctaaaccaccccttccccctctcccgactggcactggcgtgtccccaaccgccgctgccgcaccgggcgcaacatccccttccgctagttcatcgtccacatctacaagacatcttcagggcgtcgagttcgagatgcgcccacctctcttgagacgggctccctctcctagtctgctcccagccagcgaacacaaggtcagcccggcccctcggccttcaagtttgcccattctgccctcagggcctctgtatcctggtcttttcgacatcaggggctcacctacaggaggtgccggcggctctgccgatcctttcgctcccgtgttcgtgccaccccatcctggaatctccggagggctagggggggctctaagcggcgccagtcggagcctcagcccaacaaggctcctctcactgcctcctgataagcctttcggcgcaaaacccttgggcttttggacaaagtttgatgtagcagattggttagagtggctcggtctcgctgaacacagggcacaatttttagatcatgagatcgacggctcacacctcccagcactgacgaaagaggactatgtcgatcttggcgttacacgggttggtcacagaatgaatatagacagggcgctgaagttcttcttagagagatag

SEQ ID NO: 29973 - DNA, 6459 bp, Artificial Sequence
  Description of Artificial Sequence: Synthetic coding sequence
atgactcacagcccagctacttcggaagatgaagagcgacactccgcttccgagtgtcctgaggggggcagcgaatcagattcgtcacccgatgggcccgggcggggacccaggggtactcgtgggcaggggtccggggccccgggctcacttgctagcgtccgcggtctccaggggcgctcaatgagtgtccccgatgacgcccacttctcgatgatggtgtttcggattggtattcctgacttgcatcagacgaagtgtctgcgatttaaccccgacgctactatctggactgcaaagcaacaagtgctgtgtgccctgtctgagtctctgcaggacgtgctcaattatggtctcttccagccggccacctctggtagagacgccaacttcctggaggaagaaagactattacgggagtacccacaaagtttcgagaagggcgtaccctacctcgagtttcgctacaagacgagggtttacaagcagacaaatctcgacgaaaaacaactggcgaagctgcacacaaaaactggattgaaaaagttcctcgagtacgtgcaattgggaacatcagataaggtggcccgcctcttggacaagggcctggacccaaattatcatgacagcgactccggagagactcctctgacgctggccgcccagacggaggggagcgtggaggtcattcggacgttgtgtctaggcggcgctcatattgacttcagagcacgcgatggcatgacagcactgcataaagccgcatgcgcgcggcattgtctggcactgactgcgctcctcgacctggggggaagccctaactacaaagaccgacgtggcctgacacccctgtttcatactgctatggtgggaggagatcctcgttgctgcgagctcttactgtttaatcgggcccaactgggcatcgccgatgaaaatgggtggcaggagatccaccaggcctgtcaacgggggcactcacaacacctggaacatttactgttttatggcgccgaaccaggggcacagaatgcttccggtaataccgcactgcatatttgtgctctgtataataaggagacctgcgccaggattcttttgtatcggggagctgataaggatgtgaaaaacaataacggccaaaccccattccaagtggctgtgatcgctggcaactttgaacttggggagcttatacgcaatcaccgagagcaggacgtcgtcccatttcaggaatccccaaagtacgcggcgcgtagacggggcccccccgggacaggcctcacggtccctccagctcttctgagggcaaattcagacactagcatggccctcccagactggatggtgttcagcgctcctggcgctgctagcagtggcgcccccggccctaccagcggatctcaggggcagtctcagccctcagcccccaccaccaagctgagttctgggacactgcgatctgcatcaagtcccaggggcgccagagcgaggagtccgagtcgagggagacatccagaggacgctaaacggcagcctcgagggcggcccagttcctcaggcactccccgggagggacccgctggcggcacgggcggatccggcggtcctggaggttctctgggatcgcgcggtcggcgccggaagctttatagcgcagtgcccgggagaagtttcatggctgtgaagtcctatcaggcgcaggccgagggcgaaatctctctgtccaaaggagaaaaaatcaaagttctgtcaatcggagagggcggattttgggaggggcaggtgaaaggaagagttgggtggtttccaagcgattgcctcgaggaggtggctaataggtcccaggaatctaaacaggagtcccgttccgataaggcaaaacgactttttaggcattacacagttggttcttacgacagtttcgatgctcctagtgattatatcataaaagagaaaacggtcctgctgcagaaaaaagatagtgagggtttcgggttcgtgctgcggggcgcaaaggcccagacccccatagaggaatttactccaacccctgctttccctgctttacagtatctcgagtctgtggatgaaggaggcgtcgcttggcgagctggcctgagaatgggagactttttaatcgaggtcaatgggcagaacgtcgtcaaggtcggccacaggcaggtggtgaacatgattagacaggggggcaatactttgatggttaaagtggtcatggtgacgcggcatcctgacatggatgaagcggttcacaaaaaggcaccacaacaggcaaagaggcttccccctccaactatcagccttcgatcaaagtcgatgacgtccgaactggaggaaatggagtacgaacagcagcctgcaccagtgccaagcatggaaaagaagagaacagtctaccagatggctctgaataaattggacgagattctggctgccgcacagcagacaattagcgcctcggaatcccccgggcccggggggttagcatcgctgggcaagcaccgcccaaagggtttttttgcaacagaaagttcattcgatcctcaccatagggcacagccatcctacgagaggccgtcttttttacctcctgggccagggttgatgctccgccagaaatctattggcgcggccgaagatgaccggccatatctggctcctcctgccatgaaattttccagatccttgtctgtgcctgggtcagaggacatcccgcctccacctactacaagcccaccggaacccccatattccaccccacccgtgccttcgtcttctgggagactgaccccttccccaagaggcggtccatttaaccccggcagtggaggccctctcccagcatcaagtcccgcaagctttgatggtccaagcccaccagataccagggtaggaagcagagagaagtctctgtaccatagcggccccttgcccccagcccaccatcatccaccgcaccatcatcaccaccacgcccctcccccgcagccacaccatcatcatgcgcatccaccccacccacctgaaatggaaactgggggatcccccgatgatcctccccccaggcttgccctgggcccacagccctcattgaggggatggcgaggcggaggacccagtcctacaccaggagcgccatcaccatcgcatcatgggtctgccggcggcggaggcgggtcttctcagggcccagcactcaggtacttccagttgcctcctagggctgcgtccgctgcaatgtacgtccctgccagatcgggccgagggagaaaaggtcctctcgttaagcagacaaaggtggagggcgagccacagaagggcggggggctgccccccgccccgagtccaacttcccctgcaagccctcagccccctcccgcagttgcggcgccaagtgaaaaaaactcaatccccatccctacaatcatcattaaggcaccttcgactagttcctctggaaggtcgagccagggctctagcacagaggcagagccaccaacccagccggagcctacggggggtggcggcggaggggggagctcaccctcccccgcgcctgctatgtcacctgttcctcctagcccatcacctgtaccgactcccgcctctccaagtgggccagctacactcgattttacctcgcagtttggtgcagccctagtgggcgccgctcgtagagaggggggctggcaaaacgaggctagaaggcggtccacccttttcctgtcaaccgacgcaggggacgaggatggcggcgatggcgggcttggcactggcgccgcgcccggacctcggttacgacattcaaaatcaatcgatgaggggatgttcagcgccgagccatacctgaggctcgagtcagccgggtccggtgccggttacggaggctacggggcagggtcaagggcttatggagggggaggtggtagcagtgcttttacctctttcctcccaccccgtcctcttgtgcacccgctcaccgggaaggctcttgaccccgccagccccctgggcttagccttagccgcgcgtgagcgcgcactaaaagaaagctccgaaggaggcggtgctcctcaaccccccccaagacccccatcaccccgttatgaggctccacctccaaccccacatcatcactctccacacgctcatcacgagcccgtcctgcgcctgtggggcgcctctccacctgatccagccagacgagaattgggatacagagccggcctgggctcccaggagaaaagtctgcctgcctcaccccccgccgcaagaaggagtctattacatcggctcccgcctaccgcccctggagtcggccctctccttttgcagctcgggactgaacctccagcgcctcaccccggcgtgagcaagccttggcggagcgccgccccggaggaacctgagaggctgcctctgcatgttcggtttctcgagaattgtcaacctcgcgcacccgtcaccagcggacggggacccccctccgaggatggacccggcgtcccccctccttctccgcggagatcagtccccccctctccgacctcaccacgtgcatcagaagagaacggattaccattgctggtgctacccccacccgcgccttccgtcgacgtagaggacggagagttcctcttcgtggaacccctccctccccctctcgagttttccaactcgtttgaaaagcctgagagtcctctcacaccaggacccccacacccactgccggatacccccgcccctgctacacctcttccgccggtgcctccaccggccgtcgcagcggctcctcctacattggactctactgcaagctccctgacctcatacgacagtgaggtggcaacactgactcagggagcttctgcagctcctggagacccgcacccccccggccctcccgcaccagccgcacccgctccagctgcgccccagcccggtccggaccctccacccgggaccgacagtgggatagaagaggtggatagcaggagctcgtcagaccacccccttgaaaccatttccagcgcaagcacattgtctagtttgagcgccgagggtggaggctccgccgggggcggcgggggcgctggagccggcgttgccagcgggcccgagttattggatacctatgtagcatacctggacggacaagcgtttggcggctcatccactcccgggccaccgtacccgcctcagctcatgacaccttccaagctgcggggcagggccctgggagcttctggcgggctgcggcccggaccgagcgggggcctccgcgacccagttacccctacctcccccaccgtttcagtgactggtgcaggtaccgatgggttgctggctttacgggcatgttctggccctccgaccgccggtgtggccggcggtcccgtggctgttgagccagaagttccaccggttcccctgccgaccgccagctccctccccagaaaattgttgccatgggaggaaggacctggaccccctcctcctcccctgcctgggcctttagcccagcctcaggcctccgcgctcgctactgtgaaggcgtctattatttcggaactttccagcaagctgcagcagtttggcggatcctccgctgccggtggcgccctcccgtgggcacgtggcggcagtggaggcggcggagactcgcatcacggcggcgcatcgtatgtccctgagcgcacttcatctttgcagcggcaaaggctgtccgatgattctcagagttcattgttatctaaacccgtgagtagtctattccaaaattggcccaaacctccactgcctcctctgcccactggaacgggtgtgtctcccactgcagccgcagctcctggagccacttctccttcagcctcctcaagctcaacaagtacgcgacacctgcagggggtggaattcgaaatgagacctcctctactacggcgtgccccctccccttccttgctacctgcctccgaacacaaagtctcgcccgctccgcgaccctcttctctacctattctgccttcgggacccctctacccaggtttattcgacatcagaggaagcccaacaggaggagcaggcggctcagcggatccttttgcgccagtgttcgtaccccctcacccagggatttccggggggcttgggggagccttatctggagcaagtcgatccctcagcccaaccaggctgctgtctttaccacctgataaaccttttggtgcaaaaccccttggattttggaccaaatttgatgtcgctgactggctggagtggctgggactggccgaacacagggctcagtttcttgaccacgaaattgatgggtctcacctgccagccctcaccaaagaagattatgtggacctgggcgtcacgagggtgggccatcgtatgaacattgaccgggctctgaagtttttcctggaacgatag

SEQ ID NO: 29974 - DNA, 4647 bp, Artificial Sequence
  Description of Artificial Sequence: Synthetic coding sequence
atgcagctgatggcactcgagcagagatttggaagtggcctacctggaggggggcagcccctgtgtcttatgatgtcctccccactgcctcccccaccacctcacttttcctgccttccggcatctgattatatcatcaaggaaaagaccgtcttgctgcagaaaaaagacagcgaaggctttgggtttgtgttgcggggggccaaggcacagacacccatcgaggagtttacccctacccctgcattcccagcattgcaatatcttgaatcagtggacgagggcggagttgcctggagggctgggttgcggatgggcgactttctcatcgaggtgaatggtcagaatgtggtgaaggtggggcaccggcaagtggtgaatatgattaggcaaggaggaaatacccttatggtgaaagtggtgatggtgacacggcatcccgatatggatgaagccgtgcataaaaaggctccccagcaggctaaacggcttccgccgcccaccatttcactccgcagtaagtcaatgacatcagaactggaagagatggaatatgaacagcagcccgctcccgtcccctccatggagaagaagcgtactgtgtatcaaatggcattaaacaagctcgatgagatcctggcggctgcccagcagaccatctctgcaagcgagagcccaggcccaggcgggctagccagtctcggtaaacaccgccctaagggattcttcgctaccgaatcctcttttgatccccaccatcgggcgcaaccatcctatgagcggccatcattcctgcctccgggcccagggttgatgcttcgtcagaaaagtataggcgccgcagaagacgatcgcccatacctggccccacctgcgatgaagttttccagatctttgtcggtgccagggtctgaagacatcccgccaccaccaacgacgagccccccggagcctccctattccacgccacccgtgcccagttctagcggtaggctgacccccagcccacgcggcggcccatttaatcccggttccggcggccccctgcccgccagcagcccagcctccttcgacgggccttcacctcccgacacacgagttgggtcccgcgaaaagtctctttaccattccggacccttaccccccgcccaccaccaccccccccaccaccaccatcaccacgcaccccctccccagccacatcatcaccatgctcaccccccacatccgcctgagatggaaactggaggttcccctgacgacccccctcctagattggccctgggcccgcagcccagcctccggggatggcggggcggtgggccgagccctacacctggcgcccccagcccaagccatcatggatcagcgggcggtggggggggaagctcgcagggcccagccctgcggtacttccagctgcctccccgagcggcttccgcagcaatgtatgtaccggcacggagcggccgcggcaggaaagggcctctagtcaagcaaactaaggtagagggggagccacagaaaggaggaggcctgccccccgcaccctcaccaacgtccccggccagccctcaacctccccccgcagtcgcagctccatccgagaagaactccatccctatccctactattatcataaaagcaccttctacaagctccagcggcaggtcctcccaaggaagctccacggaagctgaacctcccactcaacccgagcctacaggcggaggcgggggcggaggttcatccccaagccctgccccagccatgtcacctgtgccacccagtccttcccctgtccctacaccagctagtccttccggtcccgcaacactggactttacttcacagtttggtgccgctctggtgggtgctgcgagaagggaaggcggctggcagaacgaagcgcgccgccgtagcacgctgtttctgagtacagacgcaggcgacgaggatgggggggatggtggactgggcaccggagccgccccaggtcctagattgagacacagcaaaagtatcgatgaggggatgttcagcgccgagccttacctgagactagagtcagctggctccggagccggttatgggggctacggcgccggaagtcgagcctatggcggcggaggcggatcctctgcctttacttctttcctgccaccaagacctctggtgcaccccttaacaggaaaagcccttgacccagcgtcacctcttggactagccctggccgctcgtgaaagagctctcaaggagtcttccgagggcggcggcgccccacagccgccccccagaccaccatccccacggtacgaggcgccacctcccactccacatcatcacagtccccacgcacaccacgagccagttctcaggctctggggtgcctcacctcctgaccctgccagacgcgaattgggttaccgggcggggctgggatcacaggaaaagtcacttccggcatcccccccagctgccagacggtccctgctgcaccggctcccccctaccgctcctggagtgggaccgctgcttcttcagctcggaaccgagccgccggctccgcaccctggagtcagtaagccttggaggtccgctgcccctgaggagcccgagagattaccgctgcacgtcagattcctggagaactgccagccccgagcacctgtgactagcggaagaggccccccctcagaggatggaccaggagtgcctccgccatcccccaggaggtctgtgccaccctccccgaccagtcctagagcctctgaggagaacggtcttcccctcttagtccttccccctcctgccccatccgtagatgtggaggatggggagtttctgtttgtcgaacccctccccccacccctggagttctcgaatagcttcgaaaagcctgagtcccctctgactcctgggcccccccacccactcccagatacgcctgcacccgccaccccactccctcctgtccctcccccagccgtggctgcagcacccccgacccttgattccactgcctctagcctgacatcatacgattccgaggtggcaactctcacacagggagcaagtgcagcacctggagatccacaccctccgggacctccggcgcccgcagctccagctcccgcggcgccccagccagggccggaccctccaccaggaaccgactccggcatcgaagaggtggactcaagaagctcttccgaccatccattggagaccataagttcggctagcaccctcagttccctgtctgccgaaggaggaggaagcgccgggggaggtggaggggcgggggccggggtggccagcgggcccgagctgctcgacacctacgtggcatatctcgacgggcaggcctttggggggtcaagtaccccgggtccaccgtatcctcctcagctgatgaccccttctaagctacgcggacgtgcgctgggcgcctcaggggggttacggcccggtcctagtggcggccttcgagaccctgtgactcctacttcccctaccgtgtcggtcacaggagctggcaccgacggactgttggccctgcgagcttgctccgggcctcccaccgcaggtgtcgccgggggcccagtcgctgtagagcccgaagtcccgcctgtgcctctacctaccgcatccagcctaccccgcaagctcttaccttgggaggaaggacccggaccccccccccctccattgcctggacccctggcccagccacaagcctctgcgctcgctacagtcaaggcatcaataatcagcgagctgtcatcaaaactgcaacagtttggcggtagcagcgctgccggaggcgcgcttccttgggcccgcggtgggtccggaggcggcggagattctcatcacgggggggcttcctacgtgcccgagcggacgagctcactgcagagacaaaggctcagtgacgatagccagagtagcctgctgtccaaacctgtctcatcactctttcagaactggcccaaaccacctttaccacctctgccgaccggaacgggagtgtcccccaccgcggccgctgcaccaggggccacttctcctagcgcatcaagtagtagcactagcacacggcacctgcagggagtagaatttgaaatgagaccaccgttgttgagacgagcacccagcccgagtttgttgccagcgtcagaacacaaagttagccccgcgccgcggccgtcttccttgccaattttaccgagcgggccgctgtatccagggctttttgacatcagaggcagcccaacaggaggagcaggcggatcagccgaccccttcgcgccggtttttgtgcccccacacccagggattagcggcggcctcggaggcgcgctctctggggcaagcaggagcctttctcctactagactgctgagtctgcctcccgacaagccttttggcgctaaaccactcggcttttggacgaaattcgatgtcgccgattggctggaatggttgggcctggccgaacacagggcccaatttctcgaccacgaaattgatggaagccacttacccgcgctcaccaaagaggattatgtggatctgggcgtgactcgcgtgggtcaccgaatgaacatcgaccgggccctgaagttcttcctcgagcgttag

SEQ ID NO: 29975 - DNA, 6510 bp, Artificial Sequence
  Description of Artificial Sequence: Synthetic coding sequence
atgacacactccccggctacctcggaggacgaagagcgccactcagctagcgaatgtcccgagggtgggagcgaaagcgactcctcacctgatggacctggacggggcccaagggggaccagaggtcagggctctggggcccccggaagcttggcatctgtacgagggctgcaggggaggtccatgtctgtacctgatgacgcccatttttctatgatggtgtttcggatcgggattcctgatttgcatcagactaagtgcctacgctttaatcctgatgccacgatatggactgccaagcaacaggtgctgtgtgccctaagtgaatctctgcaggacgtccttaactacgggctgtttcaacctgcgaccagtgggagggatgcgaacttcttggaagaggagagattgctgcgggaatacccacaatccttcgagaaaggcgtcccttacttggaattccgatataaaacaagggtttataaacagaccaatctggatgaaaagcagttggccaagctccatactaaaaccggactaaaaaaattccttgaatatgttcagcttggcacctccgataaagtggcgcggttgcttgacaaggggcttgatcccaactatcatgattcagactccggggaaactccattaactctcgcagcacagacagaagggagtgtcgaagtgattcggacactgtgcctcggaggagcccatatcgacttccgggcacgggacggaatgactgcgcttcacaaggcagcatgcgcccgccattgcttggccctgactgctttactggatcttgggggctcccccaattacaaagaccggaggggacttacacctctattccacacagctatggtcgggggcgatcctcgatgttgcgaattgcttctttttaatagagctcagctagggatcgctgatgaaaatggctggcaggagatccaccaggcttgccaacgaggtcacagtcagcacctggaacacttgcttttctacggagccgagccaggcgcacaaaacgcgagcggtaatacggccctgcacatttgcgctctgtacaataaagagacatgcgcgagaatcctgctataccggggggctgacaaggacgtaaaaaacaacaacggacagacaccatttcaggttgccgtgattgcagggaattttgaactaggtgagcttattaggaatcaccgggaacaggacgtggtgccctttcaagagtcgccgaagtacgctgccagacggcggggtccacccgggaccggactgacagtgccaccagccctgttgcgggcaaacagcgatacctcaatggccttgcccgactggatggtcttttctgctccaggcgccgccagctcaggtgcccctggaccaacaagcggcagccagggccagtcacaacctagtgcacccaccacaaagcttagttcgggcacattaagatcggccagctcaccacggggtgcaagagcccgttctccaagcagggggcgtcaccctgaagacgccaagaggcaaccccggggcagaccttctagttccggaaccccccgcgaaggaccagctggagggacgggcggcagtgggggccctggcggatctctgggctcccgcgggcggcgccgaaaactttacagcgctgttcctggccggagcttcatggccgtgaaatcataccaggcccaggccgagggggagatctctctatcaaaaggcgagaaaatcaaggttttgtccatcggggaaggcggtttctgggaaggacaggttaagggtcgtgtgggctggttcccctcagattgccttgaggaggtggccaatcggagccaagaaagcaagcaggaaagcagatccgacaaggcgaagcggctctttcggcattacactgttgggtcgtacgactcgtttgatgcaccttccctgatggacggtattggccccggatccgattatatcattaaagagaaaactgtccttttgcaaaagaaggattctgaaggctttgggttcgtgctgcgcggggccaaggcccagactccaattgaagagtttacacccacccccgcctttccagcgttgcaatacttggaatcagtggacgaagggggcgtggcttggcgcgccggcttgcgcatgggtgactttctgattgaggtgaatggacagaatgtagtgaaagtgggtcaccgccaggtggtgaacatgattcgccagggcggaaatactctaatggtgaaagttgtgatggtgacaagacacccagacatggatgaagctgtgcacaagaaggcacctcagcaggccaaacggttgccccccccgaccatctctctaaggagcaagtctatgacatcagagcttgaggaaatggtgagtccttggaaaaagaaatctgaatacgaacaacaacctgcccctgtgccttccatggagaaaaaaagaactgtctatcagatggctctcaacaagctagacgaaatcttagccgcggcccaacaaacaatctccgctagtgaaagtcctggccccggagggttggcttctctgggtaagcaccgaccgaagggattcttcgctacagagagtagcttcgatccacaccaccgagcccagccttcatatgagcggccgtcctttttacccccaggcccaggtctgatgcttcgacagaagtccatcggcgctgccgaggatgaccgtccctaccttgcaccccccgcaatgaagtttagccggtctctttccgtgcctggcagcgaagatataccacctccgcctaccacttcgccccctgaacctccttatagtactccgccagtgccttcctcttccggaaggctgacgcccagtccccgtgggggaccattcaatcctggaagcggcggccccctccctgcatcgagtccggcatccttcgatggcccttcgccacccgatacgcgggtggggtcgcgggagaagtccctgtaccattcagggccattgccgcccgcccaccatcaccctccccatcaccatcaccatcacgcaccacccccccagccccatcatcaccacgctcacccacctcatccaccagaaatggaaacaggggggtcacctgatgacccacctcctcgccttgctctcggacctcagccttctctaagagggtggagaggtggtggaccctcaccgacaccaggcgcaccctcccctagccatcatggatctgcggggggggggggaggaagctctcagggtcccgcccttcgatatttccagttgcctccacgggccgcctcagcagctatgtacgtgcctgcacgcagcggcaggggccgcaaaggccccctggtgaaacagacgaaggtggaaggggagccacagaaggggggaggactaccccctgctcccagtcctacttcccctgcctcgccccagcctccccctgcagtggccgcaccctccgagaaaaacagtattccaattccgactatcattatcaaagccccatccacatcctctagtggcaggagctcccagggatcatctacagaggctgaacctccaacccaaccggaacccactggcggtggaggtggtggcgggagcagcccttctcctgctcccgccatgtcccccgtcccgcctagcccttcgccagtacctactcctgcctcaccttcagggccagcaaccctggactttacctctcaatttggcgcggcacttgtaggcgccgcaaggcgggagggaggctggcagaacgaggctagacggcgatcaacccttttcttgtcgaccgacgccggggatgaggacggcggtgacggtggtctaggcaccggggctgctcccggtccccgtctcagacatagcaagtccatcgacgagggaatgttttctgcggagccatatctacgcctcgaatccgctggatctggtgcaggctatgggggatacggagccggaagtcgggcgtacggtggaggtggaggaagtagtgcctttacgtcattcctgcccccccgcccactggtgcatcccctaacaggaaaagccctggaccctgcgtcgccactcggactggcactcgccgctagggagcgagccttgaaggaatctagcgaaggcggaggggctccacagcccccaccgcgaccaccttccccgagatacgaagctcccccacctacgccccaccatcactccccccacgcccaccacgaacccgtgctcaggttgtggggggccagtcctcccgatcctgcacggcgcgaactcggctaccgagctggtctcggaagtcaagagaagagtctccctgcgtctccacccgcagctagacgaagcctcttgcatcgactgcctcctaccgcccctggcgtgggtccattgttactgcagctgggaacagaaccgcctgcccctcaccccggcgtttctaaaccatggcgcagtgctgcccccgaggaacctgaacgcttaccgctgcacgtgcggtttttggagaattgtcagccaagggctcctgtcacatcaggaagaggacccccctctgaagatggccccggggtacccccgcctagcccaaggagatctgttcctccctcccccacatctccaagagcaagcgaagagaatggcctgcctctactggtcctaccccctcccgccccctcagttgacgtcgaggacggggaatttctctttgtggagcctctacctcctcctctggagttctccaacagcttcgaaaaacctgaatcccctctgacccccggccctccacaccccctgcccgatacacccgccccagcaacacctctgccgcccgtgcccccaccagccgtggcagccgccccacctacgctggactcaaccgcctcctcgctgacctcgtacgacagcgaagtcgctactctgacccagggagccagcgctgcccccggggatccacatccgcccgggccgcctgcacctgcagctcccgcccccgccgccccccagccgggtccagatcctccaccagggactgatagcggtatcgaagaggttgacagccgctcgagcagtgatcaccctttggaaacaatttcatcggccagtaccttaagtagcctctcagcagaggggggcggcagtgccggcggtggcggtggagcaggcgctggagtggcctctggacctgagctgctggacacttacgtcgcgtatctcgatggccaggcttttgggggcagtagcacgccagggccaccgtatcccccacaactcatgacacccagtaaactgcgcggtcgggctctgggcgcctctggaggtctcagacccggtcctagtggcggcctccgcgaccctgttacaccaactagccccacagtctccgtaacgggggctggaacggacggcctgctggccctgcgggcctgttctggccctcctactgcgggcgtcgccgggggccccgtggctgtggaaccagaggttcccccagttcctctcccaaccgcatcctctctgccccgcaaacttctcccttgggaagaggggcccggacctcccccaccacccctgccaggcccactggctcagcctcaagctagcgctctcgccactgttaaggcttccataatctcagaacttagttcaaagctgcagcaattcggtggcagttcagcggcaggcggggccctgccatgggcgcgcggtggaagtggcggagggggcgattctcaccatgggggtgctagctacgtgcccgaacgcactagtagcctacagcggcagcgcctttccgacgatagccagagcagtctgctctccaaacccgtgtcttccctgttccagaattggcctaagcctcccctgccgcctctccctacgggcacaggcgtctcccctactgccgctgccgcacctggtgccacctccccctctgcgtccagctcatcgacatcgacaagacacttgcagggtgtggagttcgaaatgagacctccactgttgaggagggcgccaagcccttcgcttctgcctgcttcagagcataaagtcagccctgcaccccggccatcttccctgccaattttaccctcgggaccactgtatcccgggctgtttgacatccgtggatcgcctacggggggggccggagggtctgcagatccctttgcccctgtcttcgtgcctcctcaccctggaattagcggaggactcggcggtgcgctatctggcgcatctcgaagcctgtccccaacccgcctcctctcacttccaccggataaaccattcggggctaaacctctgggcttttggactaaattcgatgtagccgactggttggaatggctgggccttgcggaacaccgcgctcaatttcttgaccacgaaatagacggatctcacctgccagcgcttactaaggaagattatgttgaccttggcgtcacaagggtgggccatcggatgaatatagaccgagctctgaagtttttcctggagagatag

SEQ ID NO: 29976 - DNA, 2556 bp, Artificial Sequence
  Description of Artificial Sequence: Synthetic coding sequence
atgaccagccattacgtgattgcaatctttgccttgatgtcctcctgtcttgcgacggctggccccgaaccgggcgctctctgcgaactgagccctgtgagtgcgagccatcccgtgcaggccttaatggaatcattcacagtgctgagtggatgtgcaagcagaggcacgaccggcctgccccaggaagtacacgtactgaacctacgcacagcaggacagggacctggccagttgcagagagaggtcactctccacctgaatcctatctccagtgtgcacatccatcataagtccgtggtttttcttctgaattctccacatcccttggtttggcatttaaaaaccgaacggttggccacaggggtgagtcgcctgtttctggttagtgaggggagtgtggtgcagttttcatccgccaacttttcactaacagctgagacggaagagaggaatttcccccatggcaacgagcatttgttaaattgggccagaaaagagtacggggccgtgacttcttttactgaactcaagattgctcggaatatctacatcaaagtgggagaggaccaggtctttcctcctaagtgtaatatcggaaaaaattttttgagcctaaactacttggccgagtacttgcaaccgaaggccgctgaaggctgtgtcatgagttcacagcctcagaacgaagaggttcacataattgagctaattacacctaatagtaatccttactctgcatttcaggtcgacataacaatcgacatcagacccagccaggaggatctggaggtcgtcaaaaacctgatactcatcttgaagtgtaaaaaatccgtgaattgggtcatcaagtcattcgacgtgaaaggaagtttaaagatcatcgcaccgaattctatcggcttcggaaaggaaagtgagagaagcatgaccatgaccaaatcaatccgagatgacatcccaagcacccaggggaacctagttaagtgggccctagacaacggctacagtccaatcacttcctataccatggcacccgttgcgaaccggttccacctgcgcttggagaataatgccgaggaaatgggggatgaggaggtgcacactattcctccggaattgcgcattttactggatcccggtgctcttccagcgcttcagaacccaccaattcgcggtggggagggacagaacggtggcctgcccttcccttttccagatatctcccggcgggtctggaacgaggagggggaagacggactacctagaccaaaagatccagtaatccccagcattcagcttttccctgggctgcgcgagccagaggaagtgcaggggtccgtggacatcgcactgtccgtgaaatgcgacaatgaaaagatgatcgtagcagtggagaaggacagtttccaggcctccggatatagtgggatggacgtgacacttctagacccgacatgcaaagctaaaatgaacggaacccacttcgtcctggaatctcctctgaacggctgcgggactagacctcgatggagtgccctggatggagtcgtttattacaactccatcgtcatccaggtgcccgcattgggtgattcctcaggttggcctgacggatatgaagatttggagtccggcgataacggctttccgggggatatggacgagggtgatgcttcgctgtttacaaggcccgaaattgtggtgttcaattgcagcttgcagcaggtgaggaaccctagttcatttcaggagcagccccatgggaacatcactttcaatatggaactgtataatactgatctgttcctggtgccttctcagggagtgtttagcgttcctgagaacggccacgtttatgtggaagtctctgtcactaaggcggagcaggagctgggttttgccatccaaacttgcttcatctcaccttattccaaccctgatcgtatgtcgcattatactattatcgagaatatttgtcctaaggatgaaagtgtgaagttctattcacccaaaagagtgcacttccctatcccacaggcagacatggacaaaaaacggttctcttttgtcttcaagcctgtcttcaatacgtctctactctttttgcagtgcgaactcacactgtgcactaaaatggaaaagcatccacaaaagctccctaagtgtgtccccccagacgaagcatgtacgtccctcgatgctagcattatctgggctatgatgcagaataagaaaacatttaccaagccattggccgtgatccaccatgaggccgagagtaaggagaaggggcccagcatgaaggaacctaaccccatctctcctccaattttccatggattggacaccctaacggtcatgggaattgccttcgctgctttcgtgattggcgcacttcttaccggcgcactgtggtacatctacagccatactggtgaaactgccggtcgccagcaggtgcccacttctccccccgccagcgagaactcttcagcagcccacagtattgggagcacacagagtaccccctgttctagctcaagcaccgcatag

SEQ ID NO: 29977 - DNA, 1161 bp, Artificial Sequence
  Description of Artificial Sequence: Synthetic coding sequence
atgaacatcatggactttaatgtaaagaaactcgcggccgatgcaggcacgttcctgtctagggccgtgcagtttacagaggagaaactgggacaggccgagaagaccgaattggatgcccacctggaaaacctcttgagtaaggcagagtgcacgaagatatggactgaaaagatcatgaagcagaccgaggtgctcctgcaacctaaccccaatgctcgaattgaggagttcgtgtacgagaaactggataggaaggctccatccaggatcaataaccctgaactcctggggcaatacatgatcgatgctggtaccgaattcggcccaggcacagcctacgggaacgctcttatcaagtgtggggaaacacaaaagcggatcggcaccgccgaccgcgagctgattcagacttctgccttgaactttttgaccccactgcgcaacttcatcgagggcgactacaaaactatcgccaaggagcggaagttgctccagaacaagcggctagatctggatgctgccaaaacccgtctgaagaaggcaaaggcagcggagacgagaaatagccagcttaactcggcacgtctggagggtgacaatattatgatctgggcagaagaagttacaaagtcagaacaggagctgcggattactcaatccgagtttgacagacaagccgagataacccggctcctgctggagggtatcagctccactcacgcgcaccacctgcggtgcctgaatgattttgtggaggctcagatgacatattacgcgcaatgttatcagtacatgcttgatctgcaaaagcaacttgggtctttcccatcaaattacttatctaacaacaatcagacctccgtgactcccgtgccatccgtgctccccaatgcgattggttctagcgcaatggcaagtacgtccggactggtgatcacctcccctagcaatcttagtgacttaaaggagtgcagcggatcgagaaaggctcgtgtgttgtacgattacgacgcagccaactccactgagctgagtctgctggctgacgaggtaattaccgttttcagtgtagtcggcatggacagcgattggctgatgggcgagcgaggcaaccagaaaggcaaggttccaattacctatctcgaacttctcaattag

SEQ ID NO: 29978 - DNA, 798 bp, Artificial Sequence
  Description of Artificial Sequence: Synthetic coding sequence
atgattgacgccggcacggagttcgggccggggacagcatatggcaatgccctgattaaatgcggtgaaactcaaaagagaatcggcactgctgacagagagcttattcagacctctgccctcaatttcctgacccctcttcgcaattttatcgaaggggactacaagacaatcgccaaggaaagaaaactcctccagaataaacgcctcgacctcgatgctgcgaagaccaggcttaaaaaggcgaaagccgctgagacacgaaattcctctgaacaggaacttaggattacacaatccgagttcgacagacaggccgaaatcactcggcttttactggaggggatctcatcaacccacgctcaccatctgcgctgtctcaatgatttcgtcgaggcacagatgacctactacgctcaatgctaccagtacatgctggacctgcagaagcagttaggttcctttcccagcaattaccttagcaacaataatcaaacctcggttaccccagtaccgtccgtcctgcccaatgccataggaagctcggccatggcctctacaagcggtctggtcattacgtccccgtccaacctgagtgacttgaaggagtgctccggttccagaaaagctcgtgtgttgtatgactacgacgccgccaatagcaccgagttgtcgctcttggcggatgaggtgataaccgttttttccgttgtggggatggattccgactggctaatgggcgagagaggcaaccagaagggaaaggtccccatcacatacctggagctgctgaactag

SEQ ID NO: 29979 - DNA, 2124 bp, Artificial Sequence
  Description of Artificial Sequence: Synthetic coding sequence
atggctgcagccgcgaccgccgccgagggcgtgcctagccgcggtccccctggcgaggtgatccacctgaacgttggcggtaagcgtttttccaccagccgacagactctgacttggattcctgactctttctttagttccctcttgtctggtcgcatctctactctgaaagacgaaaccggcgccatcttcatcgatagagatcctacagtgtttgctcctattctcaatttcctccggaccaaagagctggacccacgcggcgtccacggatcatcattgctgcatgaagcccagttctacggcctgaccccactggtccggagactccaactacgggaagagctcgaccggagctcttgcgggaatgtgctgtttaacggttatctaccgcccccggtgttccctgtaaaacgacgtaatcgccactccctggtcggcccacagcagctcggcggccgccccgcccccgtgcggcgttcaaacaccatgccaccaaacctgggtaatgccggattactcggccggatgctcgacgaaaaaactcctccttctcctagcggccagccagaggagccgggaatggtgaggctggtgtgtgggcatcacaactggattgcggtagcttacacacagttcctggtttgctacaggctgaaagaagcctcagggtggcagttggttttcagttcaccaagactggattggccgattgaacgactcgctctgaccgcccgcgtgcacgggggggcactgggcgagcacgacaaaatggtggccgctgctacaggctcagaaattctgctctgggccctccaggctgagggagggggcagcgagattggggtcttccatctgggcgtgcccgttgaagctctgtttttcgttggcaaccagttgatagccacatctcacaccggcagaatcggtgtgtggaatgctgtgactaaacactggcaggtccaggaggtgcagccaatcacatcgtacgacgctgcagggtctttcctacttctcgggtgtaataacggtagtatatactatgttgacgtgcagaagttccccctgcggatgaaggataacgacctgctggtttctgaactttatagagaccctgctgaggatggcgtcacagctctgagcgtctacctgacccctaaaacttcggattcaggcaactggattgaaattgcatatggtacttcctcgggcggagtaagagtaatagttcaacatcccgagacagtcggaagcgggcctcagctatttcagactttcaccgtacatagatcgcccgtgaccaagatcatgctctctgagaaacaccttatttctgtttgtgccgacaataatcacgtgcgcacttggtccgtcacaagatttcgcggcatgatcagcactcagccaggtagtacacccctggccagctttaagatcttggctcttgaatctgcagacggacatggcggttgtagcgccggcaacgacatcgggccttacggggagagagatgaccagcaggtgtttatccaaaaggtcgtgccttcggcttcccaactgtttgtgcggttgagtagcacagggcagagggtttgctctgtgaggtcagtagacgggagtcccactacagccttcacagtgttggaatgtgagggcagccgcaggcttggcagcaggccacggcgctatctcctaacagggcaagccaatggctcactcgccatgtgggacctcacaactgccatggatggactgggtcaggctcctgccggcggcttaacagagcaggagctcatggagcagctagagcattgtgaactggcacccccagcccccagcgccccctcctggggatgtctcccatcaccgtcacctagaatttctctcaccagtttgcattctgctagctctaacacctcgctctcaggacaccggggatcgccttcaccaccccaggctgaggctaggagacggggggggggaagctttgtggagcggtgccaggagctggtccgcagcggcccagacctgcgccgtccccctacccctgccccttggccaagtagtggtctgggcacacctttaacccccccaaaaatgaagttgaatgaaacgtccttttag

SEQ ID NO: 29980 - DNA, 1464 bp, Artificial Sequence
  Description of Artificial Sequence: Synthetic coding sequence
atgccccctaatctcgggaatgccggcctgctagggcggatgctggacgaaaagacacccccgtccccctcaggccagcccgaggaaccaggcatggtccggctagtgtgtggacaccacaattggatcgctgtggcatacacccagttcctggtgtgttacagactcaaggaggcctccggttggcagttggtattttcctctccgagactcgattggcccatagaaaggctagccttaactgcccgagtgcacggcggtgcgctcggtgagcatgataagatggtcgctgctgctaccggaagtgagatcctcttgtgggcactgcaggcagaaggaggagggagcgagataggggtttttcacctgggagtgcctgtggaggctctgttttttgtcggaaatcagcttattgcaacttcccatacagggcgcataggggtatggaacgccgtgaccaagcattggcaggtccaggaagtccagccaattactagctatgacgctgctggctcctttctgctgttgggatgtaacaacggtagcatctactatgtggatgtgcaaaagtttccactcaggatgaaggacaacgatcttctggtttctgaactgtatagggatcctgccgaagacggggtgacagccttgtctgtgtacctcacacctaagacaatctgtgctgacaataatcacgtgagaacatggtctgtcacaaggttccggggcatgatctcgacgcagcccggttcaacacccttagctagtttcaagattctggcccttgagagtgcagacggacatggcggatgttctgcgggtaacgacatcggcccatacggcgagagagatgaccagcaggtttttatccaaaaggtcgtcccttcagcctcgcagttgtttgtccgattgtctagcacaggccaacgcgtgtgttctgtgcgctcagttgatggaagccccacgaccgctttcacagtattggagtgtgaggggtcccgcaggctaggttcccgccccaggcgctacctgctgactggccaggcaaacggatcactggcaatgtgggatctgacaaccgccatggatggactgggccaagcacccgctggcgggctcacagaacaggagctgatggaacagctcgagcattgcgagctggcaccacctgcacccagtgccccctcctgggggtgccttcccagtccatcacctcggatctcccttacctcacttcactctgcctcctctaacacgtcacttagcggccacagaggttcgccgtcacctccccaggccgaagcccggagaagaggtggtgggtccttcgtcgaaagatgtcaggaactggtcaggagtggacctgacttgcgccgtccaccaactcccgctccttggccgtccagcggcctgggtacccctcttacaccccctaaaatgaagttgaatgaaacttctttctag

SEQ ID NO: 29981 - DNA, 1893 bp, Artificial Sequence
  Description of Artificial Sequence: Synthetic coding sequence
atgagagagcgcgggcaggactccctggcaggcctcgtgctgtatgttgggctattcggccatccagggatgctgcatcgggccaagtactcaaggttccggaatgagtccattacgtccctggacgagggctcttccggaggctccgtcgggaataagggcagccctcagccaccccatcccgcactagctccacacctgccgacagaagatgcaacgttaccatcccaggagagtccaaccccgttatgtactctaatacctcgaatggcctcgatgaagttagccaatcctgccacactgctgagcctaaaaaatttttgtctcggcacaaaagaggtcccacgcttaaagttacaggaatcaagggatcctggatcatctggtccttcgagcccagaaacaagcctgtccagatcaggcacagcccctcctccccaacaagatctggtcggacaccgggcgaccgctttaaccccagactcatgtccacttcccgggccaggggaaccgactctcagatcgcgccaggaccgacacttcctccaacatctgttagggatggggatgaactactgcgtgaggtacatgggctgcgtggaagtgctacagtctatgaggtccctagactttgggatgcggacccaagtaacgcgtgaagccatcagccgactttgtgaagccgtgccgggcgcgaatggtgccatcaaaaagagaaaaccaccggtcaaattcctctccaccgttctcggcaaaagcaatctccaattcagtggtatgaatattaaactaacgattagcacctgctccctgactctgatgaatttggataaccagcagatcatagctaatcatcatatgcagtcaattagcttcgcgtccggaggcgaccccgacacgacggactatgtcgcgtacgttgccaaggacccagttaatcagcgcgcatgccacatattagagtgccacaatgggatggcccaggatgtgatctctactatcggtcaggcctttgagctaagattcaaacagtacctgaagaatccgagccttaacacaagctgtgagagtgaggaagtccatatcgactcccacgccgaagagagggaagaccacgagtactacaatgagatcccaggcaaacaaccccccgtgggaggcgtgtctgatatgagaataaaggttcaggccacagagcagatggcatattgccctattcagtgcgagaaactgtgctacctgcccggaaactctaaatgttcaagcgtctacgagaactgtctcgagcagtccagggctatcggcaacgtgcaccccaggggcgtgcaatcccagcgagacacatcactgctcaagcatacctgccgggtcgatttattcgatgacccttgttacattaacactcaggctttacaatccactccaggttcagccggaaaccagaggagcgcccaaccacttggtagtccctggcactgtgggaaggctcccgagacagttcagcctggtgcgacagcccagcccgcctcttcacatagtctgccgcatatcaagcagcagctgtggtcggaggagtgctatcatggtaagctcagtcggaaggctgctgagtctctgctcgtgaaggacggggactttctcgttcgagagtcagctacttccccaggtcagtacgtcctgtcaggtctgcagggcggccaggctaagcatctgcttctggttgatcctgaaggcaaagtgcgaaccaaggaccatgtgttcgataatgtggggcacttgattcgatatcatatggacaactctctgccaattatatctagcgggagcgaagtgtctctgaagcagcccgtcagaaaagataataaccccgctcttctgcatagtaacaaatag

SEQ ID NO: 29982 - DNA, 1164 bp, Artificial Sequence
  Description of Artificial Sequence: Synthetic coding sequence
atgctccccgcactggaacactggatcccaaagtttttctcttttaggacccggacagggtccccactctccctggcctgccggcagccaatcgttggtccctgcgaccacatcattgcaaaccaccatatgcagtccattagtttcgcatctggcggggatcccgacaccacggattatgtggcctacgtcgctaaggacccagtcaaccagcgcgcatgtcacatcctggaatgccacaatggaatggcgcaggacgtgatttcgaccatcgggcaggcctttgagctccgcttcaagcaatatctcaaaaacccatctttgaacacctcttgcgaatccgaagaggtgcacatcgacagccacgccgaagaacgggaggatcatgaatactataacgagattcctggaaagcagcccccagtcgggggggtctctgatatgcgaattaaagtgcaggcaacagagcagatggcttactgccccatccaatgcgagaagctctgttacttgcccggcaattctaagtgttcctccgtctacgagaactgcctggaacagtctagagctattggcaatgttcaccctcgaggcgtacaatcccagcgggatacatccttgctgaaacacacatgtagggtggatctcttcgacgatccgtgctacattaacactcaagccctgcaatcaacgcctggatcggccgggaaccagaggtccgctcaacctctgggctcgccctggcactgcgggaaggccccagagactgttcagccaggtgcgacagcccagccagcaagttcgcactcgctgccccacatcaagcagcagctgtggagtgaggagtgttatcacggcaagctctcgcggaaggccgccgagtctctgctggtgaaagatggggattttttggtacgcgagagcgccacatctccaggccaatatgtgctgtcgggcttgcagggtggtcaggctaagcacttgcttctcgtggatccagagggaaaggtcaggacgaaagaccacgttttcgacaacgtgggccacctgatacgataccacatggataatagtctccccataatcagtagcggcagcgaggtgtctctcaaacaacccgtccggaaagacaacaacccagctctcttgcactctaataagtag

SEQ ID NO: 29983 - DNA, 888 bp, Artificial Sequence
  Description of Artificial Sequence: Synthetic coding sequence
atgtggggggccaggcggtcctcagtgagtagcagttggaacgccgcatcattgcttcagttgctcctggccgcattgctggcagccggtgctagggcgtctggggagtactgccacggttggctggatgctcagggcgtgtggcggattggttttcaatgtccagaacggtttgatgggggcgatgccaccatctgttgcggtagttgtgcactcagatattgttgcagcagtgcggaagctcgtctggaccagggtgggtgcgataatgaccgccagcagggagccggcgagcctggaagggctgataaggatggcccggatggtagcgcagtgccaatctacgtgcctttcctcatagtaggcagcgtgtttgtcgccttcattattttgggatccctagtagcagcatgttgttgcagatgtcttagacccaagcaggacccacaacagtctcgggctccaggggggaatagactgatggagacaataccaatgatcccgagcgccagcacatccaggggctcatcatccagacagtctagcacggccgcatcctcctcgtcaagtgcgaacagcggcgcccgagccccgccaactcggtcgcagacaaactgctgtcttcctgagggaacaatgaacaacgtctacgtgaatatgcctaccaactttagcgtccttaactgtcagcaggcaacccagattgtgccacaccagggccagtaccttcaccccccctacgtaggctatactgtccagcacgattctgttcccatgacagcagtgcctccattcatggatggcctacaaccagggtaccggcagattcaatcccctttccctcatacaaacagtgagcagaagatgtaccccgcggtcactgtgtag

SEQ ID NO: 29984 - DNA, 717 bp, Artificial Sequence
  Description of Artificial Sequence: Synthetic coding sequence
atgagagctttgttggccctatgcctactgctggggtggttgagatggggcccagcgggcgcacagcagagcggggaatattgtcatggatgggtggatgttcagggcaactatcacgaaggatttcagtgtccagaagactttgatacgttggatgcgaccatctgctgcggttcttgcgcactgagatattgttgtgctgccgcagacgctcgtctggagcaggggggatgtacgaacgatagaagggagctggagcatcccggtatcacagctcaacccgtatatgtgcctttcctcatcgtgggctcaatattcatcgcctttatcatcctgggatcggtagtggcaatctactgctgcacgtgcttgagaccgaaggagccatcccaacagcctatacgattttccctgcgcagctatcagacagagaccctacctatgatcctgactagtacatcgccaagagctccttcacggcagagttcgacagcaacgtcgagctccagtaccgggggaagcatcagacggttttcattcgctagagccgagcccggctgcctagtccccagtccccctcccccctacacaacttcccattccattcacctcgcccaacccagtggctttctcgtttcaccacagtacttcgcctacccattgcaacaagaacctcccctgccggggaagtcatgccccgatttttcaagttcctag

SEQ ID NO: 29985 - DNA, 594 bp, Artificial Sequence
  Description of Artificial Sequence: Synthetic coding sequence
atgcctcctgctggccttaggagagcagccccactgacagccatagcactcctggtcctgggtgcccctctcgtgctggccggggaggactgtttgtggtacctcgatagaaatggatcatggcaccccgggtttaactgtgaattctttaccttctgctgcggcacctgttatcacagatactgctgtagagacttgaccctcttgatcaccgaacggcaacagaagcattgcctggctttttccccaaaaacgattgccggaatcgctagtgctgttatcctattcgtggctgtcgtcgcaactactatttgctgttttctgtgtagctgctgttatttatacagaaggagacagcagctgcagagccctttcgagggccaggagatcccaatgaccggcatccccgttcagcccgtgtatccataccctcaggaccctaaggccggccccgccccaccgcagccaggattcatttatcctccatctggcccagcccctcaatacccattataccctgctgggcccccagtgtacaacccagccgccccacccccttacatgccacctcagccaagctatcccggagcgtag

SEQ ID NO: 29986 - DNA, 1503 bp, Artificial Sequence
  Description of Artificial Sequence: Synthetic coding sequence
atggcactgcgccgacttttgctcctgctgcttctgagtctagagtctttagacttgctgccaagcgtccatggcgcaaggggcagggccgccaatcgcacgttgagcgccggcggagcagcagtgggcgggcgtagggccggaggtgccctagctagagggggacgcgaactgaacgggaccgcacgcgctccagggatccccgaggccggcagtcggcgtggccagcctgccgcagccgtcgcagccgcagccagcgcagccgtcacttatgagacatgctggggctattacgatgtgtccggtcaatacgacaaggaatttgagtgtaacaatagtgaatccggttatctttactgttgcggaacctgttattatcgcttctgctgcaagaaaaggcacgagaaactggaccaacgccagtgtactaactatcagagcccggtgtgggtccagaccccgtcgaccaaggttgtcagccctggaccagagaacaaatacgatcctgaaaaggacaaaaccaatttcacggtttatattacatgtggggtgatagcattcgtgatcgtggcaggagtattcgctaaggtgtcttatgacaaggcccaccggccaccccgcgagatgaacatccacagggcactggccgatatacttagacagcaggggccaatacccattgcccactgcgagagggagaccatctctgctattgacacaagcccaaaggagaacaccccagtcagatcctcaagcaagaaccactacaccccagtgcgaactgctaagcagacccctgagaagcccaggatgaataacattctgacatccgctaccgaaccttatgacctcagtttcagcaggagttttcaaaatctggctcatctgccaccctcatacgagtctgccgtgaagactaatccatcaaagtacagtagtctgaaacgtctcacagacaaggaagccgatgagtactatatgcggcggaggcaccttccggatctagcagcgcgcggcacacttcctctcaacgttatccagatgtctcagcagaagcctctccctcgagagaggcctcggcgccctatcagagcaatgtcacaggaccgcgtcctgagccctgatcggggtctgcccgatgagttcagcatgccatacgacaggatcctgagcgacgaacagctcctcagcacagaacggctccactcccaggaccccctcctctcccccgagcgtacggccttccctgagcagtccttaagcagggctatttctcataccgacgtgttcgtctccacccccgtgcttgaccgttaccggatgagcaaaatgcacagccacccatctgcttccaataattcttatgccaccctgggccagtcccaaacagccgccaagcgacacgcatttgccagccggcgccacaacacagttgagcagctgcactacattcccggacatcatacctgctacaccgccagtaagacagaagtaacagtctag

SEQ ID NO: 29987 - DNA, 1599 bp, Artificial Sequence
  Description of Artificial Sequence: Synthetic coding sequence
atggctctccgccgcttactgctgttgctgttgctgtccctcgaatcactggacctcctgccctccgttcacggtgcaagaggcagagcagctaacaggactctgagtgcgggcggagctgccgttggggggaggagggccggcggtgcactggccagagggggccgcgagctgaatggaacagcaagggcccctggcatccctgaagcaggtagccggcgggggcagcctgctgccgccgtggccgcagcggcctccgcggcagtcacatatgaaacttgctggggctactatgatgtatctggtcagtatgacaaggaatttgagtgcaacaactccgaaagtggttatctgtactgctgcggcacttgctactaccggttctgctgcaagaaacgtcacgaaaagctggatcaaagacaatgtacaaattaccaatcccctgtgtgggtccaaacaccttctacaaaggtggtatcacctggtcctgagaataaatatgaccccgagaaggataagaccaatttcaccgtctacataacctgtggagtgatcgccttcgttatcgtggccggagtgtttgccaaagtgagctatgacaaggcccatagacccccccgagaaatgaacatccatcgggctctggctgatatactacgtcagcagggccctattccgatcgcccactgtgaacgggagacaatttcagccatcgatacaagccccaaagagaatacccctgttagatcaagcagcaagaaccattatacccccgtgaggacggctaagcaaacccccgggcactatgggaaagacgcctacagatcgggcgggcccgatctccataacttcatctcatccgggttcgtaaccctgggaaggggacacaccaaggagaaacctaggatgaataatatattgacaagtgcaaccgaaccctatgacctgtcattctccagaagttttcagaacctagcccaccttcccccttcttatgagagtgcggtaaagaccaacccctctaaatactcctctttgaagcggttgacagataaggaggccgacgagtactatatgcggcgccgccatctgcccgatctggctgctagaggaactctgccgttaaatgtgatacagatgtctcagcagaaacctcttcccagggagaggcccaggcgcccgatcagagccatgtctcaggaccgagtgttgtcccccgacaggggtctcccggatgagtttagcatgccttatgacaggatcctcagcgatgaacagttgctcagtacagagcgcctgcattctcaagatcccttgctgagccccgaaaggactgcgtttcctgaacagagtttgtcccgcgccataagtcacacggacgtgttcgtctcaacgcctgtgctggaccgctaccgaatgtcgaagatgcacagtcacccctctgcgagtaataatagctacgccactctcgggcagtcccagaccgccgccaagcggcacgccttcgcatctcgcaggcataataccgtggagcaactgcactacatccccggtcaccacacttgttacaccgcttccaaaacggaggtgaccgtgtag

SEQ ID NO: 29988 - DNA, 1656 bp, Artificial Sequence
  Description of Artificial Sequence: Synthetic coding sequence
atggcactccgcagactgctgctgctgctgctactgtccctggaaagcctggacctcctccctagcgtccacggcgcgagagggcgggcggccaatagaaccttatccgctggcggagcagccgttggagggcgcagggcgggcggagctctagcacgcggaggcagagagctcaacggaactgctcgagctcccggcatccccgaagcgggatccagaagaggtcagcccgctgccgccgtcgcagccgccgcttccgccgccgtgacctacgagacctgctggggctattatgatgtctcaggacaatacgacaaagaattcgagtgtaacaacagtgagagtgggtatctgtactgctgtggcacatgttactatagattctgttgcaaaaagcggcatgaaaaattggaccagagacagtgtactaactaccagtctcccgtgtgggttcagaccccaagtactaaggttgtgtcccctggcccggagaacaagtacgatccagagaaggataagaccaactttaccgtctatatcacctgcggagtgattgcatttgtgatagttgctggcgttttcgccaaagtgtcctacgacaaagcccaccggcctcctagagaaatgaatattcaccgagccctcgctgacattctgagacagcaagggcctatccctattgcccactgcgaacgtgaaacaatcagtgcaatagacacatcacccaaggaaaacacacctgtacgcagttcaagcaagaatcattatacccctgtgagaactgctaagcagactcccgggcattatggtaaagatgcctatcgctccggaggccctgacctacacaactttatcagctccggttttgtcacgctgggtaggggacacaccaagggagaccatcagtacaaccacccaatactgtcaagcgtgacccagatccccccacacgaaaaacctcgtatgaataacatcctcacctcagcgacagagccctatgacctctcctttagtaggagctttcagaatctcgcgcacctgccaccttcctacgagagcgcggtcaagacaaacccatctaaatacagcagcctgaagcggctaaccgacaaggaagccgacgaatactacatgcgccgaagacatttgcctgatctagccgcccgcgggactctgcccctcaacgtgatacagatgagtcagcaaaagccactgccccgcgagaggccacggagacccatccgcgctatgtctcaggatcgggtgctgtctcctgatcgaggcctcccggatgagttttccatgccttacgatcgcatcctgtccgatgagcagctcctttccacagagcgattacatagccaagatccactgctgtctccagaacggaccgcgtttccagaacagagcctttctagggccatttctcatacggacgtgtttgtgtcaacccccgtgctggaccggtatcgaatgagtaagatgcactcccacccatcagctagtaataatagttacgctactttgggccagtcccagacagctgcgaaacggcacgccttcgcgtcgcggaggcataacacagtagagcaattgcattatattcccggccaccatacctgctacacagcctccaagaccgaggtcactgtgtag

SEQ ID NO: 29989 - DNA, 930 bp, Artificial Sequence
  Description of Artificial Sequence: Synthetic coding sequence
atgtcgtttaaccttcagtccagcaagaagctgttcatattcctggggaagtcattattttcgctgctagaggccatgatctttgcccttctgccgaaaccacggaagaacgttgctggggaaatcgtattaatcactggagccggtagtgggctgggaagattgctggctctgcaattcgcccgtttaggctctgtgcttgttctctgggatatcaacaaggaaggaaacgaggaaacctgtaagatggcccgggaggccggggccacccgcgtgcacgcctacacctgcgactgtagtcagaaggaaggagtgtatagggttgctgatcaggtgaaaaaagaggtcggcgatgtgtccattctcattaataatgccgggatagtcactgggaaaaaatttctggactgtcccgacgaattaatggagaaaagcttcgacgtgaactttaaagctcacttgtggacttataaagcctttcttcctgcgatgatcgctaatgatcatggccacctggtgtgtatctccagcagcgctggattatcaggggttaatggattagcagattactgtgcctcaaaatttgctgccttcgggtttgccgagagcgtgttcgtcgagaccttcgtgcagaagcaaaagggcattaaaacgaccatcgtctgtccctttttcattaagactggcatgttcgagggatgcacaacgggctgcccttccttgttgcctattctcgagcccaaatacgccgtggaaaagatcgttgaagctatcctgcaggagaaaatgtacctgtacatgccgaaattattatattttatgatgtttctcaaatcttttctcccattaaagaccggccttctgattgcagactacctggggatactccatgcaatggatgggtttgtagaccagaagaaaaaactgtag

SEQ ID NO: 29990 - DNA, 798 bp, Artificial Sequence
  Description of Artificial Sequence: Synthetic coding sequence
atgagtttcaacctgcagagttccaaaaaattattcatctttctggggaagagcctgttctctctgctggaagcaatgatcttcgccttgctgcccaagccaaggaaaaatgtggcaggcgagatcgtgttaataacaggcgccggctcagggcttggacggcttctggccctgcagttcgctagactgggaagtgtcctggtgctgtgggatataaacaaggagggtaatgaggagacctgtaaaatggccagagaagccggagctactagagtccacgcttacacttgtgactgttcccagaaagagggcgtctatcgcgtggccgaccagacttacaaggcgttcctgccagccatgattgccaacgatcacgggcacctagtttgcataagcagcagcgcggggcttagcggggtcaatggcctggccgactattgtgcttccaaattcgctgcctttggatttgccgagtcagttttcgtggaaacatttgtccagaaacagaagggaataaagaccacaatagtgtgtccttttttcataaagaccgggatgtttgaggggtgcacgactggctgccctagtctgttgccaatactggaacctaagtacgcagtggaaaaaatcgtggaggccatcctgcaggagaaaatgtatttgtatatgccaaagcttctttattttatgatgttcttaaagtcctttctgccactgaagaccggtcttctgatcgcagactacctgggcatactgcacgctatggatggcttcgttgaccagaaaaagaagctgtag

SEQ ID NO: 29991 - DNA, 693 bp, Artificial Sequence
  Description of Artificial Sequence: Synthetic coding sequence
atgtcatttaacctgcagtcttctaagaagctctttatcttcctcgggaagagccttttcagccttctggaggccatgattttcgccctgctcccaaagccacggaaaaacgtggccggcgagattgtgctgatcaccggcgctggatctggcttagggcgcctgttggctcttcaatttgcaaggttaggcagcgtgctcgtgctgtgggatattaacaaagaagggaacgaggaaacatgcaagatggctcgggaagccggagcaactcgggtgcatgcctacacctgtgactgtagccaaaaggagggggtgtaccgcgtcgccgatcaggtcaagaaggaagtgggagatgtcagtatccttattaacaacgcagggatagtgaccgggaaaaagttcctggattgcccggatgaactgatggaaaagagtttcgatgtcaatttcaaggctcatctttggacttacaaggccttcctacccgccatgatagcaaatgaccacggccacttagtgtgcatttcgtcctctgccggcctgtctggtgttaatgggctagcagactactgcgctagcaaatttgcagcttttggctttgcagaaagcgtgttcgtcgagacgtttgttcagaagcaaaaagggatcaagactacaatagtctgtcccttctataagaactggaatgtttag

SEQ ID NO: 29992 - DNA, 1182 bp, Artificial Sequence
  Description of Artificial Sequence: Synthetic coding sequence
atggacccaaaaagatcccagaaggagtctgtgctgatcacagggggctctggttattttgggtttcgtctgggatgcgccttaaaccagaatggcgtgcatgtcatcctcttcgacatttcaagcccggctcagacgattcctgaaggcatcaagttcatacagggagacattcggcatctatcagatgtggagaaagcattccaggatgcagatgtgacttgtgtgtttcacattgcttcctacggaatgtccggaagagaacagttgaaccgtaacctgatcaaggaggtgaacgttaggggcacagataacatattgcaggtgtgtcagcggcgacgcgtcccacgattggtttatacgtccactttcaacgtcatattcgggggacaagtcattaggaatggcgatgaatcgctcccatacttgccactccacctacatcctgatcactactctaggactaaaagcatagccgagcagaaagtgcttgaggctaatgctaccccactggaccgcggtgacggagtgttgagaacctgtgccctgaggcccgctgggatttacggaccgggcgaacagaggcacctgcctagaatcgtttcttatattgaaaaggggctgtttaaattcgtctacggcgacccaagatctctggtggaattcgtccatgtcgataatcttgtccaggcccacatactggcttccgaggccctgagggcagataaaggccacattgccagtgggcagccctatttcattagcgacggccgccctgttaataattttgagttctttcgtccgcttgttgaggggctgggatacacattcccatcaacgaggctgcctctaaccttagtgtactgcttcgctttcctaaccgagatggttcattttatcctgggtcgtttgtacaatttccagccgttcttaactagaacagaggtgtacaaaaccggcgtgacacactacttttcgctggagaaagccaagaaggagctgggctataaggcccagccattcgacctccaagaggctgtggagtggttcaaggcccacggccacgggcgaagtagcgggtctagagactcagagtgctttgtttgggacggactcttagtattcctgctgatcattgccgtgctaatgtggctcccatcttcagtgatcttgagtctttag

SEQ ID NO: 29993 - DNA, 369 bp, Artificial Sequence
  Description of Artificial Sequence: Synthetic coding sequence
atggacggttcacggaaggaggaggaggaggattccacattcacgaatatctctttggctgacgatatcgaccattcctcaagaattctttacccaagaccaaaatcactgttgccaaaaatgatgaatgcagacatggatgcagtggacgcagaaaatcaggtcgagcttgaggagaaaacacggctcatcaatcaggtgctggagctgcagcacacactggaagatctctctgcgagagtggatgccgtgaaggaagagaacttaaaactgaaatccgagaatcaagtcctggggcagtatatcgagaatcttatgtctgcatcttcagtatttcagacaacggacacgaaatctaagcgcaagtag

SEQ ID NO: 29994 - DNA, 480 bp, Artificial Sequence
  Description of Artificial Sequence: Synthetic coding sequence
atgcgccggagagtgttctcatcccaggactggcgcgctagtggctgggacggcatgggcttctttagcaggaggacattctgcggcaggagtggtcgttcttgtcgcggtcagctggtgcaggtgtcccggccagaggtgagcgcaggctcattgctccttcctgctccgcaagcagaggatcatagctctcgcatcctttaccctcgccccaagagcctgctaccaaagatgatgaacgctgatatggatgccgtcgatgctgaaaatcaagttgaacttgaggagaaaacccgtctaattaaccaggtgctggagctacaacacactctggaggacctcagcgcccgggtggacgcagttaaggaagaaaatttgaaacttaagtctgaaaaccaggttttgggccagtacatagaaaacttaatgagtgcctcttctgtatttcaaaccactgatacaaaaagtaaacgaaagtag

SEQ ID NO: 29995 - DNA, 369 bp, Artificial Sequence
  Description of Artificial Sequence: Synthetic coding sequence
atggacggctctagaaaagaggaggaggaggactcaacttttaccaacatctccctcgctgatgacatagatcactcttcccggatactataccccagacccaagagtctgttacccaaaatgatgaatgccgatatggatgcggtggacgccgagaatcaggtggaattagaggagaagacccgtctcataaatcaggtcctagaactgcagcatacactcgaggacctctcagcccgcgtggacgcagtcaaggaagaaaatctgaagcttaagagcgaaaatcaggtgctggggcagtacattgaaaacctgatgagtgcaagcagcgtgttccagacaacggatacaaagagtaagcgaaaatag

SEQ ID NO: 29996 - DNA, 369 bp, Artificial Sequence
  Description of Artificial Sequence: Synthetic coding sequence
atggatggctcccgcaaggaagaagaggaagattcaacctttaccaatatcagtcttgccgacgacatagatcactctagtcgcatcctttacccaaggccaaagtcactgctgcccaaaatgatgaacgccgatatggacgccgtggatgccgagaaccaggtggagctggaggagaagactcggctgataaatcaagtcctggagctccagcacacactcgaagatctgagcgccagagtcgatgctgtgaaggaggagaatctgaaactgaagtctgagaatcaggtactcggccaatatatcgagaatctgatgagcgcctcctccgtgtttcagactaccgacacaaaaagtaagagaaaatag

SEQ ID NO: 29997 - DNA, 396 bp, Artificial Sequence
  Description of Artificial Sequence: Synthetic coding sequence
atgaggaggagagtattctcatctcaggattggagggcttctggatgggacgggatgggctttttttctcggcgcactttctgcgggcgcagcgggagatcttgtagaggccagctggtgcaggtcagcagaccagaggtgagtgcagggagcctgctgctgccggccccacaagcagaggatcacagttctcgtatcctgtatccaagacctaagagccttctccccaagatgatgaacgcagacatggacgatctgtctgctcgggtcgacgccgtcaaggaggagaacctgaaattaaagtcggagaaccaggtacttgggcagtacatcgagaatctcatgtccgccagcagcgtgttccagacaactgacactaaatctaagcgcaagtag

SEQ ID NO: 29998 - DNA, 1191 bp, Artificial Sequence
  Description of Artificial Sequence: Synthetic coding sequence
atgctgcccctgctgttactgcccctattatggggaggatcattacaagagaagccggtatacgaattacaggtgcagaaatccgtaactgttcaggaaggtctctgtgttctcgtgccatgcagtttttcatacccttggcggagctggtactcgagcccgccactctacgtgtactggttccgagacggagaaataccgtattatgccgaagttgtcgccaccaacaatcccgacaggcgagtgaaacccgaaactcagggaagattccggctgctgggagatgttcagaagaagaattgttccctgtcgatcggcgatgcgcggatggaagataccggttcttatttctttcgggttgaaaggggtcgagacgttaagtacagttatcagcagaataaactgaatctggaggtgaccgccctcatcgagaagcccgacattcactttctagagccactggagagtggaaggccaacaagactcagctgctcactccccggcagttgtgaggcagggcctccactgacttttagctggaccgggaatgctctgtccccgctggaccccgaaaccactaggagcagcgaactcaccctgacaccaaggcccgaggatcacggtactaatctgacgtgccaagtgaagaggcagggggcccaggtgaccaccgagcgcaccgtccagttgaacgtgagctatgcgccccaaaatctcgccatctcaatctttttcaggaatggaacagggacggcacttcgaattctgtctaacggtatgagcgtgccgatacaagaaggccagtctctttttctcgcatgcaccgtggacagcaatcctcccgcaagtctaagttggtttcgcgagggcaaagctttaaatccatcccagacatcaatgagcggaacccttgagcttcccaatattggtgctagagagggcggtgagttcacctgcagagtgcagcatccattggggagccagcatctgtctttcattcttagcgtgcagagatcctccagttcctgcatttgtgttacagaaaagcagcagggttcctggccattggtgttaactctgattagaggcgcattgatgggggcgggattcctgttgacatacggcctgacttggatctattacacaaggtgtggcggaccccagcagtcaagagccgagagaccggggtag

SEQ ID NO: 29999 - DNA, 987 bp, Artificial Sequence
  Description of Artificial Sequence: Synthetic coding sequence
atggaaaagagtatctggctcttagcgtgcctggcttgggttctgcccacaggatcattcgtgcgaaccaagatagacacaactgagaatctgttaaacaccgaggtacacagttctcctgcgcagcgttggtcaatgcaggtcccaccggaggtcagcgcagaagccggcgacgctgcagttctgccctgcacgtttacccacccccacagacattacgatggcccgctcactgccatctggagggctggtgagccctacgccggtccccaagtattcagatgcgccgccgctagaggttcagagttatgccagacagcactctcactccatggaaggttccgtctgcttggtaatcctcgccggaacgatctgtcactgcgtgtggaacgcttagccttagctgacgaccgcaggtacttctgtcgcgtcgagtttgccggtgacgtgcacgataggtacgagagccggcacggcgtacgactgcatgttacagctgcccccagaatcgtcaacatctcggttctcccatcacctgcccatgccttccgcgcgctgtgcactgcagagggcgagcctccccctgccctggcttggtcagggccggctttggggaacagcctggctgcggttaggagcccgcgggaggggcacggtcacttggtgacagcggagttgccggcgcttacgcatgacggacggtacacatgcacagcagctaatagtctcggacggtctgaggcctctgtttatttatttagatttcacggggctagtggggcttcaaccgtggccctgctattgggtgcattggggtttaaggctctgctcctcctaggagtgttggcagctcgcgcagccaggcgaaggcccgagcatctggatacaccggacaccccaccgcgctcacaggcccaggagagcaattacgagaatctgagtcaaatgaaccctcgctcacccccagcaacgatgtgcagtccatag

SEQ ID NO: 30000 - DNA, 525 bp, Artificial Sequence
  Description of Artificial Sequence: Synthetic coding sequence
atgacagctacgcgggctgctacggcgtctgggagcgcaccgagaattgtgaatattagcgtgctgccctcgcccgctcacgccttccgagccctctgcactgccgaaggtgaaccaccacccgctctggcctggtccggacccgccttgggcaactctttggctgcagtgagaagccccagagagggacacggacatctggttacagcagagctgccagcactcacgcatgatggcaggtacacgtgcaccgccgccaattctttgggccgttctgaggcttctgtctacttgtttaggtttcacggagcttcaggcgccagcactgtggccctcctgttgggagccctcgggttcaaggcactgttactacttggagtgctagctgcaagagcagcaagacggcgaccagaacacctggacactccggatacccctcctcggtcccaagcacaggaaagtaactatgaaaatctgagccagatgaatccccgatccccacccgccactatgtgcagcccttag

SEQ ID NO: 30001 - DNA, 1494 bp, Artificial Sequence
  Description of Artificial Sequence: Synthetic coding sequence
atgatgtctagcgcagcctttccaaggtggctccagtctatgggggtccctagaactccatctcggactgtgctctttgaacgggagcgcacgggcctcacgtaccgcgtgcctagcctgctgccggtgcctcccggacccacccttctggcttttgtcgaacaacggttaagcccggatgattctcacgcccatcgactcgtcctgcggcgtggtacattagcaggcgggagtgtgcggtggggggcactgcacgtgcttggcacagccgctttagctgaacatcgcagcatgaatccctgcccagtgcacgacgcagggacgggtacggtctttctcttctttattgcagtcttaggtcacacccccgaagccgtacaaattgccaccgggcggaatgctgcacggctttgttgcgtcgccagccgcgatgctggactgtcctggggcagtgcacgcgaccttacagaggaggccataggtggtgctgtccaggattgggctacatttgctgtcggcccaggccacggtgtgcaactgccgtcaggaagactgctggtacctgcctatacttatagagtggacaggcgcgaatgttttggtaaaatatgcaggacgtccccccattcctttgctttttattccgatgaccacgggcgtacatggaggtgtggcggcctcgttcctaatttacggagtggcgaatgccagctggctgccgtagacggtggacaggctggctcttttttgtattgtaacgctagatctcctctcgggtcccgggttcaggctctgtctactgatgaaggcacttcatttctccctgcggagagagtggccagtctcccagagacagcttggggctgtcagggctcaatcgtggggttcccggccccggccccaaaccgcccaagagatgattcatggtctgtcggcccaggatcaccactacagccaccattgctgggcccaggggtccacgaaccaccagaggaagccgcggtggatcctcggggtggccaggtcccaggcggtccgttttcacggcttcagccacgcggggatgggcctcgacagccaggacctaggcctggcgtaagcggcgatgtgggatcctggacgctggccttacccatgcccttcgctgcccctccgcaaagccctacgtggctcctgtatagccacccggtgggaaggcgagccaggctgcatatggggattagactttcccagagccctctggacccaaggagttggacggagccttgggttatatatgaaggaccgagcggctactcagacctcgcaagcatcgggccagcccccgagggcggccttgtgtttgcttgtctgtacgaatctggggcacgaacctcatacgatgagatctcgttctgtaccttttccttgcgggaagtgctcgagaacgtgccagcctcgccaaaaccaccaaatcttggagataaaccacgtggatgctgttggccttcttag

SEQ ID NO: 30002 - DNA, 1455 bp, Artificial Sequence
  Description of Artificial Sequence: Synthetic coding sequence
atgggtgtgccaaggacccccagtagaaccgtgctgtttgaacgcgagcggactggcttaacatatagggtcccatctttgctgcctgtaccacccggacccacactcctggccttcgtggagcagagactctccccagacgattcgcatgcgcacagactggtgttgcgacggggtacacttgcaggtggaagtgttcgatggggagctttgcatgtcttgggaactgccgccttggccgaacatagaagtatgaatccttgtcctgtgcatgatgctggcactgggactgtgtttttgttcttcatcgccgtcctcggccacacgcctgaggctgtgcagatcgccactggcagaaacgctgcgcgtctatgctgtgtagcaagcagagatgccgggctgagctggggcagtgccagagatctcacagaagaagctatcggcggggccgttcaagactgggccactttcgcagtagggcccgggcatggagttcagctgcccagtggacggctattggtgccggcctacacctaccgagtagaccgaagagagtgttttggaaaaatctgccggacctccccacactctttcgccttctactctgacgaccacggccgcacctggcgatgcggcgggctggtccctaacctaagatcaggtgaatgtcagcttgctgccgtagatggtggccaggccggaagttttctgtactgcaacgcccggagcccactcggtagtcgcgtgcaggccctcagcacagacgagggtaccagtttcctacccgccgagagggtcgcttcattacctgagaccgcctgggggtgccagggctccatcgtggggtttcccgccccagccccaaacagacccagagacgactcttggtcggtcgggccaggcagtccactgcagccgcctctgctgggccccggcgtgcacgaacccccagaagaggcagccgtggatccccggggcggtcaggtcccgggaggtcctttctcacgcctgcaaccacgcggagacggcccccgtcagcctggtccaagacccggcgtgtccggcgatgtaggttcttggacattggctctgcctatgcctttcgcagctcctccacagagtccgacctggttgctctatagccatccagttgggcgcagagcccggcttcatatgggcattaggctctcccagtcccccttggacccaagaagttggaccgagccctgggttatttatgagggaccctccggctattcagatctcgcctctatcggtccggctccggagggagggttagtgttcgcctgcctgtacgagtcgggcgccaggacaagctacgacgagattagtttctgtacgttctccctgcgggaggtcctcgaaaatgttcccgccagtccgaaaccccctaacttaggggacaagccgagagggtgctgctggccatcatag

SEQ ID NO: 30003 - DNA, 1491 bp, Artificial Sequence
  Description of Artificial Sequence: Synthetic coding sequence
atgatgagctcagctgcctttccgaggtggttgtcaatgggggtacctcgaacacccagtcgaactgtactctttgagcgtgagcgaactggcctgacatacagggttccctctctgctccccgtgcctcccggcccaactctgctggcctttgtcgaacaacggttatcaccagacgacagtcacgctcacaggctggtgcttcgcaggggcactctggctggcggcagcgtcaggtggggggccttgcatgttctgggtacagccgcgctggccgagcacaggtccatgaatccctgccccgtgcacgatgccggcaccggaaccgttttccttttttttattgctgtactaggacatactcccgaggctgtgcagatcgccaccggccggaatgccgctaggttatgctgcgttgcttcaagggatgccggcctctcatggggcagcgctcgagacctgactgaggaggcgatcggaggcgctgtgcaggattgggccacattcgccgtcgggccaggtcacggcgtacagctgccctccggaaggctgctggtcccagcgtacacatacagagtggatagacgggagtgcttcggtaagatctgccgcacatccccacacagtttcgcgttctattccgatgaccacgggcggacctggaggtgcggtgggttggtgcctaacctgcgcagcggagagtgccaacttgcagccgtcgacgggggacaagctggctcctttctgtattgcaacgcccggagtccattaggaagtcgtgtgcaggctctcagcacagatgaagggaccagcttcttgcctgcagagcgagttgcctctctgcctgagaccgcttggggctgtcaaggtagcatcgtcggcttccccgcccctgccccaaaccgtccacgggatgactcctggagcgtcggtcccggcagccccctgcagcctcctctgctcgggcctggagtgcatgaaccccctgaggaagctgccgtcgacccaagggggggtcaggttccagggggtccattctctcgactgcaacctcggggagacggccccaggcaaccaggccccagacccggcgtgagcggggatgtaggctcgtggacgctagcattaccaatgccattcgcagcgccccctcaaagtcccacctggctcttgtactcccacccggttggccgaagagccagactgcatatggggatccggcttagccaatcacctctggaccctagatcttggactgaaccttgggtcatctacgagggcccatcaggctactccgatctggcttcaatcggtccagcgcccgaagggggccttgtatttgcttgcctctatgagtccggtgctaggacatcttacgatgaaatttccttttgcacattttctctcagggaagtcttggagaatgttcccgccagtccaaaacctccaaatctgggcgacaaacctagaggatgttgctggccaagctag

SEQ ID NO: 30004 - DNA, 1455 bp, Artificial Sequence
  Description of Artificial Sequence: Synthetic coding sequence
atgggagttcctcgtacccctagccgtaccgtgttatttgagcgcgaaaggaccggactaacctatcgggtgccaagcctgctgcctgttccaccaggacccactctactcgccttcgttgaacagcgcttatcacctgatgactcccacgcccatcggctagtgctaagacggggtacgcttgctggcggtagcgtgagatggggggcactgcatgtcctaggaaccgccgctctggcggagcaccgctctatgaacccgtgtcctgtgcatgacgccggcacggggaccgtgtttttattttttattgccgtcctcggccatacccctgaggctgtgcagatcgctacaggccgcaatgctgcccggctgtgttgcgtggcaagccgggatgccgggctttcttggggaagcgccagagacctcacagaagaggccattggaggagcggtccaggattgggcaacctttgcagtgggtcctggtcacggagttcagcttccatccggacgattgctcgttcctgcctacacataccgcgtcgaccgaagggagtgctttggaaagatctgtagaacctctccccatagctttgccttttactccgatgaccacggccgcacgtggcgatgcggcgggttggttcccaacctgagatcaggggagtgtcagctcgccgctgtcgacggaggacaggctggcagctttctgtattgtaacgcacgctctcccctgggatcgcgagtacaggctctttcaaccgatgaggggacatcctttcttccagccgaaagagtggctagcttacccgaaactgcatggggctgccaaggaagcatcgtgggattccctgcaccagcccctaataggcctcgtgatgattcctggagtgttggccctgggagtcccttgcagcctcctcttctcggccccggggtccacgagccccccgaggaagcggctgtggatccaaggggcgggcaggtcccaggggggccattctctcgcctgcaaccacgaggagatggcccgcggcaacctggaccacggcccggagtttctggtgatgtggggtcctggactctggcattgcccatgcctttcgctgcgcctccccagtcccctacctggcttctgtactcgcatccagttggcaggcgcgctcgactgcatatgggcatccggctgtctcagagtccactggaccccagaagctggaccgaaccctgggtgatttatgaaggtccatctgggtatagtgacctggcttccatcggcccagcccctgagggtgggctggtgtttgcttgcttatatgagtctggggcaaggacttcctatgacgagattagcttttgcactttctctctccgcgaggtcctggagaacgtgccggcttctcccaaacctcccaatctgggcgataaacctcgaggctgctgctggccctcctag

SEQ ID NO: 30005 - DNA, 1455 bp, Artificial Sequence
  Description of Artificial Sequence: Synthetic coding sequence
atgggggtgcccaggactccgagcaggaccgtgctgtttgaaagagaaagaacagggctgacctacagagtgccttccctgctgccagtgcctccagggcccaccctgttagctttcgtggaacagaggctaagtcccgacgactcacacgcgcacaggttagtcctgcggcgcggcaccctggcaggaggcagcgtcaggtggggggccctccacgtgctaggtaccgcagctctcgcagagcacagatcgatgaatccatgtcccgtgcatgacgccggaaccggcacagtgttcttattctttattgcagtgcttggccacacgcccgaagccgttcagattgccactgggcgcaatgccgctcgactctgttgtgtcgcaagtcgggacgctgggctctcctggggtagcgcccgagatctcacagaagaagccattgggggagccgtccaagactgggccacgttcgccgttggacccggtcacggggtgcagctcccatctgggcggctcctcgtcccggcttacacttaccgcgtggacagacgcgagtgttttggtaagatctgccggacttcccctcacagctttgccttctactcagatgaccacggtcgcacatggcgctgtgggggtctggtgcccaacctgcgttctggggagtgccagttagccgccgttgacggtgggcaggccggtagttttctctactgcaacgcacggtccccgttgggatctagggttcaggcgcttagcacagacgaaggcacatcttttctgccagctgagagagttgccagtctgcccgaaacagcttgggggtgccaggggtcaatagtgggatttccagctcccgcacccaataggcctagggatgactcttggtccgtgggcccgggctcacctctgcagcctcccctacttgggccaggggtgcacgaacctcctgaggaggccgccgttgatcctagagggggtcaagttccaggcggaccattctcccgtctgcaaccacgaggggacggccctcgccaacctgggccacgacccggcgtctccggagacgtaggaagctggacccttgccctgcccatgcccttcgccgcaccaccccagtcgcctacctggctcctgtacagccaccctgtgggcaggagagcaaggcttcacatgggcatcagactgagccagtctcctcttgatcccagatcatggaccgaaccatgggtaatttatgagggaccctccggatacagcgacttagccagtattggcccagcccctgagggcggtttggtgtttgcgtgcctgtacgagtccggagcgaggaccagttacgacgaaatatccttttgtacattctccctccgagaagtgctggagaatgtgcccgcctccccaaaacctccgaatctcggcgacaagcccagaggatgctgttggcccagttag

SEQ ID NO: 30006 - DNA, 783 bp, Artificial Sequence
  Description of Artificial Sequence: Synthetic coding sequence
atgggagttcctcgtacaccttcccggaccgtgctctttgagcgcgagcggaccggactcacctaccgcgtgcctagtctgcttcctgtcccccctgggccgaccctgctcgctttcgtggagcagagattatctcctgatgattctcatgctcatcggctggtgttacggagggggaccttggcaggtggatctgtgcgctggggggcgctccatgtgctggggaccgccgctttggcagaacatcgatcaatgaacccctgcccagtccacgacgccggaaccggcaccgtgttcttgttcttcattgcagtgctgggccatacccccgaggcagtccagatcgcaactggacgaaacgcagctagactctgctgtgtggcgagccgagatgccggcctctcttggggctctgcgagggatctcaccgaagaggccattggtggtgccgtgcaggactgggccaccttcgctgttgggcctgggcacggcgtccaactgccttcaggaagacttctggtaccggcctatacatatcgggtagaccgccgggagtgttttggtaaaatctgccggacgtctcctcattcattcgcgttctactccgatgatcacggccggacttggcgctgcggggggctcgttcccaatcttcgctccggcgagtgccaacttgcagcagtcgacggcggtcaagcaggcagcttcctttattgtaacgctagatcacctctgggatcaagagtccaggcactgagtaccgacgagggaacttcattttag

SEQ ID NO: 30007 - DNA, 567 bp, Artificial Sequence
  Description of Artificial Sequence: Synthetic coding sequence
atgggggtgccccggaccccaagccggaccgtgctgtttgaaagagagagaaccggcctgacctaccgagttccatcgctactgccagtgcctcccggccccaccctcttggcctttgtagagcagaggttgtcgccagatgacagccatgctcataggttagttcttaggcggggaacactggcaggcggtagtgtgagatggggcgcgcttcacgttcttggcaccgcagccttggccgaacaccggtcaatgaacccctgtcccgtgcacgacgcaggcaccggtactgtgttcttattcttcatcgctgttcttggacatacaccagaggctgtgcagatagctactgggcgcaatgctgccaggctctgctgcgtcgcttcccgtgatgcaggactgtcctggggctcagctagagacctcactgaggaggccatcggcggagccgttcaagattgggccactttcgcagttgggccaggccacggagttcagctcccaagtggacggttgctggtgcctgcatacacatacagagttgataggcgcgagtgtttcggctag

SEQ ID NO: 30008 - DNA, 1485 bp, Artificial Sequence
  Description of Artificial Sequence: Synthetic coding sequence
atgaagctccaggagggccacacggtgctgttgtcattaccactgcgactggcaggaacggagaccgaacacggcggaccctcttatccattcactgattccgcgctccgcgcaggggaggatggcccggaccttcccagggcgctagcggccccgagagctcctccagatgactcacacgctcatcgactcgttctcaggcgtggcacccttgctggagggagtgtgcggtggggcgccttgcacgtcttaggtacggccgcactcgccgagcaccgctctatgaatccatgccctgtacacgacgcaggaactggcacagtgttccttttcttcatcgccgttctcgggcatacaccggaagcagttcaaatcgcaacaggacggaatgccgccaggttgtgttgcgtagcttctagagatgcaggtttaagctggggatctgctagagatttgacagaagaggccatcggtggggccgtgcaggactgggctacattcgcggtcggccctggccatggtgtccagctgccctcaggacgcttacttgtgcctgcatatacataccgggtggataggagggaatgcttcgggaaaatttgccgtacctccccccactcttttgccttttattcagatgaccatggcagaacttggcgctgcggaggcctcgtccctaatttaagatccggggaatgccagcttgcagcggtggatggggggcaggcaggttcatttctttattgtaatgcaaggtctccacttggctcacgcgtgcaggctctgtctaccgacgaagggaccagtttcttgcccgctgagagggtggccagtctacccgagaccgcctggggctgccagggatctatagttggcttcccggcacccgccccaaacagaccgcgagacgacagctggtccgtgggtcccgggtctcctctccaaccccctctgctgggaccaggcgtccatgaacctcccgaagaggcagccgtggacccgcgtggaggccaagtccccggcggccctttcagccgcctgcagcctaggggggatggacctcgacaacctgggccgaggccaggagtgagtggagatgtggggagctggacgctggcactcccgatgccttttgccgccccccctcaatcaccaacttggctgctgtattcccaccccgttggtcggagggccaggctgcatatggggatccgcctatcacagagcccactggacccccgctcatggacggaaccctgggtgatttatgaaggcccaagtggctactctgaccttgcatcaataggcccagctcccgaaggtgggcttgtgtttgcttgtctctacgagagtggtgcccgcacttcctatgacgagatcagcttttgcaccttctccttaagggaggtcttggagaacgtcccagcaagtcctaagcccccgaacctgggcgataaaccccgagggtgctgctggcctagttag

SEQ ID NO: 30009 - DNA, 2484 bp, Artificial Sequence
  Description of Artificial Sequence: Synthetic coding sequence
atgcgaggttgtttgagattggcattactgtgcgctctgccctggctgctcctggccgctagcccggggcacccagctaaaagcccacgacagcccccagcccctagacgggatccatttgatgcagcgaggggagccgacttcgaccacgtttactccggcgttgtcaacctgtctactgaaaacatctactcattcaactacacttcgcagccagatcaggtgaccgcagtcagggtttacgtaaactcttccagcgaaaatctcaactatcccgtcctcgtggtagtgagacagcagaaggaggttctgtcatggcaagtgcctcttctgtttcaggggctttaccagcgttcgtacaattatcaggaagtgagcagaacattatgcccaagcgaggcgaccaacgagacaggtccactccaacagttaatattcgtggacgtagcctccatggcacctttaggcgcccagtacaagctgcttgtgactaaattaaaacacttccagttgcggaccaacgtggcattccacttcactgctagtccatcgcagccccagtattttctgtataaattccctaaagacgtggattctgtgattatcaaagtcgtcagtgagatggcttatccttgctcggtagtgtcagtccagaatatcatgtgtcctgtgtacgaccttgatcacaacgttgagttcaacggtgtgtaccagagtatgactaagaaagcggcaatcaccctccagaaaaaagattttcctggtgagcagttcttcgtggtatttgtgattaagcctgaggactatgcttgcgggggctcgttcttcatccaggaaaaagaaaatcagacttggaaccttcagcgcaaaaaaaacctggaggtgacaatcgtcccttctatcaaggagtctgtctatgtcaagtccagcctgttctctgtgttcatttttcttagcttttacctgggctgtttactcgtgggttttgtccactatctgaggtttcagaggaagagtatcgacggttcttttggaagcaacgacgggagtgggaatatggtcgcctctcaccccatcgctgctagtacgcccgagggatccaattacggaacaattgacgagagttcctcatcccctggacgtcaaatgtcctcctctgacggagggccgcctggccagagcgacaccgattccagcgtcgaggagtcagatttcgacactatgccagacatagaaagtgacaagaatataataaggacgaagatgtttctctacctgtccgacctgtcccgaaaagaccgcaggatcgtgtccaaaaaatataagatatacttctggaacattataacaatcgcggtgttttacgctcttccagtgattcagcttgtcattacatatcagaccgtggtgaatgtgactgggaatcaagacatctgctactacaacttcttgtgcgcacatcccctgggcgtgctctcagcttttaataacatcctctccaatctgggccacgttctgcttggattcttatttcttcttattgttctccgcagagacattctacacaggcgtgccctggaggccaaagatattttcgctgtggagtacgggatccccaagcacttcggcctattctacgcaatggggattgctctcatgatggaaggagtgttgtcagcttgttaccatgtttgtccaaactactcaaactttcagtttgatacatcatttatgtatatgattgctgggctgtgtatgttgaaactctatcagacacgacaccccgacatcaatgcaagcgcctatagcgcttacgcttccttcgccgtggtgatcatggtcactgtgcttggcgtggtcttcggcaaaaacgatgtgtggttttgggttattttctcagcaatccatgtgctggcctccttggcgctgagcactcagatatattatatgggcaggttcaaaatcgatcttggcatctttcgtcgagccgctatggtgttttataccgattgtattcaacagtgctcccgacccttatacatggacaggatggtactgctggtggtcgggaatctggtcaactggtcttttgctctgttcggcttaatataccgtccccgggatttcgcgagttatatgcttggcattttcatttgtaatctattgctctatctggccttttatattattatgaaattgcgctcatcagagaaagtgctgccagtgccacttttctgtatagtagcgacagccgtgatgtgggccgcagccctgtactttttttttcagaacctatcaagctgggaggggacgcctgcggaatccagagagaaaaacagagaatgtattctccttgattttttcgatgaccacgatatctggcactttctatccgccaccgccttattctttagctttctggtactgctgacactggatgacgacttggacgtcgtcagacgagaccagatccctgtgttttag

SEQ ID NO: 30010 - DNA, 2499 bp, Artificial Sequence
  Description of Artificial Sequence: Synthetic coding sequence
atgagagggtgtcttagactggcgctcctctgtgctcttccctggcttttacttgccgcttctcctggccatcccgccaaatcccctaggcagccgcccgcccctagaagggatccattcgacgcagctcgtggagctgactttgaccatgtgtactccggggtggtcaatctgagcaccgagaatatttattcattcaattacacctcccagcctgatcaggttacggctgtcagggtgtacgtcaattcatcgtccgagaatcttaattaccctgtgctagtcgtggtccgccagcagaaagaagttctgtcctggcaggtgccgctcctcttccagggcctctatcaacgctcttacaactatcaggaagtcagtaggacactttgccccagtgaagctaccaatgaaacaggtcctctgcagcagctgattttcgtggacgtggcctcaatggcacctttgggagcacagtacaaattactcgtgaccaagttgaaacatttccagttacgtacaaacgtcgctttccatttcacagccagcccctcccaacctcaatatttcctgtacaaattccctaaagacgtcgactccgtcattatcaaggtcgtgtcagagatggcctatccatgctctgtggtaagcgtccagaacattatgtgtcccgtgtacgacttggatcataatgtcgagtttaatggcgtctaccagagtatgaccaagaaagctgctattactttgcagaagaaggactttcctggagagcagttttttgtcgttttcgtcataaaacccgaggattatgcctgcggcggatccttttttatacaggagaaagagaatcagacttggaacttacaaagaaagaagaatctagaagtgactatcgtaccttcaatcaaagagtccgtatatgtcaaaagcagcctgttctcggtttttatcttcctaagtttttacctggggtgtctcctggtgggcttcgtgcactacttgcggtttcagagaaagagcatcgatgggagcttcggcagcaacgacggcagcgggaacatggtggcatctcacccaatcgccgcatccacccccgaagggtctaactacggcacgatcgacgaatcaagctcatcaccagggcgccagatgtccagttctgacggagggccccctggccagtcggacaccgactccagcgtcgaggagtccgattttgatacaatgcctgatatcgaatctgacaaaaacataattcgtactaagatgttcctatacctatcagatctgtccaggaaggatcggcgcatcgtctctaagaagtacaagatatacttctggaatattataaccatcgctgtgttctacgccttacccgtcatccaactcgtcataacctatcagacagtcgtgaacgtcacagggaaccaggacatctgctactacaatttcctatgtgcacatcccttgggcgtgctctcagcttttaacaatattctgtctaacctaggacatgtgcttctgggcttcctgtttctgctgattgtactcagaagggatattctgcatcgccgggctctggaagccaaggatatatttgccgtggagtatggtatccctaagcattttggtctattctatgcgatggggatcgcccttatgatggagggagtcttatcggcatgttatcatgtatgtcccaattatagtaatttccagtttgacacgagcttcatgtacatgatagcaggactgtgcatgctgaaactgtaccaaacacgccaccccgatatcaatgcttctgcctattctgcatacgcctccttcgctgttgttatcatggtaacagtgctcggcgtcgttttcgggaagaacgatgtgtggttctgggtaatcttttccgccattcacgtgttggcctccctggcactgtcaacccagatttactacatgggtagattcaagatcgctatcacacctaccgacctgggaatctttcggcgggccgcaatggtcttttataccgactgtatacagcaatgtagcagaccactgtacatggatcgaatggtgttactggtggttggcaatcttgttaattggtcatttgccctgtttgggctaatctaccgcccgcgtgactttgcctcatatatgctgggcatttttatttgtaacctgcttctatatctggcattctatattatcatgaagttgaggtcctcagaaaaagtgttgcccgtcccactgttctgcattgtggctaccgctgtgatgtgggccgccgcactgtatttcttcttccagaatcttagcagctgggaggggactcccgctgagagccgtgaaaagaacagagagtgtattctgctggatttctttgatgatcacgatatttggcactttctgtccgccacggccctcttcttctcattcctggtgctactgactctggacgacgatctggacgtggtgaggcgtgaccagatccccgtgttttag

SEQ ID NO: 30011 - DNA, 2568 bp, Artificial Sequence
  Description of Artificial Sequence: Synthetic coding sequence
atgttcgcactggggctcccctttctggtgctgctggttgcgagcgtggagtctcacctgggagtactaggccctaagaacgtcagtcagaaagatgcagagttcgaacgcacttatgtcgatgaagtgaactccgagctggtgaacatatatactttcaatcatacagttacgagaaaccggacagaaggcgtaagagtgagcgtgaatgtcttgaacaagcagaagggagcaccactcctctttgtggtgaggcagaaagaggccgtggtcagttttcaagtccctctcatcttgcgggggatgtttcagcggaagtacttgtatcagaaagtggagcgcaccctgtgtcaacctccgaccaagaacgagagtgagattcagttcttctatgttgatgtcagcacattatctccagtgaataccacatatcagctgagagtgagcagaatggacgactttgttttgagaacgggcgagcagtttagcttcaacacaactgctgctcagcctcagtattttaagtacgagttcccggagggggttgactccgtcatcgtgaaggtcaccagcaacaaagcctttccctgctcggtgatcagtatccaagatgtgctgtgtcccgtatatgacttggataacaacgtggctttcataggaatgtaccagaccatgaccaaaaaagccgccatcacggtgcaacgaaaagattttccgagcaactctttctacgtagtcgtagtggtgaagaccgaagaccaagcatgtggagggtcacttccattttatcctttcgcagaagacgagcccgtcgaccaaggacaccgacagaaaactttgtcagttctcgtgtcgcaggccgtgacaagtgaggcttatgtgagcggcatgcttttctgtctgggcatcttcctctccttttacttgttaacggtcttgttggcatgttgggaaaactggaggcagaaaaagaagacattgctggtcgccatcgaccgcgcttgccccgaatctgggcatccacgagttctggcagattccttccctggatccagcccctacgaaggatataattacggaagtttcgagaatgtgtcaggatccacggatgggctggtcgatagcgcagggaccggagatctttcatatggctaccaggggcacgaccagttcaaacggcggttgccttcaggtcagatgaggcagctctgtattgccatgggtaggtcttttgaacccgtgggcacccgcccacgcgtcgattccatgagctctgtcgaagaggacgactacgataccctcacagacattgatagtgataaaaatgtgatcaggacaaagcagtacctgtacgtagcagaccttgctcggaaagataagcgagtgctccgaaagaagtatcagatttatttttggaatattgctaccatcgccgtcttttacgctctcccggtggtccaactggtgataacctaccagaccgttgtgaacgtcaccggaaatcaggacatctgttactataacttcctgtgtgcccatccactcggaaacttaagtgccttcaacaacattctgtccaacctcggatacatactgctggggctcttgtttctacttattatactgcagagggaaataaatcataacagggcccttctgaggaatgatttatgtgcactcgagtgtggaatacccaaacatttcggcctcttttatgctatgggcaccgccctgatgatggagggcttactgagcgcctgttaccatgtatgccccaattacactaacttccagtttgacacatctttcatgtatatgattgcggggctgtgcatgcttaagctgtatcagaaacgacaccccgatatcaatgctagcgcttattctgcctatgcctgtctggccatcgttatctttttttccgtgcttggagtggtgtttggaaaggggaacacggctttctggatcgttttctccataattcacattatcgcgacgctgttgctctccacacagctgtactacatgggccggtggaagcttgactctggcatatttaggaggatccttcacgtgctgtacactgattgcattaggcagtgctctgggcccctgtacgtcgacaggatggttctgttggtgatggggaacgttattaactggtcgctggctgcatatggtctgattatgcgcccaaacgactttgcctcctacctcttggctatcggtatttgcaacctcctgctttatttcgccttttacatcatcatgaagctgaggtctggggagagaataaaactcattccattactctgcatcgtttgtactagcgtggtgtggggatttgccctctttttctttttccaggggctgagtacctggcaaaaaacccccgccgaatcccgggagcacaatcgggactgtatcttgctcgatttcttcgatgatcatgacatctggcacttcctctcgtcgatcgcaatgttcggtagcttcctcgtctcaggacccccgggccgcgccggatgggtaagagaagggagcagttgtctgttactgtgtggctag

SEQ ID NO: 30012 - DNA, 2499 bp, Artificial Sequence
  Description of Artificial Sequence: Synthetic coding sequence
atgttcgctctcggcctgcccttcctggtcctgctagtggcatcagtggagtctcatttgggcgtgctgggtcccaagaatgtgtcccaaaaggacgctgagtttgagaggacttacgttgacgaggtgaattcagaattggtgaatatttatacattcaatcacacagtgaccaggaataggactgagggcgtccgcgtgagcgtgaatgtgctcaacaaacagaagggtgctcctttactgtttgttgtaaggcaaaaagaggcggtggtgagtttccaggtacctctgatactgcgcggcatgttccagcggaagtacctgtatcagaaagtggaaagaacactctgtcagccccccactaaaaacgagtctgaaatacagtttttttatgtggacgtttccactctcagcccggtgaataccacttatcagctccgagtttcgaggatggatgactttgtcctgcgcaccggtgagcaattctcgtttaatactacagcggcccaaccccagtatttcaaatacgagttccccgagggagttgattctgtgatagtcaaggtaacaagcaacaaagcatttccttgtagcgtaatctctatccaagatgttctgtgccctgtctatgatctcgacaacaacgtggcatttatcggaatgtatcagaccatgaccaagaaggctgcaataacggtgcaaagaaaagattttccttccaatagcttttatgtggtggtggtggttaagaccgaagaccaggcatgtggcggatcgctgcctttttacccattcgccgaagatgaaccggttgatcagggccatcgccagaaaacacttagcgttcttgtgagccaagcggtgacttcggaggcctatgtgtctgggatgctcttctgtctgggcatctttctgagcttttacctgctgactgtcttgctcgcttgttgggaaaattggagacagaaaaagaagacactgctggttgcaattgatcgggcctgtcccgaaagcggacatccaagggttttggctgattcctttcctggcagcagcccctacgaggggtacaattacgggtccttcgagaacgtgagcggttctactgatggccttgtagattccgccggaacgggcgacttatcttacggctaccaggggcgctcatttgagccagtagggacccgccctcgtgttgactcaatgtcgagcgtcgaggaagatgactatgataccctcaccgacatcgatagcgataaaaacgtcatcaggacgaagcagtacctctatgttgccgacctcgctcggaaagataaaagagttttacgcaaaaagtatcagatctatttttggaacatcgcaaccatcgctgtgttttacgccttacctgtagtccagctagttattacttaccagaccgtggttaacgtaactggcaatcaggatatctgctattacaattttctctgcgcccacccactcggtaacctgtcagcctttaacaacatcctgtccaatctgggatatatactgctaggtttgctgttcctgttgattattctccagcgagagatcaaccataatcgcgcactgctgaggaatgatctgtgcgccctggagtgcggcatccccaaacactttggcctattttacgctatgggcaccgccctgatgatggagggtctgttgtctgcttgctaccacgtttgccccaattatacaaatttccagttcgatacctcctttatgtacatgatagctggcctctgcatgttaaagctgtaccagaagcgccatcctgacattaatgccagcgcctatagcgcttacgcatgtctcgcgattgtcatatttttttcggtcctgggggtggtttttgggaaggggaatactgctttttggatcgtgttcagtatcatccatatcatcgccaccttgctactctcaacccagctctactatatgggtcgctggaaactggactctggcatctttcgtcggattctgcatgtcctatacacagactgcattaggcaatgcagtggtccactctacgttgatcgtatggtgttactggtaatgggcaacgtcatcaactggtcactggccgcctacggcttgataatgagacccaatgacttcgcatcctatctcctggccattgggatctgcaatctactcctctatttcgccttctatattataatgaaattgcggagtggtgagaggataaagcttatccccctcctgtgcatagtgtgcacctctgttgtgtggggtttcgccctgttcttcttttttcaggggctgtctacatggcagaaaactccagccgagagtcgcgagcacaacagagactgcatactccttgactttttcgacgaccacgacatctggcacttcttgagcagcatcgctatgtttgggtctttcctagtcctgcttaccctcgatgacgacctcgacaccgtgcaacgcgacaagatttatgtcttttag

SEQ ID NO: 30013 - DNA, 561 bp, Artificial Sequence
  Description of Artificial Sequence: Synthetic coding sequence
atgtttgcactcggcctgcccttcttggttctgctggtcgcatcagtcgagtctcatctcggggtgcttggtccgaagaacgtgagccagaaggatgcggagtttgagaggacttacgttgatagaatggtactattggtaatgggaaacgtgattaattggtcgctggcagcctatgggctgatcatgaggcctaatgacttcgcttcttacctgctcgcgatcggtatctgtaatcttctcctctatttcgcattctacatcataatgaagcttcgttctggggagcgaatcaagctcatccctctactctgcattgtctgcacttctgtggtgtggggctttgctctcttctttttctttcaggggctctctacttggcagaagacaccagccgagtctcgggagcataacagggactgcatcctgttggatttctttgacgaccacgatatctggcacttcttatcatctatagcaatgttcggcagttttctggtgctgctcaccctggacgacgacctggacacagtgcagcgcgacaagatctacgtgttttag

SEQ ID NO: 30014 - DNA, 2490 bp, Artificial Sequence
  Description of Artificial Sequence: Synthetic coding sequence
atgttcgctctggggttgccctttctcgttctgctcgttgcttcagtcgagtctcacctaggggtcctcggcccaaagaatgttagccagaaggatgccgaatttgagcgtacctacgttgacgaagtgaacagcgagctggttaatatctatacctttaatcacaccgtcacccgcaatcgaaccgagggggtgagggtgagcgtgaacgtcttaaataagcaaaagggagcacctttactatttgtggtgcggcaaaaggaggccgtggtgagtttccaggttccacttatcctcaggggaatgtttcagcgtaaatatttgtaccagaaggtggaaagaactctctgtcagccaccaacaaagaacgaaagtgaaatccagttcttttacgtggatgttagtaccctatcaccagtgaacactacatatcagttgcgcgtatcacgcatggatgatttcgtgctccgtactggcgaacagtttagttttaatacgacagcagcccagccccagtacttcaaatatgagttccccgaaggggtagattccgtgattgtcaaggttacgtccaataaggcttttccatgtagtgtgatatctatacaggacgtgctgtgccctgtgtatgacctagacaacaacgtggcttttataggaatgtaccaaacaatgacaaaaaaagctgcgatcactgtgcagcgaaaggactttccctcaaatagcttctatgtggtcgtggtagtgaaaactgaggatcaggcatgcggaggcagcctacctttctaccctttcgccgaggacgagcccgtcgaccagggacacagacagaagacactcagtgtcttggttagccaggctgttaccagcgaagcttatgttagtggaatgcttttctgtcttggaatcttcctgtcgttttacctcctgactgttctcttggcttgttgggaaaactggaggcagaagaagaagactctgttagtggccatcgaccgggcctgccctgagagtgcatcattgctggggcaccctcgagtgctcgccgacagcttcccaggctcttccccatatgaaggttataactatggatcgtttgagaatgtgtccggcagtaccgacgggctagtggacagtgcaggaactggcgatctttcatacggctaccaagggacccgccccagggtggacagcatgtcgtcggtagaggaagatgactacgatacactgacagacattgacagtgacaaaaatgtaatacggaccaagcagtacttgtacgtggccgacttggcccgcaaggacaagagagtgctccgaaaaaagtaccagatctatttctggaatatcgccactatcgcggtgttttatgcccttcctgtcgttcagctcgtaatcacataccagactgtggtgaacgtgacggggaatcaagatatttgctactacaatttcctgtgcgcacatccactaggaaaccttagcgcattcaataacatcctgtcaaacttgggctatatattactgggtctgctattcctcctcatcatcctgcagcgcgaaatcaatcataaccgagccttgttacgcaacgatctgtgtgctttggaatgtggtatccccaaacactttggcctcttttacgctatgggaacggccctgatgatggagggtctgctatcagcatgttaccacgtgtgtccgaactatacaaacttccagtttgacacatcctttatgtacatgatcgccggtctgtgcatgttaaagctctaccagaagaggcacccagacatcaatgccagcgcctacagtgcgtacgcttgcctggccattgtgattttctttagcgtgttaggcgtcgtatttggcaagggtaataccgctttctggatcgtgttcagcattatccacatcattgctacccttttgctgtcaactcagttgtattatatgggacgatggaaattggattccggtatttttcggcgaattctccacgtgttgtacaccgattgtatccggcaatgtagcggtcctctgtacgtcgaccgaatggtcctgctggtgatggggaacgtgatcaattggtcacttgcagcttacggactgattatgaggcctaacgacttcgcttcctacttgctagccattggcatttgcaaccttctcttgtattttgccttttatatcatcatgaagttgcgtagcggagagcgaatcaagctgattccgttactgtgcatagtgtgtacctcagttgtttggggattcgccctgtttttcttctttcagggactgtcaacgtggcagaagactcctgccgaaagccgtgagcacaatcgggattgtattctgctggatttcttcgacgaccatgacatttggcacttcctgtccagcatcgctatgtttggttcatttttggtcctgttaacattggacgatgatttagatacagtgcaacgggacaagatatatgtcttttag

SEQ ID NO: 30015 - DNA, 330 bp, Artificial Sequence
  Description of Artificial Sequence: Synthetic coding sequence
atgtttgcccttggcctgccctttctcgtactgctggtggctagcgtggagtcccacttgggagttctgggacccaagaatgtgagccagaaggacgctgagttcgaacgaacctatgtggacgaggttaattctgagctcgtgaatatctataccttcaatcacacagtgacccggaatcgaacagagggtgttagagtcagcgttaatgtacttaataaacaaaaaggtgcaccgctgctgtttgtcgtcagacagaaggaagctgtggtcagctttcaggttccattaatcctgagaggtatgttccagagaaagtatctttactag

SEQ ID NO: 30016 - DNA, 333 bp, Artificial Sequence
  Description of Artificial Sequence: Synthetic coding sequence
atgttcgcactggggctccctttcctagtgttgctggttgcttccgtggaatcacacctcggtgtgctagggcccaagaacgtgtcccagaaagatgctgagttcgaacgtacctacgtggacgaagtcaatagcgagctggtcaacatatataccttcaaccacaccgttacccggaacaggacagaaggcgttagggtttccgtgaatgtgctaaacaagcaaaagggcgctcccttactctttgttgtacgccagaaagaagctgtggtttcattccaggtgcctctgatactccgtggcatgttccagcgtaagtacctataccaatag

SEQ ID NO: 30017 - DNA, 6642 bp, Artificial Sequence
  Description of Artificial Sequence: Synthetic coding sequence
atggcgaggggggcccgaccaagtgccgcaggtggcggaggaggcggcgccgaacccccagagcgcgccggacctggaaggccccgcggtagcccccctggccgtgcccgacccagcctggcgccacgcccaggtccagagccatccagaccgcgtgctgcacctgaaacatccggtggggacacggctggggccggccggtgtggtggaaggagagccgccaagctcggacccgggcggcgcggctggtgggctttgctggcattacagcttcatcttctgcgcgccttagctcaggatgacgtggctccctatttcaagacggaacctggactaccccagatccacctagaggggaaccgtttggtcctcacttgccttgccgaaggaagctggccacttgaatttaaatggatgcgagatgacagcgagctcaccacctactcttcggagtataaatacattattccttccctgcagaagcttgatgcaggtttctatcgttgcgtggtgcgcaaccggatgggtgccctactacaacgaaaaagcgaagtgcaagtggcgtacatggggtccttcatggataccgaccagaggaaaaccgttagccaaggtcgcgccgccatattgaacctgctccccattacgagctaccctaggccacaagtgacctggttcagggaggggcacaaaattatcccatctaatcgaatcgcaataaccctcgagaatcaactcgtgatcctggcgaccaccactagcgacgccggggcatactatgtccaggccgtgaacgaaaagaacggggagaacaaaacctccccctttattcatctttccattgctcgcgatgtaggaacccccgaaacaatggcaccaaccatagtagtccctcccgggaacagatccgtggtcgctggtagcagcgagactacattagagtgcatagccagcgctcgccccgtcgaggacctgtcagtgacatggaaacggaatggtgttagaatcaccagtggactgcattcatttggcaggcgactgactatatccaatcccacaagtgccgataccggcccatacgtatgcgaggcagctctgccaggctccgctttcgagcccgcccgagctactgcttttctcttcataattgagcctccttactttacagctgagcccgagtcgcgaattagcgctgaggttgaagaaaccgttgacatcggttgccaggccatgggcgtccccttgccaaccctgcagtggtataaagatgctatatccatcagcaggcttcagaaccctcgatacaaagtcttagcaagtggtgggctgaggattcagaagctcagacccgaagattctggcatatttcagtgctttgcaagtaatgagggcggagagattcagactcacacctacctggacgtcactaatattgcacccgtgtttactcagcggcccgtggacaccaccgtaactgacggcatgaccgctatcctgcgctgcgaggtgtctggggcaccaaagccggcaatcacctggaagcgcgagaatcacatactggccagcgggtccgttcgtatcccacgtttcatgctcctggagagtggagggttgcagattgcaccagtgttcatacaagatgcaggcaactatacatgttacgcagcaaatactgaagggtctcttaacgcaagcgcgaccctcaccgtctggaataggaccagtatagtgcatcctcccgaagatcacgtagtgatcaagggaactacggcaaccttgcattgcggcgcgacccatgatcctcgtgtctcgttgcgttatgtatggaaaaaggataacgtggctctgactccttcctctacttctcgcatagtggtggagaaggatggcagcctcttgatctctcagacctggagcggagatatcggagactacagctgcgaaatcgttagcgaagggggcaacgacagccggatggctcgcctcgaagtgattgagctgccccatagtccacagaatctgctcgtttcgccgaattcttcacactcacatgctgtagtgctctcctgggtccgacccttcgatggcaacagccccattctttactacatcgtcgagctatccgagaacaacagtccgtggaaggtgcacctttccaatgtcggcccggagatgaccggtgtaacggtcagtggcctcactcctgccagaacctatcagttcagggtatgcgccgtcaacgaagtaggtcgagggcaatacagcgccgagacctctagacttatgctgcccgaggagcctccaagcgctccgcctaaaaacattgtggcttctggacggaccaaccagagcatcatggttcaatggcaaccccccccggagacagaacataatggcgttcttagggggtatatcttgagatacagacttgctgggctccctggcgagtaccagcaaaggaatattacctctcccgaggtgaactattgccttgtcaccgacctcattatttggactcagtacgaaatccaagttgcagcctataacggagcaggcctgggagtcttcagcagagctgtcacagaatataccttgcagggcgtaccaaccgctcccccacagaatgtgcagactgaagcagtaaattccactaccatccagtttctgtggaacccccccccccagcagttcatcaatgggatcaatcaaggttacaagctattggcgtggcccgcagacgcacctgaagcggtcaccgtggtgacaatcgcaccagatttccacggcgtgcaccacggacatattactaatctgaagaagttcacagcgtactttacttctgtcctgtgcttcaccacgccaggagacgggccaccatccactccacagctggtctggactcaggaagacaaacctggggcagtcggacatctgtcatttacggagatcctcgatacgtccttaaaggtgtcttggcaggagcctctggaaaagaatggcattataaccggttaccagataagctgggaggtatatggccggaatgactccaggctgactcacactctcaacagtactacccatgagtacaagatccagggtttatcttcgcttacaacctacacaatagacgtcgcagcagtgacggcagtgggcacaggcctggttaccagttcaaccatcagcagtggggtcccgccggatttgcctggagcgccctcaaatctggtgatctccaatatctcacccagaagcgcaactttgcagtttcgaccaggttacgatgggaagacgtcaatctcaaggtggattgtggaaggccaggttggagctatcggtgacgaagaagaatgggtcaccttgtatgaggaggagaacgaacccgacgcccaaatgctggagatcccaaacctgaccccttacacccactatcgattccgcatgaaacaagtgaacattgttgggccatctccgtattcaccctcatcacgagtcatacagacactccaggcacctccagacgtagcacccacatcggtgacagtgagaactgccagcgagacatctctgcgactccgctgggtgcctctgccggattcacagtataatggcaatcccgaatccgtgggctacaggatcaaatattggcggtccgatctgcagtcttccgccgtggcccaggttgtgtctgacagattggagagggaatttacaattgaagagctagaggaatggatggaatatgaactgcagatgcaggcgtttaatgccgtcggggcgggcccctggagtgaggtcgtgagaggcaggacccgcgaatccgttccctctgcagcacctgaaaatgtgagcgccgaagccgttagctcaactcagattctgttgacgtggacttccgtgcccgaacaggatcagaacgggctgattttgggatataagattctttttcgcgccaaggatcttgaccctgagccacgaagtcacatagtcaggggtaatcacacccagagcgcgctcctggccggacttaggaagtttgtactttacgagctccaggtgctggcctttacacgaatcggcaatggggtcccctcgactcccctcattctggagagaaccaaagatgacgcacccgggcccccagtgagactcgtcttccccgaagttagactcacctctgtgcggatagtttggcagccacccgaagagcccaacgggatcatcctcggataccagatcgcatacaggctggcgtccagctcgccccacacatttacaactgttgaagtcggtgctaccgttagacagttcactgccacagacttagctccagaaagcgcctatatttttcgcctgtctgctaaaacacggcagggttggggcgaacctctggaagccacagtgatcactacagagaaacgagagcgccctgctccacccagagaactgttagtgccccaggccgaggtcacagcccgctccctcagacttcagtgggtgcctggaagtgatggagcctcacccatcagatattttaccatgcaggtaagggagttgcctagaggggaatggcaaacctattcttcaagtatatcgcatgaggctactgcctgcgttgttgatcgcctgcggccatttactagttataagttgagattaaaagccaccaatgacatcggagatagcgatttttcatctgaaacagaagctgtgacgaccctacaggacgtgccgggtgagccaccggggtcagtatccgcaactccacacacaaccagttcagtgttaattcaatggcagccacccagggatgagagtctcaatgggctacttcaggggtaccgcatatactaccgcgagctagagtacgaggcgggctctggcaccgaggccaaaaccctgaaaaaccccatagcactccacgccgaacttaccgcccagtcatcttttaagacagtgaatagctcgagcacgagcacaatgtgcgagctgacacacctgaaaaaatatcggcgctatgaggtgatcatgaccgcatacaatatcataggcgaatccccagctagcgcccctgttgaagtttttgtcggagaggccgcccccgcgatggcacctcagaatgttcaggtgactccgctgacagcctcccagctggaggtgacctgggacccacccccacctgagtctcagaatggcaatattcaaggctataaaatttattattgggaggcagactcccagaacgagaccgaaaagatgaaagtgctgttcttgcctgaacctgtggttagactcaaaaacctaacaagtcataccaaatatctggtcagcatttctgccttcaacgcagcaggcgacggccctaagtctgatcctcagcagggacgtactcaccaggctgccccaggcgccccctctttccttgccttcagcgagattaccagtactaccctcaatgtatcgtggggcgagccagccgccgcaaacgggatcctgcagggatacagggtggtatacgaacccctggcacccgtccagggtgtgtccaaagtggtgactgtggaggtacgcgggaattggcaaaggtggctgaaggtccgtgatctgacaaagggggtaacttatttcttccgggttcaggctaggacaatcacttatggccctgagcttcaggccaatataactgctggacccgcggaggggtcccctgggagtccacgtgacgtcttagtgactaaaagtgcctcagagctaacattgcaatggactgagggacacagtggcgacactccaaccacgggctacgtgatagaagcgcggccgtcagacgaggggctgtgggatatgttcgttaaagacattcccaggagcgctacttcctacaccctgagcctagacaagcttcgccagggtgtgacatacgagtttagggtggtggctgtcaatgaggccggctacggcgaacctagcaaccccagtacagccgtgtccgcacaggtcgaggcgcccttctacgaagaatggtggtttctgttggtgatggccctgagcagcctgatcgtgattcttttagtagtttttgcactggtgcttcatggccagaacaagaaatataagaactgcagtaccgggaaagggatcagcaccatggaggagtccgtgactttagataatggtggattcgctgctttggagctcagctctcgacatttaaacgtgaagtcaacctttagcaaaaagaacgggactagaagccctcctcgcccctcaccaggagggctgcactactcagatgaggatatatgcaacaagtacaacggcgctgtgttaaccgaatcagtgtccttgaaggagaaatctgccgatgcatcagaatctgaggccaccgactctgattacgaagatgctctccctaaacactcattcgttaaccactacatgagcgacccgacctactacaacagctggaagaggcgagcccagggacgcgctcccgctccgcatcgatacgaagccgtcgccgggagtgaagccggggctcagttacaccccgtgattaccacccaatctgcaggtggggtatacacgcccgcaggacccggcgctaggacaccgctgaccgggttttcatccttcgtatag

SEQ ID NO: 30018 - DNA, 1386 bp, Artificial Sequence
  Description of Artificial Sequence: Synthetic coding sequence
atgaaagtgctctttctcccagagcccgttgtcagacttaagaatcttacatctcataccaaatacctcgtgtccatatcagccttcaacgcagccggggatggccccaaatccgacccacagcagggcaggacacaccaggccgcgcccggggcgccctctttcctggcgttctcagagattactagtacgacgcttaacgtttcttggggtgaacccgcggcggctaatggtattctccagggatatcgagtcgtctacgaacccctggctcccgtgcaaggggtgtccaaggtggtgacagtggaggtcagaggcaactggcagagatggttaaaggtacgtgacctcaccaaaggtgtcacatacttttttcgcgtacaggcacgcacgatcacctatggtcccgagttacaggcgaatattaccgctggccccgctgagggaagcccaggtagccctcgtgacgtcctcgtgacgaagtctgcctcagaactgaccctgcagtggaccgaggggcactctggggacacgcccaccacaggctacgtgatcgaagcgagaccttcagatgaaggtttgtgggacatgttcgtgaaagacattcccaggagcgcaacctcttatactctgtctcttgataaattgcggcaaggtgtaacatacgaatttcgagtggtggccgttaacgaagcggggtacggtgagccatctaaccccagcactgccgtgagcgctcaggtggaagccccattttatgaagaatggtggttcctgcttgtgatggcactgtcctccctgattgtaattttattagtagtgttcgctctcgtcctgcatgggcagaataagaagtacaagaattgttcaactggcaagggtataagcacaatggaggagagtgtaaccctcgataatggtgggtttgccgccctggagctgtcctcccgacatctgaacgttaagagcacattctccaaaaagaacggaacccgaagtccccctagacccagtcctggcgggctgcattacagcgacgaggatatttgtaacaaatacaacggcgccgttctgacagaatctgtgagcctgaaagagaagagcgccgacgctagcgaatccgaagccacggactccgactatgaggacgccctgccgaagcactcgtttgtcaaccactacatgtctgaccccacgtattacaactcgtggaaaagacgcgcccagggcagagcccctgcgccgcacagatacgaagccgtagccgggagcgaagctggggcccagctacatcctgtgatcacaactcagtccgctggcggggtctatacccccgcaggacccggtgcccggactcccctgactgggttcagttcttttgtgtag

SEQ ID NO: 30019 - DNA, 6651 bp, Artificial Sequence
  Description of Artificial Sequence: Synthetic coding sequence
atgtgggggctgctcatatggactctgctcgcattgcatcagataagagccgccagagcacaagacgacgtctccccatattttaagacagagcccgtgcgcacacaagtgcacttagagggaaatagattagtcctgacctgcatggcggagggctcctggcctctagagttcaaatggctccataacaatcgggagctgacaaaattctctctggaatatagatacatgattactagcctggacagaactcatgctgggttctataggtgcattgtgagaaatcgaatgggcgccctcttacagaggcaaactgaggtccaggtggcctacatgggatcattcgaagaaggggagaagcatcaaagcgtcagtcatggggaggccgcagttattcgcgcgccacgtatagcatcatttcctcagcctcaggtgacatggttcagagacggcaggaaaattcctccgagtagccggattgcgattacacttgagaatacactggttatcctgagcaccgttgccccagacgccggaaggtattatgtgcaggcggttaacgacaaaaatggcgacaataagacaagccagccaattaccctgaccgttgagaacgtgggcggtcccgctgaccccatcgcacccaccatcatcattcccccaaagaatacatccgtcgtggcaggtacgagcgaggtaacattggagtgtgtggctaacgcccgccctctgatcaagctgcacatcatatggaaaaaagacggagtgcttctgtccggtggaatcagtgatcataatcggcgactaacaatccccaatcccaccggatccgacgcgggctactacgagtgcgaggcagtactacggtccagctctgttccatcggtggtgcggggggcctacctatctgtgctcgagcctcctcagtttgttaaagagcccgaacgacacatcactgctgaaatggagaaagtcgtggatataccgtgtcaggcaaagggagtgcctccaccgtcaatcacctggtataaagacgctgctgtggtcgaggtggagaagctgacacgtttcagacagagaaatgatggggggctgcaaattagtgggttggtccctgatgacacaggaatgttccagtgcttcgctaggaacgccgccggagaggtacaaacaagcacctatctggcggtgacatccattgcacccaacataaccaggggcccattggatagcaccgttatagatggcatgtcagttgtgttagcctgcgaaacgtctggcgcaccacggccagctatcacctggcagaaaggggaaagaatattagcgtcaggatccgtgcagctcccgcggtttactcctctcgagtctggcagcctgctaatcagtcccactcatatctcagatgccgggacgtacacctgcctagccacaaactcccgcggcgtagacgaggcctcagccgacctagtggtgtgggcaaggacccgcatcaccaagccgccacaagatcaatctgtcataaagggcactcaagcatctatggtttgtggcgtgacacacgatccaagggtgaccatccgatatatctgggagaaggacggcgcaacccttggcacagagtcccaccctcgcataagactggaccgcaacggatcactacacatttctcagacctggagtggggatataggtacttatacttgtagagtgatttctgccgggggcaatgatagtcgcagtgcacacctaagagtgcgccagctccctcatgctcccgaacatcccgttgccaccctgagcacagtggaacgccgcgccatcaatctgacctggaccaagccgtttgatggtaacagccctttgatacggtatatcctggagatgtcagagaataacgccccttggactgtattgttggcaagcgtggatcctaaagccacctctgtcacagtaaagggtttggtccctgccaggagttaccaattcagactgtgcgcggtcaatgacgtcgggaagggccagttctccaaggacaccgaacgtgtcagccttccagaggaaccaccaaccgccccaccgcagaatgttatcgccagtggtcgcactaatcaaagtatcatgatccagtggcagccacccccagaatcccaccagaatggcatcctaaagggatatatcatccgctattgcctggccgggctgccggtggggtatcagtttaagaacatcaccgacgcggatgtgaacaatctcttattagaggacctgataatttggactaattacgaaatcgaggttgccgcctacaactcagcaggactgggtgtgtacagcagtaaagtgaccgaatggacccttcaaggcgtacctaccgtgccaccgggaaatgtgcacgctgaagccacgaacagcactaccataaggtttacatggaacgcaccctcacctcagttcattaacgggatcaatcaggggtacaaactgatcgcttgggaaccagagcaggaggaagaggtaacgatggtaacagcccggcccaacttccaggactccatacacgtaggctttgtatcaggcctgaaaaagtttacagaatacttcacaagcgtgctttgcttcacaacacccggtgatggaccccggagcacacctcagctggtgagaacccatgaagatgtgcctgggccggttgggcacctgtccttctctgaaatcctggatacgtccctcaaagtgagctggcaagaaccgggtgagaaaaacggtatactgactggataccgcatttcatgggaagaatacaatagaaccaacaccagggttacacactacctgcccaatgtgactctcgaatatagggtcactggattgaccgctctgaccacttacacaatcgaggtggccgcgatgacctctaaaggtcagggccaagtcagcgcctctactatcagctcaggcgtgccccccgagttgcctggtccacctacaaatttgggcatatccaatattggacctagatctgttaccctacagttccgaccagggtatgatggtaagaccagtattagtaggtggctcgtcgaggcacaggtgggagtagttggggagggggaagagtggcttctgatccatcaactttccaatgagcctgatgcccgctccatggaggtccctgacctgaaccccttcacctgctacagcttccgcatgagacaagtgaatattgtcggcaccagcccaccatcccagccatccagaaaaatccagacacttcaagcaccacctgatatggcccctgccaacgtgagcttgaggaccgcatcagaaacctccctatggttaaggtggatgcctttgccagagatggagtataacggcaatccggagtccgtgggatacaaaattaagtactcacggagcgatggacatgggaagacgctgtcacatgtggtgcaggaccgcgtcgaaagggattatacaattgaggatctggaagaatggacagaatatcgagttcaagtgcaggcattcaacgctatcggcagcgggccttggtctcaaacagtggtgggcaggacacgagagtcagtccctagcagcgggcctaccaatgtttcagctcttgcgacgacgtctagttccatgctggtccgatggtccgaagtgccagaagcggataggaacggattggtgctcggatacaaggtgatgtataaagagaaggactccgatacacagccacgcttctggctggtagaggggaatagttcccggtcagctcagttgacggggctgggcaagtacgtcctgtacgaagtccaggttcttgccttcacccgtattggcgacggctccccatcccatccaccaattctggaacgaacactcgatgatgttcccggcccccccatgggtattctcttccccgaggtgcgaactacaagcgtgcgcttgatctggcaaccacccgccgcccctaatggaatcatcctggcctaccagatcacccataggcttaatactaccaccgccaataccgcaaccgtggaggtgttggctcccagcgcccgacagtatactgccaccggcctgaaacccgagagcgtgtacttgttcagaataacagctcagactagaaaaggatggggcgaggccgcagaggccctcgtcgtcacaactgagaaacgagacagacctcagcccccgtcccggcctatggtgcaacaggaggacgtgcgggctagatccgtgctgctgagttgggaaccagggagcgacggactgtccccggtgcgctactatactattcaaactcgggagttaccctctggtcgctgggccctccattccgcatccgtgtcacataatgcttcaagttttatagtggatagacttaagccctttaccagctataagtttcgggtgaaagcaactaatgatatcggggattccgagttcagcgaagagagcgagtcccttaccacactgcaggcagctcccgacgaggcacccaccatcctgtccgtcacacctcacacgacaactagcgtcttgatccggtggcagccgcctgctgaggacaagattaatggaattctgctcggattccgcattcgatatcgcgaactgctctatgaggggctgcggggttttactctgcggggaatcaataaccccggagctacatgggccgaactgacttccatgtatagtatgagaaacctgtctagacccagcttgacacagtatgaacttgacaatctcaataagcacagaagatatgagattcgtatgtccgtgtataatgctgtgggggaggggccatcctctcccccccaggaagtcttcgtgggggaggcggtgcccactgctgctccccggaatgttgtggtgcacggagcaactgcaacccagctcgatgtcacctgggagcctccacccctcgactctcaaaatggtgacatccagggctataagatctacttttgggaagcccagcgtggaaacttaactgagcgagtcaagacactcttcttggcagagaattccgttaaacttaagaatttaaccggttacacagcctatatggtgtctgtcgccgctttcaatgcggccggcgatggcccaagatccaccccaactcagggccaaacccagcaagccgccccttccgccccatccagcgtgaagttctccgaactgactacaactagtgtgaacgtctcctgggaagctccccagtttcccaatggcatcctggagggataccgcctggtgtacgagccatgttctccggtggatggggtttcaaagatagtcaccgtggacgttaagggcaacagcccactatggctgaaagtgaaagatctggccgaaggcgtcacataccgatttagaattcgggcaaagacctttacatatggcccagaaattgaggccaacgtgactacagggcctggagagggcgcccccggccccccaggcgtgccaataattgtgagatattcctccgccattgctattcactggtcgtccggcgatccaggcaaggggccaataacccggtacgttattgaagcccggccttccgatgagggcctctgggatatccttatcaaagacataccaaaggaagtgtccagctacactttctcaatggatattttgaagccaggtgtttcctacgattttagggtgatagccgtgaacgactatggtttcggcaccccttcttctcccagtcaatctgtgcctgcacagaaggccaatcctttctatgaggagtggtggtttctcgtcgttatcgcactggttggtctgatttttatcttgcttctcgtgtttgtgcttattattcgcggacagtccaagaaatatgctaagaaaaccgatagcggaaactccgcaaaatctggggcccttgggcacagtgaaatgatgtctttagacgagagttctttcccagctttggagctgaataacaggcggcttagtgtgaagaacagcttctgcagaaaaaatggtctgtatacgagatcacccccgcggcccagccccggctctttgcactactccgacgaggacgtgacgaaatacaatgacctgatcccggcggagtcaagctctctaacagagaaacccagcgaaatttccgactcacagggctctgacagtgaatacgaagttgactcaaatcaccagaaggcccactctttcgtgaaccactatatcagcgatcctacttactacaactcttggagaaggcagcagaagggcatttctagagcgcaagcgtatagctatacagagagtgattccggcgaacccgatcacacgacagtgacaaactccacttctacccaacagggatcattattcagacccaaagcctccagaacccctacaccccagaatccaccaaatcctccctctcagcagtccaccctctacagaccacctagcaaggcaggggtgcagaaagagggcgagaatcgggagcggatgtgtgtagcctcctcaagttcagccctgcgatggtggggctccctgttaccttgggaattgcatggtgcaggtgaagttgctgttagcctgctgtggacgcgtagcggcgcggggatttggagggagaggggctcaggaggttag

SEQ ID NO: 30020 - DNA, 6462 bp, Artificial Sequence
  Description of Artificial Sequence: Synthetic coding sequence
atgtggggcctgctcatttggactttactggccctgcatcaaattcgtgctgcccgcgctcaagacgatgtctccccatacttcaagacggaacccgttcgaactcaagtccatctggaagggaatcgactggtgctcacatgtatggctgagggcagctggcctttagagtttaaatggttacataataatagggaattgaccaaattttctctcgagtatcgatacatgattacatcactcgaccgcacccatgctggattctaccgctgtattgtgcggaaccgcatgggggccctgctgcagaggcagacggaggtacaggtcgcctacatggggagctttgaagagggcgaaaagcaccagagtgtgtcccatggagaagccgccgtcatcagggccccacggattgcctcatttcctcagcctcaagtgacttggttccgagatggcaggaagatcccaccatctagccggatcgccatcaccctagaaaacactctggtcatcttatctacagtagctccggacgccgggagatattatgtgcaggctgttaacgataaaaacggggataataagacctctcagcccattactcttacggttgagaatgtgggcggacccgccgatcctatcgcacccacaattatcatcccccctaagaatacatcagttgtggccggcacttcggaagtcacattggagtgtgtcgccaacgccagaccactgattaagctccatatcatctggaaaaaggatggggtcctgctgtccggcggtatctcggaccataaccgacggctgactatcccaaaccctaccggctcagacgcaggttactacgagtgcgaagctgttcttagatcatcctcagtgccgagcgtggtcaggggcgcttacctgtctgtgttggaacctccacagtttgtaaaagaacctgaacggcatattacggccgagatggaaaaagtcgtcgatatcccatgccaggctaaaggagtgccacccccctcaatcacttggtacaaagacgcagcggtagtggaagtggaaaagctcacacgttttagacaacggaacgacggggggttgcagatctccggcttggtccccgacgacaccggaatgttccagtgctttgcgaggaacgctgcaggcgaagtgcagaccagcacttacctggccgtgacctctatagcgcccaacattactcgcggcccgctggattctaccgtgattgacggtatgtcagtggttttggcttgtgagactagcggcgcaccacggcctgctatcacctggcagaaaggagagcgcatcctcgcttctggtagtgtgcaactgccccgattcactccgctggagtccggatcactgctcatttcaccaacacatatcagcgatgccggtacctacacctgcctcgctacaaactccaggggggtcgacgaggcttccgcagatttagtggtatgggccaggacccgaatcacaaagcccccccaggatcagtcggtgattaaaggtacacaagcaagtatggtgtgcggagttacccatgacccccgcgttacgattcgctacatctgggaaaaagacggcgctaccctggggacagagtcacacccgcggatccgtctggatcgtaacgggagcctgcatatctcacaaacgtggagcggggacatcgggacatatacatgtcgcgtcatctccgcaggaggaaacgattcgaggtccgcccatctgcgggtccggcagctcccacacgctcctgagcaccctgtcgcgacactgtctacagtagagcggcgggccatcaacctgacgtggacaaaaccttttgatggcaattcacccctaatacggtatatcctggagatgtctgaaaacaacgctccctggaccgtgctgctggccagtgtggacccaaaggcaacaagtgtcaccgttaaggggctggtccccgctcggtcttatcaattccggctgtgtgctgttaacgacgttggtaaaggccagttctccaaagacaccgagagagtgtccctgcccgaagaaccgcccactgcccctcctcagaacgtgatcgccagtgggagaacaaatcaatcaattatgatccagtggcagcccccaccagagagtcaccaaaatggcattcttaagggatacataatccggtattgtcttgctggccttccagtcggctaccagttcaaaaacatcacggatgctgacgtcaacaacctactccttgaagatctgatcatttggactaattacgagattgaagttgccgcctataattccgcgggcctcggggtttactcttcgaaagtgaccgagtggactctgcaaggcgtgcccaccgtcccaccgggtaacgtccacgcggaggcaaccaactctaccacaatcagattcacctggaacgcccccagcccccagttcatcaacggtatcaaccaaggatataagcttatcgcctgggaacccgagcaagaagaagaagtgacgatggtgactgctcggccaaattttcaggactcgattcacgtgggattcgtttccggcctgaagaagttcaccgaatactttacttcagtgctctgttttacaacacccggagatggccccaggtctactcctcagctcgtgaggacccatgaagacgttccaggacctgttggccacctgagttttagcgaaatcctggatacttccctgaaagtgtcttggcaggaaccaggtgaaaaaaatggcatccttacaggctataggatcagctgggaggagtacaatcggaccaacactcgtgtcacccactatcttccgaatgtcaccttggaatacagagtgaccgggctgaccgccttgaccacttataccattgaagtagccgccatgacaagtaagggccagggccaagtgtccgctagcaccatttccagcggggttccccccgaattacctggcccacctacaaacctcggaatttcaaacattgggcctaggtcggtcactctgcaattccgacccggctacgacgggaagacttccatctccagatggctggtggaggctcaggtaggagtagtgggcgaaggcgaagagtggctgctaattcaccaactttctaacgagccagatgcacgtagtatggaggtaccagatctaaatccgtttacttgctactcatttagaatgcgtcaggtaaacatcgtggggacatcaccaccgagccaaccatcacgcaaaatacagacgctacaggcacccccagatatggctccagcaaacgtttccctgagaactgcaagcgaaacctcactgtggctgagatggatgcctctgcctgagatggaatataatggaaatccggagtcagtcggctataagataaagtactcacgatcagatgggcacggtaagacccttagtcacgtggtgcaggacagggtggagcgagattacacaatagaggacctggaagaatggacagaatatcgtgtccaggttcaggcgtttaatgccattggcagcgggccatggagccagaccgtggttggccgcacccgggaatccgtcccgagttctggccccaccaacgtgagcgcgcttgctaccacatccagctctatgctcgtgaggtggtccgaagtacccgaggctgatagaaatgggttggtgcttggatataaagtgatgtacaaagagaaagattcagacacccaacccagattttggctggtggagggaaactcctccagatccgcccaactcactggtctaggcaagtacgtgctgtatgaggtacaagtacttgcattcacccgcattggggacgggtcccccagccatcccccaattctagagcggaccctggacgatgtgcccggtccacccatgggtattttgttccccgaagtccgtaccacctctgtaagattgatttggcagccacctgcggcacctaacgggattatcctcgcctatcaaatcacccacagactcaacacaactactgcgaacacagccaccgtcgaagtcttggctccatctgctagacaatacactgctacaggcctgaaacctgaaagtgtgtatttgtttagaattacggctcagactcggaagggctggggtgaggcagccgaggctctggtagtaacaactgagaaaagagatcgacctcagcccccatctcgccctatggtgcaacaggaggatgtccgcgcccgttccgttctgctcagctgggagcctggaagtgatggcctgagtcccgttcgatattacaccatccaaacccgtgagctgccgtcaggccgctgggccttgcattctgcttctgtctcgcacaacgcctcaagtttcattgtggacagactgaagccctttaccagctataagttccgggtgaaggccacgaacgacatcggcgattccgaattcagtgaggaaagtgagtctctgacaaccctccaggcagcccccgatgaagcccctactatactatcagtaactcctcataccaccacttccgtgctgatcaggtggcagccacccgcagaggataagattaacgggattctactgggctttcgaatccgttaccgcgagctgctgtacgagggactaagaggcttcaccctcaggggtatcaataaccccggcgctacttgggcggagttgacttatcttaacaagcacaggcggtatgaaatccgcatgagtgtctataacgctgtcggggagggaccaagctctccacctcaggaggtctttgtcggggaggccgtgccaacagcggcccccaggaatgtcgtggtgcatggtgcaacggctacgcaactcgacgtgacttgggaacctccccccctcgactcccagaacggggatattcaaggatacaaaatttatttttgggaggcccagaggggaaatctgacggaacgcgtgaagactctttttctggcagagaatagcgttaagttgaagaaccttacaggttacactgcgtacatggtgagcgtggccgctttcaatgccgccggagatggcccacgttctactcccactcagggtcagacccagcaggctgcccctagtgcaccaagctcagtcaagttctccgagctgaccaccacctccgtgaacgtaagctgggaggccccccagtttccaaatggcattttggaagggtaccgcttagtctatgaaccatgctctccagtcgacggtgtgagcaagatcgtgaccgttgacgtcaagggaaattcacccctttggctgaaggtgaaagacctcgcggagggggttacctatcgcttccgaattcgggccaaaaccttcacttatggccctgaaatcgaagccaatgttacaaccggccccggcgaaggagctccagggcccccaggtgtgcccatcatcgtgcgctatagttccgccatcgccatccattggtccagtggagatcccggaaagggtcccatcacgcggtatgtaatcgaagcccggcccagcgacgaaggcctgtgggatatccttatcaaggacatccccaaggaagtgtcttcttacacctttagcatggatatccttaaaccgggtgtcagctacgacttccgcgttatagcagtgaatgactatggtttcggtaccccctcaagcccgtcccagagcgtgcccgctcaaaaagcaaatccattttatgaggaatggtggttccttgtcgttattgcactcgtcggtcttattttcatcttgctccttgtgtttgtcctaatcatcagagggcagtctaaaaagtatgcaaagaagaccgactccggaaattctgccaaaagtggcgcgctcgggcactccgaaatgatgtccctggatgagtcttccttccctgcgctggaactgaacaaccgcagactgtcagtgaagaattcattctgcagaaaaaacggtctgtatacccgttcgcctcctcggccatcacccggaagtttacactactcagacgaggacgtcacgaaatataatgacctcatcccagccgagagcagtagtctgactgagaaaccttccgaaatctctgactcacagggtagcgattccgaatacgaggtggatagcaaccaccagaaagcccactcatttgtcaaccactacatttccgaccctacttattataattcctggcggagacagcagaaagggatttctcgagctcaagcatatagctacaccgagtccgactccggagagccagaccacacaacggtcaccaacagtacttcaacccagcaagggagcttgttcaggccaaaagcctcccgcacacccaccccgcagaatccaccaaaccccccctcccagcagtctacattgtaccggccacctagcagtcttgctcccgggtctagagccccaatcgcgggcttcagttcgtttgtgtag

SEQ ID NO: 30021 - DNA, 6519 bp, Artificial Sequence
  Description of Artificial Sequence: Synthetic coding sequence
atgtgggggttattgatttggaccctgctggcgctgcatcagattcgggctgccagagctcaggacgatgtgtccccttacttcaaaacagaacccgtgcgcacacaggttcatctagagggaaacaggttagtattgacctgcatggccgaaggcagttggccccttgagttcaagtggctccataacaaccgggagctgactaagttctcactggaatatcggtacatgattacatcactagaccgaactcacgccggtttctatcgatgcatagtgagaaataggatgggtgccctcttgcaaagacaaactgaggttcaggtggcttacatgggaagcttcgaagagggcgagaaacaccagagtgttagtcacggtgaagcggccgtcattagggctcctagaatcgcctcttttccgcagccccaggtgacgtggtttagggatggacgtaaaattcctccatcctcaaggatagccatcacgcttgaaaacacactggttattctatctaccgtggcaccggacgccggccgttactatgtccaggctgtgaacgataagaatggcgacaacaaaacaagccagccaattacccttaccgtggagaatgtgggaggccccgctgatcccatcgcgccaaccattatcatcccgccgaaaaacacttctgtggtggccgggaccagcgaagtaaccttagagtgcgtcgcaaatgctcggcctctgatcaagttacatatcatctggaaaaaggacggcgtcttactgtcgggaggcatctctgatcacaatagacggctcaccatcccaaaccctactgggagcgacgctgggtattacgagtgcgaggccgtgctgcgttccagctccgtgcccagcgtcgtgagaggtgcctatttatccgtgctggaaccacctcagtttgtaaaagagccagagcggcacattacagcagagatggagaaagtggtggacattccctgtcaagcaaaaggtgtccctccgcctagcatcacctggtacaaggacgccgccgtcgtggaggttgagaaactgaccaggttccgccaacgcaacgatgggggtctccagatctcgggcctggttcctgatgacaccgggatgtttcagtgtttcgctcgtaatgccgccggggaagtgcaaactagtacatatctggccgtgacgtccatcgcaccgaacataacaaggggacccttggatagcacggtaatcgatggcatgtcagtcgtcctggcctgcgagacctcaggcgccccccgcccagcaataacatggcaaaaaggtgaaaggattctcgcgagtggatccgtgcagctcccaaggttcactcccctggagagcggatcactcttaatttctccaacacacatcagcgacgccggtacctatacttgcctcgccacaaattctcgcggtgtggatgaggcaagcgccgatctggtcgtctgggcgcgaacccgaattacgaagcccccacaagatcagagtgtgataaagggcacccaagccagcatggtgtgtggcgtcacacacgatccacgggtcaccatccgatacatttgggagaaagatggggcaacgctgggtacagaatcccatcctagaatcaggttggaccggaacggcagcttgcacattagccagacctggtcaggtgacatagggacctatacctgccgggtaatcagtgccggcgggaatgactctcggagcgcccatctacgggtgagacagctgccacacgcccccgagcatcccgtggccaccttatcaacagtggaacgtcgggccatcaatctaacttggactaaaccgtttgacggcaactctcctcttattcgttatatcctcgaaatgagtgaaaacaatgcgccttggactgtcctgctggcttctgttgatccgaaagccacgagtgtgactgtcaagggactcgtacccgccaggtcctatcagttccgtctgtgcgctgtgaacgacgtggggaagggacaattttctaaggatacagagagagtaagtctgccagaggaaccccccaccgcacctccacagaatgtcattgcttccggaagaactaaccagagcattatgatacagtggcagccacctcccgagtcccatcagaatgggattttgaagggatacattatccgatactgcctggccggcctgcctgtgggttaccagtttaaaaatataaccgatgctgacgtgaacaacctgctcttagaggatctgatcatctggacgaactatgagattgaagtggccgcatataattccgctggcttaggtgtctacagctccaaagtaaccgaatggactctgcagggagtgccaacagtgcctccaggaaacgtccacgctgaagctacaaactctacgacaattcgctttacctggaacgcgccatctccacagttcatcaatggcataaatcagggatataaactcatcgcctgggaaccagaacaggaagaggaggttactatggtgaccgctagaccaaactttcaggattctatccacgtcgggtttgttagcggactgaagaagtttaccgagtacttcacaagcgttctgtgtttcaccactcctggtgacggccccagatctacaccccagctggtgagaacacatgaggacgtgccagggcccgtagggcacctcagcttttccgagatcctcgacacttctttgaaggtttcctggcaggagcctggcgagaaaaacggtatcctaacaggttacaggatctcttgggaggaatataaccgaaccaacaccagggtgactcattacctgccaaacgtgaccctggagtatcgggtgaccggactgactgctctgactacttatacaattgaggttgccgccatgacgtctaaggggcagggccaggtgtctgcaagtacgatttcttctggagtgcccccagagctgccgggcccccctaccaatttggggatctccaacataggcccaagaagcgttaccctgcagtttagacccgggtacgacggaaaaactagtattagccgctggctagtagaagctcaagttggtgtcgtgggcgagggagaggagtggctcctgatccaccaacttagcaacgagccggacgccaggagcatggaagttcctgatctcaatccattcacctgctactcctttaggatgcgccaggtcaacatcgtgggcacctcccccccatcccagccatcccggaaaattcagaccctccaggcccctcctgatatggcccctgcgaatgtttctctgaggaccgctagcgagaccagcctatggctccggtggatgcccctcccagaaatggaatataacggaaacccagaaagcgtaggatacaaaatcaaatactcccgttcagacggccatggtaagacactgagccacgtcgttcaagatcgtgtggaaagggactacaccatagaggacctcgaggagtggaccgagtatcgagtgcaggtgcaagcctttaatgctattggatccgggccctggtctcagacagtcgtgggccgcacgcgggagagtgtgccgtcttccggccccactaatgtcagcgccctggcgacgacgtcatcttccatgctcgtgcgatggtccgaagttcccgaggccgacagaaacggtctggtgcttggatacaaggttatgtacaaggaaaaagacagcgatacgcagccccgtttctggcttgtcgaagggaattccagcagaagcgcccagttaaccgggttgggtaagtatgtgctgtacgaagtacaagtgttggcgtttactcgcattggggatgggagtccctcccacccgccaattctcgaaagaaccttggatgacgttccgggcccccccatggggatactctttccggaagtcagaaccactagcgtgaggctaatctggcagccccctgcggcccctaatggcattattttggcgtatcaaattacgcataggttaaatactaccaccgcaaacacagcaacggtggaggtcctagccccatcggccaggcaatataccgccacggggttaaaacctgagtcggtctatctgtttaggatcacggctcaaactcggaaaggatggggcgaggccgctgaagcattggtcgtaacaacagaaaaacgcgaccgtcctcagcctccaagccggccgatggtccagcaggaagacgtacgagccagatccgtgcttctcagctgggaaccaggctccgatggactgagcccagtgcgatattataccattcagacacgcgaactgcccagcggcaggtgggcactccatagtgcttcagtcagccataacgcaagctcctttatagtagacagactaaaaccattcacctcctataagtttagggtgaaagcgacaaacgacatcggggactcagagttctccgaagagtccgaaagtctcacgacgctgcaggccgctcctgacgaggctcccaccatcttatcggtgaccccacacacaaccacgtctgttctgatccggtggcagcctcccgcagaggacaagattaatggaattctgctcgggttccggattcggtaccgcgaactattgtacgagggcctgagagggtttaccctgcgaggcatcaacaaccctggcgcgacatgggcagaattaaccagcatgtacagcatgaggaaccttagtcggccatcactgacccagtatgagcttgataaccttaataaacaccgcagatatgagattcgcatgtcggtgtacaatgcggttggggagggccctagctctccaccccaggaggtatttgttggtgaagccgtccccactgcagcccccagaaacgttgtggttcatggagccacagccacacaactggacgtgacttgggagccccccccattggactctcagaacggcgatatccagggatacaaaatctacttttgggaagctcagcgaggaaatctcacagaacgcgtgaagactctttttctggctgaaaattccgtcaaactaaaaaatctgacggggtacaccgcgtatatggtcagcgttgctgccttcaatgccgcaggtgatggtccacgaagtacccctacacaaggacagactcagcaagccgcacccagtgctccatctagtgttaagtttagcgagcttacgactacctcagttaatgtttcttgggaagccccgcaatttcccaacggcatacttgaaggatatcggctggtctacgaaccttgttccccggtagatggcgtgtccaagattgttaccgtggatgttaaaggcaactctccactgtggctaaaggtgaaagatctagctgagggcgtgacttatcgctttagaattcgcgcgaagaccttcacctacggacctgagatcgaagccaacgtaaccacgggacccggggagggtgcgcctggccctcctggagtgcccataattgttcgttactcttcggctattgctatccattggagctctggcgaccccgggaagggacccatcacccgttacgtgatcgaagcccgtcctagcgacgaaggactctgggatatactgataaaagatatccccaaagaggtctcttcatacacttttagcatggatatcctcaaaccaggcgtgagctacgacttcagggtgatcgccgtgaacgactatggattcggcacccccagttccccaagccagagtgtgcctgcccagaaggccaatccattttacgaagaatggtggttcctggtggtcatagcgctcgtggggttgatctttatcttgcttcttgtattcgtgctgatcatccgcgggcagtccaagaagtacgctaaaaagacagactctggcaattcggccaagtccggggcactcggacactccgaaatgatgtcattggacgaatcttcgttccccgccctagagctgaataatcgcaggctgtctgtgaaaaactccttctgcagaaagaacggcctctacacacggtcaccaccccgcccctccccaggctccctccactatagcgacgaagatgttacgaagtacaatgatctcatcccggcagaaagctccagcctcaccgaaaagccatccgaaatctccgattctcagggttctgattccgagtatgaagttgacagcaatcatcaaaaggcacattccttcgtgaatcattatattagtgacccaacgtactataattcctggcgaaggcagcagaaggggatttcaagagcccaggcatattcgtatacagaaagcgacagcggggaacccgaccatactaccgtcactaactcaacgagtacacagcagggatccctctttcgaccaaaagcttctcggaccccaaccccgcagaatccaccgaaccctccatctcagcagtctacactctatcggccacccagctctctggcccctggaagcagggccccaatagccggattctcctcattcgtgtag

SEQ ID NO: 30022 - DNA, 969 bp, Artificial Sequence
  Description of Artificial Sequence: Synthetic coding sequence
atgtctggagagttgcctccgaacatcaatattaaggagcctcggtgggaccaatccacatttattgggcgtgccaatcatttcttcacagtgaccgacccgcggaatatcctgttgactaacgaacaacttgagtctgctaggaaaatcgtgcacgactatcgacaggggattgtgcccccagggctgaccgagaacgagttgtggcgtgcaaagtatatttatgactcggcctttcaccctgacacgggcgagaagatgattctgattggccgcatgtctgcacaggtgcctatgaacatgacaattactgggtgcatgatgaccttctaccgtaccactccagccgtactgttctggcagtggatcaatcagagcttcaacgccgtggttaattatactaatagatctggggacgccccccttactgtcaacgagctgggtaccgcatacgtgagcgcaacgaccggagccgtggctacggccctgggcctcaatgccctcactaaacacgtgtctccgctcattggacgattcgtccccttcgccgccgtggccgccgccaactgtattaatatcccactcatgcgtcagcgggagcttaaagtcgggatccccgtgactgacgagaacggcaaccgccttggcgagtcagccaacgccgctaagcaagcaattacacaagtggtcgtgagccggattctgatggctgccccaggaatggccatcccacccttcattatgaataccctggaaaaaaaagcattcctcaagagatttccttggatgtccgcgcccattcaggtgggtttggtcggcttttgcttggtattcgccacccccctgtgctgcgccttattccctcagaagtcctccatgtcagtcacttctctagaggcagagctacaagccaagatacaggaatcccacccagagttacgtagagtatacttcaacaaaggtctctag

SEQ ID NO: 30023 - DNA, 585 bp, Artificial Sequence
  Description of Artificial Sequence: Synthetic coding sequence
atgtccggagagctcccacccaatataaatataaaagagcctaggtgggatcagtccactttcatcgggcgcgccaatcacttcttcactgtgaccgacccaagaaatatcctgctcacaaatgagcagttggagtcagccaggaaaatcgttcatgactacagacagggcattgtgccccccggcttgaccgaaaacgaactctggcgggctaagtacatttacgattccgcctttcaccccgacactggggagaaaatgattctgataggacgcatgagcgcccaggtcccaatgaacatgactatcacaggatgtatgatgactttctacagaacaactcctgctgtgttgttctggcagtggattaatcagtccttcaacgcggttgtgaattataccaataggtccggcgatgcacctttgactgtcaatgagctcgggacagcctacgtgtctgccacgactggtgcagtagctacagctctggggctaaatgcgctgacgaaacatgtctctcctctcataggccgattcgtgccttttgcagcggtcgccgccgccaactgtatcaacattccatag

SEQ ID NO: 30024 - DNA, 435 bp, Artificial Sequence
  Description of Artificial Sequence: Synthetic coding sequence
atgtcgggcgaattgcctccgaatattaacatcaaggagccacgctgggaccagagcacattcataggacgtgcaaaccatttttttaccgtgaccgatccacgtaatatcctcttgaccaacgaacaactggagagcgcgagaaaaattgtccatgactatcgccagggaattgtaccccccggtctgactgaaaatgaactatggcgagccaagtacatttatgactccgcttttcatccagataccggggaaaagatgatactgattggtcgcatgagcgctcaggtaccaatgaatatgactatcaccgggtgcatgatgactttttatcggacgacacccgcggttttattctggcagtggatcaatcaatcgttcaatgccgtggtgaattacaccaacaggtctggtgacgctcctttgactgtttag

SEQ ID NO: 30025 - DNA, 969 bp, Artificial Sequence
  Description of Artificial Sequence: Synthetic coding sequence
atggaggcagacctgtcaggcttcaacatcgacgctccgagatgggaccagcgtacatttctagggcgcgtgaaacactttctgaacataaccgacccccgcactgtgttcgtctccgaacgggagctggactgggccaaagtaatggtggaaaagtctagaatgggggtcgttcccccagggacacaagttgagcagctgttgtatgccaaaaagctgtacgatagtgcattccacccggacaccggggagaagatgaacgtgatcggcaggatgagcttccagctcccaggcggaatgattattactggctttatgctccagttctaccgcacaatgccagctgtgatattttggcagtgggtgaaccagtcttttaatgctctcgtcaactacacaaatagaaatgcggcgtctccaacctctgttcgccagatggccctctcgtacttcacggcgaccaccacagccgtcgctaccgctgtcggtatgaacatgctcactaaaaaagcgccacccttagtaggacggtgggtgccctttgcggccgtagcagctgcaaattgtgtgaacattccaatgatgagacagcaggaactcatcaagggtatttgcgtaaaagatcgcaatgagaatgaaatagggcactctcggcgcgctgcggccattgggataactcaggtggtcattagtcgtatcactatgtccgctcccggcatgattcttctccctgtgatcatggaaagactggagaagcttcactttatgcagaaggtcaaagtgctccacgcaccactccaagtgatgctttccggttgcttcctgattttcatggttccggttgcttgcgggttgttcccacagaagtgcgaactccctgtctcctatctagaacctaagctgcaagacaccatcaaagctaaatacggcgagctggagccttacgtgtactttaataagggactgtag

SEQ ID NO: 30026 - DNA, 1134 bp, Artificial Sequence
  Description of Artificial Sequence: Synthetic coding sequence
atgtgcgaggaagaagactcaacagccctcgtgtgcgataatggtagcgggttgtgcaaggctgggtttgccggggacgacgcccctcgcgcagtcttccctagcatagtgggccggccacgccaccagggcgtgatggtgggtatgggccagaaagactcatatgtgggtgatgaagcccagagcaagcgtggtatcctcaccttgaagtatcctatcgagcacggtatcatcaccaattgggacgacatggagaaaatctggcaccatagcttttataacgaactgagggttgcaccagaggagcatcccaccctgctgactgaggcccccctcaaccctaaggctaatcgggagaagatgacacagattatgttcgagaccttcaatgtgcccgccatgtatgtcgcaatccaagctgtcctgagtctctacgcaagcggaagaaccacaggaattgtactcgactctggcgacggtgtaacacacaatgttcccatttatgaaggctacgccctgcctcacgccatcatgcggctcgatttggcagggagggacctcaccgactacctgatgaaaatcctcactgagaggggatattcattcgtgacaactgctgagcgagaaatcgtgcgtgacataaaggagaaattgtgctacgtggcactggattttgaaaacgaaatggctacggccgcgagcagcagctcactggaaaagtcctacgaactgcccgatgggcaggtcattactatcgggaacgagcggtttcgctgcccagaaaccttattccaacctagttttatcggcatggagtccgcgggaatccatgagactacttacaatagtattatgaaatgtgatatcgatatccggaaagacctttatgcaaacaacgttttaagtgggggtacaaccatgtaccctggcatcgcagaccggatgcaaaaagaaatcaccgctctcgctccatccaccatgaaaatcaaaataattgccccgcctgagagaaaatactcggtgtggattggtggctccattctagcatcacttagtacctttcaacagatgtggatttcgaagcaggaatatgacgaggcaggcccatccatcgtgcaccgaaaatgtttttag

SEQ ID NO: 30027 - DNA, 966 bp, Artificial Sequence
  Description of Artificial Sequence: Synthetic coding sequence
atgggcgagctcccactggatatcaatatccaggaacctcgatgggaccagtccacgtttctgggcagagcccgacacttctttacggttactgacccccgaaatctgttgttgtccggggcacagttagaggccagccgtaatatagttcaaaactatcgggctggtgtggtgacacctgggatcacagaggaccagctatggagggcaaaatacgtgtacgactctgcattccaccctgatactggcgagaaagtggtcctgatcggcaggatgtctgcccaggtgccaatgaatatgactataacaggctgcatgctgactttctaccgcaaaacacccaccgtggtcttctggcaatgggttaaccagtcctttaacgccatagtgaattactcgaataggagtggcgacactcctatcacggttcggcaactgggtacagcctacgtgtctgctactaccggcgccgtggccacagcactggggctgaaatcactaacgaaacacctgcctcctcttgtagggcggtttgtccccttcgccgccgtagccgctgcgaattgcattaatatccccctgatgagacaaagggagctgcaggtgggcattcccgtcgcggatgaagcgggccagcggctcggctactctgtcacagccgcaaaacaaggcattttccaagtggtcataagccgaatctgcatggccattcctgcaatggctattcccccactcattatggacacactggaaaaaaaggatttcctgaagaggagaccttggctgggggctcccctccaggttggcctcgtcggattctgcctggtattcgctacaccactgtgctgcgccctatttccgcagaagtcttccatccacatttctaacctggaacccgaattgcgagctcagatccatgaacaaaacccttctgtggaagtggtgtactataataagggcctttag

SEQ ID NO: 30028 - DNA, 987 bp, Artificial Sequence
  Description of Artificial Sequence: Synthetic coding sequence
atgtcactcgagcaggaggaggaaacacagccaggccgcctgctaggacgacgcgacgctgtcccggcctttattgagcctaatgtgcgcttttggattaccgaacgacaatctttcatcaggaggttcctgcagtggactgaactgctggaccctaccaatgtgttcatctctgtggagtcaattgaaaacagtcgacagttactttgtacaaacgaggatgtttctagtcccgcttctgccgaccagcgcgccaccgtgcaccccgactcatcaaacctcatcccgaaactctttaggccggccgctttccttccttttatggcgccaacagtcttcttatctatgactcctctgaaaggaattaagagtgtgatcttgccacaggtctttctgtgcgcctacatggcggcattcaattctataaatgggaaccgaagctacacctgcaaaccgctggaaagatctctgctgatggccggtgcggtggcctcttcgacttttctcggtgttatcccccagttcgtgcagatgaaatacggattaacagggccttggatcaaaagattactgcctgttatctttctcgtgcaggcttccggaatgaacgtttacatgagccgaagtcttgaatcgatcaaagggatcgccgtgatggataaggagggcaatgtcttaggccactcccgcatcgctggcaccaaggctgtacgagagacactggcttcccggattgtgctttttgggacctccgctttaatccctgaggtttttacatactttttcaagaggacgcagtattttagaaagaatcctggcagtttgtggatactgaaacttagctgcacagtcttggctatggggcttatggttccattttccttctcgatttttccacagatcggccagatccagtattgtagtcttgaggaaaaaattcagagcccaaccgaggagacagaaattttttaccataggggcgtctag

SEQ ID NO: 30029 - DNA, 1014 bp, Artificial Sequence
  Description of Artificial Sequence: Synthetic coding sequence
atgtcgctggaacaggaggaggaaacacagcctggcagactcctcggccgccgggatgccgtaccagcgttcattgagccaaatgttagattttggatcaccgagcggcagtcctttattaggagatttcttcagtggactgagctgctggaccctaccaacgtgttcatctccgttgagagcatcgagaattctagacagctcctttgtacaaatgaggacgtgagctcacctgcgagcgccgaccagcggattcaggaagcttggaagcggtcccttgccaccgtgcaccccgactcgagcaacctaatacccaaactcttcagacctgccgcgttcttgcccttcatggccccgacggtgttccttagtatgaccccactgaaagggatcaaaagcgtcatcctgcctcaggtatttctgtgcgcttatatggccgctttcaattccattaatggaaatcgctcctatacatgcaagccactcgagcggtcgttgctgatggccggagcggtcgccagtagtactttcctcggggtcattccccagtttgtgcagatgaagtacgggctgaccggaccgtggatcaaaaggcttctgcctgtcattttcctggttcaggcctcagggatgaacgtgtacatgagtcgaagtctagaatctataaagggcattgccgtgatggataaagagggtaacgtactgggccacagcaggattgccggaacaaaggctgtcagagagacattagcttctagaatagtgctgttcggtaccagtgccctgattccagaggtatttacttatttcttcaagaggacccagtatttccgaaagaaccccgggtccctgtggattcttaaactgtcatgtacagttctggccatgggcctaatggttcccttctctttttcaatattcccacagattggccagattcaatattgttccttagaagaaaaaattcagagccctacggaagagaccgagattttctatcaccgcggggtctag

SEQ ID NO: 30030 - DNA, 537 bp, Artificial Sequence
  Description of Artificial Sequence: Synthetic coding sequence
atggcacccacggttttcctctcaatgaccccacttaagggaattaagtccgtcatcctgccccaagtttttttatgtgcctacatggctgccttcaactccatcaacggcaaccgttcttatacttgcaaaccgctggagcgttctcttctgatggccggggcagtggcttcctctacctttctcggggtgatcccacagtttgtgcagatgaagtatggactcaccggaccatggatcaagcgacttctacctgtgatcttcctcgttcaggcttcaggtatgaatgtctatatgtctcgctctctggaatccattaagggcattgcggtaatggataaagagggcaatgtgctgggtcactccaggatagcaggtacaaaggccgtaagagaaacactggcatctcgcatcgttttgttcggaaccagcgccctcatccctgaggtgttcacatactttttcaagagaacccagtacttcagaaagaaccctggaagtctgtggatactaaagttgagctgcaccgtgttatag

SEQ ID NO: 30031 - DNA, 663 bp, Artificial Sequence
  Description of Artificial Sequence: Synthetic coding sequence
tcgccactcgtctttcttagtatgacaccccttaagggcatcaagtccgtaatcctgccacaggtgtttctgtgtgcatatatggcagctttcaactctatcaatgggaaccggagctacacttgtaaacctcttgagaggagtttgctcatggcaggcgcagttgcaagttcaacctttctgggggtaatacctcaattcgtacaaatgaagtacggcctgactggcccctggatcaagcgcctgctgccagtgatatttctggttcaggcaagcggtatgaacgtgtacatgtctaggtcactcgaaagtatcaaagggatcgctgtcatggataaggagggcaacgtcctggggcactcaagaatcgccggtacgaaagctgtacgggaaaccctggcttcgagaattgtactctttggcacaagtgccctcatccccgaagtgtttacttacttttttaagaggactcagtattttcggaagaatcctggtagcctgtggatactcaagctcagttgtaccgttttagcaatgggcctgatggttccctttagtttctctatttttccacagattggccaaattcagtactgtagtctggaagagaaaatacagtcgcccaccgaagagaccgaaatcttctatcaccgtggagtctag

SEQ ID NO: 30032 - DNA, 192 bp, Artificial Sequence
  Description of Artificial Sequence: Synthetic coding sequence
atggctccaactgtttttttatcaatgacacctctgaagggaatcaagtccgtgatccttccccaagtgtttttgtgcgcttatatggccgctttcaactcaattaatgggaacagatcctacacttgcaagccgctggaaagatctcttctcatggcaggggctgtggcaagcagtacatttcttggatag

SEQ ID NO: 30033 - DNA, 1023 bp, Artificial Sequence
  Description of Artificial Sequence: Synthetic coding sequence
atggccgatacagctaccactgcctctgcagccgcagcctctgctgctagcgcctcttctgatgctccaccattccaattaggcaagccaagatttcagcaaacgtcattctatgggagattcaggcacttcctcgatatcatcgacccacgcactctgttcgtaaccgaaagacggctgcgcgaggcggttcagctgctggaggactacaagcacggaaccctaaggcccggggtgactaatgaacaactgtggagcgctcagaaaattaagcaggccatactgcatcctgataccaacgagaaaatattcatgccgtttaggatgtctggttatattccttttgggacacctatcgtggttggcctcctgcttcctaatcagaccctggcatctacggtcttttggcagtggctgaaccagtctcataacgcttgcgttaattacgccaataggaatgcgaccaagccgagtcctgctagtaagttcattcaaggatacctgggagccgtgatctcggccgtcagcatagccgtcggcctaaatgtgttggtgcaaaaggccaataagtttacccctgccacccgactcctgatacagcggttcgtgcctttccctgcagtggcctccgctaatatttgcaacgtcgtcctgatgcgctacggtgagctcgaggagggaatcgacgtcctcgatagcgatggcaacttggtgggcagctccaaaattgccgccaggcatgctctgctggagactgccctcacgcgggtggtgttacccatgcctattctggttttacctcccattgtgatgtccatgttggaaaagaccgctctgcttcaagccagaccaagacttctgctgcctgtccagagtcttgtgtgtctcgcagctttcggtctggccttaccattggctatctccctgttcccccaaatgagtgagattgagacctcacagctggagcccgagatcgctcaagccacatcttccagaacagttgtgtacaataagggactgtag

SEQ ID NO: 30034 - DNA, 4389 bp, Artificial Sequence
  Description of Artificial Sequence: Synthetic coding sequence
atgggggctcaggatagacctcagtgccattttgacatcgagattaatagggagccagtcggaaggataatgttccaactgtttagcgatatctgtccaaagacctgcaagaactttttgtgtctttgctccggagaaaaaggcctgggcaaaacgacgggcaagaaactgtgctacaaaggatccacatttcatagggttgtgaagaattttatgattcaggggggcgacttcagcgagggtaacggcaaaggcggagagtcaatatatggaggctattttaaggacgaaaattttatcttaaaacacgatagggctttcttactgtccatggctaatcgggggaaacataccaacgggtcccagttctttattacaacaaaacctgcgcctcatctggacggagtacacgttgtgtttgggctcgtcattagcggattcgaggtgattgagcagatcgagaacctgaagaccgacgccgcgagcagaccatatgctgatgtgagggtgatcgactgcggggtgctggctacaaaatccatcaaggatgtcttcgaaaagaaacggaagaaacctacacatagtgagggatcagacagttcaagcaactcaagctcatctagtgagtcaagctctgaaagcgagctcgagcacgaacggtcacgccgcaggaagcacaaacgcagacccaaagtcaagaggagcaagaaacgccgtaaagaagccagttcctctgaggagccacgcaataagcatgctatgaacccaaaaggccacagtgagagatctgataccaatgaaaagcgttcagtggatagttccgcaaaaagggaaaaaccagtggtgcggccagaggaaatacccccagttccggagaataggtttctgctgcgccgtgatatgccagtggtcaccgcggagccagaacccaaaatcccagacgtcgcccctatcgtgtctgatcagaagccttccgtctctaagtctggtcgtaagattaaaggccgggggaccataaggtaccacacccctccaaggtctcgatcatgtagtgaatccgatgacgacgacagctctgagacaccaccacattggaaagaggaaatgcagagattgcgggcctacaggcctccttctggcgagaaatggtcaaagggggacaagctgagtgatccatgcagcagtcggtgggacgagaggagcctgagccagcgcagtcggagttggtcttacaacggctactactcagatctgtcaaccgctcgccactccggccaccacaaaaaacggcggaaggaaaagaaagtcaagcataagaaaaaaggcaagaagcagaagcactgccgcagacataagcagactaaaaaacgcaggattttgatcccatctgatatcgaaagctcaaagtccagcaccagacggatgaagagttcgtgtgatagggagcgttccagtcggtcatcctctctctcatcccatcattcctctaagagagattggtcaaaatctgataaggatgtccaatcgtcactcacacattcttcacgggattcatatcgcagtaaatctcattctcagtcttactctcgcggttcgtcgcggagcagaactgcctctaagtccagcagccatagtagaagcaggagcaaatcacgatcttcctctaagtctggccaccgaaagcgcgcgtccaagtcacctagaaaaacggcttctcagctcagcgagaataaacctgtgaaaacagaacctctccgcgcaacaatggctcaaaatgaaaacgtggtggtgcaacctgtggtggcagagaatattcctgtaattcctctctctgattccccccccccttctagatggaagcccggccagaagccctggaagccttcctatgaaagaatccaagagatgaaggcgaagactacgcatctgttacctatccagtccacctacagtttagccaatatcaaggagacaggaagctcctcatcctaccacaaaagagagaagaattcagagagtgaccagtccacttattctaagtattccgacaggtcatcagaaagttcaccgagatctagatctcggtcatctcgttcacgcagctactcacgctcttacaccaggtcacggagtctcgcgagcagccattccaggtcccggtcaccttcctctcgcagccactccaggaacaagtatagtgaccattcccagtgctccaggtctagttcatatacgagcatttcctccgacgatggacgtcgggctaagaggcggctccgctcttctggtaagaaaaatagtgtgtcccacaagaagcactccagctcttctgagaagacactgcacagcaagtacgtgaaggggcgagacaggtcatcctgtgtccggaagtactctgaaagccggagttccctggactacagtagcgattcggaacaatcctccgtccaagctacacaatctgcgcaggaaaaagagaagcagggacagatggaacggactcataataaacaggaaaaaaatagaggcgaagagaaatctaagagcgagagggagtgcccccattcaaaaaagcgcaccttgaaggagaacttatctgaccacttgaggaacgggtctaagcctaaacggaaaaattacgccgggagcaaatgggatagtgagtcaaactccgagagggacgtgactaaaaattcaaaaaatgacagtcacccttcatccgacaaggaggagggtgaggccacatctgatagcgaaagcgaagtctctgagatccacataaaggtcaaacccactaccaaatcctctactaacacaagcctgcccgatgacaacggtgcctggaagtcctctaaacagagaacttcaacgtctgactctgaaggaagctgttcaaacagtgaaaataatcggggtaagccacagaagcacaaacacgggagcaaagagaacctgaaaagagagcacacaaagaaggtcaaagagaagttaaaaggtaagaaggataaaaagcacaaggctcccaagcgcaagcaggcattccactggcagcccccgctagaatttggggaggaggaggaagaggaaatcgatgacaaacaggtgacccaggaatcaaaagagaagaaagtgagtgaaaataacgaaaccataaaggataatatactaaagactgaaaagtctagcgaagaagacctgagcggcaagcatgacacagttaccgtgagctccgatctggaccaattcaccaaggatgactccaaactttctattagcccaactgcgctgaatacagaggagaacgtggcatgtctccagaatatccagcatgtggaagagtctgtccccaacggcgtggaggacgtcctgcagactgatgataatatggaaatctgtacaccagaccgctcgtccccagccaaggtcgaggaaactagcccactcggaaatgcacgtctcgacacaccagacataaacattgtcctaaagcaagacatggccaccgaacacccacaagcggaggtggtgaagcaggaaagtagtatgagcgagtcaaaagtcctcggagaggtaggcaaacaggacagctcctcagccagcctcgcatcggcgggcgaaagcactgggaaaaaggaagtcgctgagaaaagccaaatcaatctcatcgacaagaaatggaagcctctacagggagtgggcaacctggccgcgcccaatgcagccacgtcttcagccgtagaagtgaaggtgctgacgacagttccagaaatgaagccgcagggcctgcgcattgaaattaaaagcaaaaataaagtgagaccaggatccctctttgacgaagtgcgcaagactgccaggcttaaccggcggccgagaaatcaggagtcctcctcagatgagcaaacaccctctcgcgatgatgatagtcagtcgcggtctcccagcagatcaagaagtaaaagcgaaacgaaaagtcgacatcgaaccagatccgtgagctactctcactctcgcagcaggtccaggtcatcaaccagctcctacaggagccggtcatattctagatcccgttcacgtggatggtactcccgagggagaaccaggagcaggtcctccagttatagatcttacaagtcccaccggacctccagcaggagtaggtccagaagcagttcatacgatcctcattccaggagtcgcagttacacctacgactcctattactcacgtagcagaagtagatcacgatcacaacgctcggactcctaccacaggggaaggagctacaatcgacgatctagatcctgccggtcctacggcagtgacagcgagtccgatcggtcatatagtcaccataggagtccgagcgagagcagccgctactcttag

SEQ ID NO: 30035 - DNA, 681 bp, Artificial Sequence
  Description of Artificial Sequence: Synthetic coding sequence
atggccgccgctgcagttcagggggggcggtctggaggcagcggtggctgttccggggcaggcggagcctctaattgcggcaccggatctggaaggtccggactgcttgataagtggaagatcgacgacaaacccgtgaagattgacaaatgggacggaagcgctgtgaagaacagcctggatgatagcgcaaagaaagtgctgttagagaagtacaaatatgtggagaacttcggactcattgacgggcgacttactatctgcactatatcatgcttcttcgcaattgtggccctgatatgggattatatgcatcccttccccgagtccaaacctgtcctggctctgtgtgtcataagctactttgtgatgatgggcattttgactatctatacttcctacaaggagaagtctatttttctggtcgcacacaggaaggatcctactggtatggatcctgacgatatttggcagctgagctcttccctcaaaaggtttgacgacaagtataccctcaagctgacctttatatctggacggaccaagcagcagagggaggcagaattcacaaaatctatcgcaaaattctttgatcacagtggaacactcgtgatggacgcttatgaaccagaaatctccaggttgcacgattccctggccatcgagaggaaaatcaagtag

SEQ ID NO: 30036 - DNA, 543 bp, Artificial Sequence
  Description of Artificial Sequence: Synthetic coding sequence
atgaataccgtactttcaagagccaacagtttgtttgctttctctctgtcagtgatggccgcgctaaccttcgggtgctttatcacaacagcattcaaggatcgttccgttcccgtgaggctgcacgtgtcccgcattatgttgaagaacgttgaagacttcaccggccctagggaacgctccgatttaggatttattacattcgatattaccgccgatctcgaaaacatcttcgattggaacgtaaagcagctctttttatacctctcggctgaatattctacaaagaacaacgccctgaaccaagtggtcctatgggacaagatcgtcttgcggggtgacaatcctaagctccttctgaaagatatgaaaaccaagtacttcttcttcgatgatggaaacggactgaaagggaatcgaaacgtgacgctgaccctgtcttggaatgtggttcctaatgccggcatccttccgctggtgaccgggtccggtcacgttagcgtgcccttcccagacacttatgagatcaccaagtcatactag

SEQ ID NO: 30037 - DNA, 1563 bp, Artificial Sequence
  Description of Artificial Sequence: Synthetic coding sequence
atgggaccacagcggcgcctcagccccgccggcgccgctctgctctgggggttcttgcttcagttgactgctgctcaagaggccatcctgcatgccagcgggaacgggaccaccaaggactactgtatgctctataacccgtactggactgccctaccatctacactcgagaacgccactagtatttctctgatgaatctcacctctacccccttgtgcaatctttcagacatcccaccagtcggcattaagagcaaggcggttgttgtaccttggggttcatgtcatttcctggaaaaggccagaattgcccagaaagggggagccgaggcaatgctcgtcgtgaataactccgtgttattcccgccatctggcaatagaagcgagtttcccgacgtcaagatcttgatagcattcatctcctataaagatttcagggacatgaaccagaccttaggtgacaacattacagtgaaaatgtacagccccagctggcctaactttgattatactatggtcgtgatttttgtgatcgccgttttcacagtcgctctcggcgggtactggtcaggcctggtggaattagaaaatctaaaggcagtgacaaccgaggatcgcgaaatgcggaagaagaaagaggagtacttgaccttttcgccgctcaccgtggtaatttttgtcgtaatctgttgcgtcatgatggtgctcctgtacttcttctataaatggctggtgtatgtaatgatagctattttttgtatcgcttctgccatgagcttgtacaactgcctcgctgcattaatacacaagatcccatacgggcagtgcactattgcctgccggggcaagaatatggaagtgagactcatctttttaagcggcctttgcatcgccgtggctgtggtgtgggcggtgtttcgaaatgaagaccgatgggcctggatccttcaggatattctgggcattgcattctgcttgaatcttattaagaccctgaagctacctaattttaagtcatgcgtgatcctcctgggcctactcctgttatacgatgttttctttgtgttcataactccatttattacaaagaatggtgagagtatcatggttgaactcgctgcaggaccatttggtaacaacgaaaagctgcccgtcgtgatcagggtgccaaaactgatctattttagtgtaatgtctgtgtgccttatgccagttagtatcctcgggtttggggatataattgttcccggcttacttatcgcctactgccgtcgtttcgatgttcagacaggatcctcttacatctattacgtctcctccactgtggcctacgccatcggtatgatcctcacgtttgtcgttctagtactaatgaagaaaggccagccggcactgctgtatttagttccctgcactctaattactgcatctgtggtcgcatggcgccgcaaagagatgaaaaagttttggaagggcaactcctaccagatgatggaccatttagactgcgcaaccaacgaagagaatccagttattagcggtgagcagatagtgcagcaatag

SEQ ID NO: 30038 - DNA, 2055 bp, Artificial Sequence
  Description of Artificial Sequence: Synthetic coding sequence
atggcctgtcttggctttctgctccccgtaggcttcctgctccttatcagcacagtggcagggggcaaatacggagtagcacatgttgtttctgaaaactggagtaaagattactgtatactgtttagctcggactacattactctcccccgcgacttgcaccacgcgccacttttgcccctgtatgacgggactaaagctccctggtgccctggggaagattctccccatcaggctcagctacgcagcccttcacaaagaccactgaggcagaccaccgctatggtgatgcgcgggaactgttctttccacaccaaaggatggctggcacaagggcagggagctcatggcctgttaatagtttccagagtctcagatcagcagtgtagcgacaccaccctcgcacctcaagaccctaggcagcctttagcggaccttaccattcctgtcgctatgctgcactacgccgatatgctggatattctctcacacacaagaggagaagctgttgtgagagtggctatgtatgctcctccggagccaattatagactataatatgctggtgatttttattttggcagtagggacagtcgccgctggaggctactgggcgggtcttaccgaagcaaaccggctccaacggaggagggcaagacgcggtggaggtagcggcggtcatcatcagcttcaggaggctgcagctgcggaaggagcccaaaaagaggacaacgaagacatcccagtggattttacgcccgcaatgaccggtgtggtcgtgaccctttcctgctctctgatgttgctgctgtacttcttttacgaccattttgtctacgtcactatcggaatatttggcttgggggcggggattgggctctattcgtgcctttctcccctcgtttgccggctctccctgcgacaataccagcgcccacctcattcgctgtgggcgtccctccctctgccactcctgctgctggcaagcttatgtgcaacggtgatcatcttttgggtagcataccgaaatgaagatcgttgggcttggctcctgcaggatactctcgggatctcctattgtctgttcgtgttgcatcgcgtgcgactgcccacactgaagaactgcagctcattccttctggccttgttggcctttgatgtcttctttgtttttgtgaccccatttttcaccaagaccggtgagtccatcatggcccaggttgccctgggacccgcagaaagcagctcgcacgaacggctccccatggtgctgaaggtgcccagactgcgcgttagcgcactgaccctgtgctcacagccattttcaattctagggtttggagacatcgtcgtgccgggatttcttgtggcatattgttgtagattcgatgtacaggtgtgctcgagacagatctacttcgtggcgtgtactgtggcatacgcagtggggttattggtcacatttatggctatggtactgatgcagatggggcagccagcgctgctctatctagtgtcatcgaccctgctaacaagcttggcagtagccgcatgtcggcaggagttgtccctattctggactggtcagggacgcgctaagatgtgcgggctcggatgcgccccgagcgccggatcccgtcaaaagcaggaaggagctgcagatgctcacactgcctcgacactggaacgtgggacaagccggggtgcaggagacctagattccaatcccggagaggatacaacagaaattgttaccattagcgaaaatgaagcgacaaatcctgaggacagatcggatagtagcgagggttggtccgatgcacacctggacccgaatgagctgccattcatccctcccggggcatcagaagaactgatgccgctgatgccgatggcgatgctgattcctctaatgccacttatgccccccccaagcgaactgggacacgtgcatgcccaggcccaggcacatgaaaccggtctcccctgggctggcctgcataagcgaaagggccttaaagtccgcaaaagtatgagtacccaagctccactctag

SEQ ID NO: 30039 - DNA, 1155 bp, Artificial Sequence
  Description of Artificial Sequence: Synthetic coding sequence
atggccgaacagacttactcctgggcatactccttagtcgattcatcgcaggtgagtactttcctgatctccatcctgttgattgtgtacggtagtttccggagcctgaatatggactttgagaatcaagacaaggaaaaggacagcaactcgagtagtgggtccttcaacggtaattctaccaataactctattcagacgattgatagtactcaggccctatttctgcctatcggcgcttctgtgtctctgctcgtgatgtttttcttctttgactctgtccaggtcgtctttacaatctgtactgccgtcctcgccaccatagctttcgccttcctccttctcccaatgtgccagtatctgactcggccttgtagccctcagaataaaattagcttcggctgctgtggaaggttcacggctgctgaactgttgagcttctccttatcagtgatgctggtcttaatctgggtgctgactggccactggctactgatggatgctctcgcaatgggcctttgcgtagctatgatagctttcgtccgattgccaagtctgaaggtcagttgtctactgttgtcagggctcctgatatacgatgtgttctgggtgtttttctcagcttatatttttaatagcaatgttatggtgaaggtggccacccagccagccgacaatcccttggatgtactctcccgcaagctgcacttagggcccaatgttggtagggatgtgccccgcctgtccctccccgggaagcttgtattcccttcctctacagggtctcacttcagcatgctgggcatcggcgacatcgtcatgcccggattactgttatgttttgtgttaaggtatgacaactacaagaaacaggcgtctggggacagttgtggtgcccccgggcccgctaatattagcgggagaatgcagaaagtttcctactttcactgcactctgatcggttacttcgtaggacttcttacagccaccgtggcttcccggattcatagagcggctcagcccgccctgttgtatctggtcccatttacacttctgccgctgctgacaatggcctacctgaagggcgatctccgtagaatgtggtccgaaccttttcatagtaagtcatcgtcttcacggtttcttgaggtgtag

SEQ ID NO: 30040 - DNA, 1152 bp, Artificial Sequence
  Description of Artificial Sequence: Synthetic coding sequence
agtatacgaacgcactgtatggcctactctctggtagactcctcacaggtatcgacctttttgatctccattctactcatagtttacggttccttcaggtctctcaatatggattttgagaatcaggacaaggaaaaggactccaattctagctccggttcctttaatgggaacagccctatcatcggaatccaaaccattgactccacccaggccctgtttctgcctattggtgcctcggtgtccttgctcgtcatgttcttttttttcgacagcgtacaagtagtatttaccatttgcaccgcagtacttgccactatagcctttgcattcctactgttgccgatgtgccagtatttgacgaggccatgttctccacagaacaaaataagttttggttgttgcggtcggtttaccgcggcagagcttctgtccttcagcctttcggtgatgctcgtactgatttgggtattaactggtcactggctcctgatggatgccctggctatgggcctttgcgtggccatgatagcctttgtgcgattgcctagcctcaaagtgagctgtttgctcctgtccggtctgctgatttatgatgtgttttgggtgtttttctctgcgtatatcttcaacagcaatgtgatggtgaaagtggctacccagccggccgataaccccttggatgtgctgagcagaaagctgcacctaggaccgaatgtcggccgcgacgttcctcgattatcattgccagggaagctggtgttcccctcatccactggctcacatttttccatgctgggaatcggtgacattgtaatgccaggactgctgctgtgctttgtgctaaggtacgacaattataagaagcaggccagcggagactcatgcggcgcgcctggaccggcaaatatctccggaaggatgcagaaggtctcttactttcattgcactttaatcggatacttcgtaggactgcttaccgcaactgtcgcgtcaagaatccatagagcagctcagccggccctgctgtatctagtcccttttacgctgctccctctcctgaccatggcttacctaaagggagatctgcgccgtatgtggagtgagccttttcattccaagtcctcctctagccgcttcctggaagtatag

SEQ ID NO: 30041 - DNA, 816 bp, Artificial Sequence
  Description of Artificial Sequence: Synthetic coding sequence
atggcaagtgccgattcaagacgcgtggcagacggagggggcgcaggagggactttccaaccgtaccttgacacactacggcaggagttacagcagaccgaccccaccctactatctgtcgtggtcgccgtgctggccgtgcttttgacactggtattttggaagttgataagatcacggcgttctagtcagcgtgccgttctgctagtgggactgtgtgactctggcaaaacactattatttgtaaggctcctgactggcctgtaccgagacactcagacctcaatcactgactcttgtgctgtctaccgcgtgaataataataggggaaactccctgaccctgattgacttacctgggcacgagtccctgcggttgcagttcctggaacgatttaagtctagcgcgagggccatagtcttcgtggtagattcagctgcatttcagcgggaggtgaaagatgtcgccgaattcctctatcaggtactaatcgactccatggggttgaagaacacaccctccttcttgattgcctgcaacaagcaagacatcgcaatggcaaaaagcgccaagctgatacagcaacagctggagaaagaactgaacacactacgcgtcacgcgtagtgccgccccgtccacacttgactcatcatcaaccgcccctgctcagctcggcaagaagggtaaagagtttgaatttagccagttgcccctgaaagtcgaatttcttgagtgttcagcaaagggtggccggggagacgtgggcagcgccgacatccaagacctcgagaaatggctggccaaaatcgcttag

SEQ ID NO: 30042 - DNA, 279 bp, Artificial Sequence
  Description of Artificial Sequence: Synthetic coding sequence
atggcttctgcggacagcagacgggtggctgatggtgggggcgccggcgggacattccagccataccttgataccctgaggcaggaactgcaacagacggacccaacattactgtctgtggtggttgctgtcctcgcagtgctgttgactctggtgttttggaagctgattcgaagcaggagatcgagccagagagcagtgctgctagtcggactgtgcgatagcgggaagaccttactttttgtccggctgttgaccggcctctatcgggacacttag

SEQ ID NO: 30043 - DNA, 861 bp, Artificial Sequence
  Description of Artificial Sequence: Synthetic coding sequence
atgcggctgttaccacggttacttctgctgctcttactggtgttcccagccactgttctgtttcgcggtggaccacggggactgctggccgtcgcccaggacctaaccgaagacgaggagactgtggaggacagtatcatcgaggacgaagatgacgaagctgaggtcgaggaggacgaacctacagacttggtggaggataaggaggaagaggacgtgtccggggagcctgaagcttccccctctgccgatactactattctgttcgtgaagggagaggactttcctgctaataatatagttaagttcttggttggttttactaataagggaacagaggactttattgtcgaaagtctcgatgcaagcttcagataccctcaggactaccagttttacatacagaattttacagcactgccactcaataccgtggtaccacctcagcgacaagccacattcgagtattcattcatccccgcagagcccatggggggtaggccattcggcctggtgatcaatctgaactataaagacctgaacggcaatgtcttccaggacgccgtgtttaaccagacagtaacagtgatcgagcgcgaggatggtcttgacggcgagacaatcttcatgtacatgtttctcgccggactcggactactcgttatcgtgggcctgcaccagcttttagaatctaggaagagaaaacgtccaatacaaaaagtcgaaatgggaacttcatctcagaatgatgtcgacatgtcttggattccacaggagaccctcaatcagataaataaggcctccccaaggcgactgcccagaaagcgcgctcagaaacgcagcgtaggctcggacgagtag

SEQ ID NO: 30044 - DNA, 780 bp, Artificial Sequence
  Description of Artificial Sequence: Synthetic coding sequence
atgagactcctccctcggctgcttctcctcttactcctggtatttccggctacagtcctgttccggggtggcccgcggggcctgctagccgtcgcgcaggacctcaccgaggacgaagagaccgtcgaggattctattatcgaggatgaggacgacgaggccgaggtggaagaggatgagcctaccgatctagttaagtactttccagccaataatatcgtaaaatttttggtcgggttcactaataagggtacagaagattttatagtagagagtctggatgccagctttaggtatcctcaggattatcagttttacatccagaatttcactgctctgcccctcaacactgttgttccaccgcagcggcaggctacctttgaatactcatttattcccgccgaacccatgggagggaggccgtttggtctggtcatcaatctcaattacaaggatctgaatggtaatgttttccaagacgcggtttttaaccagaccgtgaccgtaattgagagagaggatggtctggacggggagactatcttcatgtacatgttccttgccgggttgggattactggttatagtggggctccaccagctgctggaaagcaggaaaaggaaacgccccatccagaaggttgagatgggtactagcagccagaacgatgtggacatgtcctggatcccccaagagactctgaaccaaattaataaagcttctcccagaagactgccccggaaacgagcacagaaaagaagcgtgggcagcgacgaatag

SEQ ID NO: 30045 - DNA, 558 bp, Artificial Sequence
  Description of Artificial Sequence: Synthetic coding sequence
atggcacctaaaggttcatctaaacaacaaagtgaagaggacttactgctgcaggatttttctcggaacctttctgctaagtcctcagcgctctttttcggaaacgcctttatagtcagcgcaatccctatatggctgtattggagaatttggcatatggacctaattcaatccgccgtgctatacagcgtcatgacactcgtgagcacctaccttgtcgccttcgcctataaaaatgtcaaatttgttttgaagcacaaagtggcacaaaaacgcgaggacgccgtcagcaaagaggtgacccgcaagctatccgaggctgacaaccgcaagatgtcccgcaaggagaaagatgaacggatactttggaaaaagaatgaggtggccgactacgaggctacaactttctcaatcttttataataacactctatttctggtggtggtgatcgttgcgagcttcttcattttgaagaacttcaatcccactgtgaactatatcctgtccatctccgcctcctccggtctgatcgccctgctgtccactggctcgaagtag

SEQ ID NO: 30046 - DNA, 597 bp, Artificial Sequence
  Description of Artificial Sequence: Synthetic coding sequence
atggccccaaagggtagctctaaacagcaaagtgaagaggatttgcttctccaggattttagtcggaatctgagcgcaaagagttctgcactttttttcggaaatgccttcattgtgtccgctattcctatttggctgtattggcgcatttggcatatggacctgatccagagcgctgttctgtacagcgtcatgaccctggtctctacttacttggtggcctttgcctacaaaaatgtaaaatttgtgctcaaacacaaagtggcgcagaagcgcgaggacgctgtgtctaaggaagtgacccgcaaactgagcgaagctgacaaccggaagatgtcacgaaaggaaaaggatgaacgcttcgattcatgcctcaagtacggccatcataagagggggatcctgtggaagaagaatgaggtggccgactacgaagccacaaccttttctatcttctacaataacaccctcttcctggtagtggtcatcgtggcctcattttttatcctcaaaaacttcaacccaaccgtcaactacatcctgtctatcagtgccagttccggtcttattgccttgcttagtacaggtagcaagtag

SEQ ID NO: 30047 - DNA, 5352 bp, Artificial Sequence
  Description of Artificial Sequence: Synthetic coding sequence
atgacgagtctcaagcggtcacagactgagagaccgcttgctaccgatcgtgcttcggtcgtgggcaccgacgggacgcccaaggtgcacaccgacgacttctatatgaggaggttcaggagccagaacgggtctttgggctcatctgtgatggcgccagttggaccacctagatctgagggctcccatcatatcacctctacacctggggtgcccaaaatgggcgtacgggctagaattgccgattggcctcccagaaaagagaatattaaggagtccagcaggtcttctcaggagattgagacatcaagttgcttggatagcttatcaagtaaatcaagccctgtttcacagggctcaagcgttagtttaaacagcaatgactccgccatgttgaagtcaatccagaacactctgaagaataagacaaggccctccgagaacatggactcgcgattcttgatgccagaggcctacccgagtagccctagaaaggctctgaggcggatccgacagaggtcaaacagtgacatcactattagcgaactggatgtggattccttcgatgaatgtatttcacccacttataaaacaggccctagtctgcaccgagaatacgggagcacctcttccattgataaacagggaactagcggggagtctttctttgaccttctcaaggggtacaaagatgataagtccgaccggggccccacccctacaaagttgagcgactttcttattacagggggcggtaaggggtctggttttagcctggacgtaattgacgggcctatcagccagagggagaaccttcgactgttcaaggagcgggagaaacccctgaagcggcgaagcaaatctgaaaccggcgattcctctatttttcgtaagctcagaaacgccaagggcgaggagctggggaagtcgtcagacctcgaagacaatcgcagtgaggattctgtacgcccctggacatgtccaaagtgcttcgcccattacgatgtccaatctatcctgttcgatctgaacgaagccatcatgaatagacacaatgttatcaagcgtagaaacacaactaccggtgcatccgccgcagccgtggccagtttagtttcgggacccttgagccattctgctagttttagcagtccaatgggtagtacagaggaccttaatagcaagggttccctctcgatggatcagggcgacgacaaatctaacgaactcgtaatgagctgtccctactttaggaacgagatcggcggtgagggggagcgcaaaatctctctgagcaagtccaattcaggatcattctcaggatgcgagtctgcaagctttgaaagcactctcagcagccattgtacaaacgccggcgtggccgtgctggaggtgccaaaggaaaacctggttcttcacctggaccgggttaaaagatatatcgtggagcatgtggacctgggcgcttactactatcggaagtttttctaccagaaggagcactggaattactttggggccgatgaaaacctcggaccagtggccgtctccatccgacgcgaaaaaccagatgagatgaaggaaaatgggtccccttacaactacagaatcatctttcgaaccagcgaactgatgaccctacgcggctctgttctggaagatgctataccaagtactgcaaaacacagcacagcccgcggtctcccattgaaggaggtgttggaacacgtggtacctgaattgaatgtgcagtgtctgcgactagcatttaatacgccaaaggtgacagagcagctcatgaagttggatgagcaggggctaaattatcagcagaaggtgggcatcatgtactgcaaggctggacagtctaccgaggaggagatgtacaataatgaaagtgccggcccggcatttgaggaatttcttcagcttctaggcgagagggtacgcttgaaaggcttcgaaaaatacagggcacagttggatacaaagacggatagcactggtacacacagcttgtacacaacctataaagattacgagattatgtttcatgttagcaccatgctgccctacacacctaataacaagcagcaactgcttagaaagaggcatattgggaatgatatagttaccatagtcttccaggaacccggggctcagccctttagcccgaagaatattaggtcacattttcaacatgtttttgtaatagtgagagttcacaatccttgtagcgactccgtgtgttactcagtcgccgtcacacgctcccgcgatgttcccagcttcggacccccaatccccaaaggcgttacatttcccaagtccaatgtttttcgggactttttgctggccaaggtgataaacgcagaaaacgcggcccataagagcgagaagttcagagcaatggccaccaggactagacaagaatatcttaaagatctggctgagaaaaatgtgacaaatacgcccatagacccaagtgggaagttcccctttatcagcttggccagcaaaaagaaagagaagtccaaaccgtatcccggagccgagctgtctagcatgggagctatcgtgtgggccgtcagagctgaagattataataaagccatggaactcgattgcctgctgggaatcagcaatgagttcatagtcctgatcgagcaggaaactaaaagtgtggtcttcaattgtagttgtcgagacgtgatcggctggacttctacagatactagcctgaagattttctacgagcgcggagagtgtgtgtctgtcgggtcttttatcaacatcgaagaaattaaggaaatagtcaaaaggttacaattcgtgtctaaagggtgtgaaagtgttgaaatgaccttacgcaggaatggactagggcagctcggattccacgtgaattacgagggtattgtggctgatgtggaaccttacggatacgcgtggcaggcggggctgcgccaggggagtcggttggtcgagatctgcaaagtggctgtcgccacactgtcccacgaacaaatgatcgatctactacgcacatctgtcaccgtgaaggttgtgattatcccgccacacgacgattgtacccctagacgcagctgctctgagacttaccgaatgcctgtaatggagtataagatgaatgaaggcgtgtcctatgagttcaagtttcccttcagaaataacaacaagtggcagagaaatgcctcgaagggtcctcactctccacaggttccatcccaggtgcaatcaccgatgacatctaggctgaacgccgggaaaggcgacggcaaaatgccacctccagagagagcagctaatatccccagatccattagcagcgacggacgacctctggagcgacgcctgtcgccgggcagcgatatctacgtaactgtttcatcaatggccttggcccggagccagtgtcgaaactctccaagcaacttatcttcctcatctgacaccgggagcgtgggaggaacataccgacaaaaatccatgccagaagggtttggagtctcccgccggtccccagcctcaatcgatcgccaaaatactcagtctgacatcggcgggtcaggcaaaagtactccttcttggcagcgtagtgaggactcaatcgctgaccaaatggagcctacctgccacctgcctgccgtttccaaggtactcccagcctttcgcgaaagcccatccggtcgactgatgaggcaggatccagtcgtccacttgagtccaaataagcagggacattccgattcccactactctagccactcttcaagcaacacgctcagcagcaatgcgtcttccgcacattcagatgagaaatggtatgatggtgatcgaaccgagagcgagctgaactcctataactatttacaggggacctcagccgatagtggcattgatacaacttcctacggcccaagtcatgggtctaccgcttcactcggagcggctacgtccagtccccggtccgggccaggcaaggaaaaagtggcgcctctgtggcactcttcatcagaggtaatcagcatggcagataggacactagaaaccgaaagtcatggcttagatagaaagacagagagttctttgtctttggatattcacagcaagtcacaggcggggtccacacccctcacacgggagaatagcaccttttccattaatgatgccgcgtctcataccagcaccatgtcgtctaggcactccgcctctcccgtggtgttcacctctgctcggtcctcccctaaagaggagttgcaccctgccgctccaagtcagctggccccgagcttctcttcgagcagcagttcatcctctggcccccgcagcttttaccccaggcagggtgccaccagtaagtatctcattggttggaaaaagcccgaaggtactattaactccgtgggctttatggacacacgcaagcgccaccagtcagatggcaacgaaatcgcccacacccgattacgtgccagtacccgagaccttagagcgtcgcctaaacccacaagcaagtctacaattgaggaagatctgaagaagctaattgatctggagtccccaaccccggaatcacaaaagtcctttaagttccatgcgctgtcatccccgcagtctccctttcccagtacacccacatctagaagagctctccaccggaccctgtccgatgagtccatttataacagccagagagaacacttctttaccagccgtgctagcttactggaccaagcgctccccaatgatgtgctcttcagcagcacctatcccagcctgccgaaaagtctccccttgaggagaccatcctataccctggggatgaagagtctgcacggcgaattctcagcaagcgatagcagtctcactgatattcaagagacaagaagacaaccgatgccagatccaggcctgatgcctcttccagatacagcggccgatttagactggagtaacctcgtggacgcggccaaggcctacgaggtgcagagagctagtttcttcgcagcgagtgatgagaatcatcggcccctgagcgccgcttctaattccgatcagctcgaagaccaagcattagcgcagatgaaaccctatagctcctcaaaagactcttcaccgaccctggccagcaaagtggatcaattagagggtatgctgaaaatgctgcgcgaagaccttaaaaaagagaaggaggataaggcccacctgcaagctgaagtccagcacctgcgggaggacaatcttcgactccaagaggagtcccagaacgcgagtgacaagctcaaaaaatttaccgaatgggtatttaatactatagatatgtcctag

SEQ ID NO: 30048 - DNA, 3774 bp, Artificial Sequence
  Description of Artificial Sequence: Synthetic coding sequence
atgaaggaaaatggtagcccctataattacagaatcatcttccggacctctgaactcatgactctacgtggatcagtcctggaagacgccatacccagcacggcgaaacacagtacagcccgcggtctgcccctgaaggaggtactagaacatgtggtgcccgagctgaacgtgcaatgcttgcggctggccttcaataccccaaaggtcaccgagcagctgatgaaactggacgaacaaggtctgaattaccaacagaaggtgggcattatgtactgtaaggctggccaaagcacagaggaggaaatgtacaacaacgagagcgccggtcctgccttcgaggagttcttgcagcttctcggagaaagagtgaggttgaaggggtttgaaaagtatcgggcccaactggatacgaagactgatagcaccggaacccatagcttgtataccacgtataaagattacgagatcatgtttcacgtgtctaccatgctgccatacacgcccaacaacaagcagcaactcctgcgcaagagacacattgggaacgatatcgtgacaattgtgtttcaagagccaggcgcacagccgttttctcctaagaacatcagatcccacttccaacatgtcttcgtgatagtacgggtgcataatccatgtagtgactcagtgtgttatagcgtcgcagttacaaggtccagagatgtcccatcttttggacctccaatcccaaaaggggtcacattcccaaaatccaatgtttttcgcgactttctgctggccaaagttattaacgctgaaaatgctgcacataagtcggaaaaatttagagcaatggcgacgcggactagacaggaatacttgaaggacttagctgagaaaaacgtgacgaacacgcctattgacccgtccgggaaattcccattcatctcattggcctcaaagaagaaagaaaaatccaagccgtatcctggggctgagctgtcttctatgggggcgatcgtgtgggccgtgcgcgcagaagactataacaaagctatggaattagattgcttgctcggaatatcaaacgaattcatcgtcctgattgaacaggaaacgaaatccgtggtcttcaattgttcgtgtagagacgtgatcggatggactagtaccgacacatcactgaagatcttttacgagagaggcgaatgtgtgtccgtgggaagttttattaatattgaagaaattaaagaaattgtgaagcgactccagttcgtcagcaaggggtgtgagagtgtggagatgactctgcggagaaacgggcttggacagctgggctttcatgtcaattacgagggtattgtcgccgacgtggaaccttatggttacgcatggcaggccggactgaggcagggatccagattggttgaaatatgtaaggtggccgtggccaccctcagtcacgaacagatgatcgatctgctccgaacgtctgtgaccgtgaaagtggtgattattcccccccacgatgactgcacccctaggcgtagctgtagcgaaacttatcgaatgcctgtcatggaatataagatgaacgagggagtgtcttacgaattcaagtttcccttccgcaacaataataagtggcagaggaacgcatcgaagggtcctcactctccgcaggtcccatcacaggtgcagtccccaatgacaagtcgcctcaatgcaggcaagggagacggcaaaatgcctccgccagaaagagctgccaacatccccaggtccatctcttcagatggcaggccgcttgaacggcgcctgtccccagggagcgatatctatgtgacggtctctagtatggccctggcgcgcagtcagtgtaggaacagcccaagcaatctctcctcttccagcgatactggttcagtgggtgggacttaccgccaaaaaagcatgcctgaggggtttggggtttccagacgcagtcctgccagtatcgacaggcagaatacccagtccgacatcggtggctcaggcaaaagcaccccatcctggcagaggtcagaagatagtattgctgaccagatggagcctacctgccatttacctgccgttagcaaagtgctcccagctttccgcgaatcaccctcagggcgactaatgcgccaggacccagtagtgcacctctccccgaacaagcaggggcatagtgattctcattacagttcccactcatcatcaaatactttatcaagtaatgccagttccgcccactccgacgagaagtggtatgacggggatagaactgagtccgagctcaacagttacaattatcttcaagggaccagcgccgattccggcattgacactacttcctatggcccatctcatgggtcaaccgctagtcttggagctgccacttcttctccacggagtgggcctgggaaggagaaagttgcaccattgtggcattccagcagcgaggtaatcagcatggctgacagaacgttggagaccgaatcacacggtttggatagaaaaacagaatctagcctgtctctcgacattcatagcaagagccaggcaggatccacccccttaacacgcgagaattcaaccttctctattaacgacgcagcgtcacacacaagcaccatgtcaagtagacactccgcctcccctgtggtgttcacgtccgcccgctcctcccccaaagaggagttacatccagcggcaccatctcagctggctccctcctttagttcaagctcaagttcctctagtgggccacggagtttctatcctaggcagggggccactagcaagtacctgatcgggtggaagaagccggaggggacaatcaactctgtcggtttcatggacaccagaaaaaggcatcagagcgatggtaatgaaatcgcgcacacgcggctgagagctagcacacgcgatctgagagcaagccccaaacctaccagcaagagcactattgaggaggatctcaagaagctgatagatctcgaaagtccaacccccgagtctcagaaatctttcaaattccacgcattgtccagccctcagagccccttcccaagcactcccacatcccggcgagccctccacagaaccttgtccgacgaatccatctataattcccaaagggagcatttttttacctcgcgagctagcctgttagatcaagcattacctaatgatgtcctcttcagcagcacatacccttccctgcccaagtcattgcccctccggcgtcctagctatactctgggcatgaaatccctccacggggagttctccgcatccgacagttcactgaccgacatccaggagacacggcggcagccgatgcccgatcccggcctcatgcccctgcctgataccgcggcagacctcgattggagtaatctggtggatgccgcaaaggcctacgaggtgcagagagcctcatttttcgccgccagcgacgaaaaccatagaccattgagcgcagccagcaactccgaccagctcgaagaccaagcacttgcccaaatgaagccctattcttcaaaggattcctctccgacactcgccagcaaggtggatcaattggaaggtatgctcaaaatgcttcgggaagaccttaagaaagaaaaagaagataaggcccaccttcaagccgaagtgcagcacttgcgcgaggataacttaagactgcaggaggagagccagaatgcatcagacaagttgaagaaattcaccgagtgggtcttcaatacgattgatatgtcatag

SEQ ID NO: 30049 - DNA, 5415 bp, Artificial Sequence
  Description of Artificial Sequence: Synthetic coding sequence
atgacttcgcttaaacgctcccagacagaacgtccgctggccactgatagggcctcagttgtgggcacggatggaacacccaaggttcacacagatgatttttacatgcgcaggttccgttcccagaacggatcattgggcagttcagttatggcccccgtggggcctcctaggtctgagggatcacatcacattacgtccactcccggggtacccaagatgggcgtcagggcccgaatcgccgattggcccccgagaaaagaaaatatcaaggaatcatctaggtcatcgcaggaaatcgaaacatcgagctgcctagactctctgtcaagtaagtctagtccggtgtcacaggggagttcagtgagcttaaattccaatgactccgcgatgttaaaatctatccagaataccttgaagaataagaccagaccctctgagaatatggacagtaggttcctaatgccagaggcttatccatcgagtcctaggaaggccttacgcagaattcgccagcggtcaaactccgacatcaccatcagtgaactggacgtggactcctttgacgagtgtattagtcctacttacaagacaggtccctccctccacagggaatatgggtctacatctagtatcgataagcaggggacatcaggtgaaagtttcttcgacctgctcaagggctacaaggacgataaatccgacaggggcccgacccctacaaagctttctgattttctcatcacgggcgggggcaaaggcagtggcttttcactcgacgtcatcgacggacctatctctcagagggagaaccttagactgttcaaagagcgggagaaacctctgaagcgcagaagtaaatctgagactggcgattcgtccatctttcgtaagttgcggaacgccaagggagaagagcttgggaaatccagcgatctcgaggacaaccggtccgaggattctgtgaggccctggacatgtcctaagtgtttcgcgcactatgacgtccaaagtatacttttcgatttgaacgaggccatcatgaaccgccacaacgtcataaaacgccgcaataccactactggggcttcggccgccgccgtggcgtcgctcgtaagcggccccttgtcccatagcgcgtcattttcttcacctatggggagcaccgaggacttaaactcaaaaggtagtctgtctatggaccagggggatgataagtcgaatgaactggttatgtcatgcccctattttagaaatgaaataggaggcgagggtgaaagaaaaatcagcctgtccaagtcgaatagtggcagcttctccgggtgcgagtctgcctcattcgaaagcaccctcagctcccattgtactaacgcgggagtggccgtgctggaagtgcccaaagagaacctggtgctgcatctcgatcgggtaaagagatacatcgttgagcacgtggacttaggcgcctattattaccgcaagtttttttatcagaaggagcactggaattatttcggagcagatgagaatttaggaccagtggctgtgagtattcgccgtgaaaagcccgacgaaatgaaagagaacgggtcaccatacaattataggatcatcttcagaacttccgaactgatgaccttacgcggctcggtgctagaggatgcaattccaagtacagccaagcattctacggctagggggttacccctgaaggaggtgttggagcacgtggtcccggagctgaacgtccagtgcttgcgcctggcctttaacacacctaaagttactgaacaactgatgaagcttgatgagcaaggcctaaattatcagcagaaagttgggatcatgtattgcaaagcaggccagagtactgaggaggagatgtataataatgaatccgcagggccagcctttgaggaattcctgcagctcctcggagaacgggtgagattaaagggcttcgagaaatacagagctcagctggacaccaagaccgacagtaccggtacacactcactgtatacaacgtataaagactacgagatcatgtttcacgtcagcacgatgctcccatatacgcctaataacaaacagcagctgctgcggaagagacacatcggcaacgatatcgtcactattgttttccaagagccgggagcgcagcccttctcaccaaaaaacattcggagccacttccaacatgtgtttgtaatcgtcagggttcacaacccttgctctgactctgtatgttattctgttgcagtaactaggtcacgggatgtgccttccttcgggcccccaatcccaaagggggtgacatttcccaaatccaatgtgttcagagatttcctcctggcgaaagtgataaatgccgagaacgccgcacacaaaagtgaaaagtttagggccatggcaaccagaacccgtcaggaatacctgaaagatctggctgagaaaaatgtgaccaacactcctattgatccctccggtaaattcccatttatttccctagcttctaaaaaaaaagaaaaaagcaagccgtatccaggcgcagaattaagctccatgggagccattgtgtgggctgttcgcgcagaagactacaacaaagccatggagctggattgcctgctggggatctccaacgagtttatcgtgttaatagaacaggaaacaaagtctgtggttttcaactgttcctgtagggatgtgattggatggacatcaaccgacacttctctcaaaatcttctatgaacgcggcgagtgtgtcagcgtgggcagttttatcaacatcgaagaaatcaaagaaattgtgaagaggttacagttcgttagtaagggctgcgaaagcgtggagatgaccttgcgaagaaatggattgggtcaactcggatttcatgtgaactatgaaggcatcgtagcagatgtggagccttacgggtatgcatggcaagccggccttcgtcagggaagtcgcttagttgagatatgcaaagtcgctgtcgcgacactatcccacgagcaaatgattgacctgctacggacaagcgtaactgtgaaggtggtgatcattcctccgcacgatgactgtacgcccaggagaagctgcagcgagacttatcggatgcctgttatggagtacaaaatgaacgagggagtatcgtacgagtttaaattcccgttcagaaataataataagtggcagaggaacgcgtcaaaagggccccactcgcctcaggtgccaagtcaggtgcaaagccctatgacctcacggctaaacgcagggaagggggatggtaaaatgcccccccctgagagggctgccaatattccccgctctataagcagtgatggccggccactcgaacggcggttgagtcccggttccgatatctacgtgaccgtcagttccatggcactggcaaggagtcaatgtcgaaactcaccttctaacttgagttcctcctctgacacagggtcggtagggggaacttatcgtcagaagagcatgcccgaaggattcggcgtgagtcgcaggtctccagcatccattgaccgccagaacacccaaagcgacattggaggtagcgggaaatccaccccctcctggcagcgatctgaggatagtattgccgatcagatggcctatagctaccggggaccacaggactttaacagtttcgtcctcgaacagcatgagtatacagaacccacctgccacctccctgctgttagcaaagtgctccctgcctttcgggagagtcctagtggaaggctgatgaggcaagatcctgtggtgcatttgtccccaaataagcagggacactccgacagccactatagtagtcactcgagttccaatactctgagctcaaacgccagtagtgcacacagcgacgagaaatggtacgacggggaccgaaccgagtcagagttgaactcttacaactacctgcagggaacctcagctgacagcggcattgatactacaagctacgggccatctcatggaagcacggcatcactcggagcagctacctcctcccctagatccggaccagggaaggagaaggtagcacctctatggcattcttcgtctgaagtaatctctatggctgatcgaaccttagaaacggagtcccatggactggacaggaagacagaatcttctttgtctctggatattcattcgaagtctcaagccgggagcacacctctaactcgcgagaattcaacgttctcaattaatgacgctgcatctcacacctccacaatgagtagccggcatagcgcctcaccggtagtttttacctcagcacggagtagcccaaaggaagaattacatcctgcagccccctctcagctggctccttctttctcctcctcatccagctcctccagcggtccaagaagcttttacccccgacaaggagctacatcaaaatacctgatcgggtggaaaaaacctgaaggtaccataaacagtgtcggattcatggacacgcgcaaacgccaccagtctgacggcaatgagatcgcacacacccggctgcgggcttctacacgtgacctgagggccagcccaaagccgacttctaagagcacaatcgaagaagatctcaaaaagctgatcgatttagagtcacctacaccggagagccaaaaaagcttcaagtttcacgccctctcctctcctcaatctcccttcccatcgactcctacctcccgtagggctctgcaccgcactttaagtgacgagtcaatttataacagccagcgggagcacttcttcacgtcccgcgcctcactgcttgaccaggcactcccaaacgatgtcttgttctccagcacatacccatctttgccaaaaagcctgccccttcgtaggccatcctatactctggggatgaaaagccttcacggggagttctcagctagtgattcctctctgactgacattcaggagacgagacgtcagcccatgcccgaccctggactgatgccactccccgataccgctgctgatttggattggtctaatctggtggacgcagccaaagcctatgaggtgcagagagcctcttttttcgccgccagtgatgaaaatcataggcccctatcagccgcctccaattctgaccagcttgaggatcaggccctggcccagatgaagccttactctagtagcaaggacagctccccgaccctggcttccaaggtcgaccaactcgagggcatgttaaagatgctgagggaggaccttaaaaaggaaaaagaagacaaggcccatctgcaagcagaggtccagcacctgagggaagataatcttagattgcaggaggagagtcaaaatgcctccgataagctgaagaaatttaccgagtgggtcttcaacacaatcgacatgagctag

SEQ ID NO: 30050 - DNA, 591 bp, Artificial Sequence
  Description of Artificial Sequence: Synthetic coding sequence
atgaatcaggctgatcctcgactccgcgcagtgtgtctttggacacttacttctgcagcaatgagcagaggcgataactgcactgatctccttgcacttgggatacccagcatcacacaggcttgggggctgtgggtactacttggtgctgtcacgctcctattcctgatctctctcgctgcccatctgtctcagtggactcgggggcggagccgaagtcaccctggccagggcaggtccggggaaagtgtggaagaggtccctctctacggcaacctgcactatttgcagaccggcaggcttagtcaggatccagagccagatcagcaggatccaacattgggtggtcccgctcgcgccgccgaagaagtgatgtgttataccagtctgcagctgcggccaccccagggtagaattcctggtcctgggacaccagtcaaatattcggaggttgttctggattctgagccgaaaagccaagccagtggtcccgagcctgaactctacgcatccgtgtgtgctcagacacggcgcgcacgggccagcttcccagatcaggcatacgccaatagccagccagcagcaagttag

SEQ ID NO: 30051 - DNA, 1515 bp, Artificial Sequence
  Description of Artificial Sequence: Synthetic coding sequence
atggagcctgccggtccggctcccggtcggcttggtccgctgctctgtttgcttctggcagcctcctgtgcctggtccggggtggccggcgaagaggaactccaggtgatccagcccgacaaatctgtcctggtcgccgcgggggagacagctactctccgctgtacagccaccagcctaattcccgtcggtcccattcagtggtttagaggcgcaggcccaggcagggagctcatatacaaccagaaggaaggacacttcccaagggttactaccgtgtcagacctcacaaaaaggaataatatggacttctccatccgaatcgggaatattacgcccgccgacgccggtacctactactgtgtcaaatttcggaaaggatctcccgacgatgtagagtttaagtcaggagcaggaactgagctgagcgtgcgtgcaaaaccgagcgcccccgtggtctccgggccggccgcccgagccaccccccaacacaccgtgagcttcacatgcgagagtcacggctttagtccccgcgatatcacgctgaaatggtttaagaatggcaatgaattgtctgactttcagaccaatgtggacccggtgggagaaagcgtttcttactccatacatagtactgcaaaagtagtgctgactagagaggatgtgcactcgcaggtgatctgtgaggtggcccacgtcaccttgcagggtgaccctttgagaggcaccgccaatttaagtgagacaatacgggtaccccctacattggaagtcactcagcagcccgtccgtgcggagaatcaggtcaatgtgacgtgtcaggtcagaaaattttacccacagcgactccagctgacgtggctggaaaacggcaacgtgtccaggaccgaaactgcttctacggtgaccgaaaataaagatggaacttacaattggatgagctggttacttgtcaacgtgagcgcccacagagatgatgttaagcttacctgccaggtggagcatgatggacagccagctgttagtaaatcccatgacctaaaagtctcagcccaccccaaagagcaagggtctaacactgcagccgagaacaccgggagcaatgaacgcaatatctatatcgtcgtgggggtcgtatgtaccctccttgtggctctattaatggccgccctgtatctggtgcgcatccgccagaagaaggcccaaggctcaacctcctcaacaagattgcacgagcccgagaagaacgcccgggaaatcacccaggataccaacgatattacctatgccgatctgaacctacctaaaggcaagaaacctgcccctcaggccgccgagccaaacaaccatacagagtacgcttcaattcagacgtcaccacaaccagcttctgaagacaccttgacatatgccgacttggatatggtacacctaaataggacaccgaagcagccagctcctaaacccgagcctagcttttctgaatatgcgtcggttcaggtaccacgcaaatag

SEQ ID NO: 30052 - DNA, 1515 bp, Artificial Sequence
  Description of Artificial Sequence: Synthetic coding sequence
atggaacctgctggaccggcaccggggcgcctcggacccctgttatgcctgctccttgccgcttcttgcgcctggagtggcgtggctggagaggaagaactccaggtgattcagccagacaaaagcgtgctggtggctgccggcgaaactgctaccctcagatgcactgcgacttcccttatacctgtcggtcctattcagtggttcaggggggccggccccggtagggaactgatctacaatcagaaagagggtcacttccctcgggttacaaccgtttctgatctcacgaagagaaacaacatggattttagtatccgcattggaaacattacgccggcggacgcaggtacatattattgcgtgaagttcagaaagggcagtccagatgatgtggaattcaaaagcggcgccggtacagaactgtcagtgcgagccaaaccgagtgctccagtcgtcagcgggcctgctgccagagccactccgcaacatactgtcagtttcacctgtgagtcacatggtttttccccccgggacataactctcaagtggttcaagaatggaaacgaattgtccgatttccagacaaatgtcgatcccgtgggtgagagcgtctcctacagcatccactccacagcaaaagtggtcctcaccagagaggatgttcacagccaagtgatctgtgaggtagctcacgtcaccttgcagggtgatcccctccggggaactgcaaatctttcagaaactatccgagtgccaccaaccttggaggtcacacagcagcctgtgagagccgaaaaccaggttaacgtaacatgtcaggtgcgcaagttttatccgcagcggctgcagttaacttggctggaaaatgggaacgtgtcacggaccgagacggcctctacggttacagagaataaggatgggacttataattggatgtcttggttgctcgtaaatgtgtctgcccaccgggacgacgtgaagttaacttgtcaggtcgagcacgacggacagcctgccgtttcaaagagccacgatcttaaagtgagcgctcaccctaaggagcagggctccaatactgctgcagaaaacaccggttcaaacgaaagaaacatctacatagtggtgggtgttgtctgtactcttctcgtcgctctcttaatggcggctctgtatttggtcagaatcagacagaagaaagctcagggcagcacatcttctacccggctgcacgagccggagaaaaacgcccgagaaataacgcaggacacgaatgatattacatacgccgatctgaatctgccaaagggtaagaaacccgcccctcaagccgccgagccaaacaaccatacggagtacgcctccatccagactagtccccaaccggcctccgaggatactttaacatacgccgatctcgatatggtgcatctcaataggacacctaaacaaccagctccgaaaccagagccttctttttcggaatacgcctctgttcaggtgcccagaaagtag

SEQ ID NO: 30053 - DNA, 1527 bp, Artificial Sequence
  Description of Artificial Sequence: Synthetic coding sequence
atggaacccgctggccctgcacctggccgactgggccctttgctctgcctgctgctagccgcaagttgcgcttggtccggcgtcgccggcgaggaggaactccaagtcattcagcctgataagtccgtgctggtagccgccggcgagacagcaacgctgaggtgcactgctacctccttaattcccgtggggcccatccagtggtttagaggtgcagggcccggccgcgaacttatctataaccagaaagaggggcattttcccagagtaacaacggttagcgaccttacaaagcgcaataatatggattttagcatccgtattgggaatataacgccagccgatgctggaacctactactgcgtgaaattcagaaaaggtagtccagatgatgtggaatttaaatcaggcgcaggcactgagctgagcgttcgtgcaaaaccctcagcacctgtggttagcggacccgcagcgcgggccaccccacagcataccgtgtctttcacgtgcgaatcgcatggcttctctccccgggatatcacccttaagtggttcaagaacggaaatgagctgtctgactttcagacgaacgtcgacccagtgggcgagtctgttagctactcgattcacagtaccgctaaggtggttttgacaagggaagatgtgcacagtcaggtgatctgcgaggtcgcacacgtgacacttcagggggacccgctccggggcacagccaaccttagcgagaccattagggtgccccccacgctcgaggtgacacagcagccggtcagagccgagaaccaagtaaatgtgacatgccaagtccggaaattttatccccagcggctgcagctgacatggctagagaacggcaacgtctcccgaaccgaaaccgcatccactgttacggagaataaggacgggacttataactggatgagctggctgttggtgaacgtgtccgctcaccgagacgatgttaaattaacttgccaggtggagcatgacggccagcccgctgtttctaagtcacatgacctgaaagtcagcgctcatcctaaggagcagggcagtaatactgctgccgaaaatacagggtcaaacgaacgtaatatctatatcgtggtgggtgtcgtctgcaccctgctggtggctctactgatggcagccctatacctggtccgtatcaggcagaagaaagcccagggctcaacctctagtacgaggcttcacgaacctgaaaaaaacgctagagaaatcacccaggtgcagtcgctggacactaatgacatcacttatgccgatttgaacctgcctaaagggaagaagccggcaccacaggcggcagagcccaacaaccacacagagtacgcatctatacaaacttcccctcaacctgccagtgaggatacccttacatacgcggacctggacatggtccatctcaacaggactccaaaacagcccgcccccaagccggaaccttcattttccgaatatgcctcagtgcaggtaccacgtaagtag

SEQ ID NO: 30054 - DNA, 543 bp, Artificial Sequence
  Description of Artificial Sequence: Synthetic coding sequence
atgcctgtgccggcgagctggccccacccaccatgccctttcctgctcctcacactgttactgggactgaccggagttgccggagaggatgaactccaggtaatccagcccgaaaaatctgtctccgtggctgctggcgagtccgccactttgaggtgtgcaatgacatccttgatccctgtcggcccaatcatgtggttcaggggagctggagcggggagagaactgatttacaatcagaaagagggacatttcccgcgcgtgacgacggtttccgaactcaccaaacgaaacaacctcgacttcagcatcagcatcagcaatattacacctgccgacgccggtacctactactgcgtcaagtttagaaaggggtcacctgatgatgttgagtttaaatctggagcgggcaccgagctttcagttagagaggccgccctggcaccaacggcccccctattggttgccctgctgctaggtccgaaattattgcttgtggtgggagtgagcgccatctatatctgctggaagcagaaggcgtag

SEQ ID NO: 30055 - DNA, 1197 bp, Artificial Sequence
  Description of Artificial Sequence: Synthetic coding sequence
atgccagtgcctgcctcctggccccacctcccaagtcccttcctcctcatgactctactgctaggacgtctgacgggtgtcgcgggtgaagaggagttgcaggtgatacaacctgacaaaagcatctcagtggccgccggagaatctgcaacactacactgtaccgttacaagtctcattcctgtcggacccatacaatggtttcgcggggccggcccaggacgagaactcatttataatcagaaagagggccactttccgcgggtgacaactgtttccgatttaaccaagaggaacaacatggacttcagcattagaatcagcaatattacaccagcagatgctgggacatactattgtgtgaaattccgtaagggaagccctgaccatgtggagttcaagtccggggccggaacagaactgtcagtgcgggcaaagccaagcgcccctgtggtgtcaggccccgccgccagagctacaccccagcacactgtgagcttcacctgcgagagtcacggtttttctccaagagacattaccctgaaatggttcaaaaatggcaatgaactgtcagattttcagacaaacgtggatcccgccggtgactctgtcagctactccatccattcgaccgccaaggtggtgctgacccgagaagacgtgcactcccaggtgatctgcgaagtggcccacgtgaccctccagggcgatccgcttcggggcaccgccaatctttcagagaccatcagagtccccccaaccttagaagtgacccagcagccagttagagcagagaatcaggtcaacgttacctgccaagtacggaaattctacccacagcggctccaattaacatggctggaaaacggaaacgtttctagaacagagacagctagtacactgactgaaaataaggacggaacatacaactggatgagttggttgcttgtcaatgtgtccgcacatcgtgacgatgtgaagctcacgtgccaggttgaacacgatggtcagccagctgtgagcaagagccacgacctgaaggtcagcgcccatcccaaagaacaaggaagtaacactgcccccgggccggcactggcctccgctgcgcccctcttgatcgctttccttcttggacctaaggttttgctggtggttggcgtctctgttatttacgtctactggaaacagaaggcatag

SEQ ID NO: 30056 - DNA, 519 bp, Artificial Sequence
  Description of Artificial Sequence: Synthetic coding sequence
atgcccgttcccgcttcctggccccatctcccttccccctttttgctaatgacacttctcctggggcgtttgacaggtgtcgctggcgaggaggaactgcaggtgatacagcctgacaaaagcattagtgtagctgctggagaatccgcaaccctgcactgtaccgtgacatctttgattcctgtgggaccaatccagtggtttaggggggcaggaccgggccgagaattgatttataaccaaaaggagggccattttcccagggtcaccacagtgtccgaccttaccaagcgaaacaacatggacttttcaattcggatttctaatattactccagccgacgcgggaacgtactactgcgttaagttccgtaagggtagtcccgatcatgttgagttcaagagcggagcaggaacagagctgtcagttcgcgtcttgcaagtgaaagaaattaagatccctcgtactttggcctccgtggtgatccaggtgtatctgctgcagcatcccgtggcctag

SEQ ID NO: 30057 - DNA, 546 bp, Artificial Sequence
  Description of Artificial Sequence: Synthetic coding sequence
atgccagtccccgctagctggcctcacctgccatctcccttccttctcatgaccttgcttcttggacgactgaccggcgtagcaggggaggatgagctgcaggtaattcaaccagaaaagagtgtgagtgtggcggccggagaatcggcgaccttgcgctgcgccatgacaagtctgattccagtaggaccaattatgtggtttaggggggctggggcgggtcgcgagctgatatacaaccaaaaagaaggccactttccacgtgtaactactgtgtcagagctaaccaagagaaacaatctagattttagtatctcgatcagcaatatcacgcctgcagatgctgggacctactactgcgttaaatttcggaagggctcacctgatgacgtggaattcaaaagtggcgcgggcaccgaacttagtgtgcgagaagccgccctggccccgaccgctccccttctagtggcattactccttggccctaagctgctgttggtcgtgggcgtaagcgcgatatacatatgttggaagcagaaagcttag

SEQ ID NO: 30058 - DNA, 1197 bp, Artificial Sequence
  Description of Artificial Sequence: Synthetic coding sequence
atgccagtcccagcctcttggccgcacttacccagcccatttctgctgatgacgcttttactgggacggctcaccggcgtagccggagaagacgagctgcaggtcatccagcctgagaagtctgtcagcgtggcggcaggggagtctgctacgttacggtgtgccatgacaagcctgatccctgtaggccccatcatgtggttccgaggagccggcgcaggtagggaactgatctataatcagaaagagggacactttcctcgcgtgacaaccgtcagtgaactgactaaaagaaacaatcttgacttttccattagcatctccaatatcacccccgcagatgctgggacctactactgcgtgaagttccggaaaggctcgccagacgacgttgagttcaaatctggagccggaacagaactctccgttagagcaaagccatcagccccggtggtgagcggtcccgcagtgcgcgctacacctgagcatactgtgagcttcacatgcgagtcacatgggttttctccgagggacattaccttgaagtggttcaaaaacggcaacgaactgtcagactttcagaccaatgtggatcctgctggcgactccgtgagttatagcatccatagtaccgccagggtggtactgacccgcggggacgtgcacagtcaggtgatctgcgaaatcgcccatataactctccagggtgaccctcttaggggcaccgccaatctgagcgaagctatacgcgtgcccccaaccctcgaggttacccaacagcctatgagggcagaaaaccaggcaaacgtgacatgtcaggtttccaacttctatccacgaggcttacagctcacttggttggagaatggcaacgttagtagaaccgagactgcgtccaccttaattgagaataaggatggcacctataattggatgtcttggttgttggtcaatacgtgtgcacatagagatgatgtggtgcttacctgccaggtagagcatgacggccaacaggcggtgtccaaatcgtatgccttggagatcagcgcgcaccagaaagagcacgggagcgatatcacccacgaggctgcgctggccccaacagcccccctgcttgtagctctgctccttggcccaaagctgctactggtggtgggagtatctgctatctacatttgttggaagcagaaagcgtag

SEQ ID NO: 30059 - DNA, 519 bp, Artificial Sequence
  Description of Artificial Sequence: Synthetic coding sequence
atgctggccgctggtgtgggcggccagggagaaaggttggcaggtcggagacggaagatggcggttgagagtagagtgactcaggaagagatcaagaaagagccagagaagcccattgatagagaaaagacctgtccactgctgctccgtgtgtttacaacgaacaacgggcggcatcatcgtatggacgaattctctagaggaaacgtgccctcttccgagctgcaaatctacacttggatggatgcaaccctcaaagaactaacatctctggttaaagaggtgtatcccgaggcacgaaaaaagggtacacacttcaacttcgccattgtctttaccgacgtgaaacgtccggggtatcgggtgaaagagataggatcgacaatgagtgggcgaaaaggtacagatgattcaatgacgcttcagagtcagaaattccagatcggggattacctcgatattgctatcacgccacccaacagagctccgccaccatcaggacggatgcgcccctactag

SEQ ID NO: 30060 - DNA, 1020 bp, Artificial Sequence
  Description of Artificial Sequence: Synthetic coding sequence
atggagagcagaaaggacattacgaatcaggaggagctgtggaaaatgaagccccgccgcaacctggaggaggacgattacttgcataaggatactggagagacatcaatgttgaaacgtcctgtgttactccacctgcatcagactgctcacgctgacgagtttgactgtccaagtgaactgcagcatactcaggagctgtttccccagtggcacttgccaattaagatcgccgcaattatcgcatccctgacctttctttacaccctcctgcgagaagttattcatcctctggcgacaagccatcaacagtatttttataagatacccattctggtaattaacaaggtccttcccatggtaagtatcacacttctggccttggtgtacctgcccggagtgatcgccgccatcgtgcagctccacaatgggaccaagtataagaagtttcctcattggttggataaatggatgctgacaaggaaacagtttggcttgctgtcattcttcttcgctgtcctccacgctatatacagccttagttacccaatgcgtcgttcatatcgttacaagcttctgaattgggcttatcagcaggtccagcaaaataaggaggatgcatggatagagcatgacgtttggcggatggaaatctacgtgtctctcggtattgtgggcttggcaattctagcgctgctggccgtgacctccatcccctccgtttcagacagcctgacttggcgcgagttccattatatccagtccaaactgggcattgtgagtctcctgcttggtactatccacgcgctcatatttgcttggaacaaatggatcgacatcaaacagttcgtgtggtacacccctcctaccttcatgatcgctgtcttcctgccaatcgtggtcctcatctttaaaagcatcttgtttctgccgtgcctccgaaaaaagattctgaaaattaggcacggctgggaggacgtgaccaaaataaacaaaacagagatttgctcccaactctag

SEQ ID NO: 30061 - DNA, 597 bp, Artificial Sequence
  Description of Artificial Sequence: Synthetic coding sequence
atgtgtgctttcccgtggctgcttctgctgctgctccttcaggagggctcccaacggagactttggcgctggtgcggcagcgaggaagtggtggccgtgttgcaggaatctatcagtctaccactcgagataccacccgatgaggaagtcgagaatatcatctggagcagtcacaagtcgttggccaccgtggtgcccgggaaggagggccaccctgcgaccatcatggtgaccaacccccactaccagggacaggtgagtttcctggatccctcctactcgttgcatatttctaatttgtcatgggaagactcaggcctgtatcaggcccaggtcaacttgcgcacctcacagatctccacgatgcagcagtataacatttgtgtgtatcatcccaactacgccagcgaaaaacctagcacagccttttgcctcctcgccaaaggtttgctgatttttcttctgctcgtcatcttagccatgggcttatgggtgatccgcgtacagaaaagacacaagatgccccgcatgaaaaagctcatgcggaacaggatgaaattacgcaaagaagcaaagccaggcagctctcccgcctag

SEQ ID NO: 30062 - DNA, 870 bp, Artificial Sequence
  Description of Artificial Sequence: Synthetic coding sequence
atgtgtgccttcccctggctcctcctcctcctcctactccaggagggctcccagcggaggctgtggaggtggtgtggatcagaggaggtcgtggcggtgctgcaggaaagcatatccctgccacttgagatcccacccgacgaagaagtggagaacatcatctggagctctcataagagtctggcaaccgtagtccctgggaaagaaggccaccctgccacaataatggtgacaaatcctcattatcagggccaggtttcctttcttgatccatcctactcactccacatctccaacttgtcctgggaggatagcgggctttatcaagcgcaagtgaacttaagaacttcacagattagcacgatgcaacagtataacatctgcgtttacaggtggcttagcgagcctcaaatcaccgtgaatttcgagagctcaggtgagggcgcctgctctatgagcttggtgtgctcagttgaaaaagcaggaatggatatgacctacagctggctgtcccgaggagattcgacatatactttccatgaaggccctgtccttagtaccagctggcgacccggcgattctgccctttcatatacttgtcgcgccaataaccccatatcaaatgtgagttcttgcccaatacccgacggtccgttttatgcagaccctaactacgccagtgagaagccatcaaccgcattctgtctgctcgcgaaagggctactgattttcctcctgcttgtgatactcgcaatggggctgtgggtaattcgggtgcaaaaaagacataaaatgcccagaatgaagaagcttatgcggaataggatgaagctacgtaaggaggcaaagcccggctctagccctgcctag

SEQ ID NO: 30063 - DNA, 519 bp, Artificial Sequence
  Description of Artificial Sequence: Synthetic coding sequence
atgaagatctggtccagcgagcacgtgttcggtcatccatgggataccgtcattcaggccgctatgagaaaatatcctaaccctatgaatccctctgtcctgggagtcgacgtcctgcagcgccgcgtggatggaagagggaggctccactctcttcgccttctaagcacggagtggggactgccatcactcgtacgagccatcctaggcacatctaggacattgacatacatccgggagcatagcgtagtggacccggtggagaagaagatggagctgtgcagcacgaatattactctgaccaatcttgtcagtgtgaatgagaggctcgtgtacaccccccatcccgagaatcctgagatgacagtcctgacgcaggaagctatcattacggtgaagggaatcagtttgggatcctatctggagagtctaatggccaacacaatatccagtaacgccaaaaagggatgggctgcgattgagtggatcatcgagcacagcgagagcgcagtgtcttag

SEQ ID NO: 30064 - DNA, 519 bp, Artificial Sequence
  Description of Artificial Sequence: Synthetic coding sequence
atgaagatctggtcaagtgaacatgtgtttggacacccctgggataccgtgattcaggcggcgatgcggaagtatccaaatcctatgaacccttctgtgcttggcgtcgacgtacttcagaggagggtggacggccgaggaagacttcactctctgcggttgctttcaaccgagtggggactgcccagtctcgtcagggccatacttggaaccagcaggacgttgacctatatcagagaacactcagtggtggatcccgtggagaagaagatggaactctgttccaccaatatcaccctcaccaaccttgtgagcgtgaacgaacggctggtgtacacccctcatcccgaaaatcccgagatgaccgtactgactcaagaggcaataattaccgtgaaaggaatatcgctcgggtcctacctggaaagccttatggctaacactatttcctctaatgccaagaaggggtgggctgctatcgagtggattattgaacattctgaatcggctgttagttag

SEQ ID NO: 30065 - DNA, 585 bp, Artificial Sequence
  Description of Artificial Sequence: Synthetic coding sequence
atgaagatctggacttccgaacatgttttcgaccatccatgggaaactgtcacgacggctgcaatgcagaagtacccgaacccgatgaatccatcagtcgtgggagttgatgtgctggatcggcacatcgacccatcgggaaagctgcattctcatcggctgctgtcaacagaatggggactccccagcattgtgaagagtctcatcggagcagcacgtactaaaacctatgtccaagaacacagcgtcgtcgacccggtcgaaaaaaccatggagttgaagtccaccaacataagcttcactaatatggtgtcagtcgacgagcgcttaatctacaagccacaccctcaggatcctgagaagaccgtgctgactcaggaggcgatcattacggtcaagggcgtcagcttgtcaagctaccttgagggactcatggcgtcaaccatttccagtaacgccagtaaaggtagagaagcaatggagtgggtgatccataagcttaacgcagaaatagaggaattaacagcttctgctaggggtactatacggacccctatggccgcagccgcttttgctgagaagtag

SEQ ID NO: 30066 - DNA, 2247 bp, Artificial Sequence
  Description of Artificial Sequence: Synthetic coding sequence
atgtcaaaccccgggggaagacgtaacgggcctgtcaagctgaggctgacagtcctgtgcgctaagaatctggttaagaaagatttcttccgcctgccagatcctttcgcaaaggtcgtggtggatggctcagggcagtgccattcaacagacaccgtgaagaataccctcgatccgaaatggaaccagcactacgatttgtacataggcaaatctgactccgtaactatctcagtttggaatcacaagaagattcacaagaagcaaggcgccggatttctgggctgtgttcggctcctgtctaacgccattaaccgcctgaaggacaccgggtatcagcggttggacctgtgtaagctgggtccaaacgataacgatactgtgaggggccaaatcgtcgtaagtttacagtcaagggacaggatcggaactggggggcaagttgtagattgctcacgcttgtttgataatgacctccctgatggatgggaggaaaggagaacagcctcaggccgaatccagtatctcaaccatatcactaggaccacacagtgggagcgccccacacgccccgccagcgaatattcatcccctggacggccactttcctgctttgtcgacgagaatacacccatcagtggaacaaacggcgcgacctgcggtcagtcttctgacccgagactggcagagaggagagtgcggtcgcagcgccaccgtaattacatgtcccgtacacaccttcatacaccgcccgacctgcccgagggctatgaacagaggaccactcaacagggtcaagtctacttcttacacactcaaacaggggtaagcacttggcacgatcctagagtaccacgcgatctcagtaacatcaattgcgaggagcttggtcctctcccgccgggttgggaaatccgaaataccgcaaccggcagagtctactttgttgaccacaataataggactacacagtttaccgacccaaggttgagtgccaacctgcatctggtgttaaatcgccagaatcagctgaaagatcagcagcagcaacaggttgtgagcctgtgtccagatgacacagagtgtctgacggtccccagatacaagcgagacctggttcagaagcttaaaatactgcgccaggagttgtcccagcagcagccacaggctgggcactgtaggatcgaggtgtctcgggaggaaattttcgaggagtcgtatcggcaagtcatgaagatgcgacctaaagacctttggaaaaggttaatgatcaaatttagaggagaggaggggctcgattacggcggcgttgctcgagaatggctttacttactgtctcacgagatgttaaatccctactacggactttttcagtacagccgtgatgatatttacacgctgcaaattaatcccgactccgccgtaaaccctgaacatctctcatatttccactttgtgggtaggatcatgggaatggctgtctttcatggacactacattgacggagggttcaccctccccttttacaaacagctgctgggaaagtctatcaccctcgatgatatggaactggtcgatcccgacctccacaacagtctggtgtggatcctcgagaatgacattacaggcgtcctcgatcacactttttgtgtggaacacaacgcctatggagaaatcattcagcatgagttgaagcctaacggcaagtccattcctgtaaacgaggaaaacaagaaggagtacgtgcgcctctacgtaaattggcgcttccttaggggtatagaggcccaatttctggcactgcaaaaagggtttaacgaggtcatcccacagcacctgctcaaaacattcgacgaaaaggaattagagctgatcatttgtgggctgggcaaaatagacgttaatgactggaaagttaatacgcgcttgaaacactgcacaccagactccaatattgtcaagtggttctggaaggctgtcgaatttttcgatgaggagagacgggcacggcttctccagtttgtcactggctcgtcccgcgtacctctccaagggtttaaagctctccagggcgctgccggaccccggctgttcacaatccaccagatcgacgcgtgcaccaacaatctgcctaaggcccacacctgcttcaaccgtatcgatatcccaccttacgaatcctacgagaaactttacgagaagctgctaaccgcaattgaggagacctgtggattcgccgtggaatag

SEQ ID NO: 30067 - DNA, 294 bp, Artificial Sequence
  Description of Artificial Sequence: Synthetic coding sequence
atgactagcttgctaaccactccctcaccccgagaggagctgatgaccacacctatattacagcctacagaggccttaagtcctgaggacggagcctcgaccgcactcatcgctgtagttattactgtggtctttcttacacttctgagcgtggtcatcctgatattcttctacttgtataagaacaaaggaagctatgtgacatacgaacccaccgaaggcgagccctcggccatcgtacagatggaatcagacctcgcaaaaggctccgagaaggaggagtacttcatatag

SEQ ID NO: 30068 - DNA, 294 bp, Artificial Sequence
  Description of Artificial Sequence: Synthetic coding sequence
atgactagcctgctgaccacaccctctccccgagaggaattgatgacgactcctattctccagcctacagaggctctgtcaccggaagatggagcctctacagctttgattgcggtggtcattaccgtggtgtttcttactttgctgtcagttgttatactcatttttttttacttgtacaaaaataagggatcatacgtgacttatgaacccaccgagggcgagccctccgccatcgtccagatggaatccgatctggctaaaggctctgagaaggaggagtatttcatctag

SEQ ID NO: 30069 - DNA, 3282 bp, Artificial Sequence
  Description of Artificial Sequence: Synthetic coding sequence
atggctagcgccccggcggaagctgagactagacagagactactgagaacagtcaaaaaggaggtgaagcaaattatggaggaggcagtgacacgtaagttcgtccacgaggactcctcacacatcatcagtttttgcgcagcagtggaagcctgtgtgctgcacggcctgagacgacgagctgcagggttcctgcggagcaacaaaattgcagcactgttcatgaaagtgggaaagaatttcccacctgccgaagacctgtcccggaaggtacaggatttggagcaattgattgagagcgcaagaaatcagatccagggtctgcaggagaatgtgagaaaactccccaagctacccaacttgagcccacttgccataaaacacctatggatcagaacagccttatttgaaaaagttcttgacaaaatcgtgcattatctggtcgagaacagcagcaagtattatgaaaaggaagcgctgttaatggatcctgttgacggccccatactggcaagtttgctcgtggggccatgcgcgctcgagtatacaaagatgaagacagccgaccatttctggacagatccttccgctgatgagcttgtgcaacggcataggatccactccagtcacgtgcgacaggactcccctacaaagcgcccagcactgtgcatacagaagcgccactcctctggctctatggatgatcgacctagtttaagtgcacgggactacgtcgaatctctgcaccagaacagccgggccactctcctgtacggaaagaacaacgtgctcgtgcagccgcgcgatgacatggaggctgtgccaggctacttgagcctgcaccaaactgctgacgtaatgacactgaagtggacccccaatcagctgatgaacggttctgttggggatctcgactatgagaagtctgtgtactgggactatgcgatgactatccgcctggaagagattgtctatctccactgtcaccagcaggtagactctggaggtacagttgtgcttgtctcccaggatggaatccagcggcccccatttagatttccaaaaggaggccacctgctgcagttcctgagctgcctggaaaatgggttgctgccccatggacagctggacccacctctttggagccaaagagggaagggaaaagtgttccctaaactgcgaaaacgcagcccccagggctctgccgaatccactagttctgacaaagatgatgacgaagcaaccgattacgtattccggattatctatccgggtatgcagtccgagtttgtgccccaggaccttatggatgtttctgtgtctaatctgccgagcctctggcaaccctcacctaggaagtcctcctgtagctcttgctcacagtccggcagtgcagatggtagctctacaaacggttgcaaccacgaacgcgccccattaaaacttctttgcgataatatgaagtaccagattctgagtagggcattctatggctggcttgcttattgtcggcatctgtctacggtgcggacacacctgagtgcgctcgttaatcatatgatcgtttcccccgacctgccatgcgatgctggacagggtttaacggcccgtatctgggaacagtatcttcatgattccacttcatatgaagagcaggaactgctgaggctgatttactatggaggaatccaacccgagattaggaaggcagtgtggccgtttctgctgggtcattatcaattcggaatgactgaaaccgaacgtaaggaagtggacgagcagatccacgcgtgttatgctcaaacgatggccgagtggctagggtgtgaggcaatagtgcgccagcgtgagagggagtcacacgctgccgcgctcgccaagtgttcctctggcgcatcccttgattctcacctgcaccgaatgctgcacagagatagtaccatcagtaatgaatcctctcaatcgtgttcctctggcagacaaaatatccggctacattctgatagttcttcctccacacaagtcttcgagtcagtggatgaggtggagcaggttgaggctgagggtcggctggaagagaagcagcccaaaatcccgaatgggaacttagtgaatggaacatgtagtcccgacagtgggcatcccagcagccacaatttcagctccggtctttccgagcatagtgagcccagtctgagcactgaggattctgttctcgatgcacaaaggaatactcctaccgttctgaggccacgcgacggatccgtggatgatcggcaatctagtgaagctacgacatctcaggatgaagctcctagagaggagctcgctgtacaggactccctggagtccgatctgctggcgaacgagagcatggatgaatttatgtcaatcactggttcgctagacatggcgcttccagaaaaagacgatgtggttatggaggggtggagaagctccgaaacagagaagcacggccaggcagattctgaggacaatttgtcagaggagccagagatggaatctctgttccccgctctcgccagcctggcagtgacaacatccgcaaatgaggtctctcctgtctcttcttcaggggtgacctacagccctgagctgctcgacctttacaccgtgaatttgcacaggatcgagaaagatgttcagcgttgcgatcggaactattggtacttcactcccgctaatctggaaaagctgcggaacattatgtgttcctatatttggcagcacattgagattggatatgtgcagggtatgtgtgatttactggcccccctcctggtgattctcgacgacgaggccctggcattcagctgtttcactgaactgatgaagcgtatgaaccaaaactttccccacggtggcgcaatggatacacattttgccaatatgaggagcctgatccaaattcttgattcggaactctttgagctgatgcaccagaatggtgattacactcacttttatttttgttatcgatggttccttttggactttaaaagagaacttgtttatgatgatgtgtttctggtctgggagacgatatgggctgcgaagcacgtgagctccgcccactatgtgctgttcattgcccttgccctggtcgaggtctacagggacatcatactggagaacaacatggactttacggacattataaaattcttcaacgagatggccgagaggcataacaccaaacaggtcctaaaactggcccgggacctcgtttacaaagtgcagaccctcatagagaataagtag

SEQ ID NO: 30070 - DNA, 3447 bp, Artificial Sequence
  Description of Artificial Sequence: Synthetic coding sequence
atggcttctgcaccagctgaagctgagacaaggcaaagactcctcaggacagtcaagaaagaggtgaaacagataatggaggaagctgtgacacgtaagttcgttcatgaagatagctcccacattatctccttctgcgccgccgttgaagcctgtgtgctccacggcttaagacggcgggccgccggctttctacgttctaacaagatagccgccctctttatgaaggtcgggaagaattttcccccggccgaagatctgtctcggaaagtgcaagacctcgagcaactcattgagtctgccaggaaccagatacagggattgcaagaaaacgtgaggaagctccccaagcttcctaacttgagcccccttgccattaaacacctttggatacggacagccctgttcgaaaaggtattggataaaatcgtgcattacctggtggagaattccagcaagtactacgagaaagaagccttactcatggacccagttgacggacccattctcgcctctctgctggtggggccgtgtgctcttgaatatactaaaatgaagactgccgaccacttttggaccgacccatctgccgacgaactcgttcagcgacatcggattcactctagccatgtgcgccaagactcaccaactaaaaggccagccctttgcattcagaagaggcatagttcgggatcaatggacgacagaccctctctgtctgctcgcgactacgtggaaagtctccaccagaacagtcgcgccactctcttgtacggtaagaacaatgtcctggtgcagccaagagatgatatggaggctgttcccggatacttgtctttgcaccagacggccgacgtcatgacacttaagtggacaccaaatcagctgatgaatggtagcgtcggagatctggattatgagaagtccgtttattgggactacgctatgaccatccggctggaggaaattgtatatctgcattgccatcaacaagtcgacagcggtggaaccgtggtgttggtaagccaagacgggatacaaaggcccccgttccggttcccaaagggaggccatttactgcaatttctttcgtgtctggaaaacggcctgctcccccatggccagttggacccccccttgtggagtcagcgcgggaaaggaaaagtgtttcctaaattaaggaaaaggtccccccagggctcagccgaatctacaagctcagacaaggatgacgacgaagctaccgactacgttttccggattatctaccccggaatgcagagcgaattcgtggctccagactttttaggctcaacatcaagcgtgagtgtcggtcctgcatggatgatggttcccgccggaagaagcatgctagtggtcgcccgcggcagccagtgggaaccagccagatgggatacaaccctgcctacaccaagccccaaagaacaacccccgatgccacaggatctcatggatgtgtctgtgagtaaccttccttcgctgtggcagccctctcccagaaaatcttcctgctctagctgctctcagtcaggatctgcagacggatcttccactaacggttgtaaccatgagcgtgctcccttgaagttgctgtgtgataacatgaagtatcagatcctgagtcgcgccttctacggttggctcgcatattgccggcacctgtctacagtgaggacacacttatcagccttggtgaatcatatgattgtatcacctgacctgccttgcgacgctggacaaggcctgaccgctcgtatttgggagcagtatctccacgattcaacaagctacgaggaacaggagctgttgaggctaatctattacggcggcatccagcccgaaatcaggaaagctgtgtggcctttcctcttgggccattaccagttcggcatgactgaaactgagagaaaggaggtggatgaacagattcacgcgtgttatgcccaaacgatggccgaatggctgggatgcgaagctattgtccgtcagagagaaagagaatcacatgccgccgctctggcaaaatgctccagcggcgcgtctttggactcacacctccataggatgctccatcgcgatagcacaatctccaacgagtccagtcagtcctgctcaagcggcagacagaatatcaggctgcatagcgattcgagttcgagtactcaggtgttcgagtcagtggacgaggtcgaacaggtggaagccgaaggtaggctggaagagaaacagccgaagatacccaacggcaacttggtgaatgggacttgctcacccgatagcggacacccctcctcccataactttagctcgggactcagcgagcacagtgaaccttccctgagcaccgaggattcagtgcttgatgctcagcgtaacaccccgacagtcctaaggcccagggacggatcagtggatgaccgtcagtcctccgaggcaacgactagtcaggacgaagctcctcgagaggaactggccgtccaagattccttagaaagcgacctgcttgccaacgagtcaatggatgagttcatgtccatcaccggcagtttagacatggcactgcctgagaaagacgacgtcgtcatggaggggtggaggtcttcagagaccgaaaaacacgggcaagccgatagtgaggacaacttgagtgaagaacccgagatggaaagccttttccccgccctggcctcccttgcagtgacgacaagcgcaaacgaggtcagtccagtgtccagctctggcgttacatattcacccgagctgctggatttatacaccgtgaacttgcaccgcatagagaaggacgtgcaaaggtgtgacagaaattactggtactttacccctgctaatctggagaagctacggaacatcatgtgtagctacatctggcagcacatcgaaataggatatgtgcagggcatgtgcgatctcctggcacccctcctggtaattcttgacgatgaagcattggccttctcatgtttcaccgagctgatgaagagaatgaaccaaaacttcccgcacggaggcgccatggatacccattttgccaacatgaggtcactcatacaaattttggattcggaactgttcgaactaatgcaccagaatggcgactacacccatttttatttctgttatcgctggttccttctcgatttcaagagagagctcgtctacgatgatgtgtttctggtatgggagaccatctgggcagccaaacatgtgtcttccgctcattacgttcttttcatcgcgctggccctcgtagaagtatatagagatataatcctggagaacaatatggattttaccgacatcataaaatttttcaatgagatggctgaacgacacaacacaaagcaggtcctgaagctcgcgagagatctcgtgtacaaggtccaaaccctgatcgagaataagtag

SEQ ID NO: 30071 - DNA, 3447 bp, Artificial Sequence
  Description of Artificial Sequence: Synthetic coding sequence
atggaagaggccgtgacacgtaagttcgtccacgaggactcaagccatattatttccttttgcgcggctgttgaggcgtgcgtcttacatggtctgaggcggcgggccgccggatttttaaggagtaacaaaattgctgccttattcatgaaagtaggaaaaaacttcccacctgccgaagatctaagcaggaaagtgcaggacctggaacagcttatcgagtccgcgcgcaaccagattcagggtctgcaggagaacgttcgcaagttgcctaaactccccaaccttagcccgctcgccatcaagcatctgtggatccgtactgcgttatttgaaaaagtgcttgacaaaatcgttcactatctggtggaaaattccagcaagtattatgagaaggaggccttgttaatggatcctgtggatggccctatcctggcctcgctcctggtgggaccttgtgcccttgagtacactaagatgaaaacagcagaccacttctggaccgaccccagtgcggatgaacttgtccagagacataggattcactcatcccatgtgaggcaggacagtcctaccaaacgcccagctttatgtatccagaagagacactcgtcaggaagcatggatgatagaccttccctgagtgcccgagattacgtcgagtccctgcaccagaactcgagagcaacccttttgtacgggaagaacaacgtgctggtgcaaccaggactgaccccaggctatagaggaaaaggcctttccggttccagactgcccattcattccagcatttatgctcttacgcatgcgcatatccacccgcctaacactcatagttctattcacctttaccttcacgccccaatccttacaagcatccatccacctattgtgatatccattcacccacccatagtcacaacgatccacccctctacccacctgtacatccatctttctaaccatctctacatccacccgagcactcatttgtacattcacccttccactcatctttatatctatcctagtattcacccatctatccaccccagcatttatccatctattcatttctctgactacgttttcctcaaccagacaggacagacctacgttcattccaattctagcaccatggcccggcccgaagacgacatggaggcagtgcctggatatttgagtctgcatcagactgctgacgtgatgacccttaagtggactccaaaccagctcatgaatgggtccgttggagacctagattacgagaaaagcgtgtattgggattacgccatgaccatccgactggaggagatcgtgtaccttcactgccaccagcaggtggactccggaggaaccgtcgtcctggtgtcacaggacggcatccagaggccgcctttcaggtttccaaagggcgggcacctactacagttcctatcttgcctggaaaatggcctactcccacatggacagctcgacccaccactttggagccagcggggaaaaggcaaagtctttcccaaactgagaaagaggtctccacagggtagcgccgagagtacatcctcagacaaggatgatgatgaggctacagactatgtatttcgaattatctatcccggaatgcagtctgagttcgtgccccaggatctcatggatgtttcagtttctaatcttccaagcttatggcagccgagccctagaaagtccagttgcagcagctgctctcagtccggctccgccgatggttccagtacaaacggctgcaaccacgaacgtgctcccttgaaactgctatgcgacaatatgaaataccagatcctgagtagagcgttctatggctggttggcgtactgtcggcatctgtcaacggtcaggacgcacctctcagccttggtgaatcatatgatcgttagcccagacctgccctgcgatgccgggcagggtcttactgctcgaatctgggagcagtatctgcatgatagcacaagctatgaagagcaggaattgctgcgcctgatatattacggcggcattcagccggagatccgtaaggcagtgtggccatttctgcttggacactaccagtttggaatgaccgagaccgagcgcaaggaatcaagtcagtcctgctccagcggtcggcagaatattcgcttgcattccgactcttcttcttccactcaggttttcgagtccgtggatgaggtcgaacaggtggaagccgaggggaggctggaggaaaagcaacctaagatccctaatggtaacctcgtgaatgggacatgttcccctgatagtgggcatccttctagtcacaacttttctagtggactcagcgaacatagcgagccctccctctctaccgaggattctgtgctggatgcgcaacgcaacactcctactgtcttgagaccaagggacggcagtgtagacgaccggcagagcagcgaagctactacatcacaggacgaggccccccgagaggaactagcggtacaggacagtctcgaatcggacctgctggctaacgagtccatggatgagttcatgtcaatcaccggttccctggacatggccctgcccgagaaggacgacgtggtcatggaaggatggcggagcagcgagaccgagaaacacggccaggcagacagtgaagataatctgtctgaggagcccgaaatggaatctttgtttccggctctggctagtcttgctgttactacttcagcaaatgaagtgtctcctgtgagttcctcgggggtgacctactctcccgagttactggatctttacactgtcaacttgcatcggatagagaaagatgtccaaagatgcgatcgaaactattggtatttcacccctgcaaatctggaaaaactgagaaatataatgtgttcatatatctggcagcacatcgaaatcggatacgtgcaaggcatgtgcgacctcttggcccctttgttggtcattctagatgacgaagctctagcattcagctgcttcaccgagcttatgaagcgtatgaaccagaatttccctcacggaggagccatggacacccacttcgcaaacatgagaagcttaatccagatattagactccgagctcttcgaactcatgcatcagaatggggactacacccacttttatttctgttatagatggtttctcctggatttcaaaagagaactggtgtatgatgacgttttcctcgtgtgggagacaatatgggctgccaagcacgtgagttctgcacactatgtgctgttcatcgcactggccctcgttgaagtttatcgggatattatactagaaaacaatatggactttaccgacatcataaaatttttcaatgagatggccgagcgccacaatacaaagcaggtcctgaagctggcccgcgatcttgtttacaaagtgcagaccttgatcgaaaacaagtag

SEQ ID NO: 30072 - DNA, 234 bp, Artificial Sequence
  Description of Artificial Sequence: Synthetic coding sequence
atgggtttgtgttttccctgccctggcgagtccgcgcctccgactcccgatctggaggaaaaacgtgctaaactcgctgaggcggctgagcgacgccagaaagaggccgcctcccgcgggattctagatgtgcaatcagtacaggagaaaaggaaaaaaaaagaaaaaattgagaagcagattgctactagcggtccacctcctgagggaggactcagatggaccgtctcttag

SEQ ID NO: 30073 - DNA, 1365 bp, Artificial Sequence
  Description of Artificial Sequence: Synthetic coding sequence
atggccgaattttcacagaaacgggggaagcggaggtctgatgaaggcttaggctccatggtggactttctgctggccaacgctcggctcgtgcttggagtgggcggcgccgccgtgttggggatagccacactggctgtgaagaggttcattgacagggccacctcgccacgcgatgaagatgacacaaaggccgatagctggaaggaactctctctgttgaaggccactccacatctacagccaaggccaccgccagccgcgttgtcccagcctgtacttccccttgcaccatcttcctctgcccccgaaggccccgccgagaccgacccagaagtgactccccagctgtcttctcccgcccccttatgtttgactctgcaagaaagactcttagcttttgagagggatagggtgactattcccgccgcgcaggttgcactagctaaacagctggccggtgatatcgccctggaactccaggcatactttcgatccaagttccccgaactgccctttggcgcttttgtgccgggtggacctctgtatgatgggctacaggctggcgcggccgaccatgtccgcttattggtgccactggtcctcgaacccggtctatggtcgctcgttcccggggtagataccgttgcacgcgatccaaggtgttgggcggtgagacgcactcagctagagttttgcccccggggcagttcaccatgggataggttcttggtagggggttatctctccagccgggtgctgctcgaactcctgcgaaaggccctggctgcttccgtcaattggccagctatcgggtccctcttaggatgcctgattagaccctctatggcgagtgaggaattgctcctcgaggttcaacacgagaggctggagctgaccgtcgctgtcttggtggcagtccctggtgtggatgcagacgacagactgttgctagcctggcctctcgagggactcgcaggtaatctttggctccaagatctctatcctgtggaggcagcacggctccgtgctcttgacgatcacgacgctgggactaggagacgattgcttctgctactgtgcgcagtatgtcgaggatgcagtgctctgggtcagcttggtcgggggcatctaactcaggtggtgctgaggttgggtgaggataacgtggattggacagaggaagcgcttggagaacgatttctacaggctctggagctcttgattggctctctggaacaggcttcactgccctgccattttaaccctagcgttaatttgttctcatcactgcgagaagaagagattgatgacattggatacgccctctatagcggcctgcaggagcccgaaggactcctatag

SEQ ID NO: 30074 - DNA, 492 bp, Artificial Sequence
  Description of Artificial Sequence: Synthetic coding sequence
atggcagaattctctcagaaaagggggaagagaagatcggacgagggcctcggctccatggtggactttttacttgctaatgcaagattagttcttggcgtcggtggggcggctgtcctcggaatcgcgacactcgctgtgaaacgcttcattgatagagccacctccccccgggatgaagacgatactaaggcagatagttggaaagagctgtccctccttaaagccacaccccacctccagccgagacctccacccgctgctctttctcagcctgtgctgcccctcgcaccctcgtcctcagcccctggggagtggcacagtttcccatctttcggcgtgaccttcaagaggcgttcgcctggatttgccctgactgattgcgtgaccctaagagagtctctgctgctgagtcggctgtgggcacctcaaatattcaacggtggcggtgtgtccctgccatgttcatggtctaaggtggtggcactgtag

SEQ ID NO: 30075 - DNA, 618 bp, Artificial Sequence
  Description of Artificial Sequence: Synthetic coding sequence
atggcagaatttagccagaagcgtggcaaaagacgaagcgatgaaggccttggaagcatggttgattttctcctggccaatgcccgcttagtgttgggcgtgggaggcgcagcagtcctcggcatcgcaacactcgctgtgaagcgcttcattgatagggccacctctcccagagacgaagatgacactaaagctgattcatggaaggaactgtcactgcttaaggccacacctcatctgcaaccacgcccacccccggccgcattatcacaacccgtgctgcccctcgcgccttcgagtagtgcccctggcgaagcagccgggcttcgagcgggcccttgcgaccatcccagtagccccggaggattcggacagactgctggatggcgacacaggcccggggcggctgggctgctgtctgaacaggtgccaggaacagcgctgtgggggataagagcctggggggcagctctgcgccgagccgcagggggcggttgtgggccatgtgcaagtccgggagccacaggggccggtgcaggacctgtggaaccaggggctggacgcggacattgtggggagggccccagcctgcttggaagagcccaggacgccgcatag

SEQ ID NO: 30076 - DNA, 1398 bp, Artificial Sequence
  Description of Artificial Sequence: Synthetic coding sequence
atgggacttagccccaatctggacaggcaaaccatggctgagttcagtcagaagcgcggtaagagaaggtcagatgaggggctggggtcaatggtcgattttttgctcgcaaatgcgaggctggtcttgggggtcgggggagctgccgtgctagggatcgcaacactggccgttaagcgctttattgaccgtgccacgagtccgcgtgatgaggacgacaccaaggccgactcctggaaggaattatctttacttaaagctaccccacatctgcaaccgaggcctcccccggccgcccttagccagccagtgttgccactcgccccgagtagtagcgcccctgaggggccagctgagaccgatcccgaggtaacgccccagctgagctctcccgccccactttgtctgacattgcaggaaaggcttctggcttttgaacgtgatagagtgactatacctgctgcacaagtggccctggcgaagcaactagctggggacatcgctcttgaattgcaagcctatttcagatcaaagttcccagagcttcctttcggggccttcgtgccaggcggacctctgtatgatgggctgcaggccggcgctgcggaccacgttaggctcctcgttccgctcgtcttggagcctggcctgtggtctctggtacccggcgtcgacactgtggccagggaccctaggtgctgggccgtgaggcgcacacagctggagttctgcccaagaggctccagcccttgggataggtttctggttggtggctatctttcctcccgcgtgttgcttgagctgctgcgcaaagcgctggcggcaagtgttaattggccggccatcggatcactacttggctgcctgataagacctagtatggcgtccgaagagctgttattggaagttcagcacgagcggctagaactcaccgtggccgtgctggtggcggtgccgggcgtggatgccgacgaccgtttgctcttggcttggcctttagagggcctggctggtaacctgtggctgcaggatctgtatcctgtggaggccgcccgacttagggcgctggacgatcacgacgccgggaccagaagaagactcttgctactcctatgtgccgtatgccggggatgctctgcccttggtcagctggggagaggtcatctgacccaggtggtcctccgccttggcgaagacaacgtcgattggaccgaggaggcgctgggagagcgcttcctgcaggccctggagctcctgattggaagcttagagcaggcctcattaccctgccacttcaacccctccgtgaatctattctcttctctgagagaagaggaaatagacgatatcgggtatgccctatattccggactgcaagagccggaaggtctgctgtag

SEQ ID NO: 30077 - DNA, 1392 bp, Artificial Sequence
  Description of Artificial Sequence: Synthetic coding sequence
atggctggagctggggagcgaaaaggcaagaaggatgataatgggatcggcactgcgatcgactttgtgctctcaaacgcccggctagtgttaggcgtcgggggcgcagctatgctcggcatcgccacactggcagtgaagcgtatgtatgatagagcgatttccgcccccacgtcaccgactcggttatcacactccggcaagaggagctgggaggaaccaaactggatgggttcaccacgtcttctgaatcgagacatgaaaacaggcctgtccagaagcttacagaccctgccaaccgactcctctacattcgataccgacacattctgtccacctcggcctaagcctgtggcccgaaaggggcaggtcgacctcaaaaagagtagattaagaatgtctctacaagaaaagctactgacctactatagaaacagagccgctatccctgctggggagcaggcaagagctaagcaggccgctgtggacatttgcgctgaactccgttcctttcttcgagcaaagctccccgacatgccactccgggacatgtacctttccggaagcctgtatgatgatcttcaggtcgtgacagccgaccatatccagctcatcgtgcctttagtgctcgagcagaacctatggtcatgcattccgggcgaagacacaatcatgaatgtgcccggcttcttcctcgtaaggagggagaaccctgaatattttcctcgtggatctagttattgggaccgctgtgtggtgggaggctacctcagcccaaaaactgttgccgatactttcgagaaagttgtggcgggctcgatcaactggcctgccataggaagtcttcttgattatgttatacgtccagcacccccaccggaggcactgactcttgaagtccagtacgagcgcgacaaacacctgttcatcgactttctcccctcagtgacactgggcgacacggtgctggtggccaaaccacacagactcgcccaatacgataatttatggagactatcactcaggcctgcagagaccgcccgcttacgcgctctggaccaggccgactccggttgccgtagcctgtgtctaaaaatcttaaaggccatctgtaagtctacccccgctctggggcatctgactgcctcacagctgaccaacgtgatcctccatttggctcaggaggaggcagactggtctccagatatgctggccgaccgctttctgcaggctctgcgcggtctcatctcctatcttgaggctggggttctaccatccgctcttaacccgaaggtcaacctcttcgccgagttaacgccagaagagattgatgaacttggctacacactatactgtagcctttcagaacctgaggtcttgctccaaacgtag

SEQ ID NO: 30078 - DNA, 1437 bp, Artificial Sequence
  Description of Artificial Sequence: Synthetic coding sequence
atggctggcgcaggagagcgcaagggcaaaaaggatgacaatgggattgggaccgccatcgacttcgtgctgagtaatgctcggctggttctgggggtgggcggtgccgcgatgctgggaatagcaactttggcagtaaagcgcatgtatgacagagcaatatccgccccaacctcacccacccggctttcccactcaggaaagaggtcttgggaggagccaaactggatgggatccccccgattgcttaaccgggacatgaaaaccggtctgtctaggtctctgcaaacattaccaaccgacagctccacgttcgatactgatactttctgccctccacggcctaagcccgtggccagaaaaggccaagtggacctgaaaaaaagtaggctgcgcatgtctttacaggagaagctactgacctactacaggaatagggctgcgatcccggctggcgagcaagcccgtgcgaagcaggctgccgtggacatctgtgccgaactgcgcagcttcctgcgagcaaaactgccagacatgccactccgcgatatgtacttgtcaggctctctgtatgacgacctccaggttgtcacagccgatcacattcagctgatcgtccctctcgtgctggagcagaatctgtggtcgtgtatccccggcgaggacacaattatgaacgtacccggcttcttcctcgtcaggcgcgaaaatcccgagtatttcccgcgggggtcaagctattgggatcgctgtgttgtgggcgggtatctctcccctaagacagttgcagacacatttgagaaagtcgttgccggctcgatcaattggccagccatcggcagcctgttggattacgtgattcgtcccgccccgcctcccgaggccctaaccctcgaggtgcaatacgagagggacaagcacctattcatagactttctgccctcggtgacactgggggacacagtcttggtcgccaaaccccatcggctggctcagtatgacaacctgtggagactgagccttagacccgcagaaactgctcggttacgcgcgttagatcaagcagattctggatgccggtcactatgtctgaagatcctgaaggccatctgtaaaagcaccccagcccttggccatcttactgcctctcagctgaccaacgtgattctgcatcttgcacaggaagaggccgactggagcccagacatgctggccgaccgatttttgcaggccctgcgtgggctgatcagctacctcgaggctggcgtgctgccatcggccctgaatcccaaggacaaagcactgaaagaacgcagtctgcgtcaccaggttaggatgatggaagtggatagccgtttgaacgtgtcctggaagatccaatcccttgtgggcgtgtggtggccctgcttcctgccacgacaggcgttgttattctag

SEQ ID NO: 30079 - DNA, 1392 bp, Artificial Sequence
  Description of Artificial Sequence: Synthetic coding sequence
atggccggggccggcgaacgaaaagggaaaaaggatgacaacggcatagggacggcaatcgacttcgtactcagcaacgccaggctcgtgctcggtgtgggcggcgcagccatgctgggaatcgctacgctggctgttaagaggatgtacgatcgcgcaatcagcgccccaacctcccctacacgactctcccacagcgggaaacgctcctgggaagaaccaaattggatgggctcacctaggctcctcaacagagatatgaagaccgggctgagtcggagcctccagaccctgccgacagactcatccacttttgacacagatacgttttgccctcctcggcccaaacccgtcgctaggaagggacaagtggacctcaagaagtctagactgaggatgtctttacaggaaaaactgcttacttactatcgcaaccgagctgccatccctgccggagagcaggcccgcgcaaagcaagccgctgtggacatttgtgcggagctccggagtttcctgcgagcaaagctgccagatatgcctctcagggacatgtacttgagtggatcgctctatgacgatctgcaggtggtgactgccgatcacattcagctcattgttcccctggtgctggagcagaatctctggtcatgcatcccgggcgaagatacgataatgaatgtccctgggttttttctcgtcagacgggagaacccagaatatttccctcgcggttcgtcctattgggataggtgcgtggtaggtggatatcttagtcctaagacagtggccgatacgttcgaaaaagtggtggctgggtcaataaactggccagcaattgggtcactgctggactacgtaatacggccagctccgcccccggaggctctaacattagaagtccagtacgaaagagataagcaccttttcatcgattttttaccgagcgtgaccctcggggataccgtcctcgttgcgaagccacacaggctggcacaatacgataacctgtggagactctcactcagacccgcggagaccgcccgactccgagccttggatcaggccgattctgggtgcaggagcctctgtctgaaaattctgaaggccatctgcaagtccacaccagccctcggccacctgaccgcaagtcagctgaccaatgtcatactccacctcgctcaagaagaagctgactggagcccagacatgttggcagacagatttctccaggccctgagagggttaataagctatctcgaggcaggggtgctgcccagcgcattgaaccccaaggtcaatctgttcgccgaacttaccccagaagagattgacgagctaggttacacactgtactgtagcctttccgagccagaagtcctgctacagacatag

SEQ ID NO: 30080 - DNA, 447 bp, Artificial Sequence
  Description of Artificial Sequence: Synthetic coding sequence
atggcaggagctggtgagcgcaaaggaaagaaggacgataacgggattggcactgcgattgacttcgtgctctcaaatgcacgcttagtactaggggtgggcggcgcggccatgcttggaatcgctacccttgctgtcaagcgcatgtatgatagggcaatcagcgccccaacttcccccacaagactgagccacagtggtaaacgttcctgggaagagcccaactggatggggtctcccagactgctcaatcgggatatgaagacaggcttgtcacgatccctccagacattacccaccgactcaagcaccttcgatacaggagaaactagttacctgcttcctgaacctgggtctcacccctgctggcgggctggcagcgggcaggctagttgttgcggacatatgtgcagggccccggagctcccagccggccaggtggcgtag

SEQ ID NO: 30081 - DNA, 447 bp, Artificial Sequence
  Description of Artificial Sequence: Synthetic coding sequence
atggctggcgcaggcgaacgtaaaggtaaaaaagacgacaatggaataggcacggcgattgactttgttctgtctaatgctcgcctggtgcttggcgtgggtggagcagccatgctcggcatcgcaaccctcgcagtaaaacgcatgtacgatagggctatttctgcacccaccagcccgaccagacttagccacagtggcaagagaagttgggaagagcccaactggatggggtctcctaggcttctgaatcgcgacatgaaaacgggactgtccaggtcactgcagacccttccaacagatagtagcacttttgataccggagagacttcttaccttttgccggagccaggctctcacccctgctggagggcaggctccgggcaggcgagctgttgtggccatatgtgccgcgccccagagctccctgctggccaggtagcgtag

SEQ ID NO: 30082 - DNA, 132 bp, Artificial Sequence
  Description of Artificial Sequence: Synthetic coding sequence
atggctggcgcaggagagcggaaagggaaaaaggatgataatggaataggaactgctatcgattttgtcctctctaacgctcgccttgtcctgggtgttggtggggcggcaatgctgggcatcgccacctag

SEQ ID NO: 30083 - DNA, 2067 bp, Artificial Sequence
  Description of Artificial Sequence: Synthetic coding sequence
atggcagctgagatagattttctgagagagcaaaatcgccggctgaacgaggactttagaagatatcaaatggagagcttctcaaagtattcttccgttcagaaggcggtgtgccagggcgagggggatgacaccttcgagaatctcgtgtttgatcagagtttcctggctccactggtaactgagtatgacaagcatttaggtgaactcaatgggcagttaaaatactaccagaaacaagttggtgaaatgaagctacagctggagaacgtcataaaagagaacgagaggcttcacagcgagcttaaggatgcagtcgaaaaaaaattggaagcattccctctgggaaccgaggtcggaactgacatctacgctgacgacgaaaccgtgcgcaacctccaggaacagttgcagctagccaatcaggagaaaacccaggcagtggagctgtggcaaaccgtgagtcaggagttggaccgattgcataagttgtaccaggagcacatgaccgaagcccaaatccacgttttcgaatcccagaagcagaaagaccagctgttcgactttcagcaactgaccaagcagcttcatgtcacgaacgagaacatggaagttactaaccagcagttcctcaaaacagtgactgagcaaagcgtcataatcgagcagcttcgcaaaaaattacggcaggctaagctagagctcagggttgcagtggcgaaggttgaagaactgactaacgtaacggaggacctgcagggccagatgaaaaaaaaagagaaagatgtggtgtctgcccacgggcgggaagaggcatctgacagacgtctacaacagttacagtcaagtattaagcagctggaaatcaggctgtgtgtcactatccaggaggctaaccaactgcggaccgagaacacccatctggaaaagcaaactcgtgagcttcaggctaaatgcaatgagctcgagaacgagaggtacgaagcgattgtgagggccaggaatagcatgcagcttctcgaggaagcaaatctccaaaaatcacaggctcttttggaggagaagcaaaaagaggaagatatcgagaagatgaaggagacagtgagccgtttcgtccaagacgcgacaatccgcactaagaaggaagtggccaatacaaaaaaacagtgtaatattcaaatctcaagactcacggaggaactttccgctctgcagatggagtgcgctgagaagcagggccaaattgagcgagtgataaaggaaaaaaaagcagtggaagaagagctagaaaagatctatagagaaggcaggggaaacgagagtgactaccggaagttagaagagatgcaccagcgcttcctggtgagcgagcggtccaaggatgacctccagctgcgcctcactcgcgcagagaaccgcataaaacaactcgagaccgactcttcagaagaaatttcccgctatcaggagatgatacaaaagctccagaatgtgctggaaagtgaacgcgagaactgcgggctggtgtctgagcagaggttgaagctgcaacaagagaacaaacaattgcggaaggagacagagtcactccggaaaatagccctagaggctcaaaagaaggccaaagttaagatcagtaccatggaacatgagttttcaataaaagagaggggcttcgaagttcagcttagagagatggaggactccaaccggaactcgattgttgaacttcgtcatcttctggcaactcagcagaaagccgctaacaggtggaaagaggagacaaaaaaactaacggagagcgccgagattcgtatcaataatctcaagagtgagctgtctcggcaaaaacttcatacccaagaattattgagtcagctggagatggctaacgagaaagtggccgaaaacgagaagctgatcttagagcatcaagagaaggcaaatagactacaacggcgcctgagtcaagctgaagagagggctgcctctgcctctcaacagctctctgtgatcaccgtgcagcgccgcaaggccgctagccttatgaacctggaaaacatatag

SEQ ID NO: 30084 - DNA, 924 bp, Artificial Sequence
  Description of Artificial Sequence: Synthetic coding sequence
atggctgccgaaattgactttcttcgcgaacagaacagacggctcaacgaggattttaggcgctaccagatggaaagcttttcaaagtactcaagcgtgcaaaaggcagtttgtcagggagaaggcgacgacacatttgagaacctcgtatttgatcagagcttcttggcccctcttgtgacagaatatgacaaacacctaggggagcttaatgggcagctcaaatactatcaaaaacaagtaggtgagatgaaactgcagttggaaaacgttatcaaagagaacgagcggttacacagcgagctgaaggatgccgtggaaaagaagctcgaggcattcccccttgggacagaggtgggaactgatatatatgctgatgatgagacagtccggaatttgcaggaacagctgcagctggcgaaccaggagaaaactcaggctgtggaactctggcagaccgtgagccaggagctcgacagattgcataagttgtaccaggaacacatgacagaggcccagatccatgtgttcgaaagtcagaagcaaaaggatcagctttttgacttccagcagctcactaagcaattgcacgtgactaacgaaaatatggaggtcaccaatcaacagttcctgaagaccgtaacggagcagagtgttatcatcgaacaactgcggaaaaaactgcgttcagaactgtccagacaaaaactccatacccaggaactgctgtctcagctggagatggcgaatgagaaggttgccgagaacgagaagcttatcttggaacatcaggagaaggctaacagactgcagcggaggctgtctcaggccgaggaacgtgcggccagcgcttcacagcagctctcagtgatcaccgtgcagcgcaggaaggctgcttctcttatgaatctcgagaacatctag

SEQ ID NO: 30085 - DNA, 528 bp, Artificial Sequence
  Description of Artificial Sequence: Synthetic coding sequence
atggcggccgagatcgattttctacgcgagcagaatcggcgtttgaacgaggactttaggagataccaaatggaatccttctccaagtattcttctgtccagaaagcagtgtgtcagggggagggggacgacactttcgagaacctggtctttgaccaaagcttcttggcccctttagtgaccgagtatgataaacaccttggagaactgaatggacaactcaagtattatcagaaacaggttggtgagatgaagcttcagttggaaaatgtgataaaagaaaacgagcgctccgagctgagccgacaaaagctgcacacccaggaactcctttcgcaactcgaaatggctaacgagaaggtagccgaaaatgagaagcttattctggagcaccaggaaaaagccaatcgtttacagcggaggctgagccaagcagaggagagagctgcaagcgcttcccagcagctcagtgtgatcaccgtacagagaagaaaagctgcatcactaatgaatctggagaacatctag

SEQ ID NO: 30086 - DNA, 240 bp, Artificial Sequence
  Description of Artificial Sequence: Synthetic coding sequence
atggccgccgaaatcgattttctaagggaacagaatagacggctgaacgaggatttcaggcggtatcagatggagagcttcagcaagtatagttccgtccagaaagcagtgtgtcagggagagggtgatgacaccttcgaaaatttggtgtttgatcagagcttcctcgcccctctggttacagagtatgataaacacctgggtgagctgaacgggcagctgaagtattatcaggcttag

SEQ ID NO: 30087 - DNA, 738 bp, Artificial Sequence
  Description of Artificial Sequence: Synthetic coding sequence
atggaagggaacaagctggaagagcaggatagctctcccccacagagcaccccgggtctgatgaagggcaataaaagagaggaacagggcttgggtcccgaacctgccgcgccacaacagcccaccgctgaggaggaagcgctcatcgaatttcacaggtcataccgggagcttttcgagtttttttgcaataacaccacgattcacggtgctatccgcctggtatgttcacaacacaaccggatgaaaaccgcattctgggccgtgctgtggctgtgtaccttcggcatgatgtactggcagtttggccttctcttcggggaatattttagctacccggtgagtctgaacattaacctcaactcggacaagcttgtgttcccagcggtgactatctgtactctcaacccctatcgataccccgagatcaaggaggagcttgaggagctggatcggatcacagaacagacattgtttgatctatataagtatagctccttcacaacactggtggcaggatccagaagtcggcgggacttacggggcaccctgcctcatccgctgcagaggctgcgtgtgccaccacccccgcacggggcgcgccgagctcgtagcgtggcttcaagcctgcgggacaataaccctcaggtagactggaaggactggaaaattggatttcagctcgaactcctttcgctgcctcccccggacgtttggaagctcctgtatttccaatag

SEQ ID NO: 30088 - DNA, 2187 bp, Artificial Sequence
  Description of Artificial Sequence: Synthetic coding sequence
atggggatggcacgcggatctctcacaagggtccctggagtgatgggggaaggcacccaggggccggaactctctttggaccctgacccttgttccccccaaagtactccggggctgatgaaaggaaacaagctagaagagcaagatccccggcccttgcagccaattcccggcttgatggaggggaacaaactagaagagcaagactccagtccaccccagagcaccccaggcctgatgaagggcaacaaacgtgaagagcaagggcttggacctgagccagcagccccgcaacagcccacggccgaggaagaagcactgattgaatttcatcgttcataccgggagctgttcgagtttttttgcaataacacaaccatccatggggctatcagactcgtctgtagccagcacaataggatgaagacggccttctgggcagtgctgtggctctgtacgtttggcatgatgtactggcagttcggcctcctatttggagaatatttttcttaccccgtgtccttaaacatcaatctcaatagtgacaaattagtgttcccagcagtcaccatctgtactctgaatccttaccggtatcctgaaatcaaagaggaactcgaggagctcgatcgcataactgagcagacactgttcgatctgtataagtactcatcctttaccacactcgttgccgggtcaaggtcccggcgggatttgagaggtacacttccccaccctctgcaacggttgagggtgccccctcctcctcatggggctagacgagctaggagcgtggccagctctctgcgcgacaacaacccacaggtggattggaaggactggaaaattggttttcaactgtgtaatcagaataaatccgattgtttctatcagacatatagcagtggcgttgatgctgtgagagagtggtaccgctttcactacattaatatcttgagccgcctccctgagaccctgcccagtctggaagaggacactctggggaatttcatctttgcatgccgattcaaccaagtctcctgcaatcaagctaattacagtcactttcaccaccccatgtatggaaactgctacacattcaacgacaaaaacaattcgaatctatggatgtccagcatgccggggattaacaatggcttatctcttatgcttcgggcagaacagaatgatttcattccgctgctcagtaccgttaccggggcacgcgttatggtacacggtcaggacgaaccagcattcatggacgacggagggttcaacctgcgccccggagtggaaaccagcatctccatgaggaaagagaccctggataggcttgggggggattatggcgactgcactaagaatggatccgatgtgcccgtcgaaaacttgtatcctagtaagtatacccagcaagtttgcattcacagctgttttcaggagagcatgattaaggagtgtggctgtgcctatattttttaccctagaccccagaatgtggaatactgcgattacaggaaacattcatcttggggttattgctactataagctgcaggtcgatttctcttcagatcatcttgggtgcttcacaaagtgtaggaagccctgctccgtgacttcttatcagctgagtgccggttatagcagatggccctctgtgacctctcaggagtgggtctttcaaatgcttagcagacagaacaactacaccgtcaataacaaacgcaatggcgtcgccaaggttaacatcttcttcaaggaactgaactacaagactaatagcgaatcaccctcagtgacaatggtcaccttactgtcaaacctgggctctcagtggtctctgtggttcggttctagcgtgctgtctgtggtggagatggcggaattagtgttcgacctattagtgatcatgttcctgatgctgttgcgacggttccggtctaggtattggagccccggccgcggcggtagaggcgcacaggaggtcgctagcaccctggcaagctcaccaccctcgcacttttgtccccacccgatgagcctcagtctgtcccagcccggcccggctccctcgcccgctctgaccgccccccctccggcttacgcaactctggggccacggccgagtcctggcggatccgccggggcgtcatcaagtacgtgccctctcggcggcccgtag

SEQ ID NO: 30089 - DNA, 2079 bp, Artificial Sequence
  Description of Artificial Sequence: Synthetic coding sequence
atgtcatcgatcaaaggaaacaaactggaggaacaagatcctaggccgctccagccgatccccggacttatggagggcaacaaactggaggaacaggatagcagtccaccccaatcaacaccaggcctgatgaagggcaataagcgtgaggaacaaggcttgggacccgagccagctgcgccccagcagcccactgcagaggaagaggccttaattgagtttcacaggtcataccgggagctctttgaatttttttgcaataacacaacaatccacggtgctatccgccttgtctgcagccaacataatcgtatgaaaaccgcattttgggctgtcttgtggctatgtaccttcggtatgatgtactggcaattcggcctgttatttggcgagtacttcagttaccccgtgagcctgaatattaacctgaactccgacaaactggtattcccagcagttacaatttgtacactgaacccctataggtatccagaaatcaaagaagagttagaggaactggataggatcacagagcaaacattgtttgacctgtataagtacagctcatttacgactctggttgccggatcacgatcccggagagacctgcgggggactctgccccatccacttcaacgccttcgggttccaccccccccccacggtgcgcgtcgagcccggagcgtagcctcaagcctgagggacaacaacccccaggtggactggaaagactggaaaattggattccagctgtgtaaccagaataagagcgactgcttctaccagacatattctagcggggtagatgccgtccgggagtggtatcggttccattacataaatatcctctcacgcctcccagagaccttgccaagtctggaagaggataccttgggaaacttcatcttcgcctgcaggtttaaccaggttagctgcaaccaggccaattactctcacttccaccaccctatgtacggaaactgttacacatttaatgacaagaacaattccaacctgtggatgagttcaatgcccggtatcaacaatgggttgagtctcatgctaagagccgagcagaacgattttattcccttgctgagcaccgtgacaggtgctcgggtgatggtccacggccaggacgaacccgccttcatggatgacggggggttcaatctcagacctggcgtcgagaccagtatctcaatgagaaaagagacgctggaccgtctcggaggagattacggagattgtactaaaaacggctctgatgtccctgtagagaatttatatcctagcaaatatacacagcaggtctgcatccacagttgttttcaggagagcatgattaaagagtgtggttgtgcttatatcttttatcccagaccacagaatgtggagtactgtgattatcgaaaacattcgagctggggctattgctattacaaactccaggtggatttttcaagcgatcatctgggctgcttcaccaagtgcagaaagccctgcagcgtaacgtcttatcagctgtcggctggttattcacgatggccgtccgtgacaagccaggagtgggtctttcagatgttgagcaggcagaacaactacaccgttaacaataagaggaacggcgtggccaaggttaatatattttttaaggagttaaactataaaacaaactcagagtccccttccgtgacgatggtgacactcctgtccaacctgggcagccagtggagcctgtggtttgggtcttcggtgcttagtgttgtggaaatggcagaactggtttttgaccttctggttatcatgttcctgatgcttctgcggcgcttccggagcagatattggtccccaggtaggggcgggcgcggggctcaggaagtggcgtccactcttgcatcctcccctccctcccacttttgtccccatcctatgtcactgtctcttagtcagccaggccctgcccccagtccagctctcacagcaccacctcccgcttatgccaccctgggacctcgcccgagcccaggtggaagcgccggggctagctcatctacgtgtcccctaggcggcccctag

SEQ ID NO: 30090 - DNA, 477 bp, Artificial Sequence
  Description of Artificial Sequence: Synthetic coding sequence
atggtgcctcacgcaatcttggcccgcggaagagatgtatgtaggcgcaacggtctgctaatcctcagcgtcctaagtgttattgtgggatgtctattgggctttttcctgagaactcgcaggctatccccccaggaaatttcctacttccaattcccaggcgaacttctgatgcgaatgttgaaaatgatgatcctaccgctggtggtatcaagccttatgtctgggctggcaagcttggacgccaagacgagttcccgcctgggggtgttgaccgtggcctactatttgtggaccacttttatggccgtcattgtgggtattttcatggtgagcatcatccaccctggcagcgcagctcaaaaagagactaccgagcagagcgggaaaccaatcatgtcaagcgctgatgcgctgttagaccttatccggcagaaggaggagagctggagaaacggccccaaaggtcctggatag

SEQ ID NO: 30091 - DNA, 1683 bp, Artificial Sequence
  Description of Artificial Sequence: Synthetic coding sequence
atggtccctcacgcaattctcgcacgagggagagatgtttgtagacgaaacggtctgctgattttatccgtactgagcgtaattgtgggctgccttctgggcttcttcctgcggacacgcagactcagtccgcaggagatctcttactttcaatttcctggagagctgctcatgcgcatgttgaagatgatgatactcccgctggtggtgagctccctgatgagcgggttagctagtcttgatgccaagacgtcgagccgattgggggtgctgaccgtggcttactacctgtggacaacatttatggctgttatcgtcgggattttcatggttagcatcattcacccagggagcgctgcgcagaaggagacaaccgaacagagcggtaaaccaatcatgagttccgcagatgcactcctggacttgatacggaacatgtttcctgctaacctcgtagaagccactttcaagcagtacagaacaaagactacccctgtggtgaagtctccaaaggtggcccccgaagaagcgccaccacggaggattcttatctacggagttcaggaagagaacgggagtcacgtgcagaattttgctttggatctgacaccccctccagaggtggtttacaagagcgagcctggcacatcggatggaatgaacgtgctgggtattgtcttcttttccgccacaatgggtatcatgctaggacgcatgggagacagcggcgcacccctggtgtcattctgtcaatgcctcaacgagagtgtgatgaagatcgtggctgtagccgtttggtattttccctttgggatagtgtttctgatagccggcaagatattagagatggatgatccccgagctgtcgggaagaagcttgggttttactccgttactgttgtgtgcggtctggttctgcacggcttgttcattttgcctctgctgtactttttcatcactaaaaagaacccaatcgtgttcatacgtggcattctgcaggctctcctgattgccctggcaactagttcatcttccgccacactacctataacattcaagtgtctgctggaaaataatcatatcgatcgtagaatcgcccgattcgttcttccagtgggagcaaccatcaacatggatggcaccgccctatacgaggcagtggcggccatcttcattgcacaggttaataattacgagcttgactttggacagatcatcactatatcaatcactgcaaccgcagccagtattggcgcggctggtatcccccaagccggcctggtcaccatggtgatcgtgctaacgagtgtaggccttccgacggatgatatcacacttatcatcgctgtggactgggcactggatcgcttccggacaatgatcaacgtgctgggcgatgccctggctgcagggattatggcgcacatatgccgaaaggattttgctcgggacacaggaacagaaaaactcctgccttgtgagacaaagcccgttagtttacaggaaatcgtcgcagcccagcagaatggctgtgttaaaagcgtggccgaagcctccgagctcacgctgggtcccacatgtcctcatcatgtgcctgttcaggtcgaacaggatgaggaactgccagccgcttctctgaaccattgcactattcagatttctgagctggagactaacgtgtag

SEQ ID NO: 30092 - DNA, 729 bp, Artificial Sequence
  Description of Artificial Sequence: Synthetic coding sequence
atgtccaaccccaggtctctcgaggaggaaaagtacgatatgagcggggccagactggctctgattctttgcgtaacaaaagctagagagggttctgaagaggacttggacgcactcgagcacatgtttagacaactccggttcgagtccacaatgaagagggatccaacagctgaacagtttcaggaggaattggaaaaatttcagcaggcaatcgacagtcgcgaagatccggttagctgcgcgttcgttgtactgatggcccacggccgggaaggctttctgaaaggagaggatggcgaaatggtaaaactggaaaacctgtttgaagctctgaacaacaaaaattgtcaggctcttagagctaagcctaaggtgtacatcattcaagcatgtcgcggggagcagcgggacccaggcgagactgtaggcggcgacgagattgttatggtgatcaaggactcccctcagacgatccctacctatactgatgcactgcacgtgtattccacagtcgaaggctacatcgcatatcggcacgatcaaaagggaagctgctttatccagacgttagtggacgtgttcactaagaggaaggggcacattctcgagctcctgactgaggtgactagaaggatggccgaagcggagctcgtgcaggaaggcaaggcacgcaagacaaaccccgagatccagagcacgctgagaaaacgcctgtatctacagtag

SEQ ID NO: 30093 - DNA, 1503 bp, Artificial Sequence
  Description of Artificial Sequence: Synthetic coding sequence
atgagcatcgaccacgaacagccctggcagcagccggttcctgctggtgaacgccccgccgcaggcccagggggtcttgctgcagccgcagccggaaaaccagccgctgagagcaccgcacatgcccccgctcctgccgaccatgacccaagagcacgtgctgccctgcctgcaccaaagcgattgcactctgccgatggacaacggaggggtcattggggacaaccagggctatgtcctgctccaatctccgcacatctccctccagaccaggtcctcctattctcatggagggcctcagatgaagacgccgcagatgccggtgtgacttcccactgcctccaacctggccacaggaacatgttcccccctaacctcgtggaggcttgttttaagcagttcaaaactcagtattcaacccgggtggtgactaggacaatggtcaggaccgaaaacggtagtgaacctggcgctagcatgccaccaccgtttagcgtcgaaaatggtacatccttcttagaaaacgtcacccgcgccctgggcaccttacaagagatgctctcattcgaggagactgtgcccgtgccggggtcagcaaatgggataaatgccctgggcctggtggtgtttagtgtggctttcggcctcgtcatcggtggcatgaaacacaaaggacgcgtgctgagggactttttcgattccttaaatgaggctatcatgaggctagtgggcattattatctggtacgcccctgtgggaatcctatttcttatcgccggaaaaatccttgagatggaagacatggcggtcctgggcggacagctagggatgtacactctcactgtcattgtgggcctgtttctgcatgctggaattgttctgcctttgatctactttctcgtgacccacaggaaccccttccctttcattggagggatgctccaagctctcattaccgcaatggggacgagctctagcagtgcaaccctccctattaccttccgatgtctggaggaagggctgggagtcgaccgacgaatcactcgcttcgtgcttcctgttggagccacagttaatatggacggcacggctctgtatgaagcccttgcggcgatcttcatcgcccaggtgaataactatgaactgaatctgggacaaatcaccacaatttccatcacagccacagccgcgtcagttggcgccgccggtatccctcaggcaggtctggtgaccatggtgatcgtcctcacctccgtcggcctgccaaccgaagacattactcttatcattgcagtcgattggttcttagacagactgcgcaccatgaccaatgttctcggggatagcatcggtgccgcggtaatcgaacacctctcccagagagaactcgagctacaagaggccgaactgacactgccttccctgggcaaaccatataagtcgctcatggcccaagagaaaggggcctcccgcggcagaggcggaaacgaatccgccatgtag

SEQ ID NO: 30094 - DNA, 618 bp, Artificial Sequence
  Description of Artificial Sequence: Synthetic coding sequence
acgatgagttcgcacgggaatagcctgttcttaagggaaagtggtcagcgccttggcagagtaggatggctgcaacggctgcaggagagccttcagcaaagggccttgagaactcggctgcgcttacagacaatgacgttagaacatgttctgaggttcctgcgtcggaatgcatttatcctactgaccgtctcagctgtcgtgattggggtgagcctggcttttgccctcaggccttaccagctaacctataggcaaatcaagtacttttctttccccggagaattgctgatgcggatgctgcagatgctagtgctccccctcattgttagtagcctagtgacagggatggcctctctggacaacaaagctacaggccgtatggggatgagggccgcagtgtattatatggtgactaccatcatcgctgtctttatcggtatcctgatggtgactattattcatcctgggaagggcagcaaagagggcttgcacagagaaggaaggatcgagacgatacccaccgccgacgcctttatggatcttataagaaatatgtttcccccgaacctggtggaggcctgtttcaagcaggtgcggggaaaatacaccgtatag

SEQ ID NO: 30095 - DNA, 939 bp, Artificial Sequence
  Description of Artificial Sequence: Synthetic coding sequence
atgtcttctcacggtaattccctgtttctcagggagagtgggcagaggctcggacgtgttggatggcttcagaggttgcaggaaagcctgcaacagagagctctgcgcacgagactgaggttgcaaacgatgaccctggagcacgtactaaggttcctacgcagaaacgctttcatcctgctgaccgtctcagcagtggtaataggcgtgagcctcgcttttgcactacggccgtatcaactaacctatcgacagatcaagtactttagcttccctggcgagctcctgatgcggatgcttcagatgcttgtcctgccccttattgtgtccagtcttgttacaggcatggcttcactggacaacaaagccacgggccgaatggggatgagggctgccgtgtattacatggtgactacgatcattgccgtatttatagggattctaatggtgacaatcatacaccccggaaaaggctcaaaggaaggcctccacagggagggccggattgaaactattccaaccgctgatgctttcatggacctcattcggaacatgtttccccccaacctcgtggaagcatgtttcaagcagttcaagacccagtattctactcgcgtggtgactaggacaatggtgcgcaccgagaacggatcggaaccaggtgcatctatgcctcctcctttttccgttgagaacggaacctctttcctggaaaacgtcacccgggccctcggtactttgcaagaaatgttatccttcgaagagacagtccccgtccctggatcggccaatggtatcaatgcactggggttagtagtcttctctgttgcctttggcctcgtgatcgggggaatgaaacacaagggtagagtattaagggatttctttgactcgctcaacgaagcaatcatgcgccttgtgggtatcattatttggtag

SEQ ID NO: 30096 - DNA, 1317 bp, Artificial Sequence
  Description of Artificial Sequence: Synthetic coding sequence
atgattcggaaactattcatcgtcctgctccttctgctcgtgactattgaagaggctcggatgtcttcccttagcttcctcaatatcgaaaaaactgaaatcctgttttttacaaagacggaggaaaccatcctggtaagctcttcttacgagaacaagagaccaaacagtagccacctgttcgtgaagattgaagaccctaaaatcctgcagatggtgaacgtggctaagaaaatttccagcgatgcaaccaattttaccatcaatctggttaccgatgaagaaggggagacaaatgtgacaattcagctatgggactcagaggggagacaggagaggctcattgaagagataaagaatgtcaaggttaaagtgcttaagcagaaagattcgcttctacaggcgcccatgcatatagacaggaatatcctgatgttaattctgcccttaattttgctgaataagtgcgccttcggttgcaaaatcgaactgcagctgtttcagacagtgtggaagcggcctctacccgtgatcctgggcgccgtgacacagtttttcctgatgcccttttgcgggtttctactgtcccaaatcgtcgccctgcctgaggcacaggccttcggtgttgtgatgacatgtacttgccctggaggaggggggggctatctcttcgccctcttactggacggcgattttaccttagctatcttgatgacctgtacaagtaccctgctggcactcataatgatgccagtgaactcctatatttattcccggattctaggcttaagcggaacattccacatccctgtcagtaaaatcgtctctactctgttattcatcctcgtcccagtcagcattggcattgtgattaaacacagaatcccagagaaggcctctttcctggaacggatcatccgaccattaagcttcatccttatgtttgtaggcatttacttgaccttcacagtcggcctggtctttctgaaaacggacaacttggaagtcatcctgctcggccttctagtgcctgccctgggcttgctatttggctattcctttgcaaaggtatgcacgttgccactaccagtgtgcaaaacagtggctatcgaatcagggatgctgaattcattcctggccttagcggtgatacagctctccttcccacagtctaaggcgaatctagccagcgtcgcacccttcactgtagctatgtgttcaggctgtgaaatgctgttaatcatactcgtgtacaaggctaagaagcggtgcattttcttcctacaagacaaaaggaagcgaaatttcctgatctag

SEQ ID NO: 30097 - DNA, 258 bp, Artificial Sequence
  Description of Artificial Sequence: Synthetic coding sequence
atgcgcctcttggaaaggatgaggaaggattggttcatggtgggcatagtactagctatcgcaggtgccaaattggaacccagcatcggggtcaatggcgggccactgaaaccggagattaccgtgtcctacatcgctgtagccacaattttcttcaacagcgggctttccctcaagacagaatttgctgacagtcgcctccacgcctcagcttgtgtgttctgcagtgacttcaaccagggaagctggtggaaatag

SEQ ID NO: 30098 - DNA, 1023 bp, Artificial Sequence
  Description of Artificial Sequence: Synthetic coding sequence
atgcgtctcctagaaagaatgcgcaaggactggtttatggtgggcatcgtgttagccattgccggagccaagcttgaaccaagtattggtgtcaatggcggcccccttaaacccgaaatcaccgtcagttacatcgcagtggccaccatctttttcaattcaggcctcagcttgaaaaccgaggaactgacctctgctctggtgcacctgaaactgcacctattcattcagatcttcacactggcttttttcccggctaccatctggctcttcctccagctgttgtccataacacctatcaatgagtggttgcttaagggcttacagacagtcggttgtatgcctccgcccgtttcctccgctgtgatacttaccaaggcggtgggcggcaatgaagccgcggcaatcttcaactccgccttcggaagctttctggggatcgtcataacccctctactgcttctacttttcctagggagctcatcctcggtcccatttacctctatattctctcaactgttcatgacagttgtcgtgccgctgatcatcggccagattgtgcgtcggtatattaaagattggctggagagaaagaaacctccgttcggagccattagcagcagtgtgttactgatgataatttacactactttctgtgatacttttagtaaccccaacatagacctcgataagttctctctggtactcatactattcataatcttctccatccagttgtcatttatgttgctaaccttcattttcagtacgcgaaataattctggctttactcctgccgacaccgtggctatcattttctgttcaacccacaagtctctaacattggggattcctatgctgaaaatcgtgttcgctggtcatgagcacctgtctctgatttccgtgcccctgctcatctatcaccccgcccagatactgctgggcagtgtactcgtccccactatcaaaagttggatggtcagtcgtcagaaaggggttaagctgaccagacctaccgtatag

SEQ ID NO: 30099 - DNA, 480 bp, Artificial Sequence
  Description of Artificial Sequence: Synthetic coding sequence
atgcgtttgctggaaagaatgcgcaaagactggttcatggtgggaatcgtgctcgctattgccggcgcgaagttagaaccgtccataggggtcaacggcgggcctcttaagccagagattacagtgtcttatattgccgtggctactattttttttaattctggactatctcttaagaccgaagagctgacctcagcactggtgcacctcaaactccacttgttcatccagatcttcactctcgcttttttcccggccactatctggctgttcctacagcttctctccatcactccaattaacgaatggttgttgaaaggactccagaccgtggggtgtatgccacctccagtaagctctgcggtgattcttaccaaggcagtgggcggcaatgaggcggccgccatcttcaattctgctttcggatcctttttggtatccaagcatagtttgacctgtctgttgcaactcctattgtag

SEQ ID NO: 30100 - DNA, 1077 bp, Artificial Sequence
  Description of Artificial Sequence: Synthetic coding sequence
atgcggttgctcgagcgaatgcggaaagactggttcatggtgggaatcgtgcttgccatcgcgggagccaaactggaaccatcaataggggtcaatggaggacccctgaagccagagatcacagtgagctatatagccgtagctacaatcttcttcaactctggattaagtctgaaaactgaagaactcactagcgctttagtgcatctgaaactccacctgttcatccagattttcacactagcattcttccctgcgaccatatggctcttcctgcagttgttaagcataacacccatcaatgagtggctgctgaaaggattgcagaccgtcggctgtatgcccccgcctgtcagctccgcggtgattctgaccaaagcagtgggggggaacgaagctgcagcaattttcaactctgcttttggctctttcctgggcatcgtcattacccccctgttattgctgctgtttctgggctcttccagttctgtgccatttacctcaatattcagtcagctattcatgaccgtcgtcgtcccactgattattggccaaatcgtgaggagatatattaaggattggctcgagaggaagaagccacctttcggagcaatctctagctcggtgctgcttatgatcatttatacaactttttgtgataccttctccaacccgaatattgatcttgataagttcagcctggtgctaatcctgttcatcatcttttcaattcagctgtcattcatgctgctgaccttcatcttctccacacgcaataactccgggttcactccggcagataccgtggccatcattttttgttccacacataaatcgctaacgctagggatacccatgctgaagatagttttcgcaggacatgaacacctttcattgataagtgtacctttgctcatttaccaccctgcccagatcctgctgggaagcgtgctcgtgccgacaatcaagagctggatggtttctaggcagaagaagctgctacaaacaagaggcccactcgcaaacttgaataatcctgaaggcctggagtacctctcaatcaagttcggacactag

SEQ ID NO: 30101 - DNA, 984 bp, Artificial Sequence
  Description of Artificial Sequence: Synthetic coding sequence
atgcgccttcttgaaagaatgcggaaagactggtttatggtggggattgtgctcgccattgcgggagccaaactcgagccaagcattggcgttaacggtgggcccctgaaaccagaaatcacagtgagttatatagccgttgctaccattttctttaattctggcttgagcctgaagacggaagaattaacttcagcacttgttcatctgaaactccacctttttatacaaatcttcactctggcatttttcccggccactatctggctgtttctccaactgctgtccatcactcctataaacgagtggctgcttaagggtctgcaaacagtggggtgcatgcctccacctgttagttccgctgttattttaaccaaggcggttggaggaaacgagggcatcgtgataactccactgttgctgctcctgttcctcgggtcctctagctctgtccctttcacaagtatattctcccagctgttcatgacagttgtggtacccctaataatcgggcagattgtgcgtagatatattaaggactggcttgagagaaagaagccacctttcggagcaatctcttcgtcagtccttcttatgattatttatacgaccttttgtgatacattcagcaaccctaatattgatctagacaagttctcactggtgcttatcttgtttatcatcttctcgatccaactgagctttatgctgctaaccttcatcttcagcaccaggaacaattcgggttttacgcctgcagacacggtggctatcatcttctgttccacccataagtccttaaccctgggaattccaatgctgaagatcgttttcgctggccatgagcatctgtctttaatctccgttccgctactaatctatcatcctgcgcagattctgcttgggtcagtgcttgtgcctacgatcaagagttggatggtctcccgtcaaaaaggggtcaagctcacacggccgacagtctag

SEQ ID NO: 30102 - DNA, 195 bp, Artificial Sequence
  Description of Artificial Sequence: Synthetic coding sequence
atgcgactgctggaacgcatgcgcaaagattggttcatggtcggaatcgtgctggcaatcgcaggtgccaagctcgaaccgagtatcggcgtgaacggtgggccactgaagccagaaatcaccgtgtcatacatcgctgtcgcaactatcttttttaacagcgggctcagtctgaaaacagagcttttgacgtag

SEQ ID NO: 30103 - DNA, 1077 bp, Artificial Sequence
  Description of Artificial Sequence: Synthetic coding sequence
atgcggcttttggaaagaatgaggaaggattggttcatggtgggcatcgtgctagcgatagccggggccaagctcgagccctccataggtgtgaatgggggacccctcaaacccgaaataacagtaagttacatcgccgttgcaacaattttctttaattccggcctcagcctgaagaccgaagagctgacgagtgctcttgtgcatttgaagcttcatctatttatccagattttcacccttgcttttttcccagccaccatttggttgttcttgcaacttctttcaattacacccatcaacgaatggttactgaaggggctgcagactgttggttgcatgccgcctccagtgtccagtgcggtgattttgacaaaggcagtaggtggtaatgaagccgcggccattttcaactcggctttcggcagtttcctggggatagtgattacaccattactgttactgctgttcctgggtagttcatcctcagtgcctttcacttctatcttctctcagttattcatgaccgttgtcgtccctcttatcatcggacagattgtgaggcgctacattaaagactggcttgagcgcaaaaaaccacccttcggcgcaatctcaagcagcgtgctgctgatgatcatctacactacgttttgcgacacattcagcaaccccaacattgaccttgacaaattctctttggtactgatcctgttcatcatcttctccatccagttgagtttcatgctgctgacctttatcttcagtaccagaaataatagcggtttcacaccagccgatacggtggccatcatcttctgcagtacccacaagtccctcaccctcggcattcccatgctgaaaatagtgttcgccgggcacgagcacctcagtctaatctccgtgcctctcctaatctatcatcccgcccagattttgctgggtagtgtcctggtgcctacaattaagtcctggatggttagcagacaaaaaaaactgctgcagacacgcggtcccctggcgaacctgaacaaccctgagggattggaataccttagcatcaaattcggccactag

SEQ ID NO: 30104 - DNA, 1707 bp, Artificial Sequence
  Description of Artificial Sequence: Synthetic coding sequence
atggtactgggccccgagcaaaagatgtccgatgactctgtatcaggggatcacggcgaatctgcttccctgggcaatatcaatcctgcttactcaaaccctagccttagccagtcaccgggcgattcggaggagtacttcgctacgtacttcaacgaaaaaatctctatcccggaggaagagtactcttgcttctcattccggaaactttgggccttcactggaccaggttttttgatgtccatagcatatctcgatcccgggaacattgagtcagatttgcaatccggggccgtggccggctttaaactgctgtggatactgctgcttgcgaccctagttgggctgttgcttcaacggttggcagcccgcctcggggttgtcacaggactccatctcgctgaggtttgtcatcggcagtacccaaaagtcccgagggtaattctgtggttgatggtggagttagccatcattggctctgatatgcaggaagtcattggatccgcaatcgctattaatctcctgtctgtgggccgtatacccctctggggtggggtcttaatcacaatagccgataccttcgtgttcctgttcctggataagtacggtctccgcaaacttgaggcatttttcggattcttgattacgattatggccttaacttttggatatgagtacgtcacagttaagccatcacagagtcaggtactaaaaggcatgtttgtgccaagctgttccggatgcagaacaccccagatcgaacaggcagtcggcatcgtgggcgccgtgatcatgccccataacatgtatctgcacagcgcacttgtaaaatcccgccaggtaaaccgcaacaacaaacaggaggtgagggaggctaacaaatacttttttattgagagctgcatcgcactttttgtgtcatttatcattaatgtattcgttgtgagtgtcttcgcagaagcattcttcggtaagactaacgagcaagtggtggaggtatgcacgaatacctcctctccgcacgctggcctcttcccaaaggacaactccactctcgccgtggatatttacaaggggggtgtggtgctgggatgttatttcggaccagctgccctgtacatttgggcggtggggatccttgcagccgggcaaagttcgactatgacaggtacgtattcaggccagtttgtgatggaggggttcctgaatctgaagtggagccggttcgcccgggttgtactgacacggtccatagctataatccccacattactcgtggctgtgttccaagacgtcgaacaccttaccggaatgaacgattttctcaacgtgctccaatcccttcagctgccctttgcacttatccccatacttacttttacgagtctgcgcccggtgatgtctgactttgcaaatggcttgggatggcgcatagctggtggtattttagtgctgataatttgttcaatcaacatgtacttcgtggtggtgtacgttcgagatttaggacatgtggctttatacgtcgtggcggcggtggtatccgtcgcctatctcggattcgtcttttatctgggatggcagtgcctaattgctctgggtatgtccttcctagattgtggccacacttgtcatctggggctcaccgctcagcctgagttatacctcctgaatacaatggacgcagacagtcttgtgagccgctag

SEQ ID NO: 30105 - DNA, 1686 bp, Artificial Sequence
  Description of Artificial Sequence: Synthetic coding sequence
atggtactaggcccggagcaaaagatgtctgatgacagcgtctcaggtgatcatggcgagtccgccagcctggggaatattaatcccgcctacagcaacccctccctctcacagagtcctggggacagcgaggaatattttgctacatactttaatgaaaagattagtattccggaagaagaatatagctgtttttcctttagaaaactctgggcttttactggccctggtttcctgatgagcatcgcatacctggatcccggcaacattgagagcgacctgcagtccggggccgtggccggcttcaaactcctttggatcctcctcttggcaacgcttgttgggctgctgctgcaacgcctggccgcccgcctcggcgtggtgaccggcttacacctagccgaggtttgccacagacagtaccccaaggtgccacgggtgattctgtggttgatggtggagttggcgatcattgggagcgacatgcaggaggtgatcgggtctgctattgcaattaaccttctgtcagttggccggatccctctgtgggggggggtgctcatcactatcgccgacactttcgtgtttctgttcttggacaagtacgggttgcggaagctagaagcctttttcggatttctcattacaataatggcgctgacgtttggttatgagtatgtgactgtcaagccatcacagtctcaggtactcaaggggatgttcgttccctcgtgttcaggatgccgcactcctcaaatcgagcaggccgtcggtattgtgggagccgtgatcatgccccacaacatgtacctgcactcagccctggtcaagagccgccaggtaaacaggaacaataaacaggaagtgcgcgaggccaataaatatttctttatcgaatcctgcatcgctctattcgtcagctttatcattaacgtgttcgtggtcagcgtgttcgccgaagcgttttttggcaaaactaacgagcaggtcgtggaggtctgtacaaacaccagctctccgcacgctggactgtttcccaaagataattctacactcgctgtggatatctacaaaggcggagtcgtgttaggctgctacttcggccccgcagctctgtacatctgggccgtcggcatactggccgccggacagtcttcaacgatgacaggaacttacagtggccagttcgtgatggaggggtttttgaatctcaaatggtcccggtttgcccgggtcgtactcacccggtccatcgccattatccctacattactcgtggccgtgtttcaggacgtggagcacctcactggaatgaacgattttctcaacgtccttcaaagcctgcaattgccattcgctctgatccccattctgacattcacttcacttaggcccgttatgtcagattttgcaaatggtctcggctggagaattgctggaggcattctcgtattaataatttgcagcataaatatgtatttcgtagtggtctatgttagggacctgggtcacgtggccctgtacgttgtggcagccgtcgtcagcgtggcctacctcggatttgtgttctacttagggtggcagtgcctgatagctttgggaatgagcttccttgactgcggccataccgtctctatctctaagggattgttgacagaggaagcaacaagagggtacgtcaaatag

SEQ ID NO: 30106 - DNA, 1773 bp, Artificial Sequence
  Description of Artificial Sequence: Synthetic coding sequence
atgcggaaaaagcaattgaagaccgaggctgcaccacactgcgaacttaaatcgtacagcaaaaacagcgctacccaggtttccactatggtgctcgggcctgagcagaagatgtcagacgatagtgtttctggggatcacggggagtccgccagcctcggtaatatcaacccagcatatagcaatcccagcctctcacagtctccaggcgacagtgaagaatacttcgccacttatttcaacgaaaagataagtatccctgaagaagaatacagctgtttctcctttagaaagttatgggctttcacagggcccggctttctaatgagcattgcttacctggatccgggaaatatcgaatctgatcttcagtccggggccgtggccgggtttaagctgctctggattcttctgctcgccacactggtaggtcttcttttacagcggctcgcagcccgacttggcgtggttaccgggctgcatcttgccgaagtttgtcatagacaatacccaaaggtcccacgcgtgattctctggctaatggtagaacttgccatcattggcagcgacatgcaggaggttataggctcagccatagctattaatctactttccgttggcagaatcccgctgtggggtggggtgcttattaccattgcagatacttttgtgttcttatttttggacaagtacgggttgcgaaagctggaggctttttttggttttctgattactatcatggccttaacgttcggatatgaatatgtgactgtaaagccgtcacagagccaggtcctcaaggggatgttcgttccaagctgttctgggtgtagaaccccccagatcgaacaggccgtaggaattgtgggggccgtgatcatgcctcacaatatgtatctccatagtgctcttgtaaaaagccgtcaggtgaacagaaacaacaagcaagaagttcgcgaggccaacaaatacttttttatagagagctgcattgccctcttcgtgtcctttattatcaacgtcttcgtggtgtcagtgttcgccgaagcattcttcgggaaaaccaacgaacaagtcgtggaagtctgcaccaacaccagtagtcctcatgcaggcctcttccccaaagacaattccacgctagcggtcgacatctacaagggaggcgtggtcctcggctgttacttcgggcccgcagccctttacatttgggctgttggaatactggctgctggccagagctcaactatgacggggacctacagcggacagttcgtgatggagggctttttgaaccttaagtggagtcggtttgctagagtggttctgactcgcagcatcgccattatcccaaccctgctggtcgcagtctttcaggacgtcgaacatctgactgggatgaatgatttcttgaatgtgctgcagtccctgcagctgcccttcgccctcattcctatcctcacctttacgtctctacgacccgtcatgtccgatttcgctaacgggttaggctggaggatagcaggaggaatactggtcctcataatttgttctataaatatgtattttgtggtggtgtatgtacgtgatctcggccacgttgccctgtacgtcgtcgctgctgtcgtaagtgtggcctacctggggtttgttttttacctgggctggcagtgtctcatcgccctgggtatgtcctttctagactgcggtcacaccgtttccatttccaagggcctgctcaccgaggaggcaaccagaggctacgtgaagtag

SEQ ID NO: 30107 - DNA, 1686 bp, Artificial Sequence
  Description of Artificial Sequence: Synthetic coding sequence
atggtgctaggccccgaacagaagatgagtgacgacagcgtgagtggagatcacggcgaatctgcgtctctgggcaacattaatccagcctatagcaacccctcactcagccagtctccgggtgactctgaggaatatttcgcaacctattttaatgaaaaaatctccattccagaagaagagtactcctgtttttcctttagaaaattatgggcatttaccggtcctggcttcttaatgagcatagcatacctggaccctggcaatatagagtccgatttacagtctggggctgtcgctggatttaaactcctctggatcctgcttttagccactcttgtcggtttgctgttacagaggctagcggcacgattgggcgtcgtaactggcctgcatctcgctgaagtgtgccatcgtcagtatccaaaagttcctcgggtaatcctatggttgatggtggaattagctatcatcggcagcgacatgcaggaagttattggctctgccattgccataaatctgctgtcggtagggcgcatccccttgtggggaggagtgctgataaccatcgcggacactttcgtattcctatttcttgacaagtatggactaaggaagctcgaggctttcttcgggttcctgattacaattatggctctgactttcggctatgagtacgtaacggtaaagccatcacaatcccaggtgcttaagggcatgtttgtgccctcctgctctggatgtcgcacacctcagatcgaacaggctgtggggattgtaggagcagtgattatgccccacaatatgtacctccacagtgctctggtgaagtcccgccaggtgaatagaaacaacaaacaagaggtgcgggaagctaacaaatacttctttatcgagagttgcattgccctcttcgtctcgttcattatcaacgtgtttgtggtgagtgtgtttgctgaggcgtttttcgggaaaacaaatgaacaggttgttgaggtctgtacaaacacctcaagtcctcatgccggccttttccccaaggacaacagtacacttgctgtagatatatataaaggcggcgttgttcttggatgttacttcggacctgctgcattgtacatatgggcggttgggatactggccgctgggcaaagctcaaccatgactgggacctactccgggcaatttgtcatggaggggttcttgaacctgaaatggagcagatttgcgagagttgtgctcacaaggagtatagcgataattccgaccctcctggttgctgtctttcaggatgttgagcacctgacaggcatgaacgattttctgaatgtgctgcagtccctccagctgccgtttgctctgatcccaattctgacgttcacatcactaagacctgtcatgagcgattttgccaacggccttggctggaggattgcagggggtatcctggtgctgattatctgcagcatcaacatgtactttgtggtcgtttatgtccgggatcttggccatgtcgcactttatgttgtcgctgccgtggtgagcgttgcttaccttggattcgtattctatctaggctggcaatgtttaatcgccctgggaatgtccttcctggactgtggccacaccgtaagtatcagcaagggcctgctcacagaggaggccaccagaggctacgtgaagtag

SEQ ID NO: 30108 - DNA, 1674 bp, Artificial Sequence
  Description of Artificial Sequence: Synthetic coding sequence
atgtcaacggtagattacctcaacagcgtttccggggatcacggagagtcagcatccctcggtaatatcaacccagcttactctaaccctagcctgtctcagagccctggcgatagtgaggagtactttgccacatacttcaacgagaaaattagtatccctgaggaggaatattcatgtttttcttttcgaaagctgtgggccttcactggccctggattcctgatgtccatcgcttacctcgaccccggaaatattgaatcagatctgcagtccggggccgtggccggattcaaactcttatggattctgctactcgcaacgctggtgggcctcctgttgcaacgcttggcggcccgcctgggcgtagtgacaggcttgcacctggccgaggtctgccaccggcagtacccaaaagtaccccgagttatcctctggctcatggtggaactagccatcattgggtccgatatgcaggaggtaatcggaagtgcgatcgccatcaatcttctctccgtcgggcgcatcccactgtggggcggtgttctaattacaattgcggatacattcgtgttcctcttcctggacaagtacggactacgaaaattggaagcattttttggttttctgatcacaatcatggctctgacatttggctacgagtacgtgactgtgaaaccctcccagtctcaggttctaaagggaatgtttgttccatcatgcagcggatgcaggactccccaaatcgaacaggccgtggggatagtgggtgcggtgatcatgccccataacatgtacttacattcagctttagtgaagagccgccaggttaataggaacaataaacaggaagttagagaagccaataagtatttctttattgagagctgtatagcactgttcgtctcattcattattaacgtcttcgtagtgagcgtcttcgctgaagcgttcttcggcaaaactaatgagcaggtagtggaagtgtgtacaaataccagctcgccacacgctggactgtttccaaaggataacagcaccctggctgttgacatctataaggggggcgtagtcctaggatgctattttggaccagccgctctttacatttgggccgtagggattctggcagcagggcaatctagtacaatgacaggaacatacagcgggcagttcgtaatggaaggattcctaaatctgaagtggtcccgcttcgctcgggtggtgctgacaagatccattgcaattatccctaccctgctggtcgcagtgtttcaggacgtcgagcacctgacaggaatgaatgatttcctcaacgtgctgcagagtctccaactgccgttcgctttgatccccattctgactttcactagtcttcgtccagtgatgagcgactttgcgaacggcctggggtggaggattgccggcggtatcctggtattaatcatctgtagtataaacatgtacttcgtggtggtctacgtcagggacctgggacacgtcgcactctatgtggttgccgctgtagtgtcggtagcctatttggggtttgtcttctacctcggatggcagtgtttaatagctttggggatgtccttcttagattgtggccataccgtgtcaatcagcaagggcctattaactgaggaggctacacgtgggtatgtcaagtag

SEQ ID NO: 30109 - DNA, 1707 bp, Artificial Sequence
  Description of Artificial Sequence: Synthetic coding sequence
atggtgttaggtcccgaacagaagatgtcagatgactccgtgagcggggaccatggagaaagtgcatcactcggcaatatcaaccccgcatatagcaacccaagtctgtcccagagtcctggagacagtgaggagtattttgccacttacttcaacgaaaagatctccataccagaagaggagtattcttgtttcagtttcagaaagctgtgggcctttacgggccccggattcctgatgtccatcgcatacctggaccctggaaacatcgagtccgacttacagtccggggctgtcgccgggtttaaactgctgtggatcctgctcttggccacactcgttggcttactgctgcagcggttggccgccaggctgggcgttgtgaccgggcttcatttggctgaggtctgccataggcaatatcctaaagtgcctcgagtgatcctttggctgatggtggagctggcaattatcggttcggatatgcaagaggtgattggcagcgccatcgctattaatttactgtccgttgggcggattcctctgtgggggggagtgttgataacaatcgccgatacattcgtgttcctctttcttgataagtacggcctgaggaagctggaagcctttttcgggtttttaattacgatcatggccctgaccttcggatacgaatacgtgaccgtgaaaccctcccagtctcaagtcctcaagggcatgttcgtgccttcctgctccggatgccgcactccccaaatcgagcaggccgtaggaattgtgggagcagtcataatgcctcataatatgtacttacactctgcactggttaagagtaggcaagtgaatagaaacaacaagcaggaggtccgggaagccaataagtactttttcatcgaatcttgtatagcactgttcgtgtcatttattattaacgtctttgtcgtgtcggtgtttgccgaagcattttttggcaagaccaatgaacaagtcgtggaggtgtgtaccaacaccagcagcccacatgccggcctgttcccaaaggacaattcgacactggcagtcgatatatataagggtggagtcgtgctggggtgctatttcggcccggcagccctgtatatttgggctgttgggatccttgccgctggccagtcaagtacgatgacaggaacttactccggtcagttcgtgatggaaggattcttaaatctgaagtggtcaaggtttgccagagtggtcctaacgcgaagcattgcgattataccaactctccttgtcgccgtgttccaggatgtggaacacctaaccggtatgaatgatttcctcaatgtcctccagtcactgcaactgccgttcgccctcatccccatcctcactttcacctcgcttaggccagttatgtctgatttcgcgaacggcctgggttggcgcatcgcgggcgggatactggtactgatcatctgttccattaacatgtacttcgtggtagtctacgtgcgggacttaggccatgtggcgttgtacgtggtcgctgccgtggtctccgtcgcatatttgggattcgttttctatctgggatggcaatgcttgatcgctttgggaatgtcgttcttggactgcggtcatacttgtcatctcggactgaccgcccaacccgaattgtatttgctcaataccatggacgcagatagtctagtctctcggtag

SEQ ID NO: 30110 - DNA, 1449 bp, Artificial Sequence
  Description of Artificial Sequence: Synthetic coding sequence
atgtcgatagcttatttggatccgggaaatatcgaaagcgacctgcagtccggcgccgtggctggttttaaactcctttggatactcctcctggccacactagtcgggctgctgctacagagactggcagcaaggcttggggtggtcactggccttcatctcgcagaggtgtgccaccgacagtacccaaaggtgccacgcgtgatcctttggctgatggtcgagctcgccataatcgggtcagatatgcaggaggtcattggcagcgccattgcaatcaatctgctgtccgtggggcgaattcccctctggggaggtgtgctcatcacaatcgctgatacttttgtatttctctttctggataagtacggcctgcgcaagctggaggcattcttcggattcctcatcactattatggccctcacttttgggtatgaatatgtgacagtcaagccctcccagagccaggtgttgaagggcatgttcgtaccgtcctgctctggctgtcgcactccccagattgagcaggctgtaggcatcgtgggcgcggtaataatgccgcataacatgtatctgcacagcgctcttgtgaagagtcgacaagtcaaccgcaataacaagcaagaggtgcgtgaggctaacaaatattttttcatcgaatcctgtatcgctctcttcgtgtctttcatcatcaatgtctttgtggtgtcagtcttcgcagaggcttttttcggtaagactaacgaacaggttgtcgaggtctgtactaacacaagctctccccatgcggggctgttccccaaggataatagtaccctggctgtggatatatacaaaggtggagtcgtactcggctgttacttcggcccagccgctctgtatatttgggctgtggggatattagctgccggccagtcttccacaatgaccgggacctactccggacaatttgttatggaggggttcctcaatctgaaatggtctcggttcgccagggtcgtcctgacccggtccatcgccatcattcctacactgctggtcgccgtctttcaggatgtggaacatttaaccgggatgaacgatttcctgaacgtgttgcaaagcctgcagttgccctttgcattgataccgattctgacgtttacgagtctcaggccagtaatgtctgatttcgccaatgggttaggctggcgaatcgctggtggaatactagtgcttatcatttgctctatcaacatgtactttgtggtcgtgtacgtccgggacctgggccatgttgcgttgtacgttgtggcagccgtagtttcagtggcatacctgggattcgtgttttatctggggtggcagtgccttattgccctcggcatgagctttctcgactgtggtcacacagtaagcatttctaaggggctgctgacagaggaagccactaggggatacgtgaagtag

SEQ ID NO: 30111 - DNA, 1707 bp, Artificial Sequence
  Description of Artificial Sequence: Synthetic coding sequence
atggtactggggcctgaacaaaagatgagcgatgacagcgtgtccggcgatcacggcgagtccgcttccctggggaacatcaatccagcctactccaacccttctctgtcacagagcccaggggactcagaagaatacttcgccacgtatttcaatgaaaagatctcaattccagaggaagagtatagttgtttttcattcagaaagctgtgggctttcactgggcctgggttcctgatgagcatcgcataccttgacccggggaacattgagtccgacctacaatctggcgcggtcgctggcttcaagctgctgtggattttactactggccacactggtcggactcctcctgcagcggctggcggccagattgggggtagtcactgggctgcacctcgcggaagtttgccaccgtcagtatcccaaggtgcctagagtaattctgtggctaatggtggaactggccatcattggcagtgatatgcaggaggtgataggcagtgctattgcaatcaatttgctgtcagtggggagaatcccgctgtggggtggcgttcttatcaccatagccgacacatttgtgtttctatttctggataaatacggactgagaaagttagaggcattcttcggtttccttatcaccattatggcattgacattcgggtatgaatacgttactgtaaagcccagccaatcacaggttctaaaaggtatgtttgttccgagctgttccgggtgcagaaccccacagatcgagcaggcggtggggatcgtgggggctgtcataatgccccacaacatgtaccttcactcagctctggtcaagagccgacaggtaaatcgtaacaataagcaggaagttcgagaggccaataaatacttctttatcgagtcatgcatagcgttgttcgttagcttcatcattaatgttttcgtggtttcggtatttgccgaggccttcttcggtaaaactaacgaacaagtggttgaggtgtgcactaacacctcttccccccacgctgggctgttcccgaaagacaactcgacattagcagtagacatctataaagggggcgtcgttctagggtgttatttcggaccagcggctctgtacatttgggccgtgggcatactcgccgctggacagagttccacaatgactggaacctactccgggcaatttgtgatggaggggttcttgaacctgaagtggtctagattcgctagagtcgtgctgacccggtcaattgcaatcatcccaacactgctagtggcagtgtttcaggatgttgagcatttgacaggcatgaacgactttttgaacgtcctccagtctctgcagcttccatttgctctcatccccattctcacttttaccagcctccggccagttatgtctgattttgcgaacggtttagggtggcgcattgctggaggcatcctggtgcttattatctgtagtataaacatgtactttgtagtggtctatgtgcgcgatctcggacacgtggctctgtatgttgtggccgccgtcgttagtgtggcttacctgggatttgtcttttacttaggttggcagtgtctgattgctctggggatgtcctttttggactgtgggcacacatgccacctaggcttgactgcccagccagaactgtatctgctcaataccatggacgccgacagcttagtgagcaggtag

SEQ ID NO: 30112 - DNA, 1773 bp, Artificial Sequence
  Description of Artificial Sequence: Synthetic coding sequence
atgcggaagaagcaattgaagacagaggccgctccccactgcgagctaaagagctattccaaaaacagcgctacccaagttagcactatggtgctggggcccgaacagaaaatgtcagatgactccgtgagcggagaccacggcgagtccgcctccttaggcaacatcaacccagcttatagtaacccatccctgagccaatcccctggcgatagcgaagaatacttcgcaacgtactttaatgagaagatctcaatccccgaggaagagtatagctgctttagcttccggaaactctgggcgttcaccgggccaggcttcctgatgtccatcgcgtatctagacccaggcaatatcgaatcagatcttcaatcgggcgctgttgctgggttcaagctgctgtggatcttactgctcgctacactagtcggcctgctactgcagagattagcagccagattgggagtcgtgactggacttcacttagctgaagtgtgtcatcgacagtaccccaaggtgcctagggtgatcttgtggctcatggtggaactggccattataggaagtgatatgcaggaggtgataggcagcgcaatagccattaatttattgagtgtgggacggataccattatgggggggagtgcttatcaccatcgccgataccttcgtattcctgttccttgacaaatacggtctgagaaagctggaggccttctttgggttcctgatcacaataatggcactgactttcggctacgaatacgtaacagtaaagcctagtcagtcccaggtgttaaagggcatgttcgtaccatcgtgcagcggatgtaggacaccgcagattgagcaagctgtgggaatcgttggagctgtgatcatgccacacaatatgtatctccatagtgccctagtgaaaagtcgacaggtgaataggaacaataagcaggaggtgcgcgaagccaataagtactttttcatcgagtcctgcattgccctgtttgtctcgttcatcatcaacgtcttcgtcgttagcgtgtttgcagaagcatttttcgggaagacaaatgagcaggtggtggaggtatgcactaatacgagtagtccacacgccgggctgtttccaaaggacaattctactctggccgtagacatctacaaaggtggcgtagtccttgggtgttacttcggaccagctgccctgtatatttgggcagtggggattctggctgcaggacagtcttctaccatgaccgggacctattcgggccagttcgtgatggagggcttcctgaatctaaagtggtcaaggttcgcccgcgtcgttctgactcgttccatagcaataatccccaccctgctcgtggccgtctttcaggacgttgagcacctgacaggaatgaacgattttcttaacgtcctgcagtccctccaactcccctttgcccttatccccattttaactttcacgtcactccgccccgtgatgagcgattttgcaaacggcctcggctggcggatagctggaggcattctcgtgctgataatatgctcaattaatatgtatttcgtagtggtctacgtgagagacctgggccatgtggcgctttacgtcgtcgccgccgtcgtgtctgtggcctatcttggtttcgtgttctacttgggctggcaatgcctgatcgccctgggtatgagcttcctggattgcgggcacactgtgtccatcagcaaagggctattaacggaggaggcaactcgaggctatgttaaatag

SEQ ID NO: 30113 - DNA, 12 bp, Artificial Sequence
  Description of Artificial Sequence: Synthetic coding sequence
atggtgctgtag

SEQ ID NO: 30114 - DNA, 450 bp, Artificial Sequence
  Description of Artificial Sequence: Synthetic coding sequence
atggtgctcgggcccgagcaaaaaatgtctgacgatagcgtgtctggcgaccacggtgaaagcgcttccctggggaacataaaccctgcttattccaacccttccctctctcagagtcctggcgacagcgaggaatactttgctacttactttaacgagaagatcagcattccggaagaagagtactcatgttttagtttccgcaagctttgggcattcaccggtcccggattcttgatgagtattgcttacctggaccctgggaacatcgagagcgatctgcagagtggagctgtggctgggtttaagctgctttggatcttacttttggccacgctggtggggcttttgctgcagaggctcgcagctagactgggcgtcgtgactgggcttcatttggcagaagtatgtcataggcagtatcccaaggtgcccagggtgattctgtag

SEQ ID NO: 30115 - DNA, 2145 bp, Artificial Sequence
  Description of Artificial Sequence: Synthetic coding sequence
atgacccagatgtcccaggtgcaggagctgtttcatgaggcagctcagcaggatgcgctcgctcaaccccagccttggtggaagacccagctctttatgtgggaacccgtgttgtttggcacatgggacggtgtttttacctcttgtatgatcaacatctttggcgtagttctgtttcttcgcacagggtggcttgtgggcaacaccggagtgctcttgggaatgtttctggtctctttcgtcattctggtcgctctcgtgacagtgctttcgggtatcggggtgggcgagaggagcagcatcgggagtgggggtgtgtattccatgatatccagcgtgctcggcggccagactggcggtaccatcggactgttatacgtgtttgggcagtgtgtggctggcgctatgtacattactggcttcgccgagtccatctctgacttgttaggcctgggaaatatttgggcagtcagggggatttctgtggctgtgctgctcgcgctcctgggtatcaatctggctggagtgaaatggatcatcaggcttcagctactcctattgtttctgctggccgtgagcacccttgacttcgtggtgggcagttttacccatctggacccggagcacggcttcatcgggtactccccagagctgctgcagaataacacgctgcctgactacagccccggagaaagcttcttcacggtgtttggcgtcttcttccctgcagcgacaggggtcatggctggatttaatatgggaggggatctacgcgagcctgcagcatccatcccccccggttcgctggccgcagtgggtatcagttggttcctttacatcatcttcgttttcttgcttggagcaatttgtacccgcgaggcgctcaggtacgattttctgattgcggaaaaagtgtcattgatgggctttctgttcttgctgggcctgtacattagctccttggcaagctgcatgggcggattatatggcgcccccagaattctccagtgcattgcccaggaaaaagtcatccctgcgctggcctgcctgggacaggggaaggggcctaataaaacacccgtcgcagccatctgtctcacctctctggtgaccatggcctttgtgttcgtcggccaggttaatgtactggcacctatcgtgaccattaatttcatgctgacctacgttgccgtggactacagttacttctctctgtccatgtgttcttgttcactgactccggtcccggagccggtgctcagagagggagctgaaggcctgcattgcagcgagcatctccttctggaaaaagcaccctcttacggttcagaaggcccagcgcagagagtgctcgaagggactctcctggaatttaccaaagatatggaccaactgctgcagctcactcgtaagctggaatcgtcccaacctaggcagggcgaggggaaccgcacacctgagtctcaaaagcggaagagcaagaaagctaccaaacagacattgcaggactccttcctactggatctgaaatctccaccaagcttccccgttgagataagtgatagactccctgcagctagctgggagggtcaagagtcatgctggaacaagcagacctctaaaagtgaaggaactcaacctgaaggcacgtatggggagcagctggtgcctgaactgtgtaaccagagcgagtcttcaggggaggacttttttctcaaatcgaggctccaggagcaggatgtgtggcggagaagtacctccttttacacccacatgtgtaatccatgggtctctctgcttggcgctgtgggatctcttctcattatgtttgtgattcagtgggtttacacactggtcaatatgggagtcgctgcaatcgtgtatttttatattggtcgggcgagccccgggctccacttgggctcagcttcaaatttttcattttttcggtggatgcgcagtctattactcccttcttgcagatcattgcggagtccgcaggagcaaatcatccttgctccttcactggccaaggtggacatggagatgacccagcttacccaggagaatgctgactttgctacgcgtgaccgatatcaccacagttcccttgtgaaccgcgagcagctcatgcctcattactag

SEQ ID NO: 30116 - DNA, 2145 bp, Artificial Sequence
  Description of Artificial Sequence: Synthetic coding sequence
atgacccaaatgtcgcaggtgcaggaactgttccacgaggctgcacaacaggatgcattggcccagccacagccatggtggaaaactcaattgtttatgtgggaacccgtcctcttcggcacctgggatggtgtgttcacttcttgcatgattaatatctttggtgtcgtgcttttcctcagaaccggctggttggtggggaataccggcgtgctcttaggtatgttcctggtctcttttgtcattctggtggccttggtaaccgtactgtccgggattggcgtgggagaaagaagttcaatcggttctggtggggtctacagcatgatttcgtcggttctggggggccagaccggaggaacaatcgggttgctgtacgtatttggacagtgtgtcgccggggctatgtacatcactggtttcgccgagtctatctctgatctgctcggattggggaacatatgggctgtaaggggtatctcagttgctgtgcttctcgcacttttaggcatcaatctggccggcgtgaagtggatcataagactccagctgcttctcctattcttgctagcagtgtcaaccttagactttgtcgtgggatcctttacgcacttagaccctgaacatgggttcatcggatattccccggagctgctccagaataacacattgccggattactcgcctggggaatctttttttacagtgtttggcgtgtttttccctgctgctacgggggtgatggcggggttcaacatgggcggggatctgagggaacctgccgcaagtattcctccaggttccctcgccgcagtcggaatatcctggtttctctacatcattttcgtcttccttctgggcgcgatctgcactagagaggctctgcgttatgactttctgatcgccgagaaagtgagtctgatgggatttctgtttttgctcggcctgtatatcagcagcttagccagctgcatgggggggctttacggggcgcccaggatcctccaatgcatcgcccaggagaaagtaattccagcactagcttgtctgggccagggcaaaggtcccaataaaaccccagtagccgccatctgtttaacttctctggtgacgatggcttttgtgttcgtgggacaggttaatgtcttggctcctatcgtaaccattaattttatgctgacttatgtggccgtagattatagctatttttccctgtctatgtgcagctgcagcctcacaccagtgcccgaaccggtgctgcgggagggcgctgagggcctccattgcagcgagcatctgctgctggaaaaggccccttcgtacggttccgagggacccgcacagagggtgcttgagggaacgctcctggaattcactaaagatatggatcagctgctacagttgactaggaaactcgagtcgtcccaacctcgccagggcgagggaaataggaccccggaaagccagaagaggaaatccaagaaggctacgaagcagaccctgcaagacagctttctgttggaccttaagtccccaccatcatttccagtggagatatcggaccgcctgcctgcagcaagctgggagggtcaagaatcatgctggaacaagcaaaccagtaaatccgaggggactcagccagagggcacctacggcgagcaacttgtacccgagttgtgtaatcagagtgagagcagcggcgaagacttcttccttaaaagcaggctgcaggaacaggacgtctggaggagatctacttctttctatacccacatgtgtaacccctgggtctccttgctgggggccgtgggcagcctactgatcatgttcgtgattcagtgggtgtacaccctagtgaatatgggagttgcggcgattgtctacttctatataggccgtgcttcccccgggcttcatctgggatctgccagtaatttttcttttttcaggtggatgcggagcctcctcctgccttcttgtcgctccttgcgcagcccacaggaacaaattattctcgcacctagtctggcaaaagtggatatggagatgacacagttgactcaagagaacgccgatttcgccacgcgggacaggtatcatcactcttctctcgtgaaccgagaacagctgatgccgcattactag

SEQ ID NO: 30117 - DNA, 1617 bp, Artificial Sequence
  Description of Artificial Sequence: Synthetic coding sequence
atggcgtctgagagctcaccattacttgcttatcgactgctgggtgaggaaggagttgcactgcccgcaaacggagccgggggccctggtggagcctcagctcgcaaactgagcacatttttgggggtcgtcgtccccactgtgctcagcatgttcagtatcgtggtgttcctacgcattgacgccactggcccaagcgggctccgcgtgctgccccaaggctatggttggaatttattgtatggatcccttttgctgggacttgtgggaggcgtgtgcaccttaggggccggtttatatgcgagagcctccttcctgacatttctgctcgtgtccggttccctggcctctgtgcttatctcctttgtcgctgtcggcccacgagatatcagactgacaccacgacctggacccaatggctcctctttacctccccgctttggacacttcaccggattcaattcctcaaccctgaaagacaatctcggtgctggttacgctgaagattacacaaccggggctgtaatgaactttgccagtgtcttcgcagtgttattcaacggttgtaccgggatcatggctggagcaaatatgtctggagagcttaaagacccatcaagagctattccgctggggactattgtggccgtggcatacacattttttgtgtacgtactcctcttctttcttagctctttcacatgtgatcgcacccttctacaggaggactacggcttcttccgtgccatatccctctggcctcccttagtgctgatcggaatttatgccacagcgctgtcagccagcatgtcaagcctgattggcgccagccggatactccatgccttggcacgggacgacctctttggagtcatccttgcccctgccaaagtggtcagcagaggcgggaatccttgggcggctgtgctctacagctggggcctagttcaactggtcctcttggctggtaaactaaataccctggctgccgtcgtgaccgtgttttacttggttgcgtatgctgccgtggacctgagttgtcttagtttagagtgggcttctgctccaaactttcggcccaccttctcacttttcagctggcacacttgcctcctcggcgtggcctcttgtctccttatgatgtttctgatctcccccggagcagctggcgggtccctgttactgatgggcctcctggccgcactcttgacggcaagaggcggtcctagcagctggggctacgttagccaggcgctgctattccaccaggtgcgaaaatatttactgcggttggacgtgaggaaagaccacgtgaaattttggcggcctcagctcctgcttttggtggggaacccacgcggggccctgccactccttaggttagcaaatcagttgaagaaagggggcctgtacgtcttgggccacgtgacgctgggagacctggactctttacctagcgatcccgtgcaaccccaatatggagcctggctgagtctcgttgatcgggcgcaggtgaaagcttttgttgacctcaccctatcacctagtgtcaggcaaggcgcccagcacctgctcagaattagcggactcgagagcaattcacatcctctgccttag

SEQ ID NO: 30118 - DNA, 2745 bp, Artificial Sequence
  Description of Artificial Sequence: Synthetic coding sequence
atggcctctgagagctcgcctctgctggcgtaccggctgttaggcgaagagggcgtggcattacccgccaatggtgctgggggcccaggaggggctagcgcacgtaagctgtccacgttcctcggtgtggttgttcccaccgtcctgtccatgttttctatagtggtttttctaaggatcgggtttgtggtaggccacgcaggtcttcttcaagcattggcaatgcttctcgtcgcttactttatactagccttgacagtgctgtccgtttgtgccatcgcaaccaatggagctgtgcaaggtgggggggcctactttatgatctctcgcaccctcgggccagaagttggaggatccatcggactaatgttctacttggcaaatgtctgtggctgtgcggttagcctcttggggctggtagaatccgtccttgatgtgttcggtgccgatgccactggaccttcaggcttaagagtgctaccccagggctacggctggaacctgctgtatggtagcctcctgttgggtctggtaggaggcgtgtgcaccctgggtgccggtctctatgcgagggcatcattcctcacatttctgctcgtctccggctctctcgcaagcgtgctcataagtttcgtggccgtgggccctcgcgacatcaggctcacccctagacccgggcctaacggctcttctctgcccccccggtttggacatttcactgggtttaatagctctacactgaaagacaatctgggagctgggtacgctgaggactacacaaccggggcagtgatgaacttcgccagtgtgttcgcagtgctctttaacggatgcacggggataatggccggcgcaaacatgagtggcgagttgaaagacccatcccgggcaatccctctgggtactatcgttgctgtggcctatacattctttgtctacgtcttgctcttcttcctcagttctttcacatgcgacagaactctgcttcaggaggactatggatttttcagggctatctctctctggccgcccctggtgttgataggaatttatgcaaccgccctgagcgcttctatgagctcccttattggggctagcaggattctacacgccctggccagagatgacttgttcggtgtgatcctggctccagccaaggtggtcagtcgcgggggcaacccctgggcagccgtcctatattcatggggactggtgcaactagtccttctggctggaaagctcaacacacttgccgcggtagtgaccgtcttctatctggtcgcttatgcagctgtggacctgtcatgtctgagtttggaatgggcatcggccccaaattttaggcccaccttcagtctttttagctggcacacctgtctcctaggggtggcttcatgccttctcatgatgttcctcatcagccctggcgccgcaggcggcagcctgctgcttatgggcctcctcgctgcactacttacagcgcggggagggccttcatcctggggctatgtgagccaagctttgctcttccaccaggtccgtaagtacctgcttcgtctggacgtgcggaaagatcacgtgaagttttggcggcctcaactgctgcttctagtcggtaaccccagaggcgctctgcctctcctgagactcgcgaaccagctgaaaaaaggggggctttatgtcctgggacatgtaacgctgggtgaccttgattccctcccatccgatcctgtccaaccccagtacggggcgtggctttctctggtggacagagcacaggttaaggcttttgtcgatcttaccctgtcgccttctgtgcggcagggcgcccagcatctcctcaggattagtggcctgggcggcatgaaaccaaacactctggtgctgggcttctacgacgacgcacctcctcaggatcacttcttgaccgaccccgccttttccgaacctgccgattccacaagggaaggatcttccccagctctgagtactctctttccccctcctcgggcccctggttcgccccgggcactgaatccccaagattatgtcgcaacggttgccgatgcattaaagatgaataagaacgtagttctggctcgagcatctggagctttgccacccgaacgcctcagcaggggaagcggcggaactagtcagctgcaccacgtcgatgtttggccccttaacctgctgaggccccgcggaggacctgggtatgtggacgtgtgcggcctctttctgttgcagatggcgactatccttggaatggttcccgcctggcattcggccaggctgagaatctttctctgcctggggccaagagaggccccaggcgcagctgagggcagactcagagccctcctgagtcagttgaggataagagctgaagttcaggaggtggtgtggggtgaaggcgccggagccggggaaccagaggcggaagaggagggggacttcgtgaattccggccggggggatgccgaagctgaggccctggctagaagcgcaaatgctctggtgcgcgcccagcagggcagagggactggtggcggacctggggggcccgaggggggtgacgctgagggcccaatcacagcccttactttcctgtacctgccccgacctcccgcagatcccgccagatacccacggtatttggcccttctcgagaccctcactagggaccttgggcctacgctgcttgttcacggcgtcacgccagtgacatgcactgacctgtag

SEQ ID NO: 30119 - DNA, 1617 bp, Artificial Sequence
  Description of Artificial Sequence: Synthetic coding sequence
atggcttctgaatcgagccccctccttgcgtaccgcttgttaggtgaagaaggggtcgcactgcccgcaaatggcgccggcggcccaggaggagcaagcgcgagaaaactgtccacattccttggcgtggtggtgccaaccgtactgagtatgttttccatagtggtgtttctacggatcgatgccactggtccttctggcctccgagttctcccacagggatatggctggaacctcctgtatggttctttactgctgggcctggtcggcggcgtctgtaccctgggggctgggctctatgcaagagcctccttcctcacatttctactggtgtcaggcagtctcgcgtctgtattaatcagcttcgtggcagtgggcccacgggatatacgcctcacaccccggccaggcccgaacggaagctcgcttcccccaagattcggacatttcacaggatttaatagcagcaccctcaaggataatttgggggctggctacgccgaagactacactaccggcgcggtgatgaattttgcttccgtcttcgcggttcttttcaatggttgcacggggatcatggctggagcgaacatgtccggcgagctgaaagatccatctagggccattcccttaggaacgatcgtcgccgttgcatatactttcttcgtttatgtcctgctgtttttccttagcagcttcacctgcgatcgcacactgttgcaggaagattatggcttcttcagggccatctccctctggcctcccctggtgcttattgggatctacgcaacagctctctcagccagtatgtcctctttgatcggcgcctctaggattctccatgcactggcgcgcgacgacctgtttggagttatcctggcacccgccaaggtagtgtccaggggcgggaatccatgggctgcagtcctctacagttggggtttagttcagttggtcctgctcgccgggaaacttaatacactcgctgccgttgtgaccgttttttaccttgttgcttatgctgccgttgacctctcgtgtcttagcctggagtgggccagcgcccctaatttcaggcccacgtttagtctgttcagctggcatacttgcctgctgggcgtggcttcttgcctcctcatgatgtttctaatctctccaggggcagccggaggctctctactgctcatggggctgctcgcggctctcctgactgctagaggcggacccagcagttgggggtacgttagtcaggcactcttgttccaccaagtgcggaagtatcttctccgcctggatgtgagaaaagaccatgtgaagttttggcgcccccaacttctattgctggtggggaacccgcggggcgccctgcctcttctgcgccttgctaaccagctgaagaagggcggcctatatgtgctcgggcatgtgaccttaggggacctggattcactgcctagcgaccccgttcagccccagtacggggcatggctgtccctggtggaccgggctcaggtgaaggccttcgtggacctgactctgtctccatccgtcaggcagggggcacaacacttgttgcgcatatcagggctagagagcaacagccatcccttaccatag

SEQ ID NO: 30120 - DNA, 1884 bp, Artificial Sequence
  Description of Artificial Sequence: Synthetic coding sequence
atggcctctgagagctccccccttctagcttatcgccttctaggggaagagggagtagcccttccggcaaatggtgcaggcggtcctgggggagcttctgctcgcaagctgtcgacattcttaggtgtggtcgtgccgaccgtgctgtcgatgttctcaatcgtagtctttctgagaattggattcgtggtcggacacgcagggctactccaggccctggcgatgctcctggtagcatatttcatcctggctctgaccgtactgagtgtgtgtgccatcgcaactaacggcgcagtgcagggcggtggcgcttattttatgatttctcgtacactgggccctgaggtgggaggaagcatcggtctcatgttttatttagctaacgtatgtggctgtgctgttagcctgctggggctcgtggagtctgtgttagacgtgttcggcgctgacgcgactggccccagcggtcttagagtgctgccccagggctatggctggaatctcctctacggatctcttctgctgggcctcgtgggcggtgtgtgcactctcggagccgggctgtatgcaagggcctccttcctcacctttttacttgtatccggcagtcttgcatcagtcttaatcagcttcgtcgccgtgggtccccgggacatacgcctgacgcctagacccggtcctaacgggtcgtccttaccacccaggtttggacatttcactggatttaattcttcgacgcttaaagataacctcggcgccggatatgcagaagattacactaccggggcggtgatgaatttcgcatccgtttttgccgtactgtttaacggctgcacaggcataatggctggcgctaatatgtcaggggagttgaaagatccttcccgggctattcccctgggaacaatcgtagccgtggcgtacaccttcttcgtatacgtgctcttgttcttcttgagttcatttacctgcgataggacattactgcaggaagattacggttttttcagagctattagcttatggccaccactggtgttgattggcatttacgccaccgcattatccgcatccatgtctagccttattggcgcttcacggattcttcacgccctggcccgagacgatttattcggagtgatcttagcaccagcgaaagtggttagcaggggcggtaatccatgggctgccgtactgtactcctggggccttgtgcagctggttctgctggctggaaagctcaacacactggccgccgtggttaccgttttttacctggtcgcatacgcagcggtagatctgtcatgcctgtccctggagtgggcaagcgccccgaatttcagacctactttctcactgttttcgtggcacacttgtctattaggcgtggcttcgtgtctcctgatgatgtttttaatttctccaggggcggccggcggcagcctgctgttaatggggttactggctgccctgttgacagcacgcggcggcccctctagttggggctatgtgtcccaagctctgctgtttcaccaagttcggaaatatctgctgcggcttgacgtgaggaaggatcacgtcaaattctggagaccacagcttcttctcctcgtcggaaaccctagaggcgcgctccctctgctccggctggccaaccaattgaaaaaaggcggactgtatgtgctaggccatgtgactctaggggatctcgatagcctgccatccgacccagtccagccgcagtacggtgcatggcttagtctcgtcgaccgggcacaggtgaaagctttcgttgatctcacgctcagcccctctgtgcgccagggagcacagcatctgctgcgtatctctggcctggagagcaatagccatcctctgccctag

SEQ ID NO: 30121 - DNA, 390 bp, Artificial Sequence
  Description of Artificial Sequence: Synthetic coding sequence
atggcctccgagagcagcccccttctggcctaccgcttgctgggtgaagagggggttgcattaccagcaaatggcgccggtgggccaggaggcgcatctgcaagaaagctgtcaacattcctaggcgtcgtagtccccacagtcctgtctatgttcagtatcgtagtgtttttgaggatcggctttgtagtcggtcacgccggtctcctgcaggctcttgccatgcttctggtggcctactttattttggccctgacggttctgtcggtttgcgccatagccacgaacggagccgttcaggggggcggcgcgtacttcatgatttcacgtactctgggaccggaagtgggagggagcattggactgatgttttatctggccaacgtgtag

SEQ ID NO: 30122 - DNA, 1461 bp, Artificial Sequence
  Description of Artificial Sequence: Synthetic coding sequence
cactttggagttcactggcacagcctggtttttaccggaatcctgggggtgcactggcattttggaacaacagcccgcttactagccctcgctcagctggtgttgctagccgggaagcttaacacactggcagccgtggtcacagtgttttaccttgtcgcctacgcggcggtggacctgtcctgtctctccttagaatgggctagtgcgcccaatttcagacctactttctccctgttcagctggcacacctgcctcttgggtgtggcctcttgcctcttgatgatgtttttgatctccccgggagctgccgggggtagcctgctgctaatggggttactggctgctctgctgaccgcgagaggcggcccctctagctgggggtacgtaagccaggctttactctttcatcaagtgagaaaataccttttgcgacttgacgtgcgcaaggaccacgtgaaattctggcgaccccagttgctgctgctggttggaaatccccggggcgcgctgccgcttttgcgtctagccaaccagttgaagaaggggggtctttacgtcttgggacacgtgactctgggcgacctcgacagcctccctagtgatcctgtgcaaccccaatatggcgcatggttaagcctggtcgatagagcccaggttaaagcattcgtggatttgaccttgtctcccagcgtgcggcaaggagctcagcacctgcttcgcatctcaggattaggggggatgaaaccaaacacactggtactagggttttacgatgacgcacctccacaggaccacttcttgacagatcctgcattctccgagcccgccgacagcacccgggaaggaagttctccagcgctaagcactttgtttccaccccctcgagctcccgggtctccgcgcgctcttaatcctcaggactacgtagctacagtggctgacgctctgaagatgaacaagaacgtcgtgctggcacgagctagcggcgctcttcctccggagagactgtcacgggggtccgggggaacaagccagcttcaccacgtcgacgtatggcccctaaacctgttacggcctcgaggaggaccagggtatgtggatgtttgtggacttttcctcctgcagatggctactattctggggatggtccccgcctggcattccgcccggcttcgaatatttttgtgtttaggaccgcgcgaagcgcctggggccgcagagggaaggctgcgcgcactcctatcccagctcagaatacgggccgaagttcaggaggtcgtgtggggtgagggcgcgggtgctggagagcctgaggccgaggaagagggcgacttcgtgaacagcggacgtggcgatgcagaagctgaggccttggccaggagtgccaacgcgctcgtccgggcacagcagggacgccatcgaagaagggccggctgggcaggggggtggggatgttag

SEQ ID NO: 30123 - DNA, 1896 bp, Artificial Sequence
  Description of Artificial Sequence: Synthetic coding sequence
atggcatccgaaagctctcctttgctagcttatcggctgctcggagaggagggcgtggctctgccagccaatggtgccggcggaccaggcggggcctcagccagaaaactatctaccttcctcggtgtggtggtcccaacagtgttgagcatgttctccatcgttgtgttcctgaggattgggtttgttgtgggacacgccgggctgctccaagctctagcaatgctgctcgtggcttatttcatcttagcattaacagtgctgtccgtctgcgccatagcaactaacggggcagtgcagggggggggagcctatttcatgatttccagaacactgggccctgaggtcggtggcagcattgggctgatgttctacctggccaatgtctgtggatgtgctgtttcccttctgggactggtggaaagcgtattagatgtgttcggtgcagatgctaccggaccaagcggcctgcgggtgcttccacagggatacggatggaacctgctgtatggctccctcctactcgggctcgtcggcggcgtgtgtaccttaggagccggactttacgctcgtgcatcatttctaacgtttttgctggttagtgggagcctcgctagcgttcttatttcgttcgtggcagtggggccccgtgatattcgtcttactcctagacctggccctaacggctcctctttgcctccacggttcggtcacttcaccggttttaattcctctactctaaaggacaaccttggggcaggctatgccgaagattacacaacaggggccgtgatgaacttcgcaagtgtgtttgctgttctgtttaacggctgtacaggcatcatggcaggagctaacatgtccggcgaactcaaagacccgtctcgcgctatcccccttggcacgatagtcgccgtggcctacacttttttcgtctatgtgctgctgttttttctgtcatctttcacctgcgaccgtaccctattgcaggaagactacggcttctttagagccatttccttgtggccaccacttgtgctgattggcatttatgccaccgcattgagtgcttccatgagttccttgattggggcttctcgtatacttcacgccttggccagagacgatctgtttggagttatcctggctcccgccaaggtcgtctcgagaggcgggaatccgtgggcagcagtgctgtacagctggggtctcgttcagctggttctcctcgctggcaagctgaacaccttggccgctgtggtgaccgtcttctacctggtcgcctacgcagctgttgatctgagctgcctgtcgctcgaatgggcttccgctcccaatttcagaccaactttttccctcttctcttggcatacatgcctcctcggagtggcctcgtgcctcttaatgatgttcctgatttcaccgggggccgcaggtggctccttgcttctgatgggcctcttagccgcgctactgacagcgcggggggggccttcttcatggggttatgtgtcccaggcgttgctgttccaccaggttcgaaagtatttgctgcgccttgacgtccgcaaggaccatgtgaagttctggcgaccgcagctgcttcttttggtgggcaatcccagaggggcactgccactgctgcggctcgcaaaccaacttaaaaaaggggggctttacgtcttagggcacgtaactctgggcgaccttgactctttacccagcgacccagtacagccgcagtacggggcttggttgagtttggtggaccgcgcccaggtgaaggcattcgtggacctaaccctgtccccctctgttcgccaaggggcccaacacttacttcgcattagcgggctggaatccggcaccctcctaccgtggggattcagaagctag

SEQ ID NO: 30124 - DNA, 2097 bp, Artificial Sequence
  Description of Artificial Sequence: Synthetic coding sequence
atgaatcccttccagaagaatgagtctaaggagaccctgttttcccctgtaagcatagaagaggtccccccccggcccccttcacccccaaagaaaccctcaccaacaatttgcgggtccaactaccctctgtctatagccttcatcgtagtgaatgaattctgtgagaggttcagttactatggtatgaaggctgttttgatactgtacttcctgtactttctgcattggaacgaggatacttcaacttctatctaccatgccttttcttctctatgctacttcacccctatactcggcgccgctattgccgactcatggcttggcaagtttaaggttttgagcctcatcggactatcccttatagcccttggaaccggggggattaaaccctgcgtggctgccttcggtggggatcaattcgaagaaaagcatgcagaggagaggactagatacttctcggtcttctatctgagcatcaatgcaggatctctcatcagtactttcattacccctatgttaaggggagacgtgcagtgcttcggagaggattgttatgcacttgccttcggcgtgccaggactgctgatggtgatcgctctggttgtgttcgccatgggctccaaaatctataacaagcccccccctgaaggaaatatcgtggcacaggtgtttaaatgtatctggttcgcaatcagcaataggttcaaaaataggagcggcgacataccaaaacgccagcattggcttgattgggcagccgagaaatatccgaagcaactgattatggacgtgaaggccctgactagagtgctatttctctacatacctttgcccatgttttgggcccttctagaccagcaaggttcaaggtggactttgcaggcgatccgtatgaatcgtaacttggggttcttcgtgctgcaacccgatcagatgcaggtgcttaatccgcttctggtcttaatttttattcctctgtttgatttcgtgatttacaggcttgtgtcaaagtgcggcattaatttttcatccctccggaaaatggccgtgggtatgattctggcctgcctggcctttgctgtggccgccgccgtggaaatcaagataaacgaaatggcccctgcccagccaggacctcaggaggttttcttgcaggttcttaacctggccgatgatgaggtcaaggtcaccgtagtgggaaatgaaaataacagtttactcatagagtctatcaaatcattccagaagaccccccactactctaagctccaccttaaaacgaagtcacaggatttccattttcaccttaaatatcacaatttatccctctacactgagcactcagttcaggaaaagaactggtactcattagtgattagagaggatggcaacagtatcagctcaatgatggtcaaagatacagaaagtcgaacaaccaacggtatgaccacagtgcggttcgtgaacaccctgcacaaggacgtgaatatctcattgagtacagatacttcattgaatgtgggagaagattacggtgtttctgcctatagaacagtgcagagaggagaatatccagctgtccactgtaggaccgaggataaaaatttctcgttgaaccttggccttctggacttcggagccgcatatctctttgtgattaccaataacactaaccagggcctgcaggcctggaaaattgaggatatccccgctaataagatgagtatcgcttggcagttgccccagtacgccctcgtcacggccggagaagtaatgttctccgtgaccggactcgaattctcctattcccaggcgccatccagtatgaaatcggtactgcaggctgcctggttactgacaatagccgtcggaaacattattgttctagtggtggcacagttcagtgggctcgtgcaatgggctgagttcatactgttctcttgtctactgcttgtaatatgtctgatttttagtatcatggggtactattacgtacctgtgaagaccgaggatatgagagggcctgctgacaagcacatcccacatattcagggcaatatgatcaagctagagacgaaaaaaaccaagttatag

SEQ ID NO: 30125 - DNA, 2190 bp, Artificial Sequence
  Description of Artificial Sequence: Synthetic coding sequence
atgaatcctttccagaagaacgaaagtaaggaaactttgttctccccagtgagtatcgaggaagtgcctccacggcctccaagtccacccaagaagccttcccccacaatttgcgggtctaactatcctctgtcaattgcttttatagtggtgaacgagttctgcgaaaggttcagttattatggcatgaaagccgtgctcatcctgtacttcctgtacttcctacattggaacgaagacacaagtacaagcatctatcacgcgtttagcagcctctgttacttcacgcctatcttgggcgcagctatcgcggattcatggttgggtaagttcaagacaatcatatatctcagtctcgtgtacgttctgggacacgtgatcaagtcactaggagcccttccaatcctgggaggccaggtggtccacaccgtgctgagcctaatcggcctgagccttatcgctctgggtaccggaggaatcaagccctgcgtagccgcgtttgggggagaccagtttgaagaaaagcacgctgaagaacggactcgatatttcagtgttttctatctctcgattaatgcggggagtttaatttccacctttattacacccatgctacggggagatgtccagtgcttcggcgaagattgttacgcactagcattcggcgttccgggtctcctgatggtaatagcactggtggtgttcgccatggggtctaagatatacaataagcccccaccagagggcaatatcgtcgctcaggtgttcaaatgtatttggttcgcaattagcaataggtttaaaaacaggagcggggatatccctaagagacaacactggttggactgggccgctgagaagtatcccaaacaactcattatggatgtcaaagcactcactagagtgctgtttctgtatatcccgttgcccatgttctgggccctgttagaccagcagggaagccgctggaccctgcaagctatcaggatgaacaggaatctcgggtttttcgtgctgcaacccgaccaaatgcaggtcctcaatcctctcctggtcctgattttcatacccctcttcgattttgtgatctatcggttagtgtcaaagtgcgggatcaactttagttcactgcggaaaatggccgtgggaatgattctggcctgcctggccttcgcagtagcagccgctgtggagattaagattaacgaaatggctcccgcgcagccagggcctcaagaggttttcctgcaggtcctgaacctggctgatgacgaggtgaaggtgactgttgtgggcaatgagaacaactctctgttgatcgaaagcatcaagagtttccagaaaacaccccattacagcaagctgcatctgaaaaccaaatcacaggactttcacttccaccttaagtaccacaatttatccttgtacacggagcacagcgttcaggagaaaaactggtactcgctggttatcagagaagatggcaattcaatttcgtccatgatggtgaaggatactgagtcgcgcacgactaacggcatgacaaccgtgagatttgtgaataccttgcacaaggacgttaatatttcacttagcacggacacctcactaaacgtgggagaggattatggagtgagtgcatatcggacggtccagaggggagagtatccagccgtacattgcaggaccgaggataagaactttagcctgaacctcggactcctagactttggcgcggcatacctcttcgtgatcaccaacaataccaatcaggggctgcaggcgtggaagatcgaagacatccctgccaacaagatgtcaatcgcatggcagctgccacagtatgccttggtgaccgcaggagaggttatgttctccgtgaccggtttagagttctcctattcacaggccccaagctcgatgaagagtgtccttcaggctgcatggcttctgactatcgccgtaggaaatattatagtcctggtcgtagcacaattctccgggttggtccaatgggctgaattcatactattcagctgtctcctgctagttatctgtttaatattttctatcatgggttactactacgttccagtgaaaaccgaggacatgaggggaccagctgacaaacatattccacacatccagggcaacatgatcaagttggaaacgaaaaagacaaagttgtag

SEQ ID NO: 30126 - DNA, 2076 bp, Artificial Sequence
  Description of Artificial Sequence: Synthetic coding sequence
atgtctcctaggaagctcttcttcccagtgtctatcgaagaggttccccctaggcctccttctccacccaagaagccttcccccacaatatgtggaagtaattatccgctgtctatcgcatttatagtagttaacgagttttgcgaacggttctcctactatggcatgaaagccgttctgatcctgtactttctctattttcttcattggaatgaagacaccagtacctccatctaccacgcgttttcttcattatgctacttcacccctatcctcggggcggccatagccgactcatggctggggaaattcaaggtgctctcactgatcggcttgtccttgatcgccctcggaacaggcggcattaagccgtgtgtggcagcatttggtggcgatcagttcgaggaaaaacatgccgaagagcgcacacgatacttttcagtgttttacttgtcaataaatgctggcagcttgatttccacattcatcacacctatgctccggggcgacgtgcagtgtttcggggaggattgttacgcactggcctttggggtgcccgggttactgatggtaatcgccttagtggtgttcgcgatgggcagtaagatctacaacaagccgcccccagagggcaacattgtcgcacaagtgtttaagtgtatatggtttgccatctcaaatcggttcaaaaatcgcagcggagacatccctaaacgccaacactggctggattgggccgccgaaaaatacccaaagcagctaatcatggatgtgaaagcacttacaagggttctcttcttatatatacctctaccaatgttttgggccttgctcgatcagcaaggctcacgctggacacttcaggccatcagaatgaatagaaaccttgggttcttcgtcctccagcccgatcagatgcaggttctcaatccactgctcgtgctgatttttattccactgttcgacttcgtgatctaccgcctggtctctaaatgcggcataaatttcagcagtttgcgaaaaatggctgtaggcatgatactagcatgtctcgccttcgcggtggctgccgccgttgagatcaagataaatgagatggcccctgctcaacccggcccacaggaagtgttccttcaagtgctcaatctggctgatgacgaggtgaaggtaaccgtggttggcaacgaaaacaacagtctccttattgagtccatcaagtccttccaaaaaacaccacattatagtaagctgcacctcaaaaccaaatcccaagactttcactttcacctcaagtatcacaacctatccctctatacagagcattcagttcaggaaaaaaattggtattctcttgtgatcagagaggacggtaatagcatctctagtatgatggtcaaagatactgagtcccgcaccaccaatggcatgaccaccgttcggttcgttaataccctccataaggacgtgaatatttcactgagtacagacacttcactgaacgtgggcgaagattacggtgtgagtgcctatagaactgttcagcggggagagtaccccgcagtccattgccgaacagaggataaaaacttcagcctgaatctagggttactggacttcggggctgcctacctgtttgtaattaccaacaatactaaccagggactgcaagcatggaagatagaggatattcccgctaacaagatgagcattgcttggcagttgccccagtacgcactagtaacagctggggaagtgatgttctccgtcaccggactggaattttcttactctcaagcaccgtcttctatgaaaagtgttctgcaagccgcctggcttttgaccattgctgtaggaaacatcattgtgctggtggtagcccaattcagcggtctggtccagtgggccgagttcatcttattctcttgtcttctgttggtgatttgtttaatttttagcattatgggctactactacgtgccagtgaaaacagaagatatgcggggacccgctgacaaacacatcccgcatatacaggggaacatgattaaactcgaaacaaagaagacaaagctctag

SEQ ID NO: 30127 - DNA, 1506 bp, Artificial Sequence
  Description of Artificial Sequence: Synthetic coding sequence
atggcggcctcctggcgtctaggctgcgacccacgcttgcttaggtatttagtgggcttcccaggacggcggagcgttgggctggtgaaaggagccctggggtggagcgtgtcacgtggcgcgaactggcggtggtttcattctacgcagtggctgcggggtgatcccatcaagatcctaatgccctccttaagcccaacaatggaggagggaaacatagttaagtggctgaagaaagagggcgaagcagtgagtgccggagatgctctgtgcgagatagagaccgacaaagcggtggtaactctggacgccagcgatgacggaatcctggcaaaaatcgtggtggaagagggctcgaaaaatataaggcttggctctctgatcggcctgatagtggaagaaggcgaggactggaaacacgtagaaatccctaaggacgtgggaccgcctccgcccgtgtctaagccaagtgagccaagacccagcccagagccacagatctctattccggttaaaaaagagcacatacctggaactctcaggttccgcctgagtccggccgctcgcaacatactggaaaaacactccctggatgccagtcaaggcaccgcaaccggcccccggggaattttcaccaaagaggatgccttaaaattggtgcagctgaagcagacgggtaagatcaccgagtcacggcccacacccgctcccacagcaacacctactgccccgtcccctttgcaggcgactgctggtccgtcatacccacgccccgttatcccccccgtgtctacacccggccagcccaacgctgtagggacctttacagaaattccagcatctaacatcaggcgcgtgattgctaaacggctcacggaatcaaaaagcacggtgcctcacgcatatgctaccgccgactgcgacctcggagccgtgctgaaagttcgccaagacttggtgaaggacgacatcaaagtctccgtgaacgactttataataaaagctgccgccgtcaccctgaagcagatgcccgacgtcaacgtctcatgggatggagagggtcctaagcaactccccttcatagatatctcagtggcagtggcaaccgacaagggtttgctgacgcctatcatcaaggacgcagcagccaaaggcatccaagaaatcgccgattctgtcaaggcactttccaagaaggctagagacggcaaactgctccctgaagagtaccagggggggagtttctccatcagcaacctaggcatgtttgggattgacgaattcacagctgtgattaatccgccacaggcctgcatcctggcggtgggacgctttaggcccgtgcttaagctaacagaggacgaagagggcaacgcgaagttgcagcagcggcagctgatcacagtgaccatgtcatctgactcaagggtcgtggatgatgagttagcaactcgatttctgaagagcttcaaggcaaatctcgaaaacccaattcggttggcgtag

SEQ ID NO: 30128 - DNA, 942 bp, Artificial Sequence
  Description of Artificial Sequence: Synthetic coding sequence
atgccagccccacgggcgagggagcaaccccgtgtgcctggggagagacagccgttgctgcccagaggcgctcgcgggcctagaaggtggaggagagccgctggagcggcagtccttctcgtggaaatgctcgaacgggctgcattctttggagttactgcaaacttagttctgtacctgaactccacaaacttcaactggacaggagaacaagccacccgggcagctcttgtgttcctcggtgcctcctacctgttagcccctgtaggcggctggcttgctgacgtttacctgggaaggtatcgagcagtggctctgagtcttttgttgtacctcgctgcctccggcctccttccagcaaccgcatttcccgacggccggtcaagcttttgtggagagatgccggcaagcccacttggcccagcctgcccttctgcgggctgccctagaagttcaccaagtccatactgcgcaccagtgctgtatgccgggcttctcctcttgggtctggccgcttcttctgtcaggtcaaatttgaccagcttcggtgctgaccaggttatggatctggggcgggatgccacacgccggttttttaattggttcacaggcgctagcacctgggtactgtgttgtcggtgctggtggtggcggctgttttcacggacctctgctagctgttgggccactgccagtctgtgggccgtgtgggcgtggcatttcagctcatcttcccttccaccgccctcctcttctccaagccctcggtgggcagctaaatgccccctatgtctgagctctttgtcgaaaacagccgcaccgtcctgcggcaatgacacacgacctgaaaccgtgaatgtgccggcatgttggcccacaaggggattgccctcacagggtcttccacgaaagcggacctcccccacctctaggtgttggtag

SEQ ID NO: 30129 - DNA, 1734 bp, Artificial Sequence
  Description of Artificial Sequence: Synthetic coding sequence
atggaaggatcaggagggggggccggtgaaagagcccccttacttggagcaagacgggctgcggctgctgccgccgcggctggagcattcgccggtcgccgagcagcatgcggagctgtgctgttaaccgaattactcgagagggctgccttttacgggattacgtctaaccttgtgctgttcctgaatggagcccctttctgttgggaaggggcccaagccagcgaagccctgctgcttttcatgggactcacttatctggggtcaccttttgggggttggttggcagatgcgcgactgggccgcgctagagcaatcctcctgagcctcgccctgtacctgttgggaatgctcgcattcccactgttggccgctcctgccacaagggctgctctctgcgggagtgccaggctgttgaactgtactgctccaggaccggacgcggctgctcgctgctgtagcccagctacatttgctggactggtccttgtgggtcttggcgtggctaccgtcaaagctaatattacgcctttcggcgccgatcaagtgaaggatcggggacccgaagcaacccggaggttcttcaattggttttattggagtatcaatctcggggctattttgtcccttgggggcatcgcctatatacagcaaaacgttagtttcgtgaccggatatgccatacctaccgtgtgtgtggggctcgccttcgttgttttcctttgtggccagtccgttttcatcaccaaacctcctgatggttcagcattcaccgacatgttcaagatactgacatactcctgctgctcacaaaaacgatctggagagaggcagagcaatggcgaggggattggggtatttcagcagtcatcaaagcagtcactgttcgattcctgcaagatgtctcatggtggcccctttaccgaggagaaggtagaagatgtcaaggctttagtgaagatcgtccctgtcttcctagctctgattccctattggacagtgtattttcaaatgcagacgacatacgtgctgcagagcctgcacctgagaatcccagagattagcaacattaccacgacacctcacactctgcccgccgcatggctcacaatgtttgacgccgttctcattctactcctcatcccgctgaaagacaagctcgtggaccctatcctgcgtcggcacggcctgctcccaagcagcctgaagaggatagcagtggggatgtttttcgtaatgtgttccgctttcgccgcagggatattggaaagcaaacgcctgaacttagtgaaggaaaagacaatcaaccagactatcggtaacgtcgtgtaccacgcagccgatctctctctttggtggcaagtgcctcagtatctcttaattggtatttcagagatttttgcctctatcgctggtctggaattcgcttactccgccgcccccaaatccatgcaatccgcaatcatgggcctatttttcttcttttccggagtagggagtttcgttgggtcaggactcctggcactcgtctctatcaaagccatcgggtggatgtcctctcacacagacttcggaaacattaacgggtgctacttaaattactattttttcctcctggccgctattcaaggtgccacactgctgctcttcttgattatcagcgttaaatatgatcaccaccgtgaccatcagcgaagcagagcgaacggcgtgcccacatcccggcgggcatag

SEQ ID NO: 30130 - DNA, 1320 bp, Artificial Sequence
  Description of Artificial Sequence: Synthetic coding sequence
atgctgaagagagagggcaaagtgcagccctacaccaaaaccctggatgggggctgggggtggatgatagtgattcactttttcctcgtcaacgtattcgtgatggggatgaccaagacttttgcaatatttttcgtggttttccaagaggaatttgaaggcacatcggagcagattggctggataggctccatcatgagctcattgcggttctgtgccgggctgggcagcgccttcctgtatcaggtggccgcagtagtgacaaccaagtacttcaaaaagaggctggctctttcaacagctatcgctcgttccgggatgggcctgactttcttgctggcaccctttactaagttcctcatcgacctgtatgactggactggggcccttatcctttttggcgccattgcccttaatctggtgcccagcagtatgctcctgcgcccaatccatatcaagagcgagaacaatagtgggataaaagataagggttcatccctcagcgcacatggacctgaggcacacgcgaccgagacccattgtcacgaaaccgaggagtctaccattaaagactctaccactcaaaaggccgggctgcccagcaagaatttgacagtttctcagaaccagagtgaagaattctacaacggcccaaataggaataggctgctccttaagagcgatgaggagtccgataaggtcatcagttggtcatgcaagcaactctttgatattagtctatttagaaaccccttcttctacatcttcacatggtcttttctgctatctcaactagcctactttattccaacttttcacctggttgcacgtgcaaagactctcgggatagacatcatggacgcttcttaccttgtgagtgttgcaggaatcctcgaaactgtatcccaaatcataagcggatgggtcgccgatcagaattggatcaagaaataccactaccataagagctatctgattctgtgcggtatcaccaaccttctcgcccccctggccacaacctttccgctgctcatgacgtacactatctgcttcgcgatatttgcaggcggttacttagccttaattctgccagtgctggttgacctgtgcaggaatagcaccgtaaaccgtttcttaggtctagcttctttcttcgccgggatggcagtcctgagtggcccaccaattgcaggttggctgtatgattatacccaaacctataacgggagtttttatttttctgggatttgctatctcctgtcttcagtctcgttcttttttgtgccactggccgagaggtggaaaaacagtctcacgtag

SEQ ID NO: 30131 - DNA, 1416 bp, Artificial Sequence
  Description of Artificial Sequence: Synthetic coding sequence
atgcccgcccctcagaggaagcatagaaggggaggattcagccatagatgtttccccacaccccagacggccatgacaccacagccggcagggccccctgacggtgggtggggatgggtggtcgcagctgccgcttttgcgatcaacggtctgtcctacggactactgagatccctggggcttgccttcccggacctggccgaacacttcgatcgcagcgcacaggatacggcttggatttcagccctggccctcgcagttcagcaggccgcctctcctgttggcagtgcgctatccaccaggtggggggcccgccccgtggttatggtgggcggagtgctagcgagtctcggattcgtcttctcagccttcgctagcgatcttctgcatctctacctgggcctggggctgttggccggttttggctgggccttggtattcgctcccgcgctggggactctgagccgatatttttctcgccgccgtgtcctggcggttggtctggcactcaccggtaatggcgcaagctccctgttgctcgcccccgccctgcagctgctgcttgacacctttgggtggcgaggcgccttactgcttctgggtgcgatcaccttacacttgactccatgcggggcactgctgctcccattggtgctgcctggggacccccccgcccctccaagaagccctctcgctgcgctgggtctgagcctattcacgcggcgcgctttcagtatattcgcacttggaaccgccctcgttggagggggttatttcgtgccgtacgtgcatctggctccccacgcgttggacagaggactgggcggatatggagccgccctcgttgtcgctgtggccgctatgggggacgccggcgccaggctggtctgtgggtggctcgcagaccagggttgggtgcccctgccaaggcttctggcggtgttcggggccttgactgggttgggcttgtgggtggttgggctggtccctgtggtgggtggcgaagagagttggggaggacctctcttagccgccgcggttgcctatggactgtctgctggttcctacgcccctctggtgttcggggtcttgccagggctagttggcgtcggcggagttgtccaggccaccggcttagttatgatgctcatgagccttggtggtctcctggggcctcccctgtcagggttcttgcgagatgaaaccggcgactttacagcctcatttctgctgtctgggtcactgatactctctggttcgtttatctacatcggcctgccacgggcacttcccagctgtggtcctgcttcccctcctgctactcctccaccagaaactggagaacttctccccgccccccaagctgttctgctgagcccggggggccctgggagtacgctcgacacaacatgctag

SEQ ID NO: 30132 - DNA, 1320 bp, Artificial Sequence
  Description of Artificial Sequence: Synthetic coding sequence
atgaccccgcaaccggctggtcccccagatgggggctggggctgggttgtggccgccgccgccttcgctatcaatgggctttcgtatgggctgttgaggtccctggggctcgctttccctgatctggccgagcactttgaccgttcagctcaagataccgcttggatttccgccctggcactcgctgtccagcaggccgccagtccagtcggaagcgctctgtctacccggtggggcgcccgccctgtggttatggtcggaggagtgctggcgagcctcggctttgtgtttagcgcttttgcttcagatctgctgcatctctatcttggtctgggcctactggccggatttggctgggccctagtgtttgccccagcactggggacactgtccagatacttctccagacgaagggtgctggccgtaggactcgctctgacaggcaatggagcttctagtttactgctcgcccccgctctccagttacttctcgatacttttggctggcgtggagccttattgctacttggagccataactttgcatctcaccccttgcggcgccttactgctgccattggtcctacctggagatccgcctgcacctccccggagtccattagctgcgttgggactgagcctgtttaccaggcgcgccttttccatattcgccctcggtacagcccttgtcgggggtgggtattttgtgccctatgtgcatttagcgccacatgcactcgaccggggactgggaggatacggggcggcactggtggtagccgtggccgcaatgggagacgcaggagcacggctcgtgtgcggttggctggctgatcaaggttgggtgcccctacctcgcctgctggcagtttttggagccctgactgggttggggttatgggtggtcggcctgtcttggggtggcccactcttggccgccgctgtggcttatgggctctcagctggatcgtacgccccattggttttcggggtattgccagggctggtgggtgtaggcggagttgtgcaggccaccgggcttgttatgatgctgatgagcctgggagggctgctgggccccccactatcaggctttctacgtgatgaaactggagactttaccgctagcttcctactctccggaagcctcatcttgagtggatcattcatttatattggcctccccagggcccttccgtcctgcgggcccgcctcgcctcccgccactcccccgcccgagactggcgaacttctccccgcaccacaggctgtgctccttagtcctggcggccccggctcaacactagataccacctgctag

SEQ ID NO: 30133 - DNA, 1281 bp, Artificial Sequence
  Description of Artificial Sequence: Synthetic coding sequence
atggctaggaggaccgagccaccagacgggggttggggatgggtcgttgtgttgtcagcgtttttccagtctgccctggtcttcggggtgctccgcagcttcggtgttttcttcgtggagtttgttgccgctttcgaagagcaagcggcgcgcgtgtcatggatcgcatctatcggcatcgcagtgcagcagtttggatcaccggtgggcagcgccctgtcaacaaagttcggacccagaccagtcgttatgacaggagggatcctcgctgctctaggtatgctccttgccagttttgccacaagtctgacccacctgtatctcagcataggcctgttgtctggctcgggatgggccttgaccttcgctcccactcttgcttgcttatcctgttacttctcccgccgaagaagtctcgccaccgggctcgctcttacaggcgttgggctttctagctttacgtttgcccccttctttcagtggctgctgtcgcattacgcgtggcgaggctccctgttgctggtgtcagccctgtcgcttcaccttgtggcatgcggcgcactgctgaggcctccgagccttgccgaagaccctgctgtgggcggcccaagggcccagctaactagcctgctgcatcacgggcctttcctgagatatacagtggcgttgacactcataaacacaggctacttcatcccatacctgcacttagtggcccatctccaggacttagattgggatcctctccccgccgcattcttgctgagcgtagtggctatcagcgatcttgttggtcgtgtggtttcaggctggttaggggatgctgtccctgggcccgtgaccaggctgttgatgctgtggacaactctgactggagtcagcctagccctcttcccagttgctcaggccccaaccgcattagtggctctcgctgtggcctacgggtttacctctggagcccttgcacctcttgctttctcagtgttgccggagctgattggcacccggcgaatctactgcgggttgggacttttacagatgatcgaatctatcggcgggttgttgggacccccactgtctggctacctgcgagacgtcaccggaaattacactgccagctttgtggtcgcaggcgccttcttgttaagtggcagtgggatactgctgacactcccacactttttttgcttctctacgactacatctgggccacaagacctggtgacagaggccctggacacaaaggtccccctgcctaaagaaggccttgaagaagactag

SEQ ID NO: 30134 - DNA, 1533 bp, Artificial Sequence
  Description of Artificial Sequence: Synthetic coding sequence
atgtatacaagtcacgaggacattggatacgactttgaagatggcccgaaggataaaaaaacgcttaaaccacatcctaacatcgatggcgggtgggcctggatgatggtgctcagttctttcttcgtgcacattctaatcatgggctctcagatggctttgggggtgcttaacgtagagtggcttgaggagttccaccagagccgggggcttaccgcttgggtgtcatctctaagcatgggcattaccctaattgttggtccgttcattgggctttttattaatacttgcgggtgccgacagaccgctatcatcggagggttagtgaacagtcttggctgggtgctctctgcctacgccgctaatgtgcactacttgttcatcaccttcggtgtcgcagccggacttgggtccgggatggcgtatctgcctgccgtcgtaatggtcgggcgttactttcaaaaaaggcgtgcactggctcaggggctgtccaccactggcactgggttcggtaccttcctgatgacagtgctgctgaaatatctgtgcgctgaatatggttggcgaaatgccatgttgattcagggggcagtttccttaaacctctgcgtttgcggagctctgatgcgacctttatctccaggtaaaaatcctaatgacccgggtgaaaaagatgtgcggggtctcccagcacactccacagagagcgtgaagtccaccggccaacaaggccgcaccgaagagaaggacgggggacttggaaatgaggagactctctgcgacctgcaagctcaggagtgtccagatcaggcaggacatcgcaagaacatgtgcgccctgcgcattctcaagacagtgagttggctcactatgcgtgtccggaaaggcttcgaggactggtactctgggtactttggaactgcttccttatttaccaaccgaatgttcgtggcctttatcttttgggctctgttcgcttatagttcatttgttatacctttcatccacctccccgaaattgtcaatctgtataacctgagcgaacagaatgacgtctttccactcacctcaattatcgcaatcgttcacatctttgggaaagtcatcctaggcgtaatcgccgacctgccatgcatcagtgtgtggaatgtgtttctcctggctaattttactttggttctgagcatctttattttacctctgatgcatacttacgccgggctggctgtgatatgcgccctcattgggttcagcagtggatatttttcactgatgcctgtggtgactgaagacctcgtgggcattgagcatcttgctaacgcctacggcatcattatatgcgccaatggaatcagtgccctgctaggccctccctttgcaggttggatttatgatatcacacagaagtacgatttttccttttatatctgtggcctgctctacatgattggcattttgttcttgcttatacaaccatgcattcggataatcgaacagagtcggaggaaatacatggacggcgcccacgtttag

SEQ ID NO: 30135 - DNA, 1458 bp, Artificial Sequence
  Description of Artificial Sequence: Synthetic coding sequence
atgtataccagccacgaagatatcggatatgatttcgaggatggaccaaaggataaaaagactttgaaaccacaccctaacatcgatggtggatgggcatggatgatggtgctgtcctcattctttgtccacattttaataatgggatcccaaatggctctgggcgtgttgaacgtagagtggctggaggagtttcaccaaagccggggcttaactgcgtgggtgagctcactgtctatgggaataaccctgattgtcggtccatttattggcctgtttatcaacacgtgcgggtgcaggcagaccgccatcatcggcgggttagtaaattctctggggtgggttctctccgcttatgctgctaacgtgcattacctctttatcactttcggcgtcgccgccgggctcggctctggtatggcttacctgcctgctgtggtgatggtgggacggtatttccagaagaggcgcgccctcgctcagggtctgagtacgaccgggaccgggttcgggacattcctgatgaccgttttgttgaaatacttgtgcgcagagtacggttggcgaaatgcgatgcttattcagggagccgtgtctctcaacctttgtgtgtgcggagctctgatgaggcctctgtcgcctgggaaaaacccaaacgatccaggtgagaaggatgtgcggggtttgccagctcattccaccgagtccgttaagagtaccggtcagcagggccgaactgaagaaaaagatggaggacttggaaatgaagaaactctgtgtgatttacaggcccaggagtgtcccgaccaggccgggcataggaagaatatgtgcgctctgcggattcttaaaacagtgtcctggctgacgatgagggtgagaaagggttttgaggactggtatagtggctatttcggtaccgccagcctttttaccaatcggatgtttgtcgccttcatattttgggccttatttgcctatagttcctttgtaatccctttcatccatttgcctgagatagttaatctgtacaacctgagcgagcaaaatgatgtttttcccttaacaagcattatagctattgtgcatattttcggcaaagtgatcttgggtgtgattgcggacttgccttgtattagcgtatggaatgtatttctgctcgcaaactttaccttggtactgtctattttcattctccctctgatgcatacctacgccggcctggctgtgatttgtgcactcattggcttctctagtgggtatttctccttaatgcccgttgtcaccgaagacttggtggggatagaacatctggcgaacgcctatggtattatcatctgtgctaacggcatctccgcactgctcggccctcctttcgccgggaagttatccgaggtcctcagggcacagtcggcatgtacctatggggccttgtgctacaaggtccccgacaaatag

SEQ ID NO: 30136 - DNA, 129 bp, Artificial Sequence
  Description of Artificial Sequence: Synthetic coding sequence
atgtatacatcacacgaggatatcggatacgattttgaagacggaccgaaggacaagaaaacgttgaagccccacccgaatattgacggcgggtgggcttggatgatggtccttagctctttcttctag

SEQ ID NO: 30137 - DNA, 57 bp, Artificial Sequence
  Description of Artificial Sequence: Synthetic coding sequence
atgtacacaagtcacgaggatatcggatacgactttgaggacggacccaaagattag

SEQ ID NO: 30138 - DNA, 1470 bp, Artificial Sequence
  Description of Artificial Sequence: Synthetic coding sequence
atgtataccagccacgaggatattgggtacgacttcgaagacggcccaaaggacaaaaagacactgaagccacatcccaacatcgatggaggttgggcatggatgatggtcttatcttctttttttgttcacatcctgattatgggctcccaaatggccctgggagtactcaacgtggaatggcttgaggagtttcatcagagccgtggactaaccgcctgggttagcagcctgtcaatgggcatcactctgattgtgggtccttttatcggtctgttcattaacacatgcggatgtcggcagacagccattatcggtggacttgtgaattctcttggttgggtcttgtctgcatatgctgctaatgtccattatttattcattacctttggggtagccgcagggctgggctcaggcatggcctatctgcccgccgtagttatggtggggcggtacttccagaaacgaagagctttggcacagggcctgagcacaacaggtacaggatttgggacctttctgatgactgtcctcctgaagtatctgtgcgcggaatatggatggagaaacgcaatgctgatccagggcgctgtcagcctgaacctatgtgtttgtggagctctaatgcgtcctttgagtccgggcaaaaatccgaacgatcccggagagaaagacgtgcggggccttcccgcacattcaaccgagagcgttaagagcacaggacaacagggtcgcactgaggagaaagatgggggattggggaacgaggagaccctttgcgacctgcaagctcaagagtgtccagatcaagcgggacatagaaagaatatgtgcgcactcaggattctcaaaacagtgagctggctgaccatgcgggtgcgtaaggggttcgaagattggtatagtggctactttggcaccgcctccctgttcaccaataggatgttcgtcgcttttatattttgggcattgttcgcttattcctcattcgtgatcccattcattcacctgcccgaaatagtcaacttatataacctgtctgagcagaacgacgtctttcctctgacgtctatcattgccatcgtgcatattttcggcaaggttattctgggagtgatcgcggatctgccatgtatttccgtctggaacgtattcctgcttgcaaacttcacattagtgttatccattttcatcttgccgctcatgcacacgtacgccggcctcgcagttatttgtgctctaatcggattttctagcggatatttttctctcatgccggtggtgaccgaggaccttgtaggcatagagcatctggctaacgcttatggcattattatctgtgccaacggaatctcagccctcctgggcccaccattcgctggcaaactctctgaggttctacgcgcccaatcagcatgtacctacggagctctgtgttataaggttccagataaagaggagggattttag

SEQ ID NO: 30139 - DNA, 1464 bp, Artificial Sequence
  Description of Artificial Sequence: Synthetic coding sequence
atgcttaagagagagggaaaagtccaaccttacacgaaaacactggatggcgggtgggggtggatgatagttattcactttttcctggtgaatgtgttcgtgatggggatgactaagacctttgcgatcttctttgtagtgtttcaagaggaatttgaaggcacaagtgagcagatcgggtggattggcagtattatgtcgagcctgcggttttgcgctgggcctttagtggccatcatttgcgatattctgggtgaaaaaacgacttcaatcttgggcgccttcgtcgtgaccggaggctacttaatctcctcctgggccacctccatccccttcctgtgtgtgaccatgggcctgctgccaggtttgggttcagcctttctgtaccaagttgcggccgtcgttactacgaagtactttaagaagagactcgccctgtccaccgctatcgccaggagtggtatgggtctcaccttcttactggcgccatttacaaaattcctcattgacctctatgattggactggtgccctgatccttttcggcgctattgctctgaatttagtgcccagcagcatgctcctccgaccgattcacattaaaagcgaaaacaattcaggcatcaaggataagggatccagcctgtctgctcatggcccagaggcccacgctaccgagactcactgccacgagacagaggaaagcactatcaaagattccaccactcaaaaagctggcttgccctctaaaaacctaacagtctcacagaatcaatctgaagagttctacaacggccctaacagaaatcggctccttctgaagtccgacgaagaaagcgacaaagtgattagttggtcttgcaagcaactctttgatatatcgctattcagaaaccccttcttctacatcttcacttggagttttttgcttagccagcttgcatatttcatccccacattccacctggttgcaagggctaaaacattgggcattgacatcatggatgcttcgtatctcgtgtctgtcgccgggattctcgaaaccgtgagccagatcataagcggatgggtcgcagaccagaattggattaagaagtaccactatcataaatcttacttaattttatgtggaataactaacttgcttgccccattggcaacaacctttcccctgctgatgacctatacaatctgcttcgctatctttgcaggtgggtatctcgcactaatcctccctgtgctcgtggatctttgcagaaactcaacagtcaataggttcctgggcttagcgtcattcttcgcgggcatggcggtcctcagtggcccacctatcgccgggtggctgtatgattatacccagacctacaatgggagtttttactttagcggaatatgctatctcctgtccagcgtctcattttttttcgtgccactggcagaacgctggaagaattccctgacatag

SEQ ID NO: 30140 - DNA, 960 bp, Artificial Sequence
  Description of Artificial Sequence: Synthetic coding sequence
atgctcaaaagggaggggaaagtacagccttatactaagactctcgacggaggatggggctggatgatagtgattcatttttttctggtgaacgtgtttgtcatgggaatgacaaagacctttgccattttcttcgtcgtcttccaagaggagtttgaaggtacttccgaacagatcggttggatcgggtcaatcatgtcctccctgagattctgtgccggccccctggtcgccattatctgcgacatcctgggagaaaagacgacctctatacttggcgcctttgtcgttactggaggttatctcataagctcctgggccacttcaatcccgtttctgtgtgtgactatgggtctactgcctggactgggcagcgcatttctctatcaggttgctgccgtggtaacaaccaagtattttaagaagaggctggctttaagtacagcgatcgcccgcagtggcatgggcctgacttttctactggcaccctttactaagtttctgatagatttatatgactggactggaatcctggagacagtgtcccagatcatatctggctgggtagctgatcaaaactggattaagaagtatcactatcacaagtcttatctcatcctttgtgggatcacaaatctcctggcccccctggccacaaccttcccgctgctgatgacctataccatatgcttcgctatttttgcaggcggctacttggcactgatcctgcccgtgcttgttgatttgtgccgaaactctaccgtgaatcggttccttggtttggctagtttctttgcaggaatggccgtgctgtccggccccccaatcgccggatggctgtatgactatacacagacctataatggatccttctactttagcggaatctgctatcttctgtccagtgtcagcttttttttcgtgcctctcgcagagcgctggaaaaatagtctaacttag

SEQ ID NO: 30141 - DNA, 1149 bp, Artificial Sequence
  Description of Artificial Sequence: Synthetic coding sequence
atgggcatggacgactgcgattctttttttcctggactgggctctgcatttctttaccaggtcgctgcagtggtgactacaaaatacttcaagaagagactggcactctctacggccattgccaggagcggcatgggccttactttcttgctcgccccattcaccaagttcctgattgatctttacgattggacgggagccctcatcctgttcggggccatagccctcaacctggtgccgtcaagtatgctgttgcgtcctatccacatcaagagcgagaacaatagcgggataaaggataaaggctcgtcgctgtccgctcacggcccagaggctcacgctactgagacccactgccatgaaaccgaggaatctacaatcaaagattctactacacaaaaggcagggctccctagcaagaacctgactgtcagtcagaatcagtctgaggagttctacaacgggcccaatagaaaccgcttgcttctcaaatctgatgaggagtctgacaaggtgataagttggagctgtaaacagttgttcgatataagcctgttcaggaatcccttcttctacatcttcacctggagctttttgctgagccagctggcatacttcatacctaccttccatctagtagcccgggctaagactctagggatcgacatcatggacgcttcctatctggtctcagttgccggcatcctcgaaactgttagccagatcatttctgggtgggtggccgatcagaattggattaagaagtaccattaccataaaagctaccttatcctgtgtggaatcaccaatctgctggcccccttagctacaactttcccactccttatgacatacactatatgtttcgctatcttcgccgggggctacttagcccttatacttccagtgttggtggacctttgcagaaattccactgttaaccgcttcctggggctggcttcttttttcgccggaatggctgtgctgtctggccctccaatcgctgaaataatcccaagcttccaggctggctacatgataattcctcggcataccatggccctatcaacttcattagcatacgccatctcctctctgcagttcccttttttcctttaccactggccaaaagatggaaaaaccgtatag

SEQ ID NO: 30142 - DNA, 1278 bp, Artificial Sequence
  Description of Artificial Sequence: Synthetic coding sequence
atgggcatggacgattgcgacagctttttcccaggcccactcgtggccattatttgcgacatcctgggcgagaagacaactagtattctgggagcttttgttgttaccggtggctatcttatctcgagctgggccacctccattccgtttctgtgtgtgacaatgggcctgctgcctggtctgggctcagcattcttgtatcaggtagccgcagtggtaactactaagtatttcaaaaagaggctcgccctcagcaccgctatcgcccgatccgggatgggtcttacatttctcctggccccgtttaccaaatttctgattgacctctatgattggacaggagctttgattctgtttggcgccatagcccttaatttagtgccttcctccatgcttttgagaccaatacacatcaagagtgagaataacagtggcattaaggataagggctcaagtttaagcgcccacggccctgaagcacacgccaccgagacccactgtcacgaaactgaagaatctaccatcaaagacagtactacacagaaggcaggcctgccctcaaaaaatttgactgtgtcccaaaaccaatccgaggagttttacaacggccccaaccgaaatcggctgctgcttaagtccgacgaggagtccgacaaagtgatatcctggtcatgcaagcagctttttgacatcagtctgtttcgcaatccattcttctacatattcacctggtcttttctgctatctcagctcgcttattttattccaacctttcacttggtagcaagggccaaaacactggggattgacattatggacgccagttacctagtctctgtagctggcattctggaaaccgtgtctcagatcatcagcggatgggtcgcagaccagaattggataaagaaataccattatcacaagagttacttgattctgtgcggaatcactaacttgcttgcccccctggccactaccttcccactcctgatgacgtacactatttgcttcgccatttttgcaggtggatatctggcccttatcctgccagtgcttgtcgacttatgtcgcaattcaaccgttaatcgatttctggggcttgcttccttcttcgctggaatggctgtcctctctggccctccaatcgcgggctggctgtatgactatacgcagacgtacaacggctccttttatttcagtggtatttgctacctgctgagctcagtgagctttttcttcgtcccccttgcagagcggtggaaaaacagtcttacctag

SEQ ID NO: 30143 - DNA, 1518 bp, Artificial Sequence
  Description of Artificial Sequence: Synthetic coding sequence
atgcctcaggccttagagcgggcagacggaagttgggcatgggtagtgctgctcgcaacaatggtgacacagggactcactttaggttttccaacctgtatcggtatcttctttaccgaattacagtgggagtttcaggcaagcaattccgaaaccagctggtttccgtccattcttacagcagtgctgcacatggccggaccactgtgctcaattctggtaggcagatttggctgccgcgtcaccgttatgctgggcggagtcttggcatctctgggcatggtggccagctcattctcccacaatttgtcccagctgtattttacagctggctttattaccggtctggggatgtgcttctcattccagagctccatcacggtgcttggcttttacttcgtgcgcagaagagtcctcgcaaatgccttagcctccatgggagttagcctgggcataaccctgtggcccttactttccagatatctgctggagaacctgggttggcggggcacttttctggtcttcgggggcatctttcttcactgctgtatttgtggagccattatcaggcctgtggctacaagcgttgcccccgaaacgaaagaatgcccacccccccctccggagacacctgccttaggttgtctggcggcctgtggacggacaatccagagacatttggcattcgacatactgagacataataccggctactgtgtttatatcctgggggttatgtggagtgtgctgggtttcccactgccacaggtttttctagtaccttatgctatgtggcactcggtggatgagcaacaggctgctctgctcattagcattattggcttctccaacatcttcctgagacctctggcaggtctcatggccggacggccggctttcgcctctcaccgcaagtatctgttttccttagcgttgctgctcaacggactgactaatttggtctgtgcagcgtcgggggatttttgggtcctcgtgggttactgtttagcctacagcgtgtccatgagtggaattggagcattaattttccaggttctcatggatattgttcccatggaccaattccctcgagctctcggcctctttactgtgctcgatggactcgcttttctgatcagtccgcctctagcaggcttgctgctcgacgccacaaacaattttagctacgtgttttacatgtcatcattcttcctcatttcggccgcattgtttatgggtggtagtttttatgctttgcaaaagaaagagcagggcaagcaggccgtcgccgcagatgccctcgagagggatctctttctcgaagcaaaggatggtccaggaaaacagcgcagcccggaaataatgtgccagagctcgaggcaaccgcgcccggcgggagtgaataaacacctgtgggggtgcccagccagctccagaacatcacacgaatggctgttgtggccgaaggccgtgctgcaggcaaaacaaaccgcactgggctggaattcccctacgtag

SEQ ID NO: 30144 - DNA, 1518 bp, Artificial Sequence
  Description of Artificial Sequence: Synthetic coding sequence
atgccccaggctctggaacgagccgatggcagctgggcgtgggttgttttgctggcaaccatggtcactcagggtttgaccctgggattcccaacatgcataggcatctttttcacagagctgcaatgggagttccaggcgagcaactccgagacgagttggtttccctctattctcaccgccgtgctgcacatggcgggccccctgtgttccattctcgtcggtcggtttgggtgccgggtcactgtgatgctgggtggggtgctcgcgtcactcggtatggtagctagttctttctcccacaatctgtctcagctgtactttaccgctgggttcataacaggtctggggatgtgcttcagttttcagtccagtattactgtgctgggcttttacttcgtaagacgaagggtcctggctaacgctctcgcgagcatgggcgtgagcttggggataactctgtggccgctcctctcaaggtaccttctggagaaccttgggtggagaggcactttcctggtcttcggcggaatcttcctgcattgctgtatctgcggcgccatcattcgaccagttgcgacttccgtcgctcctgaaacaaaggaatgtccaccccccccacctgaaacccccgcccttggatgccttgcggcctgtggcagaacaattcaacggcatttagccttcgatattttgcgacacaacaccggttactgtgtctatatactcggtgtgatgtggtccgtcctcggctttcctctgccccaggtctttctcgtgccttacgcgatgtggcattccgtggatgagcagcaagctgccctgttgatttccatcatcggattttctaacatcttcctgagaccactggcaggactgatggcaggccgacccgcctttgcgtcacatcgtaagtacctgttcagtctagctctcctcctgaacggcctgaccaacttggtatgcgctgcatctggtgacttctgggtgctggtcggctactgcttagcctatagcgtttccatgtctggtatcggcgcactgatctttcaagttctcatggatattgtaccaatggatcagttcccaagagctctggggctttttaccgtgctggatggtctggccttcctgatcagccctccgctggccgggttattgttagatgctacaaataatttttcatacgtgttctatatgagcagtttctttttgatctcagctgcgctttttatggggggaagtttttacgcgctccagaaaaaagagcaaggcaagcaggccgtggctgccgacgcactggaaagggatctcttcctcgaggcgaaggatggccccgggaaacagcgctcccctgaaatcatgtgccaatcttcaagacaacctcgcccggcaggagtaaataagcatctttggggttgccccgcatccagccgcacaagccatgaatggctgctttggcctaaggcagtcctgcaggcaaagcagacggcactcggttggaacagccctacttag

SEQ ID NO: 30145 - DNA, 1503 bp, Artificial Sequence
  Description of Artificial Sequence: Synthetic coding sequence
atgccgcgcccgaccaggggacctctggcaacctctcagggatggtgtccatccgtgactccagggacttgggccgccgcgacgctagccgtgcgcccatggcaacggcggcaacagcgtatgccccaggccttggagcgagccgatgggagttgggcttgggtggttttgttagctacgatggtaacccagggactaactctgggcttccccacatgcattgggatctttttcacagagttgcagtgggagtttcaggctagtaatagtgaaacttcttggtttccatcaatcctgactgccgtgctgcatatggccggacccctctgtagcatactagtgggtcgcttcgggtgccgtgtgaccgtaatgctggggggagttctggcctccctggggatggttgcttcttccttctctcataacctgtcacagctgtactttactgccggatttatcacaggcctgggaatgtgtttctcctttcagagcagcatcaccgtactgggtttctattttgtccggcgaagagtgctggcgaacgccctcgcatccatgggagtctcattgggaattacactgtggcccttattatctcggtacctcttggaaaacctcgggtggcggggtacattcctggtgttcggaggaatcttcctgcactgttgcatatgcggagccattatccgccccgtcgcaaccagcgttgcaccagagaccaaagagtgtccacccccgccgcctgagactcccgccctgggatgtctggcggcttgcggacgaacaatacagcggcatctggctttcgacatcttaagacacaacacaggctactgcgtgtacatactgggggtgatgtggtcagtactaggatttcccctgccccaggtgttcctggtcccgtacgcaatgtggcacagcgtcgacgagcaacaggctgccttgctgatcagcataatcgggttctcgaatatctttttacgtcctctagccggccttatggctgggagacccgccttcgcctcccacagaaaatacttgttcagcctcgccctcctactgaacggccttactaacctggtctgtgctgcctcaggggacttctgggtcctggtcggatactgtttagcctatagcgtgagtatgtccgggataggggcactaatcttccaggtactgatggacattgtgcccatggatcaattcccgcgggctctcggcttgtttacggtgttggacggcctggcgtttcttattagccctcctctggcaggcctgctccttgacgctacaaataatttcagctatgtgttttatatgtcctctttttttctaatttcagccgcccttttcatgggggggtcgttctacgccctccaaaagaaggagcagggtaagcaagcagtggccgccgatgctctggaacgtgatcttttccttgaagcgaaggatggaccgggtaaacagcgcagtcccgagattatgtatgttacttccgtgtag

SEQ ID NO: 30146 - DNA, 1572 bp, Artificial Sequence
  Description of Artificial Sequence: Synthetic coding sequence
atgacccaaaacaaactcaagctatgcagcaaggccaacgtttacacggaagtgccagatggcggttgggggtgggccgtggctgtcagctttttcttcgttgaagtgttcacctatggtatcatcaagacctttggggttttctttaacgatttgatggattcctttaatgaatccaactccagaatctcttggatcattagcatctgtgttttcgtgttgacttttagtgcgcccctggcaaccgtcctgagtaacaggttcgggcacaggctggtcgtgatgctggggggtctgctcgtgtcaaccggaatggttgctgccagcttctcacaggaagtttctcacatgtatgtagccatcggtataataagcggactcggatactgcttctccttccttccaacggttacaatcctctcccagtatttcgggaagcgcaggagtattgtgacagccgttgcttccactggtgagtgttttgccgtttttgcctttgcacctgctatcatggcgttgaaggaaaggatcgggtggcgctatagcctcttgttcgtgggtctgctccaactcaatatcgttatttttggtgcactcctaagaccaattttcatcagaggacccgcctctccaaaaatcgtcatccaggaaaacaggaaggaggctcagtatatgctggagaacgagaagacgaggacgagcatcgattcaattgacagtggagtggaattgactactagtccgaaaaatgtgccaacccacacaaatctggagctcgaacccaaggccgacatgcagcaggttttggtgaagacctctcccagacccagcgaaaagaaagctccactgttagatttttctattttaaaagagaagtcatttatctgttatgctttgtttggtttatttgccaccctgggattctttgcccctagcctctatatcattccccttggcattagtctcgggattgaccaggatcgggcagcattccttctgtccaccatggctattgctgaggtgtttgggcggattggggctggttttgttttgaatcgagagccaattcggaaaatctatatcgaactgatatgcgtgatcctgctgactgtgagcctttttgctttcacctttgccaccgaattctggggcctgatgtcctgcagcatcttcttcgggtttatggtgggcactatagggggaactcacattccactccttgcagaagacgatgttgtcggtatcgagaagatgagcagcgctgcgggagtatatatcttcattcagtccatcgcaggtctcgctggaccgcccctcgccggactgctggtggaccaaagtaagatctacagtcgcgctttctactcttgtgccgccggaatggctctggccgcagtctgcctggccttggtgagaccttgtaagatgggtttgtgccaacaccaccacagcggagaaaccaaggtagtgagccaccggggcaaaactcttcaggacataccggaggatttcttagagatggatcttgccaaaaacgagcacagagtccacgtccaaatggaaccagtgtag

SEQ ID NO: 30147 - DNA, 1515 bp, Artificial Sequence
  Description of Artificial Sequence: Synthetic coding sequence
atgggggcaggcggccctaggcgcggggagggccctccagacgggggctggggctgggttgtcctgggagcatgctttgtcgtgaccggcttcgcgtacggctttcctaaagccgtgtccgtgtttttccgtgctcttatgagagacttcgatgctgggtacagcgacactgcttgggttagttctatcatgttagctatgttgtacggcacaggcccagtgagctctatcctcgtcactaggttcggatgccggcccgtcatgctggctggaggactgttagcatccgctgggatgattctggcctccttcgcaactcgtctcctggagctttacttgaccgcaggcgtgcttaccggcctcggactggccctgaattttcagcccagcttaataatgctgggactgtactttgagcgcaggagacccctggctaatggcctcgccgccgccggatcccctgtgtttctgagtgctctttcccccctaggtcagcagcttcttgagaggtttggatggcgtggcggtttccttcttttgggtggactgctgcttcactgctgtgcctgcggagccgtgatgaggccaccaccaggccctggaccacggcctaggagagattcagccggagatagagccggcgatgctcctggagaagcagaagccgacggggcaggccttcagttgcgagaagcctctccgcgggtacgacccaggcgccgactgctggacttggcggtgtgcaccgaccgggcctttgctgtctatgctgtgacaaagttcctgatggcacttggtttgtttgtgcccgctatactgttggttaactatgctaaggacgccggcgttcccgatactgatgcagccttcctcctgtcgatcgttggatttgtggacatcgtggcaaggcccgcatgcggcgctttggccggcttggccagactccggccccacgttccttacctgttctccctggccctgcttgccaatgggctcaccgacctctcaagcgccagagcacgatcctacggtgctcttgtggctttttgcgttgcttttggactcagctatgggatggtgggagcccttcagtttgaagtgttaatggccgcagtcggcgccccacgtttcccaagcgccctgggtctggttttgctggtggaggccgccgccgtgctgataggcccaccttctgcaggacgattagttgatgtgctgaaaaattatgagattatcttttacttggctggcagcgaagttgccctcgccggagtgttcatggcagtcgctacaaattgttgtttgaggtgtgccaaagcagccccgagcgggcccgggactgaaggcggcgcgtcagatacggaggacgccgaggcagaaggagatagcgagcccctacccgtcgtcgccgaggagccagggaacctagaagcgttagaagttctttccgcccgaggcgaaccaacagagccagaaatcgaggctcggcctcgtctggctgcggaatctgtatag

SEQ ID NO: 30148 - DNA, 294 bp, Artificial Sequence
  Description of Artificial Sequence: Synthetic coding sequence
atgggcgctggaggaccccggagaggagagggtccacccgacggcgggtggggatgggttgtactgggggcctgtttcgtggttacaggatttgcatacggcttccctaaagctgtgtcagtgttttttcgcgccctgatgagggacttcgatgcaggctactccgacactgcatgggtctccagcattatgttggctatgctttacggcacaggtcctgtctcctcaattctggtgacccggtttggctgtcggcctgtgatgctggctggaggcctactggccagtgcatag

SEQ ID NO: 30149 - DNA, 1500 bp, Artificial Sequence
  Description of Artificial Sequence: Synthetic coding sequence
atgcttcacgcgctgctacggagtaggatgattcaggggcgcatcctactcctgaccatatgtgccgcgggaattggcggaacattccaatttggctacaacctatctattattaacgcccccactctacatatccaggagtttacaaatgaaacctggcaggctaggacgggggagccgctgccagaccatctagtgttgctgatgtggagtctgatcgtaagtctttatccattgggcggattgttcggggcgctcctcgcaggccctctcgccattacattaggacggaagaagtctctcctggtaaataacatatttgttgtgtctgctgccatcttgtttgggttctccaggaaggccggctcctttgagatgataatgttgggtcgccttctcgtaggcgtaaacgccggggttagcatgaacatccaaccaatgtatctcggcgagagcgctccaaaggaactccgtggcgccgtagccatgagctccgcaatctttaccgccctcgggatcgtgatggggcaggtggtcggcttgcgagagctgctgggtggcccacaggcatggcctcttcttctggcaagctgcctggtcccaggagccctgcagctggcttccctacccctccttccggagtcaccaagatacctgttaatcgattgtggcgataccgaggcctgcttggcagcgctgagacgcctgcgtggctctggcgatcttgccggggaactcgaggagctggaggaggagcgtgccgcgtgtcagggctgccgggccagacggccttgggaactgttccagcaccgagctctccgccgccaggtgacctctcttgtggtgctgggttccgccatggaactgtgtggcaatgatagtgtttacgcttatgcatcgtcagttttccggaaagcaggggtgcccgaggccaaaatacaatatgcaatcatagggaccggcagctgtgagctcttaactgcagtcgtttcatgcgttgtaatcgaaagggtgggccggcgtgtccttttgatcggaggatatagtttgatgacttgttggggtagtatcttcaccgtagccctctgtcttcagtctagcttcccttggacactctaccttgccatggcatgcattttcgcatttatcctcagcttcggcatcggccctgccggcgtgaccggaattctagccaccgaactgttcgatcagatggctagacccgccgcctgcatggtgtgcggcgcactgatgtggatcatgctcattctggtggggctggggttcccctttattatggaggcgttgtctcacttcctgtacgtgccttttcttggcgtttgcgtgtgtggtgctatctacacagggctttttcttcccgagactaagggaaagacctttcaggagatcagtaaagaactacatcggctcaactttcctaggagagctcagggacctacatggaggagtttggaagtgatacagtccaccgagctgtag

SEQ ID NO: 30150 - DNA, 1491 bp, Artificial Sequence
  Description of Artificial Sequence: Synthetic coding sequence
atgcgggctttgagaagattaatccaggggcgtatactcctgttgacaatctgtgccgccggcatcgggggaacctttcaattcgggtataatctatctatcatcaacgcacctactttgcatatccaggagttcacgaatgagacatggcaggcgcggacaggagagcccctcccagatcacttggtgttattgatgtggtcactaattgtaagtctctatccgctgggagggctgtttggagccttgctcgcgggccctttagcgattaccctggggcggaagaaaagtttgcttgtgaacaatatcttcgtcgtcagtgctgctattcttttcggcttctccaggaaggctggctccttcgaaatgattatgttaggtagactactggtgggagtcaacgcaggcgtgtcaatgaatatacaacccatgtatctgggggagtcagcccctaaagagctgcgcggagccgtcgccatgagttccgcgatattcacagcactcggcatcgtgatggggcaggtcgttggcctgcgagagctactgggtgggccacaggcctggcctctgctgctcgcttcctgcctggttcctggcgccctccagctggcctcattaccccttctccctgagagtcctagatatctgttgatcgactgcggtgacactgaggcttgtctcgccgctctaagacggctgcgggggtcgggagatttggctggagagctcgaggagctggaggaagagcgcgctgcctgtcagggatgcagagcccgccggccctgggagttgtttcaacacagggctctgaggcgacaggttacttccttggttgtcttagggtctgctatggaactctgcggcaacgactctgtctatgcttatgcgagctctgtgtttcgcaaggctggggtgcccgaagcaaaaatccaatacgcaattatcgggaccggttcatgcgaactcctgaccgcggtggtctcttgcgtggtcatcgagagagtggggaggagagtcctcttgatcgggggatattccctgatgacgtgctggggttcgatctttacagtggctctctgcctgcaaagttcctttccatggaccctctatctagcgatggcgtgcattttcgcctttatcctgagttttggaataggtccggcaggggtaaccgggatcctagccactgagctgttcgatcaaatggccaggcctgccgcatgcatggtttgcggtgcactgatgtggatcatgctcattctggtcggattggggtttccctttattatggaggccctgagccactttctttatgtcccctttcttggagtctgcgtgtgcggcgccatctatacaggactgtttctgccggaaacaaagggtaagacattccaagaaatctccaaagaactacacagactgaatttccctagaagggctcaagggcccacctggcgcagcctcgaggtaatccagtcgacggaactgtag

SEQ ID NO: 30151 - DNA, 1512 bp, Artificial Sequence
  Description of Artificial Sequence: Synthetic coding sequence
atggaggacgagctggagccatctctgcggccaagaactcagatccaagggcggatactgctgttgaccatctgtgccgccggcatcggaggaaccttccaatttggatacaatctgtccatcatcaacgcaccgaccctgcacatccaggagtttacaaacgagacctggcaggccaggacgggggaacccctgcccgaccatctggtgctcctcatgtggtcactcatagtgagtctttatcctctgggagggctttttggggccttactagcagggccgcttgccataaccctgggtcgaaagaagtccctcttggtgaataatatttttgtcgtctccgctgcaatactgtttggcttcagtagaaaggccgggagctttgagatgattatgctcggacgcctgctggtcggggtcaatgccggagtttcaatgaatattcagccgatgtatctgggtgaaagcgccccaaaggagttgcgcggcgctgttgccatgagttccgcgattttcaccgcattgggcattgtgatgggtcaggtagtgggtctgcgagagctgctagggggcccccaggcctggccactcctgttggcaagttgtctggtacctggggctcttcaactggccagtctaccactgctccccgagtcaccaagatatcttctgatcgattgcggtgatacggaagcctgtctggcggccttaaggcgactgcggggttctggagatttggcaggagagctggaggaactggaagaagagagagccgcatgccagggttgtagagcacgtcggccgtgggagctgtttcaacacagagctctgcggcgacaggtgacatcactggttgtgctaggatcagccatggaattgtgtgggaacgactctgtctacgcatatgcctcttccgtgtttcgaaaagcgggcgtgcctgaggccaagattcagtacgcgattatcgggaccggttcatgcgagctgttgacagccgttgtgagctgcgttgtgattgaacgcgtaggacgtagagtgctgttgattggcggctattcgctaatgacttgctggggcagcatattcaccgtcgccttgtgcttacaaagctccttcccctggacattgtacctcgcaatggcctgcattttcgcctttatcctgagcttcggcattggccctgccggagtgactggcatcctagccacagagctctttgaccagatggctaggcccgccgcttgcatggtatgcggcgccctgatgtggattatgctgattctagtgggtctgggattcccctttatcatggaggcactctctcacttcctgtacgtccccttccttggcgtttgcgtgtgcggcgcaatctatacaggactgttcctgcccgaaactaagggtaagacgtttcaggagataagtaaggaattgcacaggctgaactttccaaggcgagcgcaggggccgacttggagaagcctcgaagtgatccagtctactgagctttag

SEQ ID NO: 30152 - DNA, 1104 bp, Artificial Sequence
  Description of Artificial Sequence: Synthetic coding sequence
atggaggatgagttggagccttcactgcgccccagaacacagattcagggaagaatcctgctgctgacaatctgcgctgctgggatcggcggcaccttccaatttggctataacctgtctatcattaacgcccctaccctccatatccaggagtttaccaacgaaacatggcaagccagaacaggcgagcccctgccagatcatttagtgctcctgatgtggagcctgatcgtgtccctgtatccgctgggcgggcttttcggcgcactgttggctgggcccttagcaatcacccttggtcgaaagaagagtctactggtcaacaacatcttcgtggtcagcgctgctattctgtttggattttccaggaaagcagggtcatttgaaatgattatgttaggacggctgctcgtgggcgtgaacgctggagtgagcatgaacatccagcctatgtatctgggagaaagtgcccctaaggagctccgcggggccgttgccatgtcttccgccattttcacagcgctcggtatagtgatgggccaggttgtgggactgcgcgaactgttgggagggcctcaagcctggccacttctgctggccagctgcctggtgcctggcgcgttgcaactggccagccttcccctcctgcccgagtccccacggtatttgctgatagattgcggtgataccgaagcctgtctggctgcacttcgccggttacgggggagcggagacctggccggggagctcgaggagcttgaggaagagcgagcggcttgccaaggatgtagagcccggaggccttgggagctgttccagcaccgcgccctccgccgacaggttaccagtctggttgtcctgggctcggcaatggagctttgcggtaatgatagcgtgtatgcatacgcatcatccgtcttccgcaaagcaggcgtgccggaagccaagatacaatacgccattatcgggacaggcagttgtgaattacttactgccgtggtgtctgtaagcctggagggcgcactgccaccccccgccctgtgggggggcacacccaggtcttctgccctgaatcagttcacccttcagaagaaaaagaagtag

SEQ ID NO: 30153 - DNA, 1104 bp, Artificial Sequence
  Description of Artificial Sequence: Synthetic coding sequence
atgagagcgctgagaagactgatccagggtaggattttgctgctcaccatctgcgcagctggcatcggcggaaccttccaatttgggtataatctgagtatcatcaacgcaccgacactccacatccaggagttcacaaatgaaacgtggcaggcaaggactggcgagcctttacctgatcacttggtcctgctgatgtggtctctgattgtctcactctatccactcggggggctgttcggcgctctcctagctgggccacttgccataacattaggccgcaagaagagccttctggtgaacaatattttcgtggtgagtgccgccatcttatttggcttcagcagaaaggctggctcattcgagatgatcatgttaggcagactgctcgtaggcgtaaacgccggagtgtctatgaatatccagcccatgtacctgggagaatctgcccctaaagaactgaggggggctgttgccatgtcctcagccatctttaccgcactgggtatagtgatgggccaggtcgtcggactctctaccaccgctgctcctggtctccgtggcctcggccggggcgctggcggtgccggaggcggagccaggtgcctgccaggactgccctgtagaccctgggaactctttcagcatcgggctctgcgccgccaggtcactagcttagttgtgctgggttccgctatggagctgtgcggcaacgacagcgtgtatgcttatgcctccagcgtgttccgcaaggccggagtcccggaggcgaagatccagtacgcgataattggcacgggcagctgcgagctgctcactgctgtggtttcagtatctctggaaggggcattgcctccccctgcattatgggggggcactccccggagtagcgccctcaatcaattcaccttacaactgatggtcctcaaatgctctgaaggaccgggcgcggtcgcccacgcatgcaaaccctcaactttgggcggccgaggaggctggatcactcgcagtggagtgagggaccagcctgggcagcacagtgagacccccgtgtctaccaaaaaatacaaaaagctgagccgtaggggaggtggccgattatag

SEQ ID NO: 30154 - DNA, 1392 bp, Artificial Sequence
  Description of Artificial Sequence: Synthetic coding sequence
atggaagatgaattggagccctccttaaggccaagaactcagatccaaggccggatcctgctcctgacgatctgtgccgcaggcatcgggggtaccttccaatttggatacaatctgtctatcattaacgccccaacactgcacatccaggagttcaccaacgaaacctggcaggccagaactggagaaccattaccagaccatctagtgctcctgatgtggtctttaatagtcagcctgtatccactgggcgggctttttggcgccctcttggccggtcctcttgcaatcactctgggtaggaagaagagccttctggtgaacaacatcttcgtcgttagcgccgcaatcctgtttgggttcagcaggaaggctggcagtttcgagatgattatgcttggcagactccttgttggcgtgaatgctggggtgtccatgaacatacaaccaatgtacctcggcgaaagtgcccccaaggaactgagaggagctgtggcgatgtcctccgccatctttacagcccttggcatcgtgatgggacaggtggtgggattgagagaactgttgggtggccctcaggcctggcccctgttactagccagctgcctcgttccgggagccctgcagcttgcctcactgcccctgctgcctgaaagtccaaggtatctcttgattgactgcggtgatactgaagcctgcctggcggctttacgccgcctgcgagggtctggtgacctggccggagagcttgaagagctggaagaggagcgagcagcctgtcaagggtgtagggcccggagaccttgggagctcttccaacaccgagccctccgccggcaggtcacatccctagtagtcctcggcagtgccatggaactctgcgggaacgattctgtctacgcctacgccagtagtgtgttcagaaaagctggggtcccggaagcaaaaatccagtatgcaatcatcggaactggttcttgcgaattattaacagcggtcgtgtccgtggccggggtcgacgaaggttggggggtccaggcaggactgacgagtacgtccccaccgccgagaccacgtcaatcctcctttccatggacactgtatttggctatggcctgcatatttgcctttatattaagctttgggatcgggccagccggggtcaccggtatacttgctactgagttgtttgaccagatggcccgcccggcagcctgcatggtttgtggggccctcatgtggatcatgcttatcttggttggactagggttccccttcattatggttcttggttctttcctgatcgcgggaggactggtgcctctacctttgtgtccctttccatggtgcctatgcctgtggggacatctccactggccagtcccttcctag

SEQ ID NO: 30155 - DNA, 1854 bp, Artificial Sequence
  Description of Artificial Sequence: Synthetic coding sequence
atggtgcctgttgaaaatacagagggtccttccctgctcaatcagaagggcactgccgtggaaaccgagggtagtggttcccgtcatccaccatgggcaaggggctgcggaatgtttacttttctgtcaagcgtcaccgctgctgtgtctggactcctggttggttatgagctgggaattatcagcggagcactgctgcagatcaaaactcttctcgcactgagttgccacgagcaggagatggttgtcagtagtttggtcataggcgctctccttgcttcccttacgggcggagtcctcattgacagatacggccgtaggactgctataatactgagctcctgcctgttaggattgggatccttggtactcatcctttctctcagctataccgtcctgatcgttggacgaatcgcaatcggcgtgagtatctctctgagcagtatcgcaacttgtgtgtatatagcggaaatcgcacctcagcaccgtcgaggtctgctggtatctctgaatgaactaatgatcgttattggaatactcagcgcctatattagcaattacgcatttgccaacgtcttccacggatggaaatacatgttcgggctggttatccccctgggagtcttgcaggccatcgccatgtacttccttccgccatcacctcggttcttggtcatgaagggacaggaaggcgccgcttccaaagtgctgggcagattgcgcgccctgtctgacacaaccgaagagttgactgtgataaaatcctcgttgaaagacgaatatcagtattccttttgggatctgttcagatccaaagacaacatgcgaactaggataatgattggtctgactttggtcttcttcgtgcagatcaccggccagcccaacatcctgttttacgcctcaaccgtgttaaaatctgttggtttccagagcaacgaggcagccagcctcgcaagcacaggcgtgggtgtcgtgaaggtaatctccacaatacccgccaccctgctggtcgatcatgtgggctcaaagacttttctctgcataggctctagcgtcatggccgcctcacttgtcactatgggcattgtaaacttgaacattcacatgaacttcactcacatttgcagaagtcacaactctattaatcagtctctagacgagtcagtaatctatgggccgggcaacctgtccactaacaacaacacactgcgggaccatttcaaagggatttctagccactcgagatccagcctaatgcccttaagaaatgatgtggacaaacggggggaaactactagcgcctctcttctcaatgctggcctatcccacacagagtaccagatagtcaccgatccgggagatgttccggcatttctcaagtggttgtccctcgcctccctgttagtgtacgtggctgcgttctcaatcgggctggggcccatgccttggctggtgctatcggagattttccccggcggcataaggggacgtgctatggccctgacgtctagcatgaattggggcatcaacctcctcattagtctaactttccttactgttactgatctgatcggcctgccatgggtttgtttcatctataccatcatgtctttggcaagcctgctgtttgttgtgatgttcatcccggaaaccaaggggtgctcactggagcagatcagcatggaacttgcaaaagttaattacgtcaagaataatatctgttttatgagccaccatcaggaggagttggtgcctaagcaaccccagaagcggaagccacaggagcaactgctagaatgcaacaaactttgtggcaggggccagtctcgacaactgtctccagagacgtag

SEQ ID NO: 30156 - DNA, 1656 bp, Artificial Sequence
  Description of Artificial Sequence: Synthetic coding sequence
atggcccagtttgtgcaggtcctcgccgaaatcggggattttggccgtttccagatccagttgctcattcttctttgcgtcctcaactttcttagccccttctacttttttgctcacgtcttcatggtacttgacgagccacaccattgcgcagtggcttgggtaaaaaatcacaccttcaacctttcagctgccgagcagttggtgctgagcgtgccattggatacagctggacatcctgaaccctgcctgatgtttcgccccccgcccgcgaacgcctctctccaggacattctcagccatcgctttaatgagactcaaccttgtgatatgggatgggaataccctgaaaaccggttaccatcactcaagaacgaatttaatctcgtatgtgatcgtaagcatctgaaggatactactcagtctgtctttatggcaggtctgttggtagggacacttatgtttggacccctttgcgatcgtataggcagaaaggcaaccatactggcacagttactgctgtttactctgattggcctagccacggcatttgtgccctcctttgaactgtacatggcactgcgattcgcagtcgcgactgcagttgccggcctctcgttttccaatgtcactttactcacagaatgggtgggcccaagctggcgcactcaggcggtggtattagcgcagtgcaatttttctctgggccagatggtcctggccggtctggcttatggcttccgcaactggcgactgctgcagattactggtactgcacctggtcttctccttttcttttacttctgggccttgcccgaaagtgctcgttggctcctgactagggggcggatggatgaagccatccagctgattcaaaaagcggcgtccgtgaaccggaggaagctcagcccagagctgatgaatcagcttgtgccggagaagacaggaccctctggcaatgccctggaccttttcagacacccccaactgcgcaaggtgacattaatcattttctgcgtgtggttcgtggactcacttgggtattacggcctgtcccttcaggtgggggatttcgggctggacgtgtacctgacgcagctgatctttggggctgtggaggtgccggcgcgttgttcctctatcttcatgatgcagcgatttggacgcaagtggagtcagttgggcaccttggtgcttggcggcttgatgtgtatcatcattatatttattcccgctgatcttcccgttgtggtgaccatgctggcagtggttgggaagatggcaacagcggcagcctttacgatctcctacgtctacagtgccgaattgttccctaccatcctccggcaaacgggtatgggcctggtgggcatattctcccggattggaggtatcttaacccccctggtaatacttcttggtgaataccatgccgccctgccgatgctgatctacggctctctgcccatagtggccggactgctctgcaccctgctgccagagactcatggacagggtttgaaggatacccttcaagatctagagttgggcccacacccccgatcacccaaaagcgttccttctgaaaaggaaaccgaggcaaagggccggacctcttccccaggggttgcctttgtgtctagcacgtatttttag

SEQ ID NO: 30157 - DNA, 618 bp, Artificial Sequence
  Description of Artificial Sequence: Synthetic coding sequence
atggtgctggatgagcctcatcactgtgctgtggcatgggtcaaaaaccacacttttaatctgtcagcagctgagcagctcgtgttgagcgtgccccttgacacagcgggtcaccctgagccttgtctgatgttcaggccaccacccgctaatgcttcgttgcaagacatactatcccatcgctttaacgaaacgcaaccctgtgacatgggttgggaataccccgaaaatagactcccgagcctgaaaaacgagttcaacctcgtgtgtgacaggaagcacctcaaggacactacccagtctgtttttatggccggcctgcttgtagggactctgatgttcgggcccctctgtgatcgtgaccgcatgggaggcgctctcatggaagacgctggccgaggcccaggtcctgtccagctgttgccccgggcggacggcgcatgcggaacgcggctccggttcccacaactggaagccccttcagaccatcgccattgcgcatggctcacagccctgctcctgctgcttggttcagctagaatctgcacgctcgctcccgacccatgggaggacggaaggggcgacactactgacccagaaggtggtctggggcagtag

SEQ ID NO: 30158 - DNA, 1662 bp, Artificial Sequence
  Description of Artificial Sequence: Synthetic coding sequence
atggcattccaggatctcctcggccatgcgggagatttatggcggtttcagatccttcagactgtgtttctctctatttttgcggtggctacctatctgcatttcatgctcgagaattttaccgcgttcattccgggtcacagatgctgggttcacatcctcgataacgacacagtctcagataatgatactggagctctgagccaggatgcactgcttaggatctccatcccccttgattcaaacatgcgtccagaaaagtgtaggcgattcgtccacccccagtggcaactcctgcacttgaacggaacctttccaaatacttctgatgcggacatggagccgtgtgtggatggatgggtgtacgaccgtatttcattcagctctaccatcgtgacggagtgggacctggtgtgcgactcgcagtcccttaccagcgtagcaaagttcgtctttatggccgggatgatggtcggtggaattctcggtggacatctctccgatagattcggaagaagattcgtcctccgctggtgttatcttcaggtggccattgttgggacttgcgccgcccttgctccaacttttttaatctattgctcacttcgctttttatccgggatcgccgccatgagcctgataactaatacaatcatgctgatcgccgagtgggccacccacaggtttcaggcaatgggaattacactggggatgtgtccgagcgggattgcattcatgactctggccggtctggcgtttgctatcagagattggcacattttacaactcgtagtgagtgttccctactttgtcattttcctcacaagctcgtggctgttggaaagcgcacgctggttgattatcaataataagcccgaagagggcttaaaggagcttcgtaaggcagctcaccggagcggaatgaagaacgcccgggacacacttacgttggagattcttaagagtaccatgaaaaaggagctcgaagcagcacagaagaagaagccctcactctgtgaaatgttgcatatgccgaatatatgcaagcgcattagtttgctgtccttcaccagatttgccaattttatggcttatttcggactcaacttgcacgttcaacatctgggaaataatgtgttcctgcttcagactctattcggcgcggtgatcttgctggctaattgtgtggcgccctgggcactcaagtatatgaatcggcgggctagccaaatgctgctgatgttcttgttggccatatgcctcctggccataatctttgttcctcaagaaatgcagaccctgagggaagtcctcgccaccctggggttaggagcttccgctctggcaaacactttggcctttgcacatggaaacgaagtaatcccgactatcattagagcacgagccatgggaatcaatgccaccttcgctaatatcgccggagccttggcgccccttatgatgattctgtccgtgtacagcccacctctaccttggattatctacggcgtgttcccattcatctctgggtttgcctttctcctgctgccagaaactagaaacaagcctctgttcgacaccatccaagatgagaaaaatgagcgcaaagacccaagggagcccaagcaggaagatcccagagtcgaggtgactcagttctag

SEQ ID NO: 30159 - DNA, 717 bp, Artificial Sequence
  Description of Artificial Sequence: Synthetic coding sequence
atggccttccaggacctgctaggccatgcgggagacctgtggcgctttcagatcctgcagaccgtgttcctctcaatttttgctgtagcgacttatctccactttatgctggagaactttacagcctttatccctggccaccgctgctgggttcatattctggataacgatacggttagcgacaacgatacaggagctctttcacaggatgccctgctgagaatctccatcccactcgatagtaatatgagacctgagaaatgccgacggttcgttcaccctcagtggcagttgctgcatcttaatgggacatttcctaatactagtgacgcagacatggagccctgcgtggatggttgggtgtatgaccgtatttcttttagcagtaccattgttacggagtgggatctcgtatgtgatagccagagcttaacctcagttgccaagttcgtgttcatggccggaatgatggtggggggcatcttaggcgggcatctctctgattccagtagggtggggaacactcagattcctggacacggtaactacatcggcaatgtgcctttctggtactgtatttacgacccgggcagaccaggcttctgtcatagccgactggcttatcctcccgcgggaggggtctgcacaatcttatgtgatctctcagacctgaaactggcagctcgcgtgtgctcagtggcccattaccagcaatag

SEQ ID NO: 30160 - DNA, 1626 bp, Artificial Sequence
  Description of Artificial Sequence: Synthetic coding sequence
atggcctttgaggaactcctctcccaggttggcggcttaggccggttccagatgctccatcttgtgtttatcctgcctagtctcatgctgttaattccacacatactcctggagaacttcgccgctgcgattcctggacatcgctgttgggttcacatgcttgacaacaacactgggtccggtaacgagactggaatcctctccgaggatgctcttttaaggatcagcatcccccttgacagcaacctgaggccagaaaagtgtaggcggtttgtgcatccccagtggcagctgctgcacctgaatgggacgatccatagcacctccgaggcggacactgaaccatgcgttgatggctgggtttacgatcaatcgtattttccctctacgatcgttacgaagtgggaccttgtctgcgactaccaaagcctcaagtcagtagtgcagtttcttctcttaactggtatgcttgtgggtggaatcatcggcggccatgtctctgatagatttggtcgacgatttattctgcggtggtgcctactgcagctcgcaattactgatacctgcgctgccttcgcccctacgtttccagtctattgcgtgctgagatttctcgctggattttcaagcatgatcattatcagcaataatagcctaccgatcactgagtggattcgccctaattccaaagctctcgtggttatcctctccagcggagcgcttagcattggacagatcatcctcggcggattagcctatgtgttccgggactggcagacccttcacgtcgtcgcgtcagtgcctttctttgtgttcttcctactgtcccgctggttagtggagtctgcccgatggctgatcattaccaataagcttgatgaaggactgaaggccctccggaaggtggcaagaacgaacggcatcaaaaacgccgaggagaccctgaatatagaagtggtgcggtccactatgcaggaggagttagatgccgcacaaactaagaccacagtctgtgacctctttcgaaacccctcaatgcggaaacggatatgtatcctggtctttcttcgatttgctaataccatccctttttatggcacaatggtcaacttgcaacatgtgggtagtaacatctttctgctgcaggtcttatacggggccgtggccctgattgttaggtgtctggcccttttgaccttaaaccacatggggagaagaatcagtcaaatcctgtttatgttcttagtgggtctcagcattctggccaataccttcgtgccgaaggagatgcagactctgcgcgtcgccctcgcatgcctcggtatagggtgcagcgctgcaaccttctcctctgtggcggtccacttcattgaactgatacctactgtcttgagagcacgcgcatcaggcattgatctgactgcgtcccgaatcggggccgccctggcccccctcctcatgaccctgactgtgttctttactactctaccatggattatctacggtatctttcctatcatcgggggtctcattgtctttcttctcccagaaacaaagaaccttccactgccagacactatcaaagatgtggagaatcagaagaaaaatttaaaggaaaaggcgtag

SEQ ID NO: 30161 - DNA, 1119 bp, Artificial Sequence
  Description of Artificial Sequence: Synthetic coding sequence
atgctagacaacaacacaggcagcggaaatgaaacgggaatcttatctgaggatgcacttctgcgaatatcaattcccctcgattccaatcttcggcccgagaagtgccggcggttcgtgcatccacagtggcagcttctgcacctgaacggcaccatacattccacttcggaggccgacacagagccttgtgtggatggatgggtgtatgaccagtcatacttcccctctaccatcgtgacaaaatgggacctggtgtgcgattatcagagccttaagagcgtggtccagtttctgctgctgaccggcatgttggttgggggaataattggaggccatgtgtcagaccgattcggccggcgttttattctccggtggtgtctcctgcagttggcaattacggatacttgtgccgcatttgcacccacctttcccgtgtattgtgtgctgcgcttcttggctggtttcagctctatgatcatcatctctaataactccctgcccatcacagaatggatccggccgaactccaaagcgctcgtcgtgattctctcgagtggagcactcagcatcggacagataatcctgggcggcctggcctatgtgttccgcgactggcagacattgcacgtggtcgcaagcgtgccctttttcgttttttttctactgtcgcgatggctggtcgagagcgccagatggttgatcataaccaataaactggacgaaggcctaaaggctcttaggaaggttgctcgcaccaacggtattaagaatgcggaagaaaccctgaacatagaggtcgtgcggtccactatgcaagaggagttggacgcagcccagacaaaaacaacagtctgtgatctcttccgcaatccttcgatgcgaaaacggatctgcattctcgtcttcctgcgattcgctaacacaatcccgttctatggcaccatggtaaatctgcagcacgttggctctaatatcttcctcctgcaaaaatgccgcccgtgcgtctggttgtggcatgtgtgggagagcgcagtcttactactgcttttccccgtcctgctttttaccagtcttaactcctccccacttttttcagggcaggaattacaagaatag

SEQ ID NO: 30162 - DNA, 444 bp, Artificial Sequence
  Description of Artificial Sequence: Synthetic coding sequence
atgatcatcattagcaacaactcattgccaattacggaatggattcggccgaatagcaaggccctcgttgtgatactctcttccggggccctgtccatcggccagattatactgggcgggctggcatatgtcttccgcgactggcagaccctccacgtggtggcatcagtgcctttttttgtttttttcctgttaagcaggtggttggtcgaatccgccagatggttaatcattacaaataagctagacgagggcttaaaggccttacgtaaggtggccaggaccaatgggattaaaaatgcagaggagacactgaatatcgaagtggtaaggtccactatgcaggaggagcttgatgccgctcagaccaaaaccaccgtttgcgatctgtttcgcaacccaagcatgcgcaagcgaatatgcatcctcgtcttcctgaggtag

SEQ ID NO: 30163 - DNA, 810 bp, Artificial Sequence
  Description of Artificial Sequence: Synthetic coding sequence
atgctggtcggcggcattatcggcggtcatgtgtccgataggttcggtcggcgatttatcctgcgctggtgtttgctgcagcttgctatcaccgatacatgtgccgccttcgccccgactttccctgtctactgcgtgctccgatttcttgccgggttttcctctatgattattatttccaataactccctgccgattaccgaatggattcggcccaattcgaaggccctagtggtaatactgtcgtctggagctctgtccattggacagattatactgggaggactggcctatgttttccgggactggcaaacgttacatgtagtcgccagcgtgccattttttgtcttctttctgctctcaaggtggctagtggaaagtgcacgctggttgattataacgaacaaactggacgagggtctgaaggcactgcgcaaagttgccagaacgaacgggatcaagaatgccgaagaaactctaaatatcgaggtcgtgcgcagcacaatgcaggaggagctggacgctgctcagaccaaaactaccgtatgtgacctgtttcgcaacccctccatgaggaaaagaatctgtatccttgtgtttctccgatttgctaacaccattccattttatggtacaatggtcaacttgcagcacgtggggtccaacatcttcctgctccagaagtgccgcccctgcgtgtggctctggcacgtctgggaaagcgccgtcttactgctgctgttccccgtgttactcttcaccagtctcaacagctctcccttatttagtggacaagaactccaagagtag

SEQ ID NO: 30164 - DNA, 1785 bp, Artificial Sequence
  Description of Artificial Sequence: Synthetic coding sequence
atggcaggtgaggagaacttcaaggaagaactgagatctcaggatgcctcccggaaccttaaccaacacgaggtggccggccatccacactcatggtctctcgagatgctgcttcgccggcttagagcagtccataccaagcaagatgacaagtttgccaatctcctggacgctgtcggagaatttggtactttccagcagagactagttgctttaacgttcattccctctataatgtcagccttctttatgtttgccgaccacttcgtcttcactgcacagaaaccctactgtaacacaagttggattttggcagtcggcccgcatctctccaaggctgagcagctcaaccttacaatcccacaggctcctaacggctcttttcttacctgcttcatgtacctgcctgtaccgtggaacttggactctatcatacaattcggcctcaacgacacagacacttgccaggacggatggatttacccagacgctaagaaaagatcactcattaacgaattcgatcttgtttgcgggatggagactaagaaagacaccgctcagattatgtttatggccggactcccaatcggcagcctgatttttcggcttataacagacaaaatgggcagataccccgctatacttctgtctctcctgggactcataatcttcggatttgggaccgctttcatgaacagcttccacctgtatctgttctttcggtttgggatctcgcagagcgttgtgggctacgccatttcatctatttctctggcaaccgagtggctcgtcggcgaacatcgggcccatgccataatcctgggacactgttttttcgccgtgggggcagttcttttgaccggcatagcctacagcctgcctcactggcaattgttgttcctcgtgggcggaattttggttattccgttcatatcctacatttggatattgcccgagtcccctaggtggctaatgatgaagggtaaagtgaaggaagcgaagcaagtgctttgttatgcagccagcgtaaataagaaaacgatcccgtccaatcttcttgacgaattacaactcccacgcaagaaagtcactagggcctccgtgctcgacttttgtaagaaccgacagttgtgtaaggtcacactggtaatgagttgtgtctggttcacagtaagttatacttacttcactctgtcacttcggatgcgcgagctgggcgtgagcgtccacttccggcatgttgtcccgtctattatggaagtgccagctcggctttgttgtatcttcctcctccagcagattggccgcaagtggtcattagcggtcaccctactacaggctatcatttggtgcttgttgttgttgtttctccctgaaggagaagatggcctgagacttaagtggcccaggtgcccggccacagaactcaagtccatgactatccttgtgctgatgttgcgggagttttccctcgctgcgacagtaacagtattttttttatatactgctgaactcctgccaacagtgttgagagcgactgggctggggctggtgagcctagctagcgtcgcaggggccattttatccctgaccatcatcagccagacaccatcacttctcccgatttttctgtgctgtgtcctcgctattgtggcatttagtttgtcctccttgctgccggagacgagagaccagccactaagtgaatccttaaaccactcttcacagatccgcaacaaagtgaaggacatgaaaacgaaagagacctcgagcgacgacgtgtag

SEQ ID NO: 30165 - DNA, 1785 bp, Artificial Sequence
  Description of Artificial Sequence: Synthetic coding sequence
atggcaggcgaggaaaattttaaggaagagttgcggtcccaggacgcctcccgcaatctgaatcagcatgaagtcgcaggccatccccactcatggtctctggaaatgctactacggcggctccgcgccgtgcatacaaaacaagatgacaaatttgccaatcttttggacgcagtcggcgaatttgggacctttcagcaacgactggtcgccctgactttcattccctcaatcatgtctgccttcttcatgtttgcggaccactttgtcttcaccgcacagaagccctactgcaacaccagctggatactggcagtgggtccacatttatctaaggccgaacagctcaacctgactattccccaagcccctaacggaagttttctcacgtgcttcatgtacctgcctgttccttggaatctagacagcataatccagttcgggctcaatgatacagacacctgccaggacgggtggatttatcctgatgccaagaaaagaagcctgataaacgaatttgatctcgtatgcgggatggaaactaaaaaagatactgctcaaataatgttcatggccggtctgcctataggaagcctcatttttcggttaataacggacaaaatggggcggtacccggcaatactgctcagcctgctgggactgataatatttgggtttggcacggcctttatgaactcatttcatttgtacctgttcttccgtttcggcatttcacagtcagtggttggctatgctatcagttccatctccctggccaccgagtggctggttggagagcaccgtgcacatgctattatcctagggcactgcttctttgctgttggggccgtgctgttaacgggcatcgcttactctttaccacattggcagttacttttcctggtggggggaattcttgtgattcccttcatctcatacatatggatcctgcctgaaagccctaggtggctaatgatgaagggcaaagtgaaagaggccaagcaggtgctatgctatgcagcctctgtcaataaaaaaacaattccttccaatctgctggatgagctccaactccctcgaaaaaaagtgacaagggcctccgtcctcgatttttgcaaaaatcgacagctatgtaaggttactctggtgatgtcatgcgtgtggttcacagtctcttatacctactttactctgagtttgagaatgcgggaattgggcgtttccgtccattttcggcatgtggtgcccagcatcatggaagttccagcgcggctttgctgcatctttctgcttcagcagattggacgcaagtggtctcttgccgtgacgctgctccaggctattatttggtgccttcttctgctttttttgcctgagggcgaggatgggttaagactaaagtggcctaggtgtcccgccacagagctaaagagcatgactattctggttctcatgcttagggagttctctctcgctgctaccgtaaccgtgttcttcctctacaccgcagaacttctgcctactgtcctgcgcgctaccggcctcggactggtttcccttgcctcagtggccggcgcaatcttgtcgcttacaatcatcagccagacacccagtttgctgccaatcttcctatgctgcgtactagcgatcgtcgctttcagcctctcgagccttctcccagagacgcgggatcagccactgtccgagagccttaaccactccagccagatcagaaataaagtgaaagatatgaaaacaaaggaaacctcatcagatgatgtctag

SEQ ID NO: 30166 - DNA, 1275 bp, Artificial Sequence
  Description of Artificial Sequence: Synthetic coding sequence
atgcagggagcccgagctccccgcgaccagggccgaagccccggccgcatgagcgcactgggacgatcatccgtcatcctgctgacctatgttctggcagcaacggaactgacgtgtttgttcatgcagtttagtattgttccatacctatcccgaaagctgggtttagattccatcgctttcggctatttacagacaacattcggggttttgcagcttctcggtggccctgtgttcggcagattcgccgatcagcggggggctcgagctgcccttaccctcagcttcctcgcagcactcgcattatatctgctgctcgccgccgcctcaagtccagccttgcccggggtgtacctactgttcgcctctaggcttcccggggccctgatgcataccctgccagctgcacagatggtgattaccgacctgtccgctccagaggaaaggcctgccgccttaggccgcctcggactctgtttcggagtgggagttatcctcggcagtttgcttggcgggacattggtgtccgcttacggaatccagtgcccagccattctagccgcattggccaccctgttaggggccgttttaagctttacctgtatcccagcctctaccaagggggccaagaccgatgcacaggcccccctccccggcgggcccagggctagcgtcttcgacctgaaagctattgctagcctcctgagattgcccgacgttccacgcatatttctagtgaaagtcgcaagtaactgtcccacaggcttattcatggtgatgttttctattattagcatggattttttccagttggaggcagcccaggccggatatctgatgagcttttttggactgctccagatggtgactcaggggctggttatcggccagctgtcaagccatttctctgaagaagtgctattgcgagcctccgtgttggtattcatcgtcgttggactagcaatggcctggatgtcttcagtgttccacttctgcctccttgtgcccggactcgtatttagcctctgcacccttaacgtggtgaccgatagcatgttgatcaaagcggtctcaacaagtgacactggaaccatgcttggcctgtgtgcctccgttcagccgttgctcaggactttgggtcccactgtgggcggattactatacaggagctttggcgtgccagtgttcggccacgtccaagtcgccataaacaccctggtattgctcgtgctctggcgcaaacccatgccacaaagaaaggacaaagtgcggtag

SEQ ID NO: 30167 - DNA, 1275 bp, Artificial Sequence
  Description of Artificial Sequence: Synthetic coding sequence
atgcagggggctagggccccacgcgaccagggtaggtccccaggacgtatgtctgccctcggtcgctctagtgtgattctcttaacgtacgtccttgccgccactgagcttacctgcctcttcatgcaattttccattgtcccctacctgtcgaggaagttaggcttggattcaatcgcattcggctatctgcagactacctttggagtgctccagctgcttggggggccagtgtttgggaggtttgcagaccagcggggggctcgggccgcccttactttatcatttctggcagctctggctctctacttgttgcttgccgctgctagctccccggcactgcccggcgtctacctcctgttcgcgagccgcctgccaggcgctctgatgcacacgctgcctgctgcgcagatggtcattacagatctgtcggctcccgaggagaggcctgccgccctgggtcgcttgggtctctgtttcggtgtgggtgtcatcctgggatcactgctgggcggcactttagtgtcggcatacgggattcagtgccctgccatattggctgcgctagcaactttgctgggagctgtcctgtctttcacctgtattcccgcatctaccaagggggctaagacagacgcacaggcacctctccccggaggacctagggccagtgtgttcgatcttaaagcgatcgccagtcttctccggctccctgacgtgccccgcatcttccttgtgaaggtggcatccaactgtcccacagggctgttcatggtgatgtttagcataatcagcatggatttcttccagttagaagccgcacaggctgggtacctgatgagcttcttcggcctgttgcagatggtcacacagggccttgttattggccagctgtcttctcatttttctgaggaggttctcttaagagctagcgtcctcgtttttatcgtggtcggtttggcaatggcctggatgtcatcagtcttccacttctgcctgctagttcccggtctggttttcagcctctgtacgttgaacgtcgttactgacagcatgctgataaaagcggtgtccacctcagacactggtaccatgttgggcctgtgtgcgtctgtacagccgctcctccggacactcggccccactgtgggcggcctcctctaccgtagttttggcgttcctgtctttggccacgttcaggtggctatcaacacactcgtcctgctggttctctggagaaaacccatgccacaacggaaagataaggtgaggtag

SEQ ID NO: 30168 - DNA, 1275 bp, Artificial Sequence
  Description of Artificial Sequence: Synthetic coding sequence
atgcaaggagcccgagcgccaagggatcagggacggagcccgggtcgcatgagcgctctaggtaggtcatcggtgatcttactcacttacgtgttggccgcgactgagcttacatgtctcttcatgcagttcagcatcgttccctacttatcccgcaagcttgggttggatagcatcgcattcggatatttacaaacaacatttggagtactgcagctcctggggggcccagtatttggacgatttgcagaccagagaggggctcgtgccgcattaacgctctccttcctggccgctctggcactctatcttttactcgccgctgcttcatctcctgccctgcccggcgtctacctgctgttcgcaagtagattgcctggcgccctaatgcacaccctgcctgccgcacagatggtcatcaccgatctaagtgcgccagaggagcgtccagcagctcttggaaggctcggcttgtgttttggagtgggtgtaatactgggctccctgctgggaggcaccctcgtcagcgcctacggcatacagtgccccgcaattctggccgctctcgccacattgcttggcgccgtcctcagctttacctgtatccctgccagtaccaagggggccaaaaccgatgcccaggctccccttcctggtggaccccgtgcaagtgtgttcgatttaaaggccattgcctcgctgctgaggttacccgacgttcctaggatttttctggtgaaggttgccagcaactgccctacaggcctgttcatggtgatgttcagcattattagcatggacttctttcaattggaggccgctcaggccggatacctcatgagctttttcgggcttctccaaatggttacacagggccttgtgattggccagctctctagccattttagtgaggaagtccttctcagggcttctgtgctggtgttcattgtggttgggctcgccatggcgtggatgtccagcgtgtttcatttttgtttacttgttcctgggcttgttttcagcctatgcacactcaacgtggtgacagactccatgctgataaaagcggtcagcacgtccgacaccggaactatgctgggcctatgtgcctccgtccagcctctcttacggacacttggacccacagtgggagggctgttataccggagctttggagtcccagtctttggccatgtacaggtcgcaattaacaccctcgtgctgttggtgctctggcgaaaacctatgccccagaggaaagataaagtgcgatag

SEQ ID NO: 30169 - DNA, 981 bp, Artificial Sequence
  Description of Artificial Sequence: Synthetic coding sequence
atgcagggagcccgcgcacctcgcgaccagggtcggtcccctggacgcatgagtgctctggggcggagttctgttatcttgctcacttatgtgctggccgccactgagctcacctgtctattcatgcagttcagtattgttccctatctgagcagaaagctcgggctggatagtattgcctttggttacctgcaaaccacctttggggtgctccagctgctaggcggaccagtgtttggcaggatccaatgtccggccatcctcgctgctttggccaccctgctcggggccgtactgtcgttcacctgcataccagccagcacaaagggagctaagacggacgcccaggcgcccttgccaggtgggccgcgggccagcgtgttcgacctcaaggcaattgctagcctgctgcgactgcccgacgtgccaaggatattcttagtcaaggtggccagtaactgtccaactggcctgttcatggtcatgttctctatcatttcaatggacttctttcagcttgaggcggcacaggcggggtatctgatgagttttttcggtttgttacaaatggtgacccagggacttgttattggtcagctctcctcccatttctctgaggaagtcctcctccgtgcttccgtgcttgtcttcatcgtggtgggcctggccatggcctggatgagctcggtgttccacttctgcctgctcgttccaggccttgtattttctctgtgtacattaaacgtggttactgactctatgctcattaaagccgtctcaacaagcgacaccggcaccatgttggggctgtgcgccagtgtccaacctctgttacgtactctgggcccaaccgtggggggcctcctgtatcgaagcttcggagtccctgtatttggccacgttcaagtggccattaataccctcgttcttttggtgctgtggcgcaaaccaatgccacagcggaaggacaaggtgcggtag

SEQ ID NO: 30170 - DNA, 405 bp, Artificial Sequence
  Description of Artificial Sequence: Synthetic coding sequence
atgcaaggtgcccgcgccccaagggaccagggtcgaagccctgggcgcatgagcgctctgggtcgatcatcagtaattctacttacttacgttctcgctgccaccgagctcacatgcctgtttatgcaatttagcatcgtaccttatctgagtcgtaaactaggtctggatagcattgccttcggatatcttcagaccacttttggcgtcctgcagctattgggcggccccgtgttcggtcggttcgcagaccagagaggagctcgggcagccctcaccctgtcattcttggcggccctggcgctgtacttacttttggcagctgcgagctctcccgctttaccaggggtgtatcttctatttgcgtcacggctccctggcgcacttatgcatacactcccctag

SEQ ID NO: 30171 - DNA, 1644 bp, Artificial Sequence
  Description of Artificial Sequence: Synthetic coding sequence
atggctttccaggatcttcttgatcaggtaggagggctgggccggttccagattcttcagatggttttcctaattatgttcaacgttatcgtctaccatcagacacagttggaaaattttgctgcctttattctggatcaccggtgctgggttcatatcctagacaatgataccatcccagacaatgatcctggtacgcttagtcaggacgcccttttgaggatcagtatcccgtttgactccaacttacgcccagaaaagtgtaggcggttcgtgcaccctcagtggaagcttattcacttaaacggaacttttccaaacacatcagagcccgacaccgagccatgtgttgacggctgggtgtacgaccagtcatcgttcccatctacaattgtcacaaaatgggatctggtctgcgaatcgcaacctctcaattctgtggcgaaatttctctttatggcaggcatgatggtcggtggaaacctttatgggcacctaagtgacaggttcggtcgtaaattcgttctgcgctggtcctacctgcagttagctattgtgggaacttgtgctgcttttgccccaacaattctggtctattgttctctccggttcctggccggagcagcaaccttcagtattatagtgaatactgtgctgctgattgttgagtggatcacacatcagttttgcgccatggctttgacactgacgttgtgtgctgcaagtatcgggcatatcactctgggctcgctcgcatttgtgatccgcgatcagtgtatactgcaactcgtcatgtcagctccgtgcttcgtgttttttctgttttctcgttggttggccgaatctgcccgatggctgatcattaacaataagcccgaagagggcctcaaagagctgcgtaaggcagcacaccggaatgggatgaagaacgccgaggatatactgacaatggaggtgctgaagagcactatgaagcaggaactggaggctgcacagaaaaagcacagtttatgcgaactgttaaggatccctaacatttgtaagcgcatttgctttctgtcctttgtccggttcgcatccaccatccctttttgggggctgacattgcacctccagcatctgggcaacaacgtattcctccttcaaacgctgttcggcgctgtaacactactggctaactgtgtagcgccttgggctctgaaccacatgtccagaaggctatcgcagatgctgctaatgttcctgctggcaacctgtctactggcgatcatcttcgttccgcaggagatgcaaactctgcgggtcgtgttagccaccctcggagtgggcgctgcctctctgggtataacatgctcaactgcacaagaaaacgaactgatccccagtattatcaggggacgggctaccggcattactggaaatttcgccaacatcgggggtgctctggcctctcttatgatgatcctttcgatctattctaggccgcttccatggattatctacggagtgtttgctattttgtcaggattagtcgtgcttttactgcccgagacaaggaatcagccattgttggactcaatccaagacgtggagaatgaaggtgtaaattccttggcggcacctcagcggagcagtgtgttgtag

SEQ ID NO: 30172 - DNA, 705 bp, Artificial Sequence
  Description of Artificial Sequence: Synthetic coding sequence
atgaacatgttcgggcgcaagtttgttttgcgctggagctacctccaactggcaattgttggaacatgcgccgcctttgcccccactatacttgtctactgctctttacggtttctagctggggcagccacattcagtattattgtcaacacagtgttgctgattgtggaatggataacccatcagttctgtgccatggctctcactctgaccctgtgcgctgcaagcattggacacattactttggggagcctcgcctttgttattagagatcagtgcatcctgcagttggtgatgagcgcgccgtgcttcgttttctttctttttagtaggtggcttgccgaatccgccagatggctgatcataaacaataagcccgaagagggactcaaggaactgcggaaggccgctcaccggaatgggatgaagaatgccgaggatatactgaccatggaggtcctaaaaagcaccatgaaacaggagctggaagctgctcagaagaagcactcactgtgcgagctgctgcgcatccctaacatctgcaaacggatatgctttctgagcttcgtgcggtccgctggcgtgtgttggagatctacaccagaccccgtgtgtctgggaatcaccagcgggggctgccgcaccgccaaaataccggcttgtagcttcctctggaaactgcacttccgcggagcacctgcctag

SEQ ID NO: 30173 - DNA, 609 bp, Artificial Sequence
  Description of Artificial Sequence: Synthetic coding sequence
atggcttttcaggacctcctggatcaagtgggcggactgggcagattccagatccttcagatggtttttctcatcatgttcaatgtcattgtataccatcagacacagctggagaactttgctgcttttattctcgaccacagatgctgggttcacattctggataacgacacgatccccgataacgatcctggaaccttgtcacaagacgcgctcttgcgcatttcgattcccttcgacagcaaccttcggcccgagaaatgccggagattcgtgcatccgcaatggaagcttatacatcttaacggcacctttccaaacactagcgaacccgacaccgaaccctgtgtagacgggtgggtctacgatcagtccagtttcccctccacaattgtgacgaaatgggacctcgtctgtgaatcacagccactgaacagtgtggcaaagttcttgtttatggcaggcatgatggtggggggtaatctctacggccacctgtctgacagaaaacccctgtccagccccaaccacgtgagtacagactgcgatgaaggcctggaggtcccaatcgccatacatcagcatcacgtgttttggtatctctcctag

SEQ ID NO: 30174 - DNA, 1200 bp, Artificial Sequence
  Description of Artificial Sequence: Synthetic coding sequence
taattccaggatttgttagaccaagtcggcggcctggggcgcttccagattctgcagatggtgttcctgattatgttcaacgttatcgtgtatcaccaaacacaattggaaaactttgccgctttcatcctggaccacaggtgttgggtgcacatcctcgacaatgacactatcccagacaatgatcccggaacacttagccaggatgcgcttctcagaatcagcatacctttcgactcaaatttgagacctgagaagtgccgccggtttgtgcacccccagtggaaactgattcacttgaacggcacatttccaaacactagtgaaccagacacagaaccatgtgtggacgggtgggtgtatgaccagtcgtcattcccttctaccatcgtgaccaaatgggacctggtctgcgagagtcagcctttgaactctgtggcgaaatttttattcatggccggtatgatggtaggggggaatttatacggacatctgtccgatagatttggtagaaagttcgtcctgcggtggtcatacttgcagctcgccattgtcggcacgtgcgctgcctttgcccccacaatactggtgtattgttcattgaggttcctggccggcgcagctaccttttcaatcattgtcaataccgtcctgctgatcgttgagtggatcacccatcagttttgtgctatggcactgacgttaaccttgtgtgctgcctctattggacacattacgttgggcagtctcgcgttcgttataagggatcagtgtattttgcagctcgtgatgtcggcaccctgcttcgtattcttcctgtttagtagatggctagccgaaagtgcgcgctggctgattatcaacaataagcccgaggagggcctgaaagagttgcggaaggctgcccaccggaatgggatgaagaacgcagaggacatccttaccatggaggtgcttaaatcaaccatgaaacaggagctggaggcagcccagaagaaacactccctgtgcgaactactacgcatccctaacatctgcaagaggatctgcttcctatcgtttgtcagatctgcaggggtgtgttggaggagcacgcccgaccccgtctgcttgggcatcactagtggcggctgccgcaccgccaagataccagcatgttcattcctttggaagcttcatttcaggggcgcacctgcctag

SEQ ID NO: 30175 - DNA, 1482 bp, Artificial Sequence
  Description of Artificial Sequence: Synthetic coding sequence
atgtcacgatcacccctgaaccccagccagctgcgctcggtgggcagccaagatgctctggctcccctccccccccctgctccgcagaacccgagcacgcactcatgggaccccctgtgtggcagccttccatgggggttgtcttgtctactggcccttcagcacgtcctggtgatggcctcgctgctgtgcgtaagccacctgctgttactctgtagcctgtcccctggaggactctcttattcacccagccagctgctagcttcctccttctttagctgtggtatgagcacgattctgcagacctggatggggtcgagacttccgctggttcaggccccatccctggaattcctcatccctgcccttgtcctgacctcccagaaactcccccgggctattcaaactcccgggaactcatcactgatgctgcacctctgccggggaccaagttgtcatggcctgggtcattggaacacgagcctgcaggaagtctccggagccgtggtcgtaagcggcctgctgcaggggatgatgggactgttgggcagtccaggccatgtgtttcctcactgcggcccacttgtgctcgccccaagtctcgtggtggccggtctctccgcccacagggaagtggcccagttttgttttacacactggggcctggccctgctgacatgggcccctgctagcttcatgtgtgctccaggcggcgaattgcagcgacaccagctcacactactgtcactctcatccggctcgtttcgcaactgtctgcccccaccccggcatcacggcttcggttgcttaacgcaggccggctcacaacaagtcgcccacttggttgggctgctatgcgtgggtctcggtctcagtccccgcctcgctcagctgctcactactatccctctcccagtggttggcggggtattgggtgttacacaggctgtggtcttaagcgccggattttcgagtttctaccttgctgacatagactccggacgaaacatctttatcgtgggattctctatttttatggccctccttttgcccagatggttccgcgaagccccagtcctattctccacaggttggtcgcccttggacgtgctcctacattcacttctgacacagcccatctttctggccggcctgagcggcttcctcctcgaaaatacaatccccggaactcaactggagaggggactggggcaaggtctaccttccccctttacagcccaggaagctaggatgcctcagaagccccgcgagaaggcggcccaggtgtaccgactcccctttccaatccagaacttgtgtccatgcatcccccaaccactgcattgcctctgcccactgccggaagaccccggcgacgaagaaggaggcagctccgaacccgaagaaatggcagacctactgcctggttccggggaaccctgtccagaatcatcgcgagaggggtttcggtcacagaagtag

SEQ ID NO: 30176 - DNA, 585 bp, Artificial Sequence
  Description of Artificial Sequence: Synthetic coding sequence
atggcaagtctgctgtgtgtgtctcacctgctactgctctgtagcctgtctccgggcggtctgtcctatagcccaagtcaacttcttgcctccagtttcttttcatgcgggatgtcgacaattctacagacatggatgggctccaggctgcccctagttcaagccccaagtctggagttcctcatccctgcactggtcttaacctcccagaagctccctcgagcgattcagacacctgggaattccagtttgatgcttcatttgtgtcgagggccgtcctgccatggcctggggcactggaacacttcccttcaggagggataccctgcacacggaggcctcttctccgcccctggcttgttacccgtgtcatgcgtgcctctggaggcaagttttaacgtcattaacagccactcctcgccctgcctgcccgccccctttggggctgacccctccgggctgtgtgtggattgcttctgcctctgtggaatccaatgctatcctcccggtactgtttgcccccatcagggaactatggacctggctgcttctcctagactcgacttgtctaagtggctgacatag

SEQ ID NO: 30177 - DNA, 1833 bp, Artificial Sequence
  Description of Artificial Sequence: Synthetic coding sequence
atgagccgcagcccgctgaaccctagccagctccgttcagtaggtagccaggatgctctcgcccccctgcctccacccgccccacagaacccatctactcattcgtgggatccactctgcgggtctttgccgtgggggctgagttgccttctcgccttgcagcacgtcctcgtaatggctagcctcttgtgcgtgtcccatttgcttttactctgtagcctgtctcccgggggactgtcctacagtccttctcagctgctggcgtcctcttttttttcctgcggcatgtctactatactccagacgtggatgggctcaagattgccattagtacaggccccctccctggagttccttattcctgcgctggtgctgactagccagaagctccctagagccatccagacgcctgggaacagctccctgatgttacacctgtgccggggccccagctgccacggccttggccactggaacacatcgctccaggaagtgtccggcgcggtcgttgtatcaggcctgctgcagggaatgatgggcctgctgggttccccagggcatgtgtttccccattgcggtcccctggttttggctccgtcactggtggtcgccggtttgagtgctcaccgggaggtggcgcagttctgttttacccattggggcttggccctccttgttatcttactcatggtcgtctgttctcaacacctggggtcctgccagttccacgtgtgtccttggaggcgcgcatcaaccagttcaacccataccccattacctgtcttcaggctgctgtctgtcctcatccccgttgcgtgcgtgtggattgtttctgcgttcgtcggattctcagtcatcccccaagagcttagtgctccgaccaaagcgccctggatctggttgccccaccccggggagtggaattggccactgctgaccccacgcgctctggccgccggcatcagtatggcccttgctgcgagcacctcctcactgggatgctacgcactgtgcggcagattgcttcacctgccacccccaccaccccacgcctgttcacgcggtctgagcctggaaggtctcggctcggtgctcgctgggctgctagggagtcccatggggaccgcgtcctccttccccaatgttggcaaggttgggttaatccaagctgggtcccagcaggtggcacacctggtgggcttactgtgtgtagggttaggactgtctccccgcctggcacagctgctgacaactatcccgcttcccgtggtgggcggcgtcttaggtgtgactcaggctgtggtgttgtcagctggtttctcttccttttatcttgccgacatcgacagcggtcgaaacattttcatcgtgggatttagcatcttcatggcactcttgctgcctcgctggtttagggaagccccagtcctattcagcactgggtggtctcccttagatgtactgctccattctctcctgacgcagcccatcttcctagccggcttgtccggttttcttctggaaaacaccatccctgggacacagctggaacgcggcttagggcagggcttgcctagcccctttacggctcaggaggcgcgcatgccacaaaaaccccgtgagaaggccgctcaagtatacaggctgccgtttcctatccagaatctgtgcccatgtattccgcaacccttgcattgcctgtgccctcttcccgaggatcccggggacgaggagggtggatccagcgaacccgaggagatggcggacctgctgccgggaagcggcgagccctgtcccgaatcaagtcgtgaggggtttcgttcccagaagtag

SEQ ID NO: 30178 - DNA, 1857 bp, Artificial Sequence
  Description of Artificial Sequence: Synthetic coding sequence
atgtcgaggagtcccctaaatcccagtcagttgcggtcagtcggctctcaggacgccttagcccccctcccgccacctgcacctcagaacccctctacccacagttgggacccactgtgtggttccctcccttggggtctgtcttgtctgctcgccctccagcacgttcttgtcatggcctctctcttatgcgtatcgcaccttcttctgctgtgctctctttcaccagggggcctgagttatagcccttcccagttgttagcttcttcgttcttttcttgcggaatgagcacgatcttacagacatggatgggtagtaggctgcccttagtccaggccccgagtttagagttcctgattccggccttggttctaacaagtcagaaactgcctcgggctatccagacgcccgggaattgcgagcatcgtgcacgagctagggcatcacttatgcttcacttgtgtcgaggtccttcatgccacggactgggtcactggaacacatctcttcaggaggtcagcggagctgtcgtggtgtcaggcttgctacagggaatgatgggcctgctggggtctcctggacacgtcttcccccattgcggccctctggtgttagccccttcattggtggtcgccgggttatcagctcatcgcgaggttgcacagttttgtttcacccactggggcctggccctcctggtcatccttctaatggtggtttgcagccagcacttaggcagttgtcagtttcacgtctgcccttggagaagggctagtacctcctcaacgcataccccactgcccgttttccggcttctttccgttttgattcccgtggcatgtgtgtggatcgtaagcgcattcgtaggcttctccgtgattcctcaggagctgagtgccccgacgaaagccccctggatttggctgcctcatcctggggagtggaactggccgctacttacaccgcgcgcccttgccgcggggatctccatggcgctggctgcgtcaacatccagcttgggctgctatgcgctatgtggacgcctattgcatctcccgccgccccccccacacgcgtgctcacgggggctgagcctggaaggcctggggagcgttctcgccgggctcctggggtcccccatgggaaccgcttcatctttccccaacgtgggaaaagtggggctaatacaagcaggtagtcagcaggttgcccatctggtgggactcctctgcgtcgggttgggactgtcccccaggctggcccagctgctgactacaatccccctgccggtggtcggaggtgttctcggagtgacccaagcggttgtgctgtcggccggcttttccagtttttacctggccgacattgactcaggtcgcaacatcttcattgtgggcttcagcatcttcatggcactgctgcttccacggtggttcagagaagcacccgtgttattttcaactggatggtcccctctggacgtcctcctgcatagcctattgacccagcccatcttcctcgctggacttagcggattcctgctcgaaaacactataccgggaactcagctggaaagaggactggggcaaggactgcccagtccgttcaccgcccaggaggctaggatgccccagaagccccgagagaaggccgcacaggtgtaccggctgccatttcctatccagaacctgtgtccgtgtatcccccagccgctacattgtttgtgccctctccccgaggacccaggagatgaagaagggggcagtagcgaaccagaagaaatggctgacttgctgccaggatcgggtgagccatgcccagaaagctccagagaaggttttaggagtcagaagtag

SEQ ID NO: 30179 - DNA, 1434 bp, Artificial Sequence
  Description of Artificial Sequence: Synthetic coding sequence
atgctgagatggctgagagactttgtgctgcccacagccgcctgtcaagatgctgagcagccaactcgatacgaaacgctctttcaggccctggatcgaaacggggacggcgtggtggatatcggcgagcttcaagagggtctgcgtaatctgggcattcctctggggcaggatgcggaagagaagatattcactaccggagatgttaataaagacgggaagctcgactttgaggagttcatgaaatacttgaaggaccatgagaaaaaaatgaaactggcattcaagtcgttggataagaataatgatggaaaaattgaagcctcagagatcgtgcaaagcctccagaccctggggctgacaatcagcgagcagcaagctgagctgatcctgcaaagcattgacgttgatgggacaatgactgtcgactggaatgaatggcgcgactacttcctgtttaatcccgttactgacatcgaggagatcatccggttttggaagcatagtaccgggattgatattggcgactccttaacaatccctgatgaatttacagaggacgagaagaagagtggtcagtggtggcgccagctcctcgcgggggggatcgctggcgctgtaagccgcacaagcacggctcccctggataggctgaagattatgatgcaggtacatgggagtaagtcggataaaatgaatattttcggagggttccgtcagatggtaaaagagggtggaatcaggtcactgtggagagggaacgggaccaacgtgatcaagatagcgcccgagactgccgtaaaattttgggcttatgagcagtacaaaaagttgttgaccgaggaagggcaaaagatcgggactttcgagcgcttcatctcggggtcaatggccggggcaaccgctcagaccttcatctaccccatggaggtgatgaagactcgcctggcggtgggtaaaactggccaatacagcggaatctacgactgcgcaaaaaagatcctgaagcacgagggtctgggcgcgttctacaaggggtatgtaccaaacctactggggattattccctatgcaggaatcgatctcgcagtttacgaactgctcaagtcatattggctagataactttgcaaaggactcagtgaaccctggcgtgatggtcctgttaggctgtggcgccctgagcagtacatgtggacaattggcctcatatccacttgcattggtgcggactcggatgcaggctcaggccatgctggaggggtcaccccagctcaatatggtcggattgttcagaagaattatctcaaaagaaggaattcctggtctctaccgggggattaccccaaactttatgaaagtactacccgctgttggaattagttacgtagtgtacgaaaatatgaaacagacgctcggggtaacacagaaatag

SEQ ID NO: 30180 - DNA, 1449 bp, Artificial Sequence
  Description of Artificial Sequence: Synthetic coding sequence
atgcggggatccccgggagacgccgagaggcggcagaggtgggggaggctctttgaggaactggatagcaacaaagatggtagagtggacgtgcatgagctcaggcaaggcctggcgcgactcggaggcggaaaccccgatcccggagcgcaacaagggataagtagtgagggcgatgcagatccagacggcggtttagacctggaggaattctctagatatttacaggaacgagagcagaggcttctattgatgttccatagtctcgatagaaaccaggacgggcacattgatgttagcgagatccagcagtcctttcgggcccttggaatctctattagcctcgaacaggctgagaagatcctccactcaatggatcgagacgggaccatgacaattgactggcaggagtggagggatcactttctcctccactcccttgagaatgttgaagacgtgctctatttctggaagcacagcacactgagtagcgctggatttagtgcatggattaaggacagcactgccgaacagaaccggagcaagaccacggtacttgcccgccgatccggctcccatctcaaatctcagcactttggccgccccaagtgggcggatcacgaagtattggatattggcgaatgcttaacagtcccggatgagtttagtaaacaggaaaaactgaccggtatgtggtggaaacagctggtggccggtgccgtagcgggtgccgtttcccgcactggaaccgctccgctggaccggctcaaggtctttatgcaagtgcatgcttccaagactaaccgcctgaatatattaggcggactgcggtctatggtgctggagggaggcatccgctctttgtggcgaggcaatggtatcaatgttcttaagatcgcgcctgaaagtgccatcaaatttatggcctacgaacagatcaaacgcgctattctggggcagcaggagaccttacacgtccaggagagattcgttgctggaagcctggccggcgcaaccgcacagaccataatataccctatggaggttctcaaaactaggctcacattgcgtagaaccggccagtacaagggactgttagactgtgcccgaagaatattggaaagagaaggaccaagagccttttatagagggtatcttcctaacgttctcggtataattccttacgccgggatcgacctagcagtttatgaaactctcaaaaattggtggctgcagcagtattcccatgatagcgccgacccgggcatactcgtccttctggcatgcggcaccatctcatcgacctgtgggcaaatcgcttcatatcccttagccctggtgcgaacgcgcatgcaggcccaaggatggtcaaccgtcgccagatttcagatcactgccacaagcgctttccaggtgcaggcgattctcctgccacagcctcccgagtag

SEQ ID NO: 30181 - DNA, 1407 bp, Artificial Sequence
  Description of Artificial Sequence: Synthetic coding sequence
atgaggggctcgccaggggacgccgagagacgccaacgctggggtagattatttgaagagctggatagtaacaaggacggtagggtagatgtgcatgagttacggcagggcctggcccgcctgggaggaggaaacccagatcctggcgctcagcaaggcattagctcggaaggcgacgcagatcccgacgggggtctggacctcgaggagtttagccgttacttacaagagagagaacagagactcttacttatgttccactcattggacaggaatcaggatgggcatattgacgtctcagaaatccagcagtcctttagggccctcggaattagtatctcattagagcaggctgaaaagatcctccatagcatggacagggatggcaccatgacaatcgactggcaggaatggagagatcattttctgttgcactccctagagaatgttgaggacgtactgtacttttggaagcattctacagtgctagacatcggcgagtgtttaactgtcccggacgagttttctaaacaagaaaagcttaccggaatgtggtggaaacagctggttgccggtgccgtggccggggcggtgtcaagaaccggcactgctccactagacagattgaaggtgtttatgcaagtgcacgcttcaaaaactaatcgactcaacatcttaggcgggttaaggtcaatggtgctggaaggagggatcagaagcctttggagaggaaacggaattaatgtgcttaaaatcgcaccggagtcagccattaaattcatggcctatgagcagattaaacgcgcaatcttggggcaacaagaaacgttacatgtccaagagcggtttgtggccgggtctctcgcaggggctaccgcccagaccatcatctaccctatggaagtccttaagactcgcttaacgttgcgcagaaccggccaatataaaggcctcctggattgcgcaaggaggatattagaaagagagggcccaagagctttttatcgaggatatctgccaaacgtgttaggtatcattccatacgccggaatcgaccttgcggtttacgagacgttgaagaactggtggctccaacagtattcgcatgactctgccgaccccggcattctggtcctcctagcctgtgggacaatctcatctacgtgtggccagatcgctagctatcctctcgctctggtgaggacgcgaatgcaggcccaggcctccattgagggaggcccacagctgagcatgttaggtctgttaaggcacattttgagtcaggaaggtatgcgcgggctgtacagagggatcgcccctaatttcatgaaggtgattcccgcagtgagtatttcctatgtggtctacgagaatatgaagcaggccctcggcgtgacttctcgctag

SEQ ID NO: 30182 - DNA, 1317 bp, Artificial Sequence
  Description of Artificial Sequence: Synthetic coding sequence
atgaggggttccccgggtgacgctgaaaggaggcagagatgggggcggcttttcgaggagctagactcgaataaggatggacgcgtggatgtccatgagcttcgccaaggcttggctcgcctcggaggaggcaatccggatcctggagcccaacagggcatcagtagtgagggcgatgcggatcctgatggtggccttgacttagaggagttttccagataccttcaggaaagggagcagcgactgttgctgatgttccacagtctggaccggaaccaggatggacatattgatgtcagtgagatacagcagagcttccgcgccctaggaataagtatttcccttgaacaggcggagaaaatcttgcactccatggatcgagacggcaccatgaccatcgattggcaggaatggcgggaccactttctcctgcattcactcgagaacgtagaggatgtgctgtatttctggaagcactcaactgtgctggatattggagagtgcctgaccgtgccagatgaattcagtaaacaggaaaagcttaccggcatgtggtggaaacagctggtcgctggtgcggtggcaggagctgtgagcagaaccggaaccgcccctcttgatagacttaaagtgtttatgcaggtgcacgcctctaagaccaatagattgaatatcctgggtgggcttcgctcgatggtgctggaaggcggcatccgctcactatggaggggaaacggcatcaacgtcctcaaaatagcccctgaatccgcgattaaatttatggcgtacgagcagattaagagggccatactcgggcagcaggaaaccctgcatgtgcaggagcgattcgttgcggggagcttggctggcgctacggcacagaccataatctacccgatggaggtgctaaagacacgccttacacttcgcagaaccggacagtataaaggactcctggattgcgcccggcggatccttgaaagggaaggtccaagggcattctatagagggtatctgcctaacgttctgggcattattccttatgctggcatagatttagccgtgtatgagacactgaagaattggtggctccagcagtattctcacgattctgccgaccccgggatcctggtactgctggcctgtggcaccatcagtagcacatgcggccaaatagctagctatcctctggctctagtgcgcactcggatgcaggcacaggatgtctcagtctacaaaacagataccgtgccgacactgattgagttgacaggccggagaggcaggaagatgctaaacaaatcgttttggaattag

SEQ ID NO: 30183 - DNA, 690 bp, Artificial Sequence
  Description of Artificial Sequence: Synthetic coding sequence
atgtggtggaaacagctcgtggctggagccgttgcaggcgccgtcagcagaactggcactgcaccactggatcgcctcaaagtttttatgcaggtacacgcttctaaaactaaccggctcaacattttgggcggattaaggtccatggtgctggaagggggcatccgctctctctggaggggaaacgggataaatgtactaaagattgcccccgagtctgcgatcaaatttatggcctacgaacagattaagcgcgccatactaggtcagcaggagacgctacatgttcaagagcgattcgtggcagggtccctggctggggctaccgcacaaaccatcatctacccaatggagactctgaaaaactggtggctgcagcagtatagtcacgatagcgccgaccccgggatcctggtcctacttgcatgtggcactatcagctccacctgtggccagatcgcatcctaccccctggcgctggtacgaacccgcatgcaggctcaggcaagtattgaaggcggaccccagctgagcatgctaggcttgttgagacacatcctatcgcaggagggcatgagaggactgtatcgaggaattgcccccaacttcatgaaagtgattccagcagtctcaatcagctacgttgtatacgaaaacatgaaacaggccctgggagtgaccagccggtag

SEQ ID NO: 30184 - DNA, 372 bp, Artificial Sequence
  Description of Artificial Sequence: Synthetic coding sequence
atggaggtgctgaagactcggctgacactcaggcggacaggacaatacaaagggctcctcgattgtgcaagacgcatcttagagcgcgagggacctcgagcattctaccgggggtacttgccgaacgtgttagggattatcccttacgccggaatagacctggccgtgtatgaaacactaaagaactggtggctccaacagtatagtcatgactcagctgatccaggtattctcgtactgctcgcttgcggtaccatttcaagtacatgcgggcagatcgcaagctacccgctggcccttgtcaggaccagaatgcaggcccaagcaggtggtcatgctatgtcatcccttatggaacggaccatgtggtag

SEQ ID NO: 30185 - DNA, 1434 bp, Artificial Sequence
  Description of Artificial Sequence: Synthetic coding sequence
atgcttcggtggctgagagatttcgtgttaccgaccgcagcttgccaggatgccgagcaacctacccggtatgagactctgtttcaagcactcgatcgtaatggcgacggcgttgtagacataggtgagctgcaggagggcttgcggaatctagggatccccctcggccaggatgccgaagagaaaatttttacaacaggggatgtaaacaaagatgggaaactcgattttgaggagtttatgaagtacctgaaggatcacgaaaagaagatgaagctggcatttaaatccttggacaaaaataatgacggcaagatcgaggcatcagaaatcgtgcagtctttgcagacactaggactgacgatctcagagcaacaggcagagctcatccttcagtcaatagatgtcgacggtacgatgaccgtcgactggaacgaatggcgcgactatttcctctttaaccccgtgaccgacatagaggagattatccggttttggaaacacagtaccgggattgacattggggactccctaacaatccccgatgaatttactgaagacgagaaaaagtccggtcagtggtggaggcagctgttggccggaggaattgcaggggccgtgtccaggacgtccaccgcccctttggaccgactgaagattatgatgcaggtgcacggaagtaagtcagataaaatgaacatcttcgggggtttcagacaaatggtgaaagagggcggaattcgctctctttggcggggcaacggaacaaacgtcattaaaattgccccagagactgcggtaaaattctgggcctacgagcagtataaaaagctgctgactgaagagggccagaagattggaactttcgaacgtttcattagcgggagcatggcgggcgcaactgcgcagacctttatctaccccatggaggtcatgaagacgcgtctggccgttggcaaaacaggccagtacagtgggatctacgattgtgccaagaagatactaaaacatgaaggccttggagctttttataagggatatgtccccaacctcctcggaataataccctacgccgggatcgatctggcggtgtatgagttgttaaagagctactggctggacaatttcgcaaaggattccgtcaaccctggggtcatggtcctgctcgggtgtggtgccctctcatcaacgtgtggccaactggcttcctaccccctggctctagttcgcacccgcatgcaggcccaagccatgctcgaaggttcgccccagctgaacatggttggactgttcaggagaatcatttccaaggagggaattcctggcctataccggggcatcactcctaactttatgaaagtgctacctgcggtcggtatatcctatgtcgtttacgagaacatgaagcagaccctgggcgtgacccagaaatag

SEQ ID NO: 30186 - DNA, 1377 bp, Artificial Sequence
  Description of Artificial Sequence: Synthetic coding sequence
atggactccctctatggtgacttgttctggtatttagattataataaagacgggaccctggatattttcgagctgcaggaggggttagaggatgttggggcaatccaaagtcttgaagaggccaaaaaaatctttaccaccggtgacgttaataaagacggaaaattagattttgaagagtttatgaaatatctaaaagaccacgaaaagaaaatgaaactcgcttttaaaagtctcgacaaaaacaatgatgggaaaattgaggcttctgaaatagtgcagtcgcttcagaccctgggcttgaccatcagcgaacagcaggccgagctcatcctgcaaagcatcgatgttgatggaaccatgacagtagactggaatgagtggcgcgactacttcctgttcaaccccgtaacagacatcgaagaaatcatccggttttggaagcatagtaccggcatcgacatcggagactctctaacaattcccgacgagtttacggaggacgagaagaaatccggacagtggtggcgccagttactggctgggggcatcgctggggccgtgagccgaacatctacagcaccactggatcggctcaagattatgatgcaggtgcatggaagtaaaagtgacaagatgaacatattcggtggcttccgccagatggttaaggaaggagggataaggtcactgtggcgcggtaatggcactaatgtgatcaagatcgcaccagaaacggccgtcaagttttgggcatatgagcagtacaagaaactgctcaccgaagaaggccagaagatcggcaccttcgaaagattcatcagtggcagcatggctggcgctaccgctcagacattcatctatccaatggaggtcatgaagacccgcctggccgttgggaagaccggacaatactctgggatttatgattgcgcaaaaaaaatccttaagcacgaaggactgggcgccttctacaaagggtacgtcccgaacttactgggcattattccttacgcagggattgacctggccgtctacgaactgcttaagtcttactggcttgacaacttcgccaaggacagcgtcaaccccggggtgatggtgttgttgggctgcggcgccctctcttccacatgcggtcagttggcatcttatccactggcccttgtgagaacacggatgcaagcccaggcaatgttggaagggtccccccagctgaacatggtcggcctgttccgccgaatcatcagtaaagaaggaatcccagggctctaccggggtatcacccccaacttcatgaaagtactgccagccgtgggcatctcgtatgtcgtctacgaaaatatgaaacagactttgggggtcactcaaaaatag

SEQ ID NO: 30187 - DNA, 1410 bp, Artificial Sequence
  Description of Artificial Sequence: Synthetic coding sequence
atgctgtgcttatgcttgtacgtaccagtgatcggcgaggcccagactgaatttcaatactttgagtcaaaaggcctgccagcagagctcaaaagcatatttaagctgagtgttttcatcccaagccaggaattcagcacttatcgccagtggaaacagaagattgtgcaggctggcgacaaggatctggatgggcagttagatttcgaagaatttgtccattacctgcaagaccatgagaagaagctgcgactggtattcaagtcactggacaagaagaatgacggaagaatcgatgctcaggagatcatgcagagcctgcgggacctgggggtaaaaatctctgaacagcaggcggagaaaatcttgaagtccatggacaaaaatgggacaatgacaatagactggaacgagtggagggattaccatctgttgcatccggttgagaatattccagaaatcatcctgtattggaagcattccaccatttttgacgttggcgagaatctcaccgtccctgatgagtttactgtagaggaaagacagacaggaatgtggtggaggcacctcgtagccggtggcggtgctggtgcggtaagccgcacctgcaccgcgcctctcgacaggctgaaagtactgatgcaggttcacgcgtctcgctcaaacaatatggggatagtcgggggcttcacccagatgattagggagggcggtgcccgatcactgtggagagggaatggcatcaacgttctgaagattgctcccgagagcgccataaagtttatggcctatgaacaaatcaaacgtctcgttgggtcagaccaggaaacacttaggatccacgagcgacttgttgccgggtcccttgcaggcgccatcgctcaatcttcgatttatcctatggaggtgctgaagacgaggatggcccttagaaaaaccggtcaatattctgggatgctcgactgtgctcgacgaatcctggcacgagagggggtagccgcattttataagggctacgtgccaaatatgctcggaatcatcccgtacgccggcatcgacctcgccgtctacgagactctcaagaacgcatggcttcagcattacgcagtgaacagcgccgatcctggggtgtttgtcctgctggcctgtggtactatgtccagtacctgtgggcaactggcctcctaccctctcgcgctggttcgcactagaatgcaagctcaggcctccatagagggagctcccgaagtgaccatgagtagtctgttcaagcacatcttgaggactgaaggcgcctttggcttgtaccgcggactggcaccgaactttatgaaagtgatccccgctgtatcgatctcatatgtggtatacgaaaaccttaagattactcttggcgtgcaaagtcgatag

SEQ ID NO: 30188 - DNA, 1506 bp, Artificial Sequence
  Description of Artificial Sequence: Synthetic coding sequence
atgctgcagatgctgtggcacttcctcgcatccttcttcccacgggccggttgccatggctctcgagaaggggatgatagagaggtgcgcggcactcctgcccctgcgtggcgggatcagatggcttctttcctgggtaaacaggatggacgcgctgaggctaccgagaaaagaccaactattttgctcgtagtgggacccgccgagcagtttcctaagaagatcgtccaggctggtgacaaggatcttgacggacagttggacttcgaggagttcgtgcattatctgcaagaccatgagaaaaagctgagattagtgttcaaaagcttggacaagaaaaatgacggacgtatcgatgctcaagaaattatgcaaagcctcagagatctaggcgtcaaaatttccgagcagcaggctgagaagattctgaagcggatccgcacgggccatttctggggtcccgttacctacatggacaagaacggcaccatgacgatcgattggaacgagtggagagactaccatctgctccacccggttgagaatattccagaaatcattctatattggaagcacagtacaatcttcgacgtgggggagaaccttaccgtgcctgatgaatttacagtggaagaaagacagaccgggatgtggtggcgacatttggtagcaggagggggcgcaggtgctgtcagtcggacatgcacagcacccctggaccgtctaaaggtgctgatgcaggttcacgcctcccgctcaaacaatatggggattgtgggcggtttcactcaaatgatacgtgaagggggagcacggtccctgtggagaggtaacggaatcaacgtgctaaaaatcgctcctgaatcagccataaagttcatggcctacgagcagatcaaaagactggtaggctcagaccaagagactctgcgcattcatgagaggctggtcgcggggagcctcgccggcgccatcgcacagagttctatatacccaatggaggtgctgaaaacccgcatggccctccggaagacagggcagtactccggcatgcttgactgcgccaggcgtatcttagcccgtgaaggagtggccgccttctacaaagggtatgtgcctaatatgctgggcattataccctacgccggcatcgatctggcggtatacgagaccctgaaaaatgcttggctacagcattacgcagttaattccgctgaccctggcgtgttcgttctactggcatgcgggacgatgtcttccacctgcgggcaacttgcgtcctaccctctggccctagttcgcacccgcatgcaagcacaggccagcatagaaggggctccggaagtcactatgtcgtccctgttcaagcacatcttgcggactgagggggcttttggtctttatcgcggcttggcacctaattttatgaaagtgattcccgctgtgtccattagttacgtcgtgtatgaaaatctaaaaatcacacttggtgtgcagagtagatag

SEQ ID NO: 30189 - DNA, 1512 bp, Artificial Sequence
  Description of Artificial Sequence: Synthetic coding sequence
atggtttccagtgtcctatgccggtgcgttgccagcccccctcccgacgcagcggcaaccgcagccagttcctccgccagcagccctgcgtccgtgggggacccgtgcgggggagcaatctgcggaggtccggaccatcgcttacgcctgtggagactgtttcagacactggatgttaacagagacggcggtctgtgtgtgaacgacctagccgtgggtctgagacgtctgggtctgcatcgaacggagggtgagttgcagaagattgttcaagcaggtgataaagatttagatgggcaactcgattttgaggagttcgtccactacctgcaggatcacgagaaaaaactgcggctggtatttaaatcattagataagaaaaacgacgggaggattgatgcacaggagataatgcagtctctcagagacctgggggtgaagatctccgaacagcaggcagagaaaattctcaaatctatggacaaaaacgggacaatgaccattgactggaatgaatggcgggactaccacctgctgcatcctgtcgagaacatacccgagatcattctctattggaaacacagcactatttttgatgttggggaaaatctaactgtacccgatgagtttacagtcgaggagcgacaaactggaatgtggtggaggcaccttgtcgctggcggaggagctggcgcagtcagtaggacatgcaccgcccctctcgacaggttgaaagtactgatgcaggtacatgctagccgatccaacaacatggggattgtggggggtttcacacaaatgattagagagggcggtgcccgctccctgtggagaggcaacgggatcaatgttctgaaaatcgccccagagagcgcaatcaaatttatggcctatgagcagatcaagcgcctggtggggagtgaccaggagacgcttcgtatacatgagcgcttggtggctgggtcattggcaggggccatcgcccagtcttcaatctatcccatggaggtgctcaagacacgcatggctttgcgcaaaacaggacagtactcggggatgctggattgtgctcggcgtattctggctagggagggcgtagcggccttctataaggggtacgttcccaatatgctcggcatcattccttacgctggaatcgacctggccgtctacgagactctcaagaacgcttggctccagcactatgcagtgaactctgccgacccaggcgtctttgttctgttggcttgcggcacaatgtcctcgacatgtggccaactggcttcttatcccctggcactcgtccgtactcgcatgcaagcccaggctagcatcgagggcgcgccagaagtgaccatgagcagcttgtttaaacacatccttaggactgaaggggcatttggcctttatagaggcctggcacccaattttatgaaagtaatcccagcagtgtccatctcttatgttgtctatgagaatctgaaaataacgctgggagtccagagccgctag

SEQ ID NO: 30190 - DNA, 1548 bp, Artificial Sequence
  Description of Artificial Sequence: Synthetic coding sequence
atggtgagctcagtgctgtgcagatgcgtcgccagccccccacccgacgccgcggcaactgccgcctcctcttcggcatccagtccagcctctgtgggggatccttgtgggggcgccatctgcggaggccccgatcataggctgagactgtggcgccttttccagaccttggacgtcaatcgagatggcgggttgtgtgtcaatgatctcgcagtcggattgaggcgactgggactgcacaggacggaaggggaactgcaaaaaatcgttcaagcaggcgataaggatctggatggacaacttgactttgaagagtttgttcactacctgcaggatcacgagaaaaaactcaggctggtgtttaagtctttggataagaaaaacgacggtagaatagacgctcaagaaattatgcaatccttgcgcgaccttggtgtcaagatcagtgagcagcaggccgagaagatcttaaaacggattaggactggacatttctggggacctgttacgtacatggacaagaatggaacaatgactatcgattggaatgagtggcgtgactaccatctcttgcatccggtggagaacattccagaaattatcctttattggaagcactcaaccatttttgacgttggtgagaatctcactgttcctgatgaattcactgtggaggagaggcagacggggatgtggtggagacatctggtggcaggtggcggcgcaggagccgtaagtagaacgtgcaccgcgcccctggacaggttaaaggtcctgatgcaggtgcacgcctcacggtcaaacaatatggggattgtcggcggcttcacccagatgatcagggaagggggggccaggagtctgtggaggggcaacggaattaacgtactcaagatagcccccgagtccgctatcaaattcatggcctacgagcagatcaagcggttggtgggctctgaccaagaaaccctgaggatccatgagcggcttgttgcagggagtctggccggcgccattgcccagtcaagcatttacccgatggaggtactcaaaaccaggatggctctgcgaaagacggggcagtacagcgggatgcttgattgcgcgcgccggatcctcgctagagaaggcgtggccgctttttacaagggctacgtgcccaacatgcttggaatcattccatacgctgggattgacttagctgtctacgagaccctgaaaaacgcctggctgcaacactacgcagtgaactccgcagaccctggagtcttcgtcctgctagcctgcggtacaatgagctctacgtgcgggcagctagcctcctatcccctggccctcgtgaggactaggatgcaagctcaagcttcaatcgaaggggccccagaagtgactatgtcaagtttgtttaaacacattctgcggactgagggagcctttggcctttatcgtggcctggcacctaatttcatgaaagtgatcccagcggtgagtatctcatatgtggtttatgagaacctgaaaattaccctcggagttcagagtagatag

SEQ ID NO: 30191 - DNA, 1470 bp, Artificial Sequence
  Description of Artificial Sequence: Synthetic coding sequence
atgctacagatgctttggcattttcttgccagtttttttccccgggcaggctgtcacggctcgagagagggagatgatcgggaggttcgcgggacgccggccccggcgtggcgcgaccagatggcttcatttctgggtaaacaggatggccgtgccgaagctactgagaaaagaccaacaattctcctggtggttggacccgcagaacagtttccaaagaagatagtgcaggccggggacaaggatctggacggacaattggactttgaggaatttgttcactatttgcaggaccatgaaaaaaaattgagattggtcttcaagagtctggataagaaaaacgatggcaggatcgatgcgcaggaaattatgcagtcacttcgggacctcggagtgaaaatcagtgagcaacaggcagaaaagatcctaaagtctatggataagaatggaaccatgactatcgattggaacgaatggcgcgattaccacctgctgcaccccgtcgagaacatccctgaaattatcctgtattggaaacacagcacgatctttgatgtgggcgagaacctcactgtgcccgacgagttcaccgttgaagagcgccaaactggaatgtggtggcgccacctcgtcgccggcggaggcgcaggggcagtgagccggacatgtaccgctccgctggaccgcctgaaagtgttaatgcaggtccatgcctcacgtagtaataatatgggcatcgtggggggattcacccagatgatacgtgaaggcggagcacgctctctgtggaggggcaatggcattaatgtactcaagattgcgcccgaatcagccattaagtttatggcttacgaacagatcaagcgcctagtgggatctgaccaggaaaccttgcgcattcacgagcgcctcgtcgcgggctccctcgctggagctatcgcgcaaagctcaatatatccaatggaggtcttgaagactaggatggccctccgcaaaacaggccagtactccggaatgctcgattgtgctaggcggatccttgcaagggaaggagttgcggccttctataaggggtacgttccgaacatgctaggcattatcccttacgccggcattgacctggcagtctacgagaccctcaagaatgcttggcttcaacattacgccgtgaactcagctgacccaggagtgtttgtcctactggcctgcggcaccatgagcagtacctgtggccagctcgcctcctaccccctcgccctggtgaggactcgtatgcaggctcaggcatccattgaaggggctccagaggtcacaatgagcagtctgtttaaacacattctccggaccgagggcgcatttggcctgtatagaggcctggcccctaacttcatgaaagtgatccctgccgtgtctattagttacgttgtctatgagaacctcaagattaccctgggcgtgcagtcgcggtag

SEQ ID NO: 30192 - DNA, 1101 bp, Artificial Sequence
  Description of Artificial Sequence: Synthetic coding sequence
atgcagtccctcagggatttgggagtgaagattagcgagcagcaggccgaaaaaatcctgaagtctatggacaagaacggcactatgacgatagattggaatgaatggagagactatcatctactgcatcctgtagaaaatatccctgagatcattctgtattggaaacactctacaattttcgatgtgggagagaacctgactgttccggacgaatttactgtggaagagcggcaaacagggatgtggtggaggcacctcgtagcgggcggaggagccggagccgtgtcacggacctgcactgcaccgctcgacagactgaaggtattaatgcaggttcatgctagccgcagcaataatatggggattgttggcgggttcactcaaatgataagagaaggcggtgctaggtccctatggaggggaaacggcatcaacgtactaaagatcgctcctgagtctgctatcaagtttatggcatacgagcagattaaacgactcgtgggctctgatcaagagacactccggatccatgagcggcttgtcgccggctctttagctggcgccatcgcccagtcaagtatttatcccatggaggtacttaaaacgagaatggccctgagaaaaacaggacaatattcaggcatgctggattgcgcacggagaatattggctcgcgagggagtcgcagccttttacaaggggtacgtacctaacatgttggggattataccctacgcgggcattgatctcgccgtgtatgagaccctgaagaatgcttggctccagcactatgctgtgaactcagcagaccccggggtgttcgtgctgctggcctgtggtactatgtcttccacatgcgggcagctcgcctcttaccctcttgccctcgtgaggacacggatgcaggctcaggccagcatagagggggcgcccgaagtaaccatgagctccctctttaaacacatcctcaggactgaaggcgcgtttggcctgtatcgaggacttgcacccaatttcatgaaggtgatccccgccgtgtccatcagctacgtcgtgtatgaaaatttaaaaattaccttgggagtccagtcccggtag

SEQ ID NO: 30193 - DNA, 894 bp, Artificial Sequence
  Description of Artificial Sequence: Synthetic coding sequence
atgatagatagcgaagcgcatgagaagaggccgccaattctcactagctcgaagcaggatatttctccgcacattacaaatgttggagagatgaaacattacctgtgcggatgctgcgctgccttcaataatgttgcgattacgtacccaattcagaaggtcctatttcgacagcagctctacggaatcaagaccagggacgccgttctacaactgcgcagagatggctttaggaatctgtaccggggtatcctgccacctctcatgcaaaaaacgactactcttgctctcatgtttggattatacgaggatctgtcttgcctgcttcgcaagcatgtcagggctccggagttcgcaacgcacggggtcgcagccgttctcgccggtactgctgaggccatctttacccccctggagcgagtgcagactttgctgcagaaccacaagcaccatgataagtttacaaacacatatcaagcgtttaaagccttaaagtgccatggaatcggtgagtattaccggggccttgtaccaatactcttccgcaacgggctgtcaaatgttcttttttttgggctgcgggggcccattaaggagcatcttcctaccgctacaactcactcggctcacctcgtaaacgatttcattggaggaggcctcctgggcgccatgctcggatttctgtgttttcccattaacgtcgtgaaaacacgcctgcagtcacagataggtggggagttccagtcttttcccaaggtctttcaaaagatatggctggaaagggacagaaagctgattaatctgtttcgtggggctcacttaaattaccacaggagcctcatttcctggggcattatcaacgccacctatgagttcctcctcaagtttatatag

SEQ ID NO: 30194 - DNA, 912 bp, Artificial Sequence
  Description of Artificial Sequence: Synthetic coding sequence
atggcacttgacttcctggccggctgcgcgggcggggtggctggggtgctggtgggacatccctttgatactgtcaaagtgcgcctgcaagtccagtccgtcgagaagcctcaataccgagggacactccactgctttaaatctattattaaacaggaatctgtgctaggcctgtacaagggcctcggaagtccgctcatgggactgacattcatcaatgccttggtattcggggtgcaggggaatactctcagggccctgggccacgactcaccactgaatcaattccttgctggcgcagccgccggtgcaattcaatgcgtgatttgctgccctatggagctcgccaagacacgcctgcaactacaagatgccgggccggcccggacatacaagggaagcctggattgcctggcacagatttatggccatgaagggctgagaggcgtgaatcggggcatggtatccaccttactcagggagacaccctcttttggggtgtatttcctgacttatgatgcacttactcgggcgctgggttgtgagccaggggaccgcctgctggtacccaaactcctcctggccggcggcacctcgggtatcgtttcttggctttccacataccccgttgacgttgtgaagtctcgactacaagccgatggccttcgtggcgcaccacgttacagaggcatccttgattgcgtccaccaaagctacagggcggaggggtggcgcgtttttaccaggggtctggcctcaacattactgcgggcatttcccgttaatgctgctacatttgcaacggtcaccgtagtcttgacttatgcacggggagaggaggccggccctgagggcgaggccgtcccggccgcccctgctggcccagctctcgcccaaccaagttcgttgtag

SEQ ID NO: 30195 - DNA, 714 bp, Artificial Sequence
  Description of Artificial Sequence: Synthetic coding sequence
atgggcctgaccttcattaatgccttggtgtttggcgttcaggggaacacactgcgagccctgggccacgatagcccactaaaccaatttctagcgggggctgctgctggagccattcaatgtgtgatctgttgccccatggagctggcaaagacacggcttcagttacaggatgcaggccctgcccggacatataagggcagtttggattgtctggcgcagatctatggccatgagggccttcgcggcgtcaacaggggaatggtgagtacactgctgagagagacaccctcattcggggtttattttctaacctatgatgccttaacacgtgccctcggctgcgagcccggggatcgcctcctggtgcccaagttacttctcgcaggcgggacatcaggaattgtgtcctggctgtccacatatcccgtcgacgttgtcaaaagcagacttcaggccgatggattgcgcggggcccccaggtatcgcggtatccttgattgcgtgcaccagagctatagagccgagggttggagggtctttacgcgtggattagccagcacattgctgagggcctttcccgtgaatgcggcaactttcgcaacagtcacagttgtcttaacttacgccagaggggaagaggccgggccagagggggaggccgttcctgccgcacccgccggtccagcactggcccagccttcatccttgtag

SEQ ID NO: 30196 - DNA, 714 bp, Artificial Sequence
  Description of Artificial Sequence: Synthetic coding sequence
atgggactgacttttatcaatgccttggtctttggcgtgcagggcaatacattgcgggcactcgggcacgattctccgctgaatcagtttttagctggggcagccgccggagccattcagtgcgtgatctgttgccccatggagttggcgaaaactaggctgcagctacaagacgcagggccagcccgcacttacaagggttctttggactgtctggcccagatctacgggcacgaggggctgagaggcgtcaacagaggtatggtgagtactttactgcgcgagacacccagtttcggcgtgtattttttgacttacgatgctctgacacgggctctgggctgcgaacctggggacagacttctagtccccaagttgcttctcgctggggggacgtcagggattgtgagttggctgtcaacttacccggtcgatgttgtaaaatcgcgcctgcaggccgatggtctcaggggggctcctagatataggggcatcttggactgcgtccaccaatcatacagagcggagggatggcgggtgtttaccagggggctggctagcactctgctgagggcgtttcctgtgaatgctgcaacttttgcaacagttaccgtggtcctgacctacgcccgcggtgaggaagcaggacctgagggtgaagccgttcccgctgccccagcaggtcccgccctggcgcagccaagctccctatag

SEQ ID NO: 30197 - DNA, 714 bp, Artificial Sequence
  Description of Artificial Sequence: Synthetic coding sequence
atggggcttaccttcatcaatgcactagtgtttggggtacaagggaacacattgagagcactgggacatgactctccactgaaccagtttctggccggggccgccgcaggggcgattcagtgcgtgatctgctgtccaatggagcttgccaagacccgcttacagctccaggacgccggccccgctcgcacttacaaaggaagtctcgactgtctggctcagatttacggtcatgaagggctgcgaggtgtgaatcgtggtatggtctctacattgctaagggagacacccagttttggggtgtacttcctgacctacgatgccctgacccgggccctgggctgcgagccaggcgaccgcttgctggtgcctaagctcttgctggccggcggtaccagcggcatagtgtcctggctatccacctaccccgtggacgtggtcaaatctcggttacaggccgacggactccgcggtgccccaagataccgcgggattctcgattgtgtgcatcagagctacagggccgaagggtggagagtgttcacgcggggccttgcttccacgctgcttcgtgcattccccgttaatgctgcgaccttcgcaactgttacagtggttttgacatacgcacgtggggaagaggctggcccagagggtgaagctgtaccagccgctccagcaggccctgccctagcccagccgtccagcctctag

SEQ ID NO: 30198 - DNA, 714 bp, Artificial Sequence
  Description of Artificial Sequence: Synthetic coding sequence
atgggcctgaccttcatcaatgccctggtgtttggcgtccagggcaatactcttagagcgcttggtcatgactctcctctgaaccagtttctcgctggggccgcagccggagcaatccaatgtgtcatctgctgtcccatggagttagctaaaacgagattacagcttcaggacgccggccctgctcgcacatacaagggctcccttgattgcctggcgcagatttacggccatgagggcctccggggtgttaatagaggcatggtgagtaccctcttgcgggaaactcccagtttcggagtttacttcctgacctatgatgctctgacgcgcgccctcggttgcgagcctggcgataggctccttgtccctaagctcctgctggctgggggaaccagcgggatcgtgagctggctgagtacctaccctgtggacgtcgtcaagagtcgccttcaggcagacggcctccggggagctccaaggtatagggggatactggactgcgtccaccagagctacagagccgaagggtggcgggtgtttacgcgcggtttggcaagcacactacttcgggcattccccgtgaacgccgccacctttgccactgtgactgtagtgctcacttacgccaggggtgaggaagccggccctgagggagaagccgtacccgctgcgccagcgggccccgccttggcgcagcctagttccctgtag

SEQ ID NO: 30199 - DNA, 936 bp, Artificial Sequence
  Description of Artificial Sequence: Synthetic coding sequence
atgtctcagagagacacacttgtgcaccttttcgctggcgggtgtggtgggactgtcggagcgatccttacgtgcccactggaggtcgtcaagaccaggttgcaaagttctagcgtgaccctttacatcagcgaggtccagcttaacacaatggctggcgccagcgtgaacagagtcgttagtcccggccctcttcactgtcttaaggtgatcctcgagaaagaaggaccacggtccctgttccgtggcctggggcccaacctcgtcggagtggcaccttctagagccatctattttgccgcgtatagcaattgcaaggagaagctcaacgacgtatttgatccagacagcactcaggtgcatatgatctctgctgcaatggcaggcttcactgctattactgcaaccaatcctatctggctgataaaaacacgtcttcagctagatgccagaaatcggggtgaaaggcggatgggtgcctttgagtgtgtccggaaagtttaccagaccgacgggctgaagggattctatcgaggaatgtctgccagttacgccggaatcagcgagacagtcattcacttcgtgatatacgaaagcattaaacagaaattgcttgagtataagactgccagcactatggaaaacgatgaggagagcgtaaaggaggcatctgattttgtgggaatgatgctggccgctgcgacctctaagacttgtgctaccactatcgcctatccccacgaagtggtgagaacccgccttcgcgaggagggcacaaagtaccgtagtttctttcagacgttaagtctgctggttcaggaggaaggatacggtagcctataccgcgggctcactacccacctagttcgccagattccaaacacagctatcatgatggccacctatgaattagtggtttatctgcttaacggctag

SEQ ID NO: 30200 - DNA, 933 bp, Artificial Sequence
  Description of Artificial Sequence: Synthetic coding sequence
atgtcacagcgggatacactggtgcacctgttcgcaggcggatgtggagggaccgtgggtgccatcctaacctgtcctctggaagtggtgaagacaagactccagagttcgagcgtaactctgtatatttccgaggttcagttgaacactatggcaggggccagtgtgaatcgggtcgtatcacctggaccgctccactgcctgaaagtgatcctagagaaggaggggcctagaagtctgttcaggggccttggacctaaccttgttggtgtggctccttcacgggcaatctatttcgctgcctactcaaactgcaaagagaaactgaatgacgtcttcgacccggactcgacacaggtacacatgataagcgcagccatggccggattcaccgctataacagctacgaacccaatctggcttattaaaaccaggctacagcttgatgctagaaaccggggggagcgccgcatgggagcttttgaatgtgtacgcaaagtgtatcagacagacgggttgaaaggcttttacaggggcatgagcgccagttacgcaggcattagtgagaccgtaattcattttgtgatatacgaatctattaagcagaagctactggagtacaaaaccgccagcactatggagaacgacgaggagagcgtgaaagaggcctcggattttgtgggtatgatgctggcagctgcaacctccaaaacatgcgccacgacaatcgcctatccacatgtcgtgcgaacacgtctgagagaagagggcactaagtatcgcagtttcttccagactctttctctgctggtgcaggaggaggggtatggtagtctctatcgaggcctcacaactcatctcgtccggcagatccccaataccgctatcatgatggcaacctacgagctggtcgtatatctactgaacggatag

SEQ ID NO: 30201 - DNA, 927 bp, Artificial Sequence
  Description of Artificial Sequence: Synthetic coding sequence
atggacttcgtcgcaggagctatcggaggcgtttgtggggtcgccgtcggttatcccctcgatacggttaaagtccgcattcaaaccgaacccaaatacactgggatctggcactgtgttcgggacacttaccacagagaacgggtgtggggtttctatcgcgggctcagcctcccagtgtgtacagtgagcctcgtgtcttcggtctctttcggcacctataggcactgtttagcccatatctgcaggctgaggtatggaaatcccgacgctaagccgacaaaggccgatataacactgagcggctgcgcttccgggttggtcagggtcttcttaacatcacctaccgaagttgctaaggtccgactccagacccagacccaggcccagaagcagcagcgtcggctctctgcatcagggcccttggccgttccccctatgtgtcctgtcccgcctgcctgccctgagcccaaatacagggggcctctccattgtctagcgaccgtcgcccgggaggaaggtctgtgcgggctatacaaaggcagttccgcgctggttttgagggacggtcactcctttgccacatactttctatcatacgccgttctctgcgagtggctatctcctgccggccattctaggccagatgtgccaggcgttctcgtagccggaggttgcgctggcgttctggcatgggcagttgccacgcccatggatgtgatcaaatcaagattacaggcggacggtcagggtcagcgccgctatcgcggtcttctccactgcatggtcacaagcgtgcgggaggaaggcccccgcgtgctttttaaaggtcttgtgctgaactgctgccgtgcttttccagtaaacatggtcgtgtttgtggcctatgaggccgttctgaggctggctcgaggtctgctcacctag

SEQ ID NO: 30202 - DNA, 876 bp, Artificial Sequence
  Description of Artificial Sequence: Synthetic coding sequence
atggggagcttccaactagaagactttgctgcgggatggatcgggggtgcagcatctgtcattgtcgggcacccactcgatacggttaaaactagactgcaggccggtgttggatatgggaacactctgtcttgtatacgagtggtgtatcggcgcgagtccatgtttggctttttcaaaggtatgagcttccccttagcctcaatcgcagtgtataactccgtggttttcggagtcttctcaaacacccagcgctttttgtctcagcataggtgcggagaacccgaggctagtccgcctcggaccctctcggacctgctcctagctagtatggtcgccggcgttgttagcgtggggctgggcgggcctgtggatcttattaaaattagactgcaaatgcagacacagcctttcagagacgcaaatctcggcctgaaatcccgagctgttgcccccgccgagcaaccagcttaccagggacccgtgcactgcatcactaccattgtgagaaatgaggggcttgccggtctctacagaggtgcctccgctatgctcctccgtgacgtacccgggtactgtttgtacttcataccttacgtatttttgtctgagtggatcacccccgaggcctgcactggaccaagcccctgtgcggtatggcttgctgggggcatggccggaaagggcagctcttcctggagccggacccccgtgcaggccacagccgtgggacagctagggaactgccacgcactgctctcacccggtggagggcaagatacttttaggtactcgccaaacaattccctccttggcacgtactcggttccaggaccgcttcccccacagtcccatccttttccaatgcagctgtag

SEQ ID NO: 30203 - DNA, 474 bp, Artificial Sequence
  Description of Artificial Sequence: Synthetic coding sequence
atggggagttttcagctggaggacttcgctgcaggctggattgggggcgctgctagcgtcatcgtcggccacccactggatacggtcaaaacccgactgcaggccggcgtgggatacggtaatactctcagctgtatccgggtcgtgtaccgacgggagagtatgttcggattttttaagggcatgtccttccccctggcaagcatcgcagtctataattccgtggtgtttggtgtattcagcaacacccaaagattcctgtctcagcaccgatgcggggagcctgaggcctctcctccccgcaccctatcagatttattgctggcctctatggtggccggagtcgtgtccgtaggactggggggacctgtggacttgattaaaatacggctgcaaatgcagactcagccatttagggacggcggcgaacatagaatgacaaccgtcttccctgggccacacctgtgtatgtag

SEQ ID NO: 30204 - DNA, 936 bp, Artificial Sequence
  Description of Artificial Sequence: Synthetic coding sequence
atgggttcttttcagttagaagactttgctgccggctggatcggtggtgctgcaagcgtaatcgtcggtcacccccttgatactgtgaaaacacgcctgcaggctggcgtcgggtatggaaacaccctgtcctgcataagggtcgtgtatcggcgggaaagtatgttcggattctttaaaggcatgagtttcccactggcttctatagccgtctacaattctgtggtctttggtgtcttcagtaacacccaacgattcctgagccagcataggtgcggagaaccggaagcctcacctcctcggacccttagtgatcttttactagcctctatggtggctggggtcgtgagcgtggggctgggaggcccggtggatctgatcaagataagacttcagatgcagactcaaccctttcgcgatgctaacttggggctgaagtcgagggctgtggccccagccgagcagcccgcctaccagggtcctgtgcactgcattaccaccattgtgaggaatgagggtctcgcggggctctaccggggcgctagtgcaatgcttttgcgcgatgttcctggttactgcttgtacttcatcccctacgtgttcctgtccgagtggatcacccccgaggcgtgtactggtccgtcaccttgtgcagtatggctggcggggggcatggccggcgctatcagctgggggacagcaacaccaatggacgtggtgaagtctcgtttacaggcagatggggtgtaccttaataagtacaaaggcgtcctggactgcatatcacagtcctaccagaaagagggactgaaagtcttttttcgaggtatcacagtgaatgctgtccgaggcttccctatgtccgctgctatgttcctggggtacgagttatctctgcaggccatacggggcgaccacgcggttacatcgccctag

SEQ ID NO: 30205 - DNA, 774 bp, Artificial Sequence
  Description of Artificial Sequence: Synthetic coding sequence
atgtttggctttttcaagggtatgagctttcccctcgcctctattgccgtgtacaattccgtagtgtttggtgtgtttagcaacacccagcgcttcctttcccagcaccggtgtggggagcccgaggcatcccctccgcggaccttatctgacttactgctggcttccatggtggccggcgtggtatccgtgggactggggggaccagtcgatttgattaaaatccggctgcagatgcagactcaaccctttagagatgcaaacctcgggctgaaatctcgggcagtcgccccagcagagcaacctgcgtatcagggaccagtgcactgcattactactatcgtaagaaatgagggtttagcaggactataccgcggtgcttcggccatgctgctgcgagacgtcccgggatattgcctgtattttattccttacgtgttcctcagtgagtggattactccagaggcctgtacgggaccaagtccatgcgcagtatggctggctggcgggatggccggtgccatttcatgggggactgcaacacccatggacgtcgtaaagagtcgtctgcaagctgatggggtttacttgaataagtataagggcgtgcttgattgtatcagccaatcctatcaaaaggagggcttgaaggtgttcttccgcggtattacggtgaatgctgtccgaggctttccaatgagcgccgctatgtttttagggtacgagcttagccttcaagcgatccgcggcgatcacgccgtcacgtcgccatag

SEQ ID NO: 30206 - DNA, 2106 bp, Artificial Sequence
  Description of Artificial Sequence: Synthetic coding sequence
atggacgaaagtccagagccccttcagcagggaaggggcccagtgccagtacgccgccagaggccggccccaagagggcttcgggagatgctcaaggctagactgtggtgctcctgcagttgctccgtgctgtgcgtaagggccctggtgcaggatctattacctgctacgcgatggctgcgccagtatcggcctcgagagtatttagcgggggacgtcatgtcaggtctcgtgataggaatcattctcgtcccccaggcgatcgcatattccctcctggccggactccagcctatttactcactgtatacttcatttttcgctaatctgatctattttttgatgggtacatcacgccacgtgagcgttggcatattctccttgctgtgcctgatggtcggtcaggtggtagatcgggagctacagctcgccgggttcgatccttcccaggacgggttgcagccgggggccaatagcagtacactcaacggctctgctgccatgctggattgcgggcgggattgttatgcaatcagagtggccactgcactgaccctgatgacagggctttaccaggtccttatgggtgtgcttagactgggctttgtgagcgcatatcttagtcagccactgctggatgggtttgccatgggtgcgtctgtcaccattcttacaagccagcttaaacatctgctgggtgtcagaatccccagacatcagggacccggcatggtggtgttgacgtggctaagcctattgcgcggtgctggccaggctaatgtgtgcgacgtagtgacctctaccgtgtgtctggccgtgttgctcgcggccaaggagctgtcagatagataccggcaccgattgagagtacctctgcccaccgagttgctagtcattgttgtggctacactcgtttcccacttcggccaattgcacaagcgctttggatctagcgtggcaggagacatcccgactggtttcatgccaccgcaggtaccagagccaagactgatgcagcgcgtggcactggacgctgtggctttggccctggtggcggcagccttttccatttctttggcagaaatgtttgctcgatcccacgggtattccgtccgcgcaaaccaggagctcctggccgttggttgttgcaatgttctcccagccttcctgcactgctttgcaaccagcgcggccttagctaaaagcctggttaaaacggccactgggtgccgcacccaactcagctctgtggtgagtgccaccgttgttcttctggtcctcttagctctcgctcctctcttccatgatctgcagagatctgtgttagcctgtgtgattgttgtgtctctgagaggggccctccggaaagtttgggacctgccgagattatggagaatgagtcccgcagatgcattagtctgggctgggaccgccgccacctgtatgttagtttctacagaggcaggcttgctagccggcgtgattctgtctctgctctcgcttgcagggagaactcagaggcccagaactgccttattggcccgcatcggcgacaccgctttttacgaggatgccactgaattcgaagggctcgtgccagagcctggtgtcagggtgttcaggttcggaggcccattatactatgccaataaggatttctttttgcagagcttatacagtttaactggtctggacgccggctgtatggctgctcggaggaaagaaggaggatcggagaccggcgtgggtgagggtggacctgcacagggggaagatctgggacccgtaagcaccagagctgcactggtcccggccgctgccggctttcatacagtggtcattgattgcgctcccttgctgttcctggatgccgcaggcgttagtacccttcaggaccttagacgagactacggtgccttgggaatatctctcctactggcctgttgcagccccccagtgcgcgatattttatcaaggggaggcttcctcggagaagggccaggggatacggccgaagaagagcagttgtttctgagtgttcatgacgctgtgcagacagcccgggcaaggcatcgcgaactcgaggccacagatgcccacctctag

SEQ ID NO: 30207 - DNA, 2106 bp, Artificial Sequence
  Description of Artificial Sequence: Synthetic coding sequence
atggacgagagccctgagcctttacagcaggggcgcggccctgtgcctgtgaggagacagaggcctgcccccaggggtctccgagaaatgctcaaggcgcgcctctggtgctcttgcagctgtagtgtgctgtgcgtcagagccttagtccaggatcttctgcccgctacacgctggctgagacaatatcggccccgcgagtacctcgcaggggacgttatgtcaggactggtaatcgggatcattctggtaccacaagcaatcgcatactctctcctggcgggactacagcccatctacagcttgtacacatccttttttgctaatctcatctatttccttatgggaaccagtaggcacgtgtccgtcggcatctttagcctcctgtgcctcatggtaggccaggtggtcgacagagaactacagttagccgggtttgatccaagccaagatggcttgcagcctggggcgaatagctctacgctgaatggctctgccgcaatgctggactgcggccgtgactgctatgccatccgagtggctacagccctgacgttgatgacaggcctctaccaggtgctcatgggagtcctgcggctgggtttcgtctccgcttacttatcccagcccctcctggacgggtttgccatgggggccagcgtcaccatcctaacaagccagctgaagcacttactgggagtgcgcattcctcggcatcaggggccgggtatggtggtgctcacttggctttccctcctgcgcggagccggacaggcgaacgtctgtgatgttgtgacatccactgtgtgtctcgcagtgctcctcgccgcgaaagaactgtcagacagatataggcatcgcttgcgcgtcccactgccaacagagctactcgtgatcgtcgtagcaacgctggtatcccacttcgggcagcttcacaaaaggtttggttcatcagttgcaggcgacatccctacaggcttcatgccccctcaagtccctgagccaaggcttatgcaacgggtggcactagacgctgtcgcacttgctcttgttgcagctgccttttccatatctctcgctgaaatgtttgcccgatcccacggctactctgtgcgcgcgaatcaggagctgttggctgtagggtgttgtaacgtcttgcccgcattccttcactgtttcgcaacttcagctgccctggccaaatcccttgtgaagaccgctactggttgtcgcactcaactgtctagcgtcgtgtccgcaactgttgtgctcctagtccttcttgcacttgcccctttatttcacgacctccagagaagcgtcctggcatgcgtgattgtggtctctttgagaggcgcactcaggaaagtgtgggacctcccccgcttgtggcgcatgtccccagcagatgcacttgtttgggcagggacagccgcgacttgcatgctggtctcaaccgaggcgggactgctcgctggcgtcatcttgtctctgctctccctggccggccggactcagcgacccaggacagcactgctggctaggatcggagatacagccttttacgaagacgccacagaatttgaaggactggtgccggaacctggagtcagggtgtttcgattcggagggcctctttattacgcaaacaaagactttttccttcagtccctgtatagcctgaccgggctggatgccgggtgtatggcggcccggcggaaagaagggggtagcgaaacaggcgtgggggagggcggtccggcacaaggtgaagacttaggccccgtttctactagggccgctctggtccctgccgccgccggcttccacacagttgtgatcgattgtgctcctctgttgttcctcgacgctgcaggcgtatcaaccttgcaggatttgcgtagagactacggggctctagggattagtttgctactggcctgctgttccccaccggttagggatattctgtcaagaggagggtttctgggagagggtcctggggacactgcagaggaggaacagcttttcttatcagtgcacgacgccgtgcagaccgcccgcgcccggcatcgtgagctggaagcaaccgacgctcacctgtag

SEQ ID NO: 30208 - DNA, 675 bp, Artificial Sequence
  Description of Artificial Sequence: Synthetic coding sequence
atggatgagtctcccgagccattacaacaaggtagggggcccgtgcccgtgcgtaggcagcgacctgcccctcggggcctacgggagatgctgaaggcacggctgtggtgcagttgttcttgctccgtcctgtgtgtaagagccctcgtgcaagacctgctcccagcaacaagatggctgcggcagtatagaccacgagaatatttggctggagacgttatgtccggactggtgataggcatcattctggtccctcaagctattgcctactccctcttggcggggctccaaccaatctatagcctgtatacctcattttttgctaatcttatttattttctgatgggcactagtcggcacgtgtccgtgggcattttttccctcttgtgcctgatggtgggccaagtggtggaccgggagctgcagctcgccggctttgacccctctcaagacggcctgcaacccggagccaactcttccaccctcaatggctccgcggccatgctcgactgtggccgcgactgctacgctatccgagtggccaccgccctgaccctcatgaccggtctctaccagacctcctggggccgaaacagctttcagcaacacccatggcagctgacacaacgtagcgatagccaggagctactcgaggaagaagagaggtcctgttag

SEQ ID NO: 30209 - DNA, 1365 bp, Artificial Sequence
  Description of Artificial Sequence: Synthetic coding sequence
atgcggctggacctggcttcgctgatgagcgcgcctaaatctctgggcagcgccttcaaatcctggcggctggacaaagccccctcgcctcagcacacgtttcccagcacttctatccctggcatggcctttgcccttttagcctctgtaccccccgtcttcggcctgtacaccagcttcttccccgtcctgatttatagccttcttggcactgggcgacatctgtctaccggtacattcgccattctaagcctaatgactggctccgccgttgaaagactagtccctgagcctctggtcggaaacctgtccggcattgagaaagagcagctggacgctcaaagagtgggagtagctgccgctgtggcgttcgggtccggagcattgatgctgggaatgttcgtgctgcagttaggcgtcctgtctacgtttttgtcagaacctgtggtaaaggctctgacttctggcgcagcactgcacgtgttgctcagtcagctgccttcactgctggggcttagcctgccacgtcaaatcggatgcttctccttgtttaagactttggcaagcctactgaccgctttgccccgaagctctcctgcagaactgacaatttcagcgctgagcctggccttactggtgcccgtgaaagagctgaacgttaggtttcgggaccggcttccaacgcccatccctggggaggtggttctcgtcctcctagcttcagtcctttgtttcacgtcatcagtcgataccagatatcaggttcaaatagtaggcctcctgccaggtggcttcccacaacccttgctcccgaacctggccgagttgcccagaatcctggcagatagcttgcccatcgctttagtttcattcgcagtgtcagcaagtttagcaagtatccatgccgataaatactcttacacaatcgatagcaatcaggagttcctggctcacggagcaagtaacctcatcagttccctgttcagctgctttccaaattccgccaccctagccactaccaacctgctagtagatgccggtgggaaaacccagttggccggcctattctcatgtactgtggtgctttcggttcttttatggctggggccatttttctattacctgcccaaggcagtgctggcgtgcattaacataagtagtatgcgccaggtgttctgtcagatgcaggagctgccacagttatggcatatatcccgcgtggatttcgctgtgtggatggttacctgggtggctgtggttactttaagcgttgatttaggcttggcagtgggggtagtcttcagtatgatgactgtggtgtgccgcactagatcgagcagcagaagtagaggatcggcgtcgtag

SEQ ID NO: 30210 - DNA, 1821 bp, Artificial Sequence
  Description of Artificial Sequence: Synthetic coding sequence
atgccatcgtctgtgactgcccttggccaagctaggagcagtgggccaggtatggccccatctgcctgttgttgttcacctgcggccttgcagagacggctgccaatcctggcatggctgcccagctattctctccagtggctcaagatggatttcgtcgcgggactgtctgtaggtctcacggcaatcccccaggcactggcctacgccgaggtcgctggcctcccccctcagtacggtctgtacagcgcattcatgggatgcttcgtttacttcttcctgggcaccagccgcgacgttacattgggtcctacagccattatgtcgcttctggtgtccttttacacctttcatgaacctgcatatgcagttctgttggcgtttctgagcggatgcattcagctggctatgggggtgctacggctcggctttctgcttgacttcatatcttacccagtgatcaaaggctttactagtgccgcagcagtcaccattggttttggccaaatcaaaaacctgctgggcttacagaacattcccagacctttttttcttcaggtgtaccacacattcctgagaatcgccgagacgcgggtgggcgatgccgttctgggactcgtatgtatgctgctgctgctcgtgctgaagttgatgcgagaccacgtcccacctgtgcatccagaaatgcctcccggcgttcgtctgtctaggggtctggtttgggccgcgacaactgctagaaatgccctggtcgtgtccttcgctgcgctggtcgcttattcgtttgaagtgaccggatatcagccgttcatactcactggtgagacagcggagggcttgcctcctgtacgcatacctccatttagtgtgacaactgccaatggcacgatttccttcacggagatggttcaggatatgggcgcgggactagcagttgtgcctctgatggggctgctggaatctatcgccgtcgcgaaggcatttgcctcccagaataattaccggatcgacgccaatcaggaactattagccatcggcctgacaaatatgctgggtagcctggtatctagttaccccgtcaccggatctttcggtcgcaccgccgtaaacgcccagtctggtgtctgcacacccgccggcgggctcgtgaccggcgtgttggtcctgctaagccttgactaccttacatccctgttctattacattccgaagtctgctctcgccgccgtgataataatggctgtggcgccgttgtttgacactaagatcttccgcactctgtggcgggtgaaaagactggacctcctccccctctgcgttaccttcctgttgtgtttctgggaggtgcagtacggcattttggccggggccctggtgtcactgctgatgctcctgcactcagctgcacggccagagaccaaggtgtcggagggacctgttctggtcctgcagcctgctagcggcctctcttttcccgcaatggaagccctgcgggaagaaatcctcagccgggctttagaggtaagccctcccaggtgtttggtgttggaatgcacacatgtgtgttcaatagattacaccgtcgtgctggggctgggggagcttctgcaggacttccagaaacagggcgtggctttagctttcgtggggttgcaggtgcctgtgctgcgggtgctgttaagcgccgaccttaagggtttccaatatttcagcacgctggaggaggccgaaaaacaccttcgacaggagcccggtacacaaccctataacatccgcgaggatagcatactggaccagaaagtggctctgctgaaggcctag

SEQ ID NO: 30211 - DNA, 1821 bp, Artificial Sequence
  Description of Artificial Sequence: Synthetic coding sequence
atgcccagctccgtgacagcactcggccaggccagaagcagcgggcccggcatggcacctagcgcctgctgctgctcccccgcggcactccagaggcggctgccgattctggcttggctgccatcatacagcctacagtggttgaagatggacttcgttgccgggctgagtgtcgggttgaccgccatacctcaggcattagcttacgctgaagttgctggtttacctccacagtatggactctacagtgcgttcatggggtgcttcgtttacttcttcttgggaacctccagagatgtgacactcggtccaactgccataatgagcttactggtttccttctacacattccatgaacccgcatatgcagtgcttctagccttcctgtctggatgtattcaactggctatgggtgttctacgcttaggcttcctcctggacttcataagttaccccgttatcaaaggttttacgagtgccgccgcagtgaccatcggtttcggccaaatcaaaaacctactcgggctccagaatatcccgaggccgttctttcttcaagtataccacacgttcctgcgcattgctgagacacgggtgggcgatgcggttctgggactcgtgtgcatgctgctgctcctcgttctgaaactcatgagagaccatgtcccgcccgtgcatcccgagatgcctcctggtgtacgtctgagcaggggcctggtctgggccgcaacaacagcaaggaacgcactcgttgtgtcgttcgccgccctcgtagcttattctttcgaggtaactggatatcaaccctttatcttaacaggggagaccgcagaaggtctaccaccggtgaggatcccacccttttccgtcactaccgctaacggcaccatatcgtttaccgagatggttcaggatatgggggcaggcctggcagttgtgccactgatgggcttgctggaatcaatagctgtggcaaaggcattcgcatctcaaaataattatcggatcgatgctaatcaggagctgcttgcaatcggcctcactaacatgctcgggtcactcgttagcagttacccggtgacaggatcctttggcagaacggccgtcaacgcccagtcgggcgtgtgtacacccgcagggggattggtgacaggtgtactggttctgctgtcccttgattatcttactagcctgttctactatatccccaaatccgccctggccgccgttatcatcatggcagtcgcccctctcttcgacacaaaaatcttcaggacgctctggagggtgaagaggctggatctcctcccgttgtgtgtgacatttttgctttgtttctgggaagttcagtacggaattctggccggagctctggtctccctactgatgctcctgcacagtgctgcccggcctgagaccaaggtctcagagggacccgtgctggtcctacagccagcttccggattgtcctttcccgccatggaagcactgcgcgaggaaattctgagccgcgcattagaagtttctcctccccggtgccttgtactggaatgcactcacgtttgcagtattgactacactgtggtactcggacttggagaactgctgcaggactttcagaaacagggcgttgcccttgcctttgtgggactgcaggtcccagttctgcgcgtcctactgtccgctgacctgaaaggctttcagtacttctccacactggaggaagccgagaagcacctcagacaggagcctgggacccagccttacaacatccgcgaggattccattctggatcaaaaggtcgcattgctgaaagcttag

SEQ ID NO: 30212 - DNA, 1821 bp, Artificial Sequence
  Description of Artificial Sequence: Synthetic coding sequence
atgcccagctctgttacagcccttgggcaagccagatcttctggccctggcatggctccctccgcctgttgttgttccccagcagctctccaacggcgccttcccatcctggcatggctgccctcgtactctctgcagtggctcaagatggatttcgtggccggcctctccgtaggtcttactgcaattccccaggccctggcttatgctgaagtggcaggcttgcctccccagtatggcctttattctgcatttatgggatgcttcgtctatttttttttgggtaccagccgggatgtgacactgggccccaccgccatcatgtctcttctagtaagtttctacaccttccacgagcccgcctatgcagtgctactggcctttctgtccggttgtatacagttggcaatgggtgttctgcgattaggcttcctcctcgactttatctcctatccagtgatcaaggggttcacgagtgccgccgctgttaccatcggatttggccagataaagaacttactggggctgcagaacatccccagaccattttttcttcaagtttatcacacattcctcagaatcgccgagacgagagttggcgatgccgtcctgggtctcgtgtgcatgctgctgctgctggttttgaagttgatgcgcgaccacgtgccccccgtccaccctgaaatgcctcctggggtccgcttgagtagggggctggtgtgggctgctaccacagcccggaacgcacttgtggtgtcctttgcagctttggtggcgtacagcttcgaggtcactgggtatcagccatttatcctgaccggtgaaactgccgagggcctaccacccgtgaggatcccacctttttctgtaactacagcaaatggaaccatcagtttcaccgagatggtacaggatatgggggccggattggccgttgttccacttatgggacttctggaatccatagctgtggccaaggcttttgcctcccagaataattatcgtatagatgccaaccaggaactgttggctattgggttgaccaacatgctgggcagcttggtgtcctcttatcccgtgaccgggtccttcgggcgtactgccgtcaacgcacagtctggcgtgtgcacgcccgctgggggcctggtgaccggggtgttggtgttgctttctctcgattacttgacgagccttttttattatattcccaagagtgccctcgcagcagtgatcatcatggctgtggcacccttattcgacacgaagatatttaggacgttgtggagggtgaaaaggctggatttacttccactgtgcgtcacatttctgctttgtttctgggaggttcagtacggaatactcgccggtgcccttgtgtcattgctgatgctgctgcacagcgccgcccgacctgaaacgaaggtctccgagggccccgtgctggtgctgcaaccggcctccggactgagcttcccggccatggaggctttgagagaagagatcctctcgagggccttggaggtttctcccccgcgttgcctggtactggagtgtacccatgtatgtagtattgattataccgtagttttaggcctgggagagctgctgcaggacttccagaaacagggggtggctttggcctttgttggcctccaggtcccagtcctaagagtattactgtctgccgacctcaagggcttccagtactttagtacactggaagaggccgagaagcaccttcggcaggagcccggaacccaaccctataatattcgcgaggacagtattctggaccagaaagtggctttgcttaaagcatag

SEQ ID NO: 30213 - DNA, 1971 bp, Artificial Sequence
  Description of Artificial Sequence: Synthetic coding sequence
atgaccggcgccaagcggaaaaagaaatcaatgctctggtctaaaatgcatacccctcagtgtgaggatattattcagtggtgtcgcagacgactcccaattctcgactgggccccacactacaatctcaaagaaaacttgctgcctgacaccgtgagcggaattatgctggccgtccaacaggtgacccaggggctcgcgtttgccgttctcagcagcgtacatcctgtgtttgggctctacggctctctgttccccgcgattatctatgctatctttgggatggggcaccacgtcgctaccggaacatttgctctgacaagcctcatcagcgctaacgcagtggagagaatcgtgccccaaaatatgcagaacctcaccacacaatcgaatactagtgtgctcggtctgtccgatttcgaaatgcagcggatccacgtggcggccgccgtctcctttttgggcggggtgattcaggtggccatgttcgtgctacagctcggaagcgctacctttgttgtgaccgagcctgtgatcagcgctatgactacaggagcagccacacacgtggttacatcccaggtgaagtacttgctcggcatgaaaatgccttacatatccggccccctaggttttttttatatctatgcgtatgtatttgagaacattaagagcgtgcggttggaagccttgctcttgtccctgctgtcaatcgtggttctggtgctggtgaaggagctcaacgaacagtttaaaaggaagattaaagttgtgctgcctgtggaccttgtgttgattatcgccgcgtcctttgcctgctactgcacgaacatggaaaacacgtacggcctcgaggttgtggggcatatcccacagggcatcccctccccacgcgcgcctccaatgaacattctgtctgccgtcatcactgaagcgtttggcgtcgcgctcgttgggtacgtcgcctcactcgcactggcccagggcagcgcaaagaagttcaagtatagcatcgatgacaatcaggagttcctggcccatggtctgagtaacattgtttcatcattcttcttttgcataccctccgctgcagctatgggccggactgccggcctgtattcaaccggggcaaagacacaggtcgcttgccttattagctgcatcttcgttctcattgtgatctacgccatcggccccctgctttattggctgccgatgtgtgtcttggccagcataattgtggtcggactcaaaggaatgcttattcaattccgggacctgaaaaagtactggaacgttgacaaaatagactggggtatttgggtgtctacctatgtgtttaccatttgctttgctgctaatgtggggttgttatttggtgtggtttgcacaattgctattgtaatcggaaggttccctcgggccatgacagtctccatcaaaaacatgaaggaaatggagttcaaggtcaaaacagagatggacagcgagacactgcagcaagtcaaaattatctccataaataaccctctagttttcctgaacgccaagaaattctatacagacttgatgaacatgattcagaaagaaaatgcatgcaaccagcccctggacgatatttcaaaatgcgagcaaaatacccttctcaactcactgtcaaacggtaattgcaacgaagaggcctctcagtcctgccctaacgagaaatgctatctcatccttgattgcagtgggttcactttcttcgactacagcggagtgtctatgctcgttgaggtgtatatggactgtaagggaaggtctgtggacgtgttactggcccattgcacagccagcctgatcaaggctatgacctactatggtaacctggatagcgagaagcccattttcttcgagtctgtgagtgcagccatatctcacattcactccaacaagaatctgagcaagctctcagaccattccgaggtttag

SEQ ID NO: 30214 - DNA, 1992 bp, Artificial Sequence
  Description of Artificial Sequence: Synthetic coding sequence
atgacaggtgctaaaaggaaaaaaaagtctatgctctggtccaagatgcataccccccaatgtgaggacatcatacagtggtgtcgacggagactgcctattttagactgggccccccactacaacttgaaagagaatcttctgccagacacagtgtctgggatcatgctggcggtgcagcaagtaacacagggactggctttcgcagtgctctcttcggtgcatcctgtgtttggcctctacggaagcctgttccctgcgatcatttatgcaattttcgggatgggtcaccatgtcgctaccggtaccttcgccctaacctctcttatatcagcaaacgccgttgaacgaattgtaccccagaatatgcagaatctcacaacacaatccaacacttctgtgcttggcctctccgacttcgaaatgcagcgaatccacgtggccgcagccgtgtcgtttttgggaggggtaatacaggtcgctatgtttgtgctccagctggggagtgctacgtttgtggtaaccgaacccgtcatatccgctatgactaccggagctgctacgcatgtcgtgacctctcaggttaaatacttgctcgggatgaaaatgccgtacatctccggcccactcggtttcttttatatctatgcctacgtcttcgaaaacattaaatccgtgcgactcgaagctttgctattgtctcttctgagtatcgtcgttcttgtgctcgttaaggagttgaatgagcagtttaagaggaagatcaaagtggtgttgccagtcgacctggttctgattatcgccgcaagtttcgcatgctactgcacgaatatggaaaatacctacggattggaagtggtgggtcatattccgcaaggcattccgagcccccgagctccccccatgaacattctgtccgcggtcattacagaggctttcggagtggccctcgtaggctacgtcgcaagtctcgccttggcccaagggagtgctaagaagtttaagtattctatcgacgacaaccaggaattcttagcccatggcctgtccaatattgtatcttctttcttcttttgcatccctagcgctgccgccatgggtaggactgctggtctctatagcacaggtgcaaaaacgcaggtcgcctgcctgatttcttgcatctttgtccttattgtgatttacgccatcggccccctgctgtattggctcccaatgtgtgtgctcgccagcatcatagtggtgggactgaagggcatgcttatccagttcagagatctgaaaaagtactggaatgttgacaagattgattggggcatctgggttagcacttatgtattcacgatctgtttcgcagcaaacgtggggttgctatttggagtcgtctgtactatagcaattgtgatcggccgattccccagggctatgaccgttagcatcaaaaatatgaaagaaatggaatttaaagttaaaacggagatggactcagaaactctgcagcaggtgaagatcatctccattaataatcctctggtctttctgaacgctaagaaattctacactgacctcatgaacatgattcagaaagagaatgcctgtaatcagcctctggacgatatttccaaatgcgaacagaacacactgttgaatagtttgtctaacggcaattgtaatgaggaggcgagtcaaagttgtcccaacgagaaatgttacctgattttagactgctcagggttcaccttttttgactattctggggtgagcatgctcgtagaggtgtacatggattgtaaggggcgtagtgtggacgttctcctggctcattgcactgcaagtttaattaaggcgatgacgtactacgggaacctggacagcgagaaaccaatctttttcgaatcggtcagtgctgccatatcccacatccacagcaataaagcctcttacaagctgcttttcgacaatctcgacctgccaactatgcctcccttatag

SEQ ID NO: 30215 - DNA, 624 bp, Artificial Sequence
  Description of Artificial Sequence: Synthetic coding sequence
atgactggagccaaacggaagaaaaagagcatgctgtggtcaaagatgcacacaccccaatgtgaggatattatccaatggtgcaggcgcagactgcccattttggattgggctcctcactataatttgaaagagaacctacttcccgataccgtgagtggtattatgctggccgtgcagcaggtcactcagggtctcgctttcgccgtgttgtcctccgtgcatcctgttttcggtctctatgggagcctgttccccgccatcatctatgccattttcggaatgggacatcacgtggccaccggtaccttcgctcttacatccctcattagtgccaatgccgtggaaaggattgtcccgcagaatatgcagaacctcacaacacagtcaaacacatctgtgcttggcctgtcggactttgaaatgcagagaattcatgttgcagctgcggtctcgtttctgggaggcgtcattcaggtagccatgttcgttctgcagcttggaagcgctacctttgtggtgaccgaacccgttattagtgccatgacaacgggtgcagccactcatgtggtgacctcccaggtaaaatatctcctgggcatgaagatgccctacatttcatag

SEQ ID NO: 30216 - DNA, 1971 bp, Artificial Sequence
  Description of Artificial Sequence: Synthetic coding sequence
atgaccggcgccaagcggaagaagaaatctatgctgtggagtaaaatgcacaccccacagtgtgaggacatcattcagtggtgtcgtcgcagactgcccatattggattgggccccccactataacctgaaagaaaaccttctgcctgatactgtgtcaggcatcatgttggcagtacagcaagtaacccaaggtctcgccttcgctgtcctgtccagcgtccaccccgtgttcggtctttacggatctctgttccccgctatcatctacgctatttttggaatgggacatcacgtggctacgggtacctttgctctgacatcccttatctccgcgaacgctgttgaaaggatcgtcccccagaatatgcagaatctgaccacacagagcaatacaagcgttctaggcttgtctgactttgagatgcaacgcatccacgtggcggctgctgtatcgtttctcggcggggttatacaggtggccatgttcgtcctgcagctggggtccgccacatttgttgtgactgagcctgtgatctccgctatgaccactggcgcggctacccatgtggtgaccagccaagtgaagtacctgctggggatgaagatgccttacatatctggtcctctcggcttcttctacatatacgcatatgtctttgagaacattaagagcgtacggctggaggcgcttttattatctctactttcaattgtggtcctggtgctcgtcaaggaactcaatgagcagttcaagaggaagatcaaagtggtgttaccagtcgatttagtgctcatcatcgctgcttcatttgcatgttactgtacaaacatggaaaacacctacggactcgaggtagtgggtcatattccacaaggaatcccatctcctcgcgcacccccaatgaatattctgtcagccgttattactgaagcgtttggcgtagcactcgtcggatacgtcgcctcccttgcgctggctcagggctccgccaagaaattcaaatacagcatcgacgacaatcaggagtttctggcacacggtttgagtaacattgtgtcctctttctttttttgtattcccagcgcggctgccatggggaggactgcaggactttattcaacgggagcaaagacccaggtcgcctgcctgatttcttgcatttttgttcttattgtgatctatgcaatcggccctctgctgtattggcttccgatgtgcgtcctggcctcaatcatagtggtgggactgaaggggatgttaattcagttccgtgatctgaaaaagtattggaatgtagacaagatagactggggcatctgggttagcacatatgtattcaccatttgtttcgccgctaatgttgggcttttattcggggtggtctgcacaatagccattgtcatcggacggttccctagggccatgaccgtgagcattaaaaacatgaaggagatggaatttaaagtgaagacagagatggactccgaaaccttgcaacaggtgaagatcataagtatcaacaacccgttggtgttccttaacgccaaaaagttttatacagacctcatgaatatgatccagaaggagaacgcctgcaaccaacccctcgatgatatttctaaatgtgagcaaaacacgctgttgaatagcttatccaacggaaactgcaacgaggaggcctcccagtcgtgcccaaatgagaagtgttacctgatcctggattgctccggatttaccttctttgattactccggcgtgtccatgcttgtcgaagtttacatggattgtaagggccgtagcgtagacgtgctcctggcacattgcacggccagccttattaaagccatgacttactatggaaaccttgattccgaaaagcctatcttctttgaatccgtcagcgcagccatatcacatatccacagcaataaaaatctgtccaagctgagcgatcatagtgaggtgtag

SEQ ID NO: 30217 - DNA, 2913 bp, Artificial Sequence
  Description of Artificial Sequence: Synthetic coding sequence
atggcccagctagaacgatccgccatttctggattcagttcaaaatctcgaagaaatagctttgcttatgacgtgaagcgcgaagtatacaacgaagagacttttcagcaggagcataaaaggaaggcctcctcatctggcaacatgaacattaacattaccactttcagacaccatgtccagtgccggtgctcttggcataggtttctacgatgcgtgctcacaatcttcccctttcttgaatggatgtgcatgtaccgacttaaagattggttgctcggtgacctcctggcagggatctcagttggactggtgcaggttcctcagggcctcacactgagtttactggcgcggcagttgataccacccctgaatattgcctacgctgccttttgtagcagtgtcatctatgtgatcttcggaagctgtcatcagatgtctatcggttcatttttcctcgtgtctgccctcctcattaacgtgctcaaagtcagcccgttcaacaatgggcaattggttatgggcagttttgtgaaaaacgaattttcagcaccctcctatttgatgggatacaacaagtcgttgagtgtcgtggctacgactacatttctaactggaataatacagctcattatgggagtgctgggcctggggtttatcgctacttacctacccgagagcgccatgagcgcatatctcgcagctgtggcgcttcacattatgctctcacagctgacgttcatctttggtattatgatttcttttcatgccggacctatatcctttttttatgatattattaattattgtgtcgcgctgcccaaggcaaacagcacctctatcttggttttcctcacagtggtagtcgccttaaggatcaacaagtgtattagaattagttttaatcagtatccaattgagtttcctatggagctgttcctgatcatcgggtttaccgttattgcaaataaaatctctatggctactgaaaccagtcagacactgatcgatatgatcccctattcattcctcttgccggttacccccgatttctctctgctgcccaaaatcatactccaggcattcagcctgagtttagtctcaagctttcttctgatcttccttggaaagaagattgcatctctgcacaattactctgtgaacagtaaccaggacctcattgcaatagggttatgtaacgtggtgtccagcttttttcgctcatgcgtgtttacaggagctatcgccagaacaattatccaagataaatcagggggaagacagcaattcgccagtttagtgggggccggcgtgatgctgctgttgatggttaaaatgggccactttttctacacactgccaaacgctgtactggctggtattatcctgtctaacgtgattccgtacctggaaacaatatccaacctccctagcctctggcgccaggaccagtacgattgcgctctctggatgatgaccttctcttcatctatcttcctaggtctcgatattggtttgattatcagcgtggtaagtgcattctttataacgacagtgcgcagccaccgggccaagattctgcttctggggcagatacctaacactaacatttatagatccataaacgactacagggagatcatcactattcctggagtgaagatctttcagtgttgtagcagtatcacatttgtaaacgtttattaccttaagcacaaactgctcaaggaagtggacatggttaaggtcccactgaaagaggaagagatcttcagtctgtttaacagtagcgacacaaatttacagggcggaaagatatgccgctgcttttgcaattgtgacgatttagagcctctgccccggattctatacacggaaaggttcgagaataagctggatccagaagcttcatcaataaacttaatacattgctctcacttcgaatctatgaacacctcccaaactgccagcgaggaccaggtgccctacacagtctcatcagtctcgcagaagaatcagggccagcagtacgaggaggtcgaagaagtatggcttcctaacaacagctccagaaacagttcccccggattgcccgatgtcgctgagagccaagggcgaagatcccttatcccctactctgacgccagcctcctcccgtctgtacatacaattattttggatttctctatggtccactatgttgatagtcgtgggctggtggtgctgcgccagatttgtaatgcctttcaaaacgctaatatattaatattaattgcaggatgtcacagctctatcgtgagggccttcgagcggaacgatttctttgatgccgggattaccaaaacgcagttattcttgagcgtccacgacgccgtcctgtttgcactcagccgaaaggtgatcggatcttcagaactatcaatcgacgagagcgaaacagttattagggagacttactcagagactgataaaaatgacaattcccggtacaaaatgtcgagctcttttttagggagccaaaagaatgtgtctccaggtttcatcaaaatacagcagccagtagaagaagagtctgagctggacctcgaacttgagtcggaacaggaggcggggctgggacttgatcttgacctggatcgggaactcgaacctgagatggagccaaaagcagagaccgagacgaaaacacagactgagatggaacctcaaccggagactgagcccgagatggaacctaatcccaaatcacggccccgggcccacacctttccgcagcagcggtactggcctatgtaccaccctagcatggcttccactcaaagccagacccaaacacgcacatggagcgtggaacgacgacgccatcctatggatagttattctccagagggcaatagtaatgaagatgtctag

SEQ ID NO: 30218 - DNA, 2598 bp, Artificial Sequence
  Description of Artificial Sequence: Synthetic coding sequence
atggctcagctcgagaggtctgccatatctggttttagctccaaaagcagacgaaattcattcgcatatgacgtgaagagggaggtgtacaacgaggaaaccttccaacaggagcataaacggaaagcttcatcctcggggaacatgaacatcaacattactactttccgccatcatgtgcagtgtcggtgcagctggcaccgcttccttagatgcgtattaacgatcttcccattcctcgaatggatgtgcatgtaccgtctgaaagactggttgctgggcgatctgcttgccggtatcagcgtcggtcttgtccaggtgccccagggactgaccttatcgctcctggcgcgccagttaatccccccactaaatatcgcatacgctgctttctgctcaagcgtgatatacgtgattttcggaagctgccaccagatgtccatcgggagtttcttcctggtgagcgccttactgatcaacgtcctgaaggttagcccattcaacaatggccaattggttatggggagtttcgtgaaaaacgaatttagcgcgccaagctaccttatggggtataataagtcattatcagtggtcgctacgacgacctttctcaccggtattattcaaattatcggctttaccgtgatcgccaacaagatctctatggccaccgaaaccagtcaaacactgattgacatgattccctatagttttctcctccccgtgacgcccgattttagtcttttgcccaagattattctccaggctttttctctgtcgctggtgagtagttttcttctgatcttcctagggaagaaaattgcctctctgcacaattattctgtgaacagcaatcaggatttgatagcgatcggcttgtgcaacgtggtgagtagcttctttagaagctgtgtctttacaggcgcaatagcccgaacgataatccaagataagtcaggaggacgacaacagttcgcttcgctagtaggtgccggtgtgatgcttttgcttatggtgaagatgggacacttcttttacactctgcccaatgctgtgctggcggggataatcttaagcaatgtaatcccatacctggaaacaatctcaaacctgccttcactctggaggcaagaccagtatgactgcgccctgtggatgatgacgttttctagcagcatctttctaggactagacataggcttgatcatttcagtcgtgagcgccttttttatcacaacagtgcggtcccatagagctaagatccttcttttgggacagatccctaatacgaacatctatcgatccataaatgactatagggaaatcattacgataccaggcgtcaaaatattccagtgttgctcaagtataaccttcgtcaatgtgtattatctgaagcacaaactcctcaaggaggtggacatggtgaaggtccctttgaaggaggaggagatttttagcttattcaattcttccgacactaatctgcagggaggcaagatttgtcgttgcttctgcaattgcgacgatctggagccgctgccgcgcatcctgtataccgagagattcgagaacaagctcgatcccgaggcttctagcattaacctgatccattgcagccactttgaatccatgaatacatcacagacagcttcagaggatcaagtgccatacaccgtgagcagcgtcagccagaaaaatcaaggccagcagtatgaggaggtcgaggaggtatggctgcccaataacagcagccgtaacagctcccctggcctgcctgacgtagctgaatcgcaaggtcggcgtagtctgattccttatagtgacgcctccttactcccgtccgtacacacgatcatcttggacttttcaatggtacactatgtggactccaggggactagtagtgctccggcaaatttgtaacgctttccagaacgccaacattctgattctcattgctgggtgccactcatcaatcgtccgggccttcgaaaggaatgatttcttcgatgccggtattaccaaaacccagttgttcctgagcgtgcacgatgccgtgctgtttgcactctctcgcaaggttattggctcgtccgagctgtctatcgacgagtccgagacggttattcgcgagacatactctgagaccgataagaacgataacagcagatacaaaatgtcctcgtcctttctgggatcacaaaaaaatgtgtctcctggattcatcaaaatccagcagcctgttgaagaagaaagtgaactggacctggagctcgaatcagagcaggaggccggcctgggcctggacctggacctggaccgcgagctcgagcccgagatggaacctaaggccgaaacagagaccaaaacccagactgaaatggaacctcaaccagaaaccgaacccgagatggagcccaaccccaagagcaggcctcgcgcacacacattccctcagcagcggtattggcccatgtaccacccatcaatggcgtcgactcaatcacagactcagacgcgtacgtggtcagttgaaaggcgaagacatcctatggattcatactcacctgaggggaattctaacgaggacgtgtag

SEQ ID NO: 30219 - DNA, 2913 bp, Artificial Sequence
  Description of Artificial Sequence: Synthetic coding sequence
atggcccaactggagagaagcgcaattagcggcttttcttctaagtcaaggcgcaattcatttgcctacgatgtgaagcgcgaagtatataacgaggagactttccagcaggaacataaacgaaaagcttcctccagtggaaatatgaacatcaatatcacaacctttagacaccacgtacagtgccgctgctcctggcatcgcttcctccgatgcgttctgaccatatttcctttcctcgagtggatgtgcatgtaccgcctcaaagactggctgctcggggacctcctggccggcatctctgtgggattggtgcaggtgccgcagggactgaccttgtcccttctggcgcgtcagttgattcctccgctcaatatcgcctatgccgcattctgttcgagtgtcatatatgtcatttttgggagctgccaccagatgtcaatcggaagcttcttcctcgtatctgctcttctgataaatgtcctgaaggtgtccccctttaacaacggccaactggtcatggggtccttcgttaagaacgagttctctgcaccgagctacctcatgggatataacaagtctcttagtgtcgttgctactacaaccttcttaaccggaatcatccaactgattatgggggtgttgggtttagggtttattgccacttatctccctgaatctgcaatgtctgcctaccttgccgctgtggccctgcatattatgctgagccagctgaccttcattttcgggataatgatcagtttccacgccggcccaataagctttttctatgatatcattaactactgtgtggccctgccgaaggctaatagtacctcaattctggtctttttaacagtggtcgtggccctgaggataaataaatgtattcggatttccttcaaccagtatccaattgaatttcctatggaattgtttctgatcattggcttcacggtgatagccaacaagatatccatggcaaccgagactagccaaacgctgatcgatatgataccctacagctttctcctccccgtgacccccgactttagcctcctccctaagattatcctgcaggcttttagcctgtcgctggtatccagttttctattaatcttcctcgggaagaagatcgctagtctacacaattacagtgtgaactcaaatcaggatttgatcgccatcggcttgtgcaatgtcgttagctcattttttagatcctgcgtgtttacaggtgccatcgcccgtactatcatacaggataaaagtggtgggcgacagcagttcgcctcacttgtgggtgcaggagtgatgctcttactcatggtaaagatgggccactttttctacactctcccaaacgcagttctggcaggtatcattctatcaaatgtgataccatatttggagactatcagcaatctgcctagtctttggcggcaggaccaatatgattgtgccttatggatgatgactttctcatcctctatttttctggggctcgacatcggactgattatctccgtcgtgtcggccttctttatcactaccgtgcggtcccaccgcgctaagatcctgctgttaggccagattcccaacacaaacatctaccgcagcataaatgactacagggaaatcatcactatacctggagtgaagatcttccagtgttgcagttcgatcaccttcgtgaatgtgtactaccttaagcataaactgctgaaggaggtggatatggtgaaggtgccattgaaagaagaagagattttcagtctctttaattcctctgataccaacctgcagggcggaaagatttgcaggtgcttctgcaactgcgacgacctcgaacccttgccacggatcttgtataccgaaaggttcgaaaataagctcgacccagaggccagctccatcaatctgattcactgctctcatttcgagtccatgaatactagccaaaccgctagcgaggaccaagtgccctataccgtgtccagtgtgtctcagaagaaccaaggacagcagtatgaagaggtggaggaagtgtggctgccaaataattccagccgcaattcttcaccgggactacctgacgtcgcagagagccagggtcggaggtctttaatcccatattccgacgctagtctgctgcccagcgtgcacacgattatcttggatttttctatggtgcattacgtagacagtaggggtctcgtagtgctcagacagatctgtaacgcttttcagaacgccaacattctgattctgatcgcgggatgccattcatctatcgttagagcatttgagcggaatgacttcttcgacgccgggataactaagactcaactgtttctcagcgtacacgacgctgtactattcgccttatcccgaaaagtgatcggctcttctgaactgtctatcgatgagagcgaaactgtgatcagggagacctattcagagacggacaagaatgataacagcagatacaagatgagcagttcctttctaggaagccaaaaaaatgtatcccctggattcataaaaatccagcagccggtggaagaggaaagtgaactggatctcgaactcgagtcggaacaggaggccggactgggtctcgacctggacctggatagagaactggagcctgagatggaaccaaaggcagagactgaaacaaaaacccagacggagatggagccgcagccggaaactgagcctgagatggagcccaacccaaaatccaggccccgggctcacacatttccgcagcaaaggtattggccaatgtaccacccctctatggcctccactcagtctcaaacccagactaggacctggagtgttgaaaggaggcgccaccctatggattcctactccccagaaggcaattccaacgaagacgtatag

SEQ ID NO: 30220 - DNA, 2664 bp, Artificial Sequence
  Description of Artificial Sequence: Synthetic coding sequence
atgtcgcagccacggcccagatatgtcgtcgatcgggccgcttattcccttaccctatttgacgatgagtttgagaaaaaagaccgcacctacccagtaggggaaaagcttcgcaatgccttccgctgctcttcagcaaaaatcaaggcagtggttttcggtttgctgcccgtgctgtcttggttgcctaaatataagattaaagactatatcatccctgacttacttggaggccttagcggtgggagcatccaggtgcctcaagggatggcgtttgctctactcgcaaacctgccagccgtgaacgggctatatagctcttttttcccgctgctgacctacttctttctcggaggtgtccaccagatggttcccggaacatttgctgtgatttcaattctcgtcggtaacatctgtttgcagcttgctcccgagagcaagtttcaggtctttaataacgccacgaatgagtcttacgtggatacagcggccatggaggccgagaggttgcacgtctccgccacattagcctgtttgaccgcgatcatccagatggggttggggtttatgcagtttggattcgtggcgatttacctatcagagagttttattcgcgggttcatgacagctgctggtctccagatcttgatttctgtactgaaatacattttcggtctcactatcccttcttacaccgggccagggtccatcgttttcaccttcattgatatatgcaagaacctaccacacactaatatcgcatccctcatctttgccttaatctctggggccttccttgtactcgtaaaagagttgaatgccaggtacatgcataagatccgattccccattccaactgagatgattgtggtagtggtcgccacagccatttcagggggatgtaagatgcccaagaagtatcacatgcaaatcgtcggcgaaatccagagaggctttccgacccctgtgtcgcccgtggtaagtcagtggaaagacatgattggcactgcctttagtctcgccattgtctcatatgtaataaacctggctatgggcaggacactcgccaacaagcacggctacgacgtagatagcaatcaggagatgatcgcccttggctgctctaatttttttggtagtttctttaaaattcatgtgatatgctgcgcactctctgtgacactggcagtcgacggcgcaggcggcaagagtcaagtggcatctttgtgtgtgagcctagtggtgatgataactatgctggtgctaggcatctacctctaccccttgcctaagtctgtcttgggtgctctgatagcggttaacttgaagaactctctgaaacagctgaccgacccgtactacctatggagaaagagcaaactggattgctgcatctgggttgtgagctttttatcttctttttttttgtcacttccttatggcgtcgccgttggagtcgctttcagcgttctagtagtcgtgtttcaaacacagttccggaatggatacgctctcgctcaggtcatggacacagatatttatgtgaatcctaagacgtataatagagcccaggatatccagggcatcaagatcattacatactgcagtcctctgtacttcgcaaactccgagatttttcgacagaaagtgattgctaagacaggaatggatccccagaaagtgttgctggcaaagcaaaaatatctgaagaaacaggagaagcgtagaatgaggcccacacaacagcgcaggtctctttttatgaaaacgaagaccgtgtcactacaggagttgcaacaggattttgaaaatgcgccccctactgatccgaacaataaccagactccagctaacggcacgtcagtgagctacattacttttagccctgacagttcctcgcctgcccaatcagagcctccggcgagcgctgaagctcctggagagccctccgatatgctcgcttccgtcccccccttcgtgaccttccacacactcatcctggatatgtccggagtctcttttgtcgatttgatgggaatcaaagcactggctaagcttagtagcacgtatggcaaaatcggcgtgaaggtcttcttagtgaatatccatgctcaggtatataacgatataagccatgggggggtgtttgaggatggatcactcgagtgcaaacatgtctttccaagcattcacgatgccgtgctctttgctcaagcgaatgcccgcgatgtgacgccaggacataattttcagggcgctccaggcgatgctgaactgtctctgtacgattccgaagaagatatcagatcgtattgggaccttgaacaggagatgtttggatcaatgtttcatgctgaaaccctgacggctctggaaagcctgtccgccgcaggcgggtgttacccttacagatcagagtcattggtttccccattgttcacacgacaggcacttgctgcaatggacaagcccccagctcattctactccccctactagcgccctgagcttagcggccgaagggcacctggattttcagttgttgcgcgtctctcagaagcaaaaggacaaatacaattgtgctggacttctgtataaattgcagaaggtgtcacaatccccgcacggtagcgttagcgatggcgtcaggctcagtagaacatag

SEQ ID NO: 30221 - DNA, 2664 bp, Artificial Sequence
  Description of Artificial Sequence: Synthetic coding sequence
atgagccaacccagaccacgctacgtggttgaccgcgccgcctattctctgacccttttcgacgacgagtttgagaagaaagacaggacttacccagtgggcgagaagctgagaaacgcgtttcggtgtagtagcgccaagatcaaagctgtggtgtttggtctgcttcctgtgttgagttggcttcctaaatacaaaatcaaagactacatcatacctgacctgttgggcgggctgtctggtggatccattcaggtcccccagggaatggccttcgccttgctggccaatctcccggccgtcaatgggctatacagcagtttcttccccttactgacctatttcttcctcggcggagtacatcagatggttcccggcacattcgcagtgatttctattctcgtcgggaatatatgtctgcagctcgcaccggagagtaagtttcaggtttttaataacgcaaccaatgaatcatatgtggatacagccgcaatggaggctgaacgtctccatgtctctgctacgctggcatgcttaacagcaattattcagatggggcttggcttcatgcagttcggtttcgttgccatctacctctctgaaagttttatcaggggattcatgaccgcggctggccttcagattctcataagcgtcctcaaatatatatttggcctcaccatcccaagctacacaggccctggctccatagtgttcacatttatcgatatctgtaagaatttaccacatacgaacatcgcctctttgatttttgcgttgatttccggcgcgttccttgtgctggtgaaggagctgaacgctcgttacatgcacaaaatccggtttcccatcccaactgagatgattgtcgtagtggttgcaacagcaatctctggtggttgtaaaatgcctaaaaaatatcatatgcagatcgtgggtgagatacagcgagggttccccacacctgttagtcccgtggtttcgcaatggaaagatatgatcggcactgcattcagcctagctattgtgtcttatgtcatcaatctggcaatgggaaggaccctcgccaataaacacggctacgacgttgattctaaccaggagatgatcgctctcggttgttctaacttctttgggtcttttttcaagatacacgtgatctgttgcgcgctgtccgtgactttagcggtggacggcgcgggtgggaaaagccaagtggcctcgctgtgtgtgtccctagtggtgatgatcaccatgttagttcttggcatatacctatatccattgccgaaatccgtactaggcgcccttatcgcagtgaaccttaaaaacagtctgaaacagctgacggacccctattacctctggcgtaaatccaagctggactgttgtatctgggtggtgagcttcctgtcaagcttctttctgtctctgccttacggcgtagctgtaggggtcgctttttcagtcctggtcgtcgtattccaaacacagtttagaaacggctacgctttagcgcaggtcatggacaccgacatttacgttaaccctaagacatacaaccgagcccaagacatccagggaatcaagattataacatattgtagcccgctttactttgcaaactcagagatctttaggcaaaaggtgattgcgaaaactggcatggacccacagaaagtgctgttggccaaacagaaatatctcaagaagcaggaaaaaagaagaatgcgccccactcagcagcgaagatccttgttcatgaagacgaagactgtgtccctacaggagctccaacaggattttgagaatgccccgcccacagatcctaataataatcagacacccgcaaacggtacttccgtatcctatatcaccttcagccctgatagctctagcccagcacagtctgagcctccagcctctgcagaagcccccggggaaccttccgatatgcttgcatctgtacccccttttgtgaccttccacacacttattcttgatatgtcaggcgtctctttcgtcgacctaatgggcataaaagcgctagccaaactgtcctcaacctatggaaagattggagtcaaggtgtttttagtgaatatccatgctcaggtctataatgacatttctcacggcggggtcttcgaggacgggagtctggagtgtaaacatgtgttcccatctattcatgacgccgtgctttttgcccaggctaacgctagagatgtgacaccaggccacaattttcagggtgcccccggcgatgcagaattatccttgtacgattccgaggaggatatccgcagctattgggacctggagcaggaaatgtttggatcaatgttccatgccgagactctgaccgccctcgagagtttatccgccgcaggcggatgctacccatacaggagtgaatcactagtgtctcctctgttcacccggcaggctttggctgctatggacaaacctcccgcccatagtacccctccaacttccgcactgagcttagcagcagaaggccacctggacttccaactgctccgggtttctcaaaagcaaaaagataagtataattgcgccggtcttctgtataaactgcagaaagtgtctcaaagccctcacggatctgtgtctgacggcgtacggctgtcaagaacatag

SEQ ID NO: 30222 - DNA, 2376 bp, Artificial Sequence
  Description of Artificial Sequence: Synthetic coding sequence
atgtcccaaccccgcccacgctatgtcgtcgacagggccgcatattccctgacactctttgatgacgagtttgagaaaaaggaccggacatacccagtcggtgagaagctccgcaatgcgttccgatgttcttcagcaaaaatcaaagccgttgtgttcggattgttgcctgtgctgtcttggctccctaaatacaagattaaggattatatcattccagacttactgggcggcctgagtggcggctctattcaggtacctcagggtatggcctttgccctgcttgccaatttgcccgcagttaacggcctgtactcttccttttttcctctcctgacatatttttttctggggggtgttcaccagatggtgccaggtaccttcgctgtgatcagcatcctcgtggggaatatctgtttgcagctagccccagagagtaagtttcaggtcttcaacaacgccacaaatgagagctatgtggataccgctgccatggaggctgaacgcctgcatgtgtcggctaccctggcctgtctgaccgccataattcaaatgggattagggtttatgcagttcggctttgtggccatttatctgagcgaatcgtttattcgaggttttatgactgcggctgggctccagatcttaataagtgttcttaaatatattttcggcctcacaatccccagttacaccggtcccggatctattgtcttcacctttatagacatctgtaagaacttgccccacactaatatagcttccctgattttcgcgttgatctcaggagcgttcttggtgctcgtgaaggagctaaacgcaagatacatgcacaagattcgtttccccataccaaccgagatgatcgtggtggtcgtcgccacagccatctctggagggtgcaagatgccgaaaaaatatcacatgcaaatcgtgggggaaatacagcgtggcttccctacacctgtgtctccagttgtcagccagtggaaagacatgattggcaccgctttttcactcgccatcgtgtcgtatgtcataaacctcgcaatgggccgaacacttgccaacaagcatgggtacgacgtggacagcaatcaggagatgatcgctctcggatgcagtaatttcttcgggtcatttttcaagattcacgttatctgctgcgctctgagcgtgacgttggccgttgatggggcagggggtaaaagtcaagtggcgtctctttgcgtgagtctggtggtcatgatcactatgttagttctgggcatatatctttacccactacccaagtccgtgttgggagccctgatcgctgtgaacctcaagaacagtcttaagcagctgactgatccttactatctgtggcgcaagagtaaactcgactgctgcatctgggtggtgtcttttcttagcagcttcttccttagtctgccgtacggggtcgcggtgggtgttgccttcagcgtcctggtggtggtgtttcaaacccaattcagaaatggctacgcgcttgcacaggtgatggacaccgacatctacgtgaatccaaaaacttataaccgcgcacaagacattcagggcatcaagatcattacatattgttccccactatactttgctaactcagaaatctttcggcagaaagtgatcgccaaaactggtatggacccccagaaggtgctgctggcgaagcagaaatacctcaaaaaacaggagaaaagacgaatgcgccccactcaacagcgacgaagcttgttcatgaagaccaagactgtgtctctgcaggagctgcagcaggacttcgaaaatgcccctcccaccgaccccaataacaaccaaacccccgcgaatggaacatccgtgtcctacattacctttagtccggacagcagctcaccagcccaatctgagccccccgctagcgcggaagcccctggcgagcccagcgatatgctcgccagcgtcccccccttcgtgacttttcacacactgatacttgacatgtccggcgtgtcattcgtcgacctgatgggaatcaaagccctggccaagttgtcctccacttacgggaaaatcggagttaaggtctttctggtgaatattcatgcacaggtctacaatgatatttcccacgggggagtcttcgaggacggaagtctggaatgtaagcacgtgtttccatcgatacacgacgctgtcctgtttgcccaggcgaacgctagggatgtcactcccggccataacttccagggagcccctggggatgccgaactttctctgtatgattccgaggaagacatccgcagctattgggacctggaacaggaaatgtttgggtctatgttccacgccgagactctcacggctctttag

SEQ ID NO: 30223 - DNA, 1860 bp, Artificial Sequence
  Description of Artificial Sequence: Synthetic coding sequence
atgctgttatcttggttaactgtactaggggcgggaatggtggtgctccacttcctgcaaaagctcttattcccctatttctgggatgatttctggttcgtgctaaaggtggtgttaatcattatccggctgaagaagtacgaaaagaggggggagttagtcactgtactggacaagtttctgagccacgctaagcgccagcccagaaaacctttcatcatctacgagggggatatttatacctaccaagacgtggacaaacggtcaagcagggttgcacatgtgttcctgaaccatagcagcttgaagaagggggacacagtggcactactaatgtccaacgaaccagacttcgtacacgtgtggttcgggctagcgaaactcggatgcgtggtggccttcttgaatactaacatccgaagcaattcactgctgaactgtattagagcttgtggccctcgagcgttggtcgtcggtgccgatcttttgggtacagtggaggaaattctgccttccctgtccgagaacatcagcgtttgggggatgaaggacagcgtgcctcagggagtgatctccctaaaagagaaattatctacgagtcctgatgaacccgtgccacgctctcatcacgtggtctccctactgaaatccacttgtctgtatatcttcacaagcggcactacaggcctgcccaaggctgccgtcattagtcagctccaggtcctgagggggtccgccgtgttgtgggctttcgggtgcacggcacacgatatcgtctacattacactgcctttatatcattccagcgcagctatcctagggatcagcggatgcgttgaactcggggccacttgcgtcctgaaaaagaagttctcagcatcccaattctggtcggactgtaaaaagtacgatgtgacagtgttccagtacatcggggagctgtgtagatatttgtgcaaacagtccaaaagagagggcgagaaggaccataaggtgcgtttagctatagggaacggtatccggagcgatgtgtggagagagttcttggatcgattcggaaacattaaagtttgtgaactgtatgctgccacggagtcctccatatcattcatgaactacaccggtagaataggcgccataggcaggaccaaccttttctacaagttgctgagcacgttcgatctgattaagtatgattttcagaaggacgagcctatgagaaacgagcaaggttggtgtatccatgtgaaaaaaggagaacctgggctgctcatcagccgggtgaacgctaagaatccattctttggttacgcaggcccatacaagcacactaaggacaaactgctctgtgacgtgttcaagaagggggatgtgtacctgaacaccggtgacctgatcgtccaggatcaggacaatttcctgtacttctgggataggaccggtgatacctttaggtggaagggcgaaaacgttgccacgacggaggtggccgatgtgatcggcatgcttgacttcatacaggaggcgaacgtttacggtgtggctatatctgggtacgaggggagggctggtatggcctccatcattctgaaacccaacacctccctcgatctggagaaggtttatgagcaggtagtgacctttctccccgcttacgcctgcccccggttcctgcgaatccaagaaaaaatggaggctacaggcacatttaaattactcaaacatcagctcgtggaggacggatttaatcctctcaagatttccgagcccttgtatttcatggacaatttaaagaaaagttatgtactgctgaccagggaattgtatgatcagattatgctgggggaaataaaactgtag

SEQ ID NO: 30224 - DNA, 1860 bp, Artificial Sequence
  Description of Artificial Sequence: Synthetic coding sequence
atgctcctgtcttggctgacggttctgggagctggtatggtcgtccttcactttctccaaaagttgttgtttccatatttttgggacgacttctggtttgtgttaaaggttgtgctgatcatcattcgactgaaaaagtacgagaaaaggggggaacttgtcactgttctcgataaatttctctctcacgccaaaaggcagcctcgcaaaccttttatcatctacgagggagatatctatacataccaagacgtagacaaaaggtctagccgggtggcacacgtttttcttaatcacagttctttgaagaaaggcgacaccgttgccttactgatgtctaatgaacccgactttgtgcacgtgtggtttggtctggctaagttgggctgtgtggtggccttcttgaatacaaatatcagatcaaactctcttctgaactgcattcgcgcctgtgggcccagggctctggttgtgggagctgatctcttgggcaccgtcgaagagatcctgccgagtctgagtgagaatatcagcgtatgggggatgaaggattctgtgccccagggggtgataagcctgaaagaaaaactctctaccagcccagacgaacccgtcccgagaagccatcacgtggtctccctgctcaagtcgacatgtctctatatcttcacttcgggcacgaccggtctccctaaggccgcagtgatctcccaactgcaggtgttgcgcggctccgcagtactctgggcattcgggtgcactgcccacgatatagtgtacattacccttcctttgtaccattcctcagctgcaatcctcggcatttctggttgtgtggagctgggagccacatgtgtgctcaaaaagaaattctctgcctcccagttctggagtgattgcaaaaagtatgacgtaaccgtgtttcaatatattggggagctttgtagatacctgtgcaaacagagtaagcgagagggcgaaaaagaccacaaggtgcgcctggcaattggtaacggaatccgctcagatgtatggcgcgagtttctcgatagatttgggaacattaaggtgtgtgagctatacgctgccactgaaagctctatttcttttatgaattacacaggccgcatcggggctatcgggcggaccaacctgttctataagctgctcagtacgtttgacctaatcaaatacgactttcagaaagatgagcctatgcggaacgaacaggggtggtgtattcacgtgaaaaagggggaaccgggcctcttgatcagccgagtgaatgctaagaaccctttttttggctacgcaggaccgtacaagcacactaaggacaagctgctctgtgacgtgtttaaaaagggcgacgtgtatctaaataccggcgacttgatcgtacaagatcaagataacttcctgtatttctgggatagaacaggcgacacctttcgctggaaaggggaaaatgtcgcaactacggaagtggcggatgtcattgggatgttagacttcatccaggaggcaaacgtttatggggtcgctataagcggttatgaaggcagggcaggaatggcaagcatcatcctgaaaccaaacacctcactggacctggagaaggtctatgagcaggtcgttacattcctccctgcatacgcttgcccaaggtttttgaggattcaggaaaaaatggaagctaccggcacatttaagctcctgaaacaccagctggtggaggacggtttcaacccccttaaaatttcagaaccactgtactttatggacaatttgaaaaaatcttacgtgctcttaactagggaactgtatgatcagataatgttgggcgagataaaactgtag

SEQ ID NO: 30225 - DNA, 1860 bp, Artificial Sequence
  Description of Artificial Sequence: Synthetic coding sequence
atgctgcttagctggttgacagtacttggcgccggcatggtagtattgcattttctgcagaaactgctttttccctatttttgggacgatttttggttcgtgctgaaagtggtgcttataatcatccgcttgaaaaaatatgagaagcgaggggagctcgtgacggttctggacaagttcctctcccacgctaaacggcaaccacgcaagccctttattatctacgagggcgacatttatacataccaggatgtcgacaagcgatcttcacgcgtggctcatgtctttcttaatcactcctcactcaagaaaggtgacactgttgcactgctgatgagcaatgaacccgacttcgtgcacgtctggtttggtctggctaaattggggtgtgtcgtagcgttcttgaatacaaacattcgttcaaacagtctgctgaattgtatccgtgcctgtggcccgcgagccttagtagtaggggctgacctgctcggcacagtggaagaaatcctgcctagcttgagcgagaacattagcgtctggggcatgaaggattctgttccgcagggggtcatcagcttaaaggaaaagctgagtacatctccagacgagcccgtccccagatcgcatcacgtggtcagcctgctgaagagcacctgcctatatatctttacatctggtacgacgggactgcctaaggccgccgttatttcacagttgcaggtgctcaggggatctgccgttctctgggcctttgggtgcaccgcccacgatattgtctatataactttgccactctatcattcttccgccgccattctcggaatttctggctgcgtcgagctgggggccacttgcgtgctgaaaaagaagttctccgcaagtcaattttggtctgactgtaaaaaatacgacgtgacggttttccagtacattggggagctctgtaggtatctgtgcaaacaatctaaacgggagggagagaaagaccataaagtgaggctggctataggcaacggtatccggtctgacgtgtggagagagttcctcgatcgatttggcaacataaaggtgtgcgagctatacgccgccacagagtccagcatctctttcatgaactatactggccggatcggtgctatcgggcggacaaacctgttttataagctcttgagcaccttcgacctcatcaaatatgactttcagaaagatgagcccatgaggaatgagcaagggtggtgtattcatgttaagaagggggaacctggcttactgatctctagagtcaatgccaagaacccattcttcggttacgccggtccctataagcacaccaaggataagctgctgtgcgatgtcttcaagaaaggggacgtctaccttaatactggtgatttgattgttcaggaccaagacaactttctctacttttgggatcggaccggcgatactttcaggtggaagggggaaaatgtagctacgactgaagtagcagatgtcataggaatgcttgacttcatccaggaggcaaacgtgtacggggtcgccatttcaggttacgaagggagagccggaatggcatcaatcattctgaaacccaacacaagccttgatctggagaaggtgtacgagcaggtagtgaccttccttcctgcatatgcctgccctcgcttcttgcgtatccaagagaagatggaggcaacagggacattcaagctgctgaagcaccagttagtggaggacggatttaatcctctcaagatcagcgagccactgtacttcatggataacctcaagaagagctacgtgttgttgacaagggagctctacgatcaaatcatgctcggagagatcaagctttag

SEQ ID NO: 30226 - DNA, 1593 bp, Artificial Sequence
  Description of Artificial Sequence: Synthetic coding sequence
atgggatcagttgggtcacagagactcgaggaacctagtgtggccggcactcccgatcccggcgtagtaatgagcttcacattcgactcgcatcagctggaggaggctgcagaggcggcccagggtcaggggttgagggctaggggagttcccgcatttacagataccacccttgacgagcccgtacccgacgacaggtatcacgccatctactttgccatgcttctcgcaggcgtcgggtttctgttgccctataacagctttattacagatgtggactacctccatcataaatatccagggacctctattgtcttcgacatgtctctaacgtatatacttgtggcactcgccgctgtattgctcaacaacgtgttggtggaacggctcaccctgcacacacggatcaccgccggctatttgctggccttgggtccactgttgttcatttccatttgcgacgtgtggcttcagctgttttcgagagaccaagcctacgccatcaatttggcagcggtcggaacagtggcctttgggtgtactgtgcagcagagctcattttatggctacaccggaatgttaccaaaaagatacacccaaggcgtcatgaccggagaatccacagcgggcgtaatgattagcctctccaggatattgactaagctgctcctgccagacgagcgtgccagcacacttatattctttctggtgtctgtagccctggaactgctgtgttttctactgcatcttctcgtgaggcgatcccgattcgtgctgttctataccacccggcctagagactctcacagggggcggccaggactgggccgggggtatggctatcgggtgcaccacgacgtggtcgcaggcgatgtgcactttgagcatcctgcccctgctctcgcccccaacgaatcccccaaagactcgcccgctcacgaagtcactggcagcgggggcgcctatatgaggttcgacgtcccaagaccgagagttcagagaagttggccgaccttccgtgccttgctgctgcatcggtatgtcgtcgctcgggtgatctgggctgacatgctatctatcgccgtaacttattttataactttatgtctgttccccggtctcgagtccgagatcagacactgcatactcggagaatggttgcccattcttatcatggcggtttttaacctatccgatttcgtggggaagatccttgcagctctgcccgtcgactggaggggtacacaccttttggcgtgttcatgcctgagagtggtctttatcccactgtttatcctgtgtgtttatccttcggggatgcccgcactgcgccaccctgcctggccctgcatcttctcattgttgatggggatctccaacgggtacttcggatccgtgcctatgatcctcgccgcagggaaggtgtctcccaagcagagggagctcgccggcaacactatgactgtgagctacatgtcaggattgaccctcggctccgccgtggcctactgcacctacagcctgactcgcgacgcgcatggttcttgtttgcatgcatccactgcaaatgggagcattctcgccgggctctag

SEQ ID NO: 30227 - DNA, 1593 bp, Artificial Sequence
  Description of Artificial Sequence: Synthetic coding sequence
atgggctcggtggggagccaacgcctggaggagcccagcgtggcaggaaccccggatccaggagtcgtaatgagctttaccttcgattctcaccagctcgaagaggccgccgaagctgcacaaggccaagggttaagagcaagaggggttccagctttcactgacaccacacttgacgaaccagttccagacgatagataccacgccatatattttgcgatgctgcttgctggggttgggttcttgcttccttataacagtttcattaccgacgtggattacctgcatcacaaataccccgggaccagtatcgtatttgacatgtcgttgacatatattctggtggctcttgccgcggtgctgctcaataatgtgttggtggaacggctgactctgcatacccgcatcactgcgggttatctacttgctttaggcccactgctctttatcagcatatgcgatgtgtggctgcagttatttagcagggaccaggcatatgctatcaatctggccgccgtcggcactgtcgctttcggctgcacggtccagcagagctccttctacgggtatacgggtatgctgcctaagcgctatacacaaggagtaatgactggtgagtctaccgcaggcgtgatgatctctctctctcgaatcctcacaaagctgctactccccgatgaaagggccagcaccctgatctttttcctcgtctccgtggcactggaactgttatgtttcctcctgcatctgctcgtgcgcaggtcaaggttcgtgttgttttatactacgaggccaagagattcccacaggggcagaccagggcttggccgggggtacggttatcgcgtacaccacgacgtggtggctggcgatgtccattttgagcatccagctcctgccctggctcccaatgaatctccaaaggacagtcccgcacacgaggtaaccggcagcgggggcgcctacatgagatttgacgtccctcgcccaagggtgcagagatcttggcccacatttcgggccttattgctccaccgatacgttgttgcacgcgtgatatgggcagacatgctgagcatcgcagtgacttacttcatcacactctgtctgttcccgggcttagagtctgagatccgccactgtattctgggggaatggttgcctatcctgattatggcggtgtttaatctgtctgacttcgttggaaagatcctggcagccctgcccgtcgactggcgtggaacgcaccttctggcttgttcatgtctgcgcgtggtgttcatccccctgttcatcctctgtgtctatcccagcggtatgcctgcactccgtcacccagcttggccgtgcatcttctccctcctcatgggcataagtaacggctattttggctctgtgccaatgattttagcagctggcaaggtctcacctaaacaacgggagctcgctggcaatacaatgacagtttcttatatgtccgggttaaccctgggaagcgccgtggcttactgcacttattccttgacccgggacgcccacgggagttgtctacatgccagcacagctaacggaagcatcctggcggggctctag

SEQ ID NO: 30228 - DNA, 492 bp, Artificial Sequence
  Description of Artificial Sequence: Synthetic coding sequence
atggggtctgtcggcagccagcggctggaggaacccagcgtagccggaactcccgaccccggagtggtgatgagttttacctttgactctcatcagcttgaggaggcggccgaagccgcacagggccaggggctcagagcaagaggtgtgccggcatttacagatactacgctagatgaaccagtaccggacgaccgataccatgcaatttactttgccatgctgttagcgggcgtcggattcttgctgccatacaatagtttcatcaccgacgttgattatttgcaccataaatatcccgggacctccatcgtatttgatatgtctctgacctacattcttgtagctctggcagccgtgctactgaacaacgtgcttgtagaacgcctaacccttcacactcggatcaccgcaggctacctcttggccctcggtccattgctcttcatttcaatctgtgacgtatggctccagttgttctccagagattag

SEQ ID NO: 30229 - DNA, 1707 bp, Artificial Sequence
  Description of Artificial Sequence: Synthetic coding sequence
atgcttcctggtctagctgccgctgccgcccacaggtgttcttggtcatccctctgtcgtctccggttgagatgcagggctgctgcatgtaacccctccgacagacaagagtggcaaaacctggtcacttttggaagcttctctaatatggttccctgctcacacccgtatatcgggaccttatcgcaggtgaagctatacagcactaacgtgcagaaagaaggccagggaagccaaacactgagggtggagaaagttcccagcttcgaaaccgctgagggaattggtaccgagctaaaagcacccctgaaacaggagcccctgcaggtgagagtgaaagccgtattgaagaagcgcgaatatgggtccaaatacactcagaacaatttcattaccggagtacgcgctattaacgagttttgtctgaagagtagcgacctggagcagttacgtaagatacggaggcggtcgccacacgaagacacagagagttttaccgtctatttgcggagtgatgtggaagccaaatctctcgaagtctggggcagccctgaagccctggctagggaaaagaagctccgcaaggaggccgaaatcgagtatcgagaaaggctgttccggaatcagaagattctgcgcgagtacagggactttcttggcaatactaaacctcggtcccggactgcctccgttttttttaaggggcctggcaaggtggtcatggtagctatttgtattaatggcctgaactgcttctttaagttcttagcttggatctacacgggatcagcctcgatgttttccgaggcgattcatagcttgtccgacacttgtaatcagggcctgctggccctgggtatctctaaaagcgtgcagactcctgacccctctcacccatatggattttctaacatgcgatatatctccagcctgatttccggagtaggtatcttcatgatgggagctggcctgagttggtaccatggggtcatgggtttgcttcaccctcagccaatcgaaagcctgttgtgggcgtattgcatactcgcaggaagcctagtgagcgagggagctacacttctggtggcagttaatgagctgcgtcggaatgcccgggccaaaggcatgagcttctacaaatacgtgatggaatctagggatccttccaccaacgttatcctgctagaggacactgccgcggtcctcggcgtgatcatagcggcgacatgcatgggattaacctctatcacaggtaaccctctctatgattccttaggttccctgggcgtggggaccctgctcggaatggtttctgcgtttctcatctacaccaatacggaagctctcctcggaaggtcaatccagcctgagcaggtccagcggctgaccgaactactggaaaatgacccttcagtgagagcgattcatgatgtgaaggcgactgatctgggcctcggaaaggtgaggtttaaggctgaggtcgattttgacggaagggtggttacgcggagctatttggagaaacaggattttgatcagatgctgcaagaaatccaggaggtgaaaactccagaagagctggagacatttatgctgaagcatggagagaacattattgacacactgggcgctgaagtcgataggcttgagaaagagctgaagaagagaaatcctgaagtaagacacgttgatctggagatcctgtag

SEQ ID NO: 30230 - DNA, 1191 bp, Artificial Sequence
  Description of Artificial Sequence: Synthetic coding sequence
atgtggaaacagaacctgtggaaatttggggaagcgctgaagctccttccagagaaaaaactgaggaaagaggccgagatagagtaccgggagcgcctgttcaggaaccagaagatattgcgcgaatatagagattttctaggcaacaccaagccccgcagtcggaccgcctcagttttctttaagggacctggcaaagtggtcatggtcgctatctgtattaacggccttaactgcttcttcaaatttttagcttggatttacactggctccgcgagtatgtttagtgaagcaatacatagcctgagtgacacatgtaaccaaggccttctggcactgggcatcagcaagtccgtccagactcctgacccctcgcatccatatggattttccaacatgcgttacatatcttctctgattagcggtgtgggaatcttcatgatgggagccggacttagctggtaccatggagttatgggacttctgcatcctcagcctattgaatccctcctttgggcatattgtatcctggcaggcagcttagtcagcgagggcgcgaccctccttgtggctgtgaacgaactgcggagaaacgctagagccaagggtatgtccttctataagtacgtgatggagtcgagagacccctctaccaacgtcattctactggaagataccgccgcagtgctgggcgtgataatcgctgcaacctgcatgggcctgacctccatcacaggtaatcctttatacgatagcctggggtctctcggggtgggcacactcctcggcatggtgagcgctttccttatatacactaatacggaagctttacttgggcggtccattcagccagagcaggttcagcgtttaactgaacttctggaaaatgatccgtcggtccgtgcaatccatgatgtcaaagcaacggatctcggtctcggcaaagtcagattcaaggccgaagtggattttgatggaagagttgtgacccgctcttacctggaaaagcaggacttcgatcagatgttgcaagagattcaggaggttaagactccagaggagttagaaacctttatgcttaagcacggtgagaacataatcgatactctaggagctgaggtcgacagactggagaaagagcttaagaagcgaaatccggaggtgagacatgtggacctcgaaatactctag

SEQ ID NO: 30231 - DNA, 1446 bp, Artificial Sequence
  Description of Artificial Sequence: Synthetic coding sequence
atgggcgctctggcacgtgcgctgccatctatcctacttgctcttctgctgacctccacgccggaggcactcggtgcaaaccccggcttagtggccagaattacagacaagggattacagtatgcggcgcaggagggccttctggccctccaatctgaattgctccggatcactctaccagactttaccggcgacctgcgaataccccacgtgggcaggggcaggtacgagtttcattctcttaacatccactcctgcgagctgttgcacagcgccttgcgccccgtacctggacaggggcttagcctatctatttccgactcctcaatccgggtccagggacgctggaaagtacgtaagtctttcttcaagctgcaaggctcattcgacgtatctgtgaagggcatctcaatctccgttaatctcctcctcggctccgagtcttcaggtcgaccaacagtgactgcctctagctgtagctcagatatagctgacgtggaagttgacatgagtggcgatttagggtggcttctgaacctattccacaatcagatagaaagtaagttccagaaagtcctggagtctcgcatttgcgaaatgattcagaagtcagtgagctcggatttgcaaccctatttgcaaactctgcctgtgactaccgaaatcgactcctttgccgatatagactattctcttgtagaggctccaagggcgacggcccagatgcttgaagtcatgtttaaaggcgaaatctttcacagaaaccaccgcagcccagtgactctcttagcagccgtgatgtccctgcctgaggagcataacaaaatggtgtacttcgcgatcagtgattacgtcttcaatacagcctctctcgtgtatcacgaagaggggtacttaaactttagtatcacagatgacatgataccccccgattccaacatccgcctaacaactaaatctttcagacccttcgtgcctagactggcgcgactctaccccaatatgaacttagagctgcagggcagcgtgccgagcgccccacttctaaacttttccccagggaatctaagtgtagatccatatatggaaatcgacgcatttgtgcttctgcccagcagttctaaagaaccagtctttagactgagcgtcgccaccaatgtgtccgcaaccctgacctttaacaccagtaagataacaggttttcttaagccaggaaaggtgaaagtggagttaaaggagtccaaggtggggctctttaacgccgagctgctggaagcccttctcaattattacattctcaacaccttttatccaaagttcaacgataagctggccgagggctttcccttacccctcttgaaacgggtgcagctctacgatctgggtctccaaattcacaaggatttcctctttcttggggcaaacgtgcagtacatgagggtatag

SEQ ID NO: 30232 - DNA, 1233 bp, Artificial Sequence
  Description of Artificial Sequence: Synthetic coding sequence
atggccgctgccgccgttggcgccgggcatggggctggaggccccggcgccgcgtcaagttcaggaggtgcacgagaaggggcccgcgtggccgcactgtgtctgctttggtatgcgttgagcgcaggagggaacgtggtcaacaaagtgatcctgagcgcttttccatttccagtaacggtgtctctttgccacatccttgccttgtgcgctggcctcccccctctgctgcgcgcctggcgggtcccccccgccccccctgtgtctgggcctggcccgagtccgcacccatcgagtgggcctcttctgcctccacgcttctacccaaggtacgtgctgccactagcctttggtaagtacttcgcttccgtcagcgcgcacgtgagtatctggaaggtacccgtcagttatgctcatacagttaaagccacaatgcccatttgggtggtgctgctgtcaagaataataatgaaggaaaagcagagtacaaaagtgtacctgtcactaattccaatcatcagcggagtgctgctagcaacagtgacagaactgtctttcgacatgtggggccttgtgtccgcactggcggccactctctgcttcagcctccagaacatattctcaaaaaaagtactgagggactcacgaattcaccacctgagactgttaaacatactgggatgccatgctgttttcttcatgatccctacctgggtgttggtcgatctgagcgcatttttggtgagctccgaccttacttacgtgtatcagtggccctggaccctgctgctcctggcagtcagcgggttttgcaattttgctcagaatgtgatcgcattctcaatcctgaacttggtgtcccctctgagctacagcgttgcaaacgccacaaaacgaatcatggtgataaccgtgtctctgatcatgctgcgcaaccccgtgacctcaacaaacgtgctcggcatgatgacggctattctgggagtgttcttgtataataagaccaagtacgatgcaaaccagcaggcccggaagcacctgctgccagttacaaccgcagacctgtcttccaaggaacgtcaccggagccctctcgagaaacctcacaacggcctactgtttcctcagcatggggactaccagtatggccggaataacatcctgacggatcattttcagtatagtcgccagagctatcccaattcttattctctcaacaggtacgacgtgtag

SEQ ID NO: 30233 - DNA, 1458 bp, Artificial Sequence
  Description of Artificial Sequence: Synthetic coding sequence
atggacgtgaaagctgcccccaacggcgtcgcgaccattgaggatcgaattctcagaattaccggttactacgggtactaccctggctatagtagccagaagtcaaccagtcgatccagtgtgacccgctgcaagcctggtgccaattgtcccagcagccactctggaattagcagacagctgtcacccctgtcagttacagaggactctagcgcccccatcctggagctgcagaatcagggctcaagcggcgtgtgcgggcatcgggtcgagagacaaaaccgcagcgccgatgatgggactcagactcattcagagaattccagccaggaaaatcggattaaggcacgatgtctgtcctgcacttcaatggtgctgaaagggatatggggacttttgataatcctgagcgtgtcttcttcctgggtcggcaccactcaaattgtcaaaataacttataagaacttctattgtccatttttcatgacctggttcagcacaaactggaacatcatgtttttccccgtatattacagtggccaccttgcgacagcacaggaaaagcagagcccaatgaaaaagtttcgggaatgttcacgcatcttcggggaagatggattaactctgaaactgttcttgaaacgaacagcccctttcagcatcctttggacactgaccaactatttgtatctgctggccttaaaaaaattaacagccacagacgtctccgctcttttctgctgcaacaaagccttcgtattcctactgtcatggatcgttctgaaagatcgtttcatgggcgtccgcatcgttgcggcaattatggctattaccggaatcgtgatgatggcttatgcagacaactttcacgccgattcgatcattggggtcgctttcgcagtcgggagcgccagtacctccgcactgtacaaggttttgttcaagatgtttctgggctccgctaattttggggaggctgcccacttcgtttcaaccttaggcttttttaacctgatatttatatcctttactccagtgattctctactttaccaaagtggaacattggtcctccttcgccgccctgccttggggctgcctgtgcgggatggcaggcctctggcttgcttttaatatactggtcaacgtgggggtggttttaacctatccaatactgatttctatcggtaccgtactaagtgtaccgggaaatgccgcagtcgatttattgaaacaggaagtgattttcaacgtggttcgactagcagcgactataattatctgtatcgggtttttactgatgctgctgcctgaggaatgggacgaaatcaccctgcgcttcattaatagtctgaaggagaagaagtcagaggagcacgtcgatgatgttaccgatccctccatacatctgcgaggccggggccgcgccaacggcactgtctctattcccctcgcctag

SEQ ID NO: 30234 - DNA, 975 bp, Artificial Sequence
  Description of Artificial Sequence: Synthetic coding sequence
atgagcgttgaagacggaggaatgcctggtctggggcgtcctaggcaagctcgatggactctcatgctgctgctgtccacagcaatgtacggtgctcacgcaccactactagccctttgccacgtggacggcagggtcccatttcgccctagctctgccgtgcttcttaccgaattgactaaactactcttatgtgcattctcactcctggtaggctggcaggcatggcctcaagggccacctccttggcgtcaggctgccccgtttgccctttcagcgctgctctacggtgcaaataataacttagtgatatacttacagcgctatatggatccaagtacctaccaagtgctgtcaaatttaaaaatcgggtccacagccgtcctgtactgtctgtgcctgcgacacagattgtcagttcggcagggacttgccctactgttgcttatggcggccggggcttgttatgccgccggcggtctgcaggttccagggaataccctgccatcacctcctcctgctgcggctgcctctcctatgcctttacatatcactccactaggtttattgttactgatcctttactgcttgatttccggcctgtcctcggtgtatactgagctgttaatgaagagacagaggcttcccctggcactgcagaatctgttcctgtacactttcggggtactgcttaacttgggactgcacgccggtggggggagtggcccaggactcttggagggcttctcaggctgggccgccctggtagtgctcagccaagcccttaatggcctgctcatgagcgccgtcatgaagcacgggtctagtattactcgcctgtttgtggtttcgtgctcactggtcgtgaacgcagtgttgtcagcggtgctgctccgtctacagctaaccgctgccttctttctggccacccttcttatagggctggcaatgagactgtattatgggtcccgttag

SEQ ID NO: 30235 - DNA, 537 bp, Artificial Sequence
  Description of Artificial Sequence: Synthetic coding sequence
atgcccctcattctgtctatcctgtctggaaatgtgcctcgactccttctccccggaagctggctccacaatctgattttcccgaaaagagtggcaattcctgctgcccctggcacatccgagcccttgcccctgcacttctggtgcgcgtccgagagcagaagcgcctgctggcgacggctctggccccggccacctgggagattcctacgcatgggtagtacaaggggcgctgaacctggaactaagtggacagcgcatgtgtgttgccacgaggcttggcaacagcatcatactccattgtgtggcgttctgctggctggtggccagaggcgcgccctcagctcccctgccacagctgcagcccacagtaggcttttacccggccacattgcacattggcccggccacgcacctgtgttgtggcagccccttgttcccgacaattttcatccagattccggcccctgcagactcggtgctacgacccgtagcccctcgcaagccttcctaccattaccttcagcagcactgtag

SEQ ID NO: 30236 - DNA, 975 bp, Artificial Sequence
  Description of Artificial Sequence: Synthetic coding sequence
atgtctgtggaagatggcggcatgccaggcttagggcggcccaggcaggcccgctggacactgatgttgctgctcagcactgccatgtacggagctcatgcccctttgctggctctgtgtcatgttgatgggcgggtgccgtttcggccaagtagtgctgttctgctcacagaactgaccaaacttcttttgtgcgctttcagcctcctggttggctggcaggcctggccccaaggcccgcccccttggagacaagctgccccgttcgctctgtccgccctactatatggggcaaacaacaacttagtcatttatctgcagagatacatggacccaagtacgtatcaggttctaagtaatctaaagataggcagcacggcagtgctgtattgtttgtgtctcaggcatagactctctgtgaggcaagggctcgccctccttctcctgatggccgctggagcttgctacgctgcaggtggcttgcaagtgccgggaaatacactgcccagtcccccaccagccgctgccgccagcccaatgcctctgcacatcacccctctgggcctactgcttctcatattatactgcctgataagcgggctttcatcggtctatactgagctgctgatgaaaaggcaaagactacccctcgccctccagaatctatttctctacacttttggtgtgctcctgaacctgggcctgcacgccggcggtgggtctggccctggactgctggaaggtttctccgggtgggccgcacttgtggttctttcgcaggctttgaatggtctgttgatgtccgctgtgatgaagcacggctccagcattactaggctctttgtggtgagctgctcattggtggttaacgctgtcctgtccgcggtccttctgaggcttcagctcactgctgccttttttctggcaacactcttaattggcctcgcaatgcggctttactatggatcccggtag

SEQ ID NO: 30237 - DNA, 267 bp, Artificial Sequence
  Description of Artificial Sequence: Synthetic coding sequence
atggagaagcaatgctgttcacatcccgtgatatgtagccttagtactatgtatacctttcttctaggcgctatcttcatcgcactatcctcaagccggatcctgcttgttaaatatagcgccaacgaggagaataagtatgactatcttcctacaacagttaatgtctgtagcgaactcgtcaagctggttttttgcgtcctggtgagcttctgtgttatcaagaaagaccatcaatctcgaaatctgaagtacgcatcgtggtag

SEQ ID NO: 30238 - DNA, 444 bp, Artificial Sequence
  Description of Artificial Sequence: Synthetic coding sequence
atggaaaaacagtgctgctcccaccctgtcatctgctcccttagtacaatgtacacctttcttctgggggctatcttcattgccctgtccagcagtcgaatcctgcttgtgaagtattccgctaacgaagaaaataaatatgactacctacctaccaccgttaacgtgtgttcagaactcgtgaagctggtgttctgcgtactggtgagtttttgcgttattaagaaagatcaccaatcccgtaatcttaagtacgcttcctggaaagaattttccgattttatgaaatggtcaattcctgctttcctctactttctcgataacctgatcgtgttttatgtcctgtcctatctccagccagccatggcagtgatcttctcaaatttcagcattataacgactgcccttctcttcaggattgtgcttaaaagaagactaaattag

SEQ ID NO: 30239 - DNA, 1275 bp, Artificial Sequence
  Description of Artificial Sequence: Synthetic coding sequence
atggaaaagcagtgttgctctcatcccgtcatctgtagcttatctacaatgtatacattcctgctcggtgccatttttattgccttatcttcgtcccgaatattactcgtgaagtatagcgccaatgaagagaacaagtacgattatttaccaaccaccgtgaatgtttgtagtgagctggtgaagctggtgttctgtgtgctggtgtcgttttgtgtaattaaaaaggatcatcaatcaagaaatctgaaatacgcttcatggaaggaattcagcgattttatgaagtggtccatccctgcattcctatacttcctggacaatctgatagtcttttatgtcctctcctacttacagcccgcaatggctgtgatcttttctaactttagtataatcacaacagccctgctgtttcgcattgtgctcaagaggaggctgaactggatccagtgggctagccttctaactctgtttctcagtatcgtagctctcacggctggaaccaagactttacagcacaacttggccggcagagggttccaccatgacgctttctttagcccctccaacagctgcctgctcttcagatctgaatgtcccagaaaggacaactgtaccgccaaagaatggacatttcccgaggccaaatggaatacgacagccagggtcttctctcatataaggttaggaatgggccacgtgttgataatcgtgcaatgttttattagttccatggctaacatatacaacgagaaaatcctgaaggagggaaatcagctgacagagagcatctttattcagaactcaaaactgtacttcttcggcatactcttcaacgggttaacgctcggacttcagcgctcgaacagagatcagatcaagaactgtggcttcttttatggacactcagcgttttccgtggctctcatctttgtgaccgcattccagggcctcagcgttgctttcattctgaagttcctggataatatgttccatgtactgatggctcaggtgactaccgtcatcatcaccacggtcagcgtgttggtgttcgatttcagaccatcgttagaattcttcttggaggcacctagtgtgctcctgagtatatttatctacaatgctagtaaaccccaggttccagagtacgctccacggcaggagcgcatccgggatctctctgggaatctttgggagcgctctagcggggatggtgaagaactggagcggctgaccaaaccgaaaagcgacgaatccgatgaggacacattctag

SEQ ID NO: 30240 - DNA, 1098 bp, Artificial Sequence
  Description of Artificial Sequence: Synthetic coding sequence
atgggacggtgggcgttggatgtggccttcctgtggaaggcagtactgactctggggctggtgttgctgtattattgcttctcgatcggaatcaccttctataataagtggttaaccaagagctttcactttcctttattcatgactatgttgcacctggctgtgatctttcttttttctgccctatcccgcgcactcgttcaatgctcctcacaccgggcaagagttgtcttgagttgggcagactatctccgacgtgtggccccgaccgccttagcaactgctctggacgtgggcttatctaactggtcctttctctatgtgaccgtgtctctctacacaatgactaagtcctctgccgtgcttttcatattaatatttagcttgatcttcaagctagaagagctcagagccgctctcgtgctcgtggtgctgctgatcgctggcggcctgtttatgtttacttataagtctacccagtttaacgtagaagggtttgctcttgtgctcggtgcctcttttattggcggaattaggtggaccctgacccagatgctacttcagaaggctgaacttggtctccagaaccctatcgacactatgttccacttacagcctttaatgttcttgggcttgttcccactgttcgcggtcttcgagggcttacatttgtcgacctcagagaaaatcttccgcttccaagatacggggctgctgttgagggttttgggatcactgttccttggggggattttagcatttggcttaggattctcagaatttctgctcgtgagcagaacgtcttccctgacgttgtctatagccggtatcttcaaagaggtgtgcaccctgcttttagctgctcacctgctgggcgaccagatttcccttttgaattggctaggtttcgctctgtgcctgagcggaattagccttcatgtcgcgctaaaggcgctgcacagccgaggagacggcgggccaaaagctttaaaaggcttggggtcaagccctgatctggaactgctgctccgcagttcccagagagaggaaggagataatgaagaggaggaatacttcgtggcccagggccagcaatag

SEQ ID NO: 30241 - DNA, 1035 bp, Artificial Sequence
  Description of Artificial Sequence: Synthetic coding sequence
atggggcgatgggccctggacgtcgcctttctgtggaaggccgtgttgacccttggcctggtcctgctctactattgtttttcgatcggtatcacgttttataacaagtggcttactaaaagcttccacttccctctgtttatgacaatgttgcacctggctgtgatttttttattctccgcattaagcagagcgctggtccagtgttcatcgcatagggccagagtcgttctgagttgggctgactacctcaggagagtcgcccccaccgcactcgcaactgcacttgacgtggggctctcgaattggtcctttttgtacgtgacagtcagtctgtataccatgacaaaatccagcgcggttctgttcatcctgatctttagtctcatctttaaacttgaggaactgtccacccagtttaacgtggagggtttcgcattagtgctcggcgcatcctttattggcggcatacggtggaccctcacacagatgctcttgcagaaagccgagttgggcctgcaaaacccgatcgacaccatgttccatctgcaacccttgatgtttctgggactgttcccccttttcgcagtttttgaaggcctgcatctgtctactagcgagaaaatctttcgctttcaggacacaggacttctgctccgggtgctcgggtccctgttcctcggaggtatcctggccttcggcctgggattctcagaattcttgcttgtctcacgcaccagctcccttaccctgtctattgccggcatcttcaaggaagtgtgcacactattattggccgctcacttgctcggagaccagatctctttgctgaattggctgggttttgctttatgtctttccgggattagtcttcacgttgccttaaaggctttacacagccggggagatgggggcccaaaggctctgaaagggcttggaagctcccccgacctcgagcttctgctcagatcatctcagcgggaggaaggggacaacgaagaggaggaatacttcgtcgcccaaggccaacagtag

SEQ ID NO: 30242 - DNA, 477 bp, Artificial Sequence
  Description of Artificial Sequence: Synthetic coding sequence
atggggcgatgggcactggacgtcgcgttcctgtggaaagccgtgctgactctgggccttgtgctcctttactattgtttttcaatcggtatcactttctacaacaagtggctcacaaagagcttccatttccctctgtttatgacaatgctccatttagctgtgatcttcctcttctcagccctgtcccgggctttagttcagtgcagctcacacagggctagggtcgtcctgtcgtgggccgactatttacggagagtggcgccgaccgctctggcgacagctctcgacgtgggcctctcgaactggagcttcctgtacgttactgtgtctctcgctcggcactggagctggtggtcaagcagctcaccaggcgtgtcttcttgtagccccacgtcaccacattcttccacctggagagcgtccccttggtgctggggcccacgatcttctgttgcctttgccggcccatcctag

SEQ ID NO: 30243 - DNA, 702 bp, Artificial Sequence
  Description of Artificial Sequence: Synthetic coding sequence
atggaacttaagcgtgccgccctcgtcctggtggttctactaattgccggtggcctcttcatgtttacctacaaatctacacaatttaacgtggaagggttcgcccttgtgcttggcgcatcattcattggcggaatccggtggactctgacacagatgctccttcaaaaggctgagctgggccttcaaaaccctattgatactatgttccacctgcaacccctcatgtttttgggactgtttcccctcttcgccgtctttgagggactccatctttcaacttcagagaaaatcttccggttccaagacacaggattactgctgcgcgttctgggttctctgtttctgggcggcatattggccttcggtttggggttttccgagttcctgttagtctcccgaaccagctcactgaccttgtcaatcgcgggaatctttaaggaagtatgtactctcttgttggctgcccaccttctcggagatcagatctctcttctgaattggctgggtttcgcactctgtctgagcgggatctcattgcacgtagccttgaaggccctacacagtcgaggcgatgggggtccaaaagccctcaagggcctggggtcaagtccagaccttgagctcttgctgaggtcaagccagcgggaggaaggagacaacgaggaagaggagtactttgtcgcccaaggtcaacagtag

SEQ ID NO: 30244 - DNA, 1098 bp, Artificial Sequence
  Description of Artificial Sequence: Synthetic coding sequence
atggggcggtgggctctggacgtggcatttctctggaaagccgtgttgaccctggggctcgtcctgctgtactactgcttttcgatcggtatcaccttctacaacaagtggcttaccaaatcttttcatttccccctgttcatgactatgcttcacctagctgtgatctttctgttttcagctctgtcgcgggctctggttcagtgctccagccacagggcacgcgtcgtccttagctgggccgactatctccgtcgggtggcacccaccgcactggccactgctctggacgtgggactaagtaattggtctttcctctacgtaacggtctccctgtatacgatgacaaagagttcagcagttctgtttattcttattttcagcctgattttcaagttggaggagctgagagctgctttggtgttagtagttttgttgatagcggggggactttttatgtttacctacaaaagcactcagttcaatgtggagggcttcgcgctggtgttaggggcctccttcatcggcggcattcgatggaccctgacccagatgttgctgcagaaggcggagttgggcttgcagaatcccatcgatacaatgtttcacttgcagcccctcatgtttctgggactattccccctgttcgccgtgttcgaaggcctgcacctgtcaaccagtgaaaagatctttcgttttcaagatacagggcttcttctgcgggtcctgggcagcttgttcctggggggaatactggcctttggcctgggcttctcagagttcctgctggtgtcccgaacatctagtttgaccctgagcattgccggtatcttcaaagaggtttgcactctgctgcttgccgcccatttattaggggatcagatttctctgctgaactggcttgggtttgcgctgtgtctctcagggattagcctgcatgttgcgctcaaagcgctgcactctcgaggagacggcggcccgaaggctctcaaaggtctgggcagctctcctgatctggaattattgttgcgctcttcacagagagaggagggggataacgaagaagaggagtactttgttgcccagggccaacaatag

SEQ ID NO: 30245 - DNA, 699 bp, Artificial Sequence
  Description of Artificial Sequence: Synthetic coding sequence
atggagctgcgggctgctctggtactggtggttttactaatcgccggcgggctgttcatgtttacatataaaagcacacagttcaacgtcgaaggtttcgccctagtcctgggcgctagttttatcggcggcataaggtggacactgacccagatgctgctccagaaggccgagctgggcctgcaaaacccaatcgacactatgtttcacctccagccgctcatgttccttgggctgttccctctgttcgctgtatttgagggactgcacctttcgacatcggagaaaatcttcagattccaagacacgggacttctactccgcgtgctaggcagcctatttctgggcgggatcttggcatttggactggggttctctgaatttttgttagtgagcagaacatcatctctaactctatcaatcgccgggattttcaaggaggtttgtactctgttgctggccgcccacctcctgggcgaccaaatttctctgctgaactggctaggtttcgccctatgcctgtccgggatcagcctgcacgtggcccttaaagccctgcacagccgaggtgacggtgggcccaaagctttgaaggggttagggtcatcaccagacctggagctattactgaggtcctcccagcgggaggaaggtgataacgaagaggaagagtattttgtagctcagggtcagcagtag

SEQ ID NO: 30246 - DNA, 1098 bp, Artificial Sequence
  Description of Artificial Sequence: Synthetic coding sequence
atgggcagatgggcattggacgttgcctttctctggaaggccgtgctgactctcgggttagtgctcctgtactactgctttagtatcgggataactttctacaataaatggctaacaaaatcttttcatttcccactattcatgactatgttgcacctagccgtgatctttctcttcagcgccttgtcgcgggcactggttcagtgctcaagtcatcgagccagggtagtgctaagctgggccgactacctgcgtagggtagcccccacagcactggcaacagccttggatgtggggctctccaattggagcttcttgtatgtgacagtgagcctttacactatgactaagtctagcgctgtactgttcatactcatcttttccctgatctttaagttggaggagctgagagccgctctcgtgctcgtggtactgctcatagcaggggggttgttcatgttcacctacaaatctacacagtttaatgtcgagggatttgccctagtactgggcgcaagttttattggcggcatccggtggaccctcacccagatgctgctccagaaagcagagcttggcctccaaaaccccattgacacgatgttccacctgcagccactgatgtttctgggcctgttccctcttttcgccgtctttgaggggctgcacttgtcaacttccgaaaagatattcaggttccaggatacggggctcctgctaagggtcctgggcagcctgtttctgggcgggatcctggccttcggactcgggttctcggagttcctgctggtgagccgaacatcaagcttaacgctcagcatcgctgggatcttcaaggaagtgtgtaccctacttttggctgcccacctgcttggcgaccagatttccctgttaaactggctcgggtttgctctatgcttgtcagggatctcacttcacgtcgcgttaaaagctttgcactctaggggggatggtggccccaaggccttaaaaggcctgggtagctcacccgatctcgaattgttgctcaggagctcccaaagagaggaaggcgacaatgaagaggaggaatattttgtagctcagggacagcaatag

SEQ ID NO: 30247 - DNA, 591 bp, Artificial Sequence
  Description of Artificial Sequence: Synthetic coding sequence
atgggtcgttgggctctcgatgtcgcatttctgtggaaggccgtccttacattaggactagtcctcctgtattattgttttagtatcgggataactttttataacaagtggttgacaaaatcattccatttccccctgtttatgactatgctgcacctggctgtgatctttttgtttagcgccctgtcccgagccctcgtgcaatgctcctctcaccgtgccagggtcgttctgagttgggccgactatctgcgaagggtggccccaacagctctcgctaccgccctcgacgtgggcctctctaattggtcatttctgtatgtgactgtgagcctgccacacagctccacctggagggctagcccttggtgttggggtcctagatccagcgtggcctttgctggaccgtctcctagatgtagttgcaggcgcctcaactctgccagcaggatcccctctacgccatgttctacttgttcacactcctgtagctgggggagctcactgagcctgttgtacttgaaggtctcgatctgcccacacttaagaaaaagtagcgtcagccgcacccagggatgctcatgtgggtag

SEQ ID NO: 30248 - DNA, 477 bp, Artificial Sequence
  Description of Artificial Sequence: Synthetic coding sequence
atggggcggtgggcactcgacgtggcctttttgtggaaggctgtgctaaccctaggcttggttctgctatactattgcttttccatcggaataaccttttacaataagtggctgacgaaatcttttcattttcctctctttatgactatgctgcatttagccgttatcttcctcttctccgccctttcccgtgcattagtacagtgctccagccacagggccagagttgtcctatcgtgggccgactaccttcggagagtggcccccacagccctggccactgccttagacgtcggtctgagtaattggagtttcctctatgtcacagtctccctggcacgacactggtcctggtggagtagcagcagccccggggtttcttcttgctcaccgacatccccccacagtagtacatggcgcgcctccccttggtgctggggcccgagaagctccgtagccttcgcagggccctcttag

SEQ ID NO: 30249 - DNA, 1185 bp, Artificial Sequence
  Description of Artificial Sequence: Synthetic coding sequence
atgggaagggtgagcaccagccatcaaccattgcgaggggtacctgcgcccgcagatagcggcgcacctgtcctgcaacctcccagaatgggaaggtgggcgctcgatgtggcattcctgtggaaggctgtgcttacactcggactggtcctgctgtactactgcttcagtatcgggattacattctacaacaaatggctgaccaagtcatttcacttccccttatttatgacaatgctgcatttggccgttatattccttttctccgcgctgtccagggctttggtgcagtgcagctcccaccgagcccgggtagtgctgtcatgggccgactatctcaggcgcgtggcccctactgcgctcgctacagctctggatgtagggctctccaattggagtttcctttacgttaccgtgtccctttacactatgactaagagcagcgccgtactgtttatcctgatcttcagcctcatcttcaagttagaggagctgagagctgccctggttcttgtggtgttactgatcgctggggggctgttcatgtttacctacaagtcgacccagttcaatgtggagggatttgctctggtcctcggcgcgtcttttatcggggggattcggtggacattgactcaaatgctgctgcagaaggccgaactgggcctgcagaatcccatcgatacaatgtttcacctacagcccctgatgtttctgggcctctttcccttgttcgcagtgttcgaaggcctgcatctgtccactagtgagaaaatctttcgcttccaggacaccgggctcctgctcagggtgcttggctctctgtttctaggggggatcttggcctttggcctcggcttcagcgagtttctgctggtttcacggacatccagcttaaccctgtctatagccggcatctttaaagaggtgtgcaccttgctgttggcagcccatctgctcggagaccagatcagcttactgaattggctgggtttcgcactttgcctctccggaatcagtttgcacgtcgcgctcaaggctctccactcccgtggagatggtggacctaaagccctcaaaggcctgggcagctcacctgatttagagctgctgctgcggagttcccaaagagaagaaggagataacgaagaggaagagtattttgtggcccagggacagcagtag

SEQ ID NO: 30250 - DNA, 1233 bp, Artificial Sequence
  Description of Artificial Sequence: Synthetic coding sequence
atggctgccgctgcagtaggtgccggtcacggggcaggcggccctggcgccgcctcgagcagcggtggggcacgcgagggagctcgggtcgctgccctgtgcctcttatggtatgccttgtcagctgggggcaatgtggttaacaaagtcatactgagcgccttcccttttcccgtaacagtgtctctgtgccatattcttgctctttgcgctggactaccgcctcttctaagagcctggagagtcccaccagcaccacccgttagtggtcccgggccgtccccacatccttcctcaggccctctcctgccaccacggttttatccaagatatgtcctccccttagcattcggcaaatacttcgccagcgtatctgcgcatgtgtccatctggaaagtgccggtgtcttacgcgcatactgtcaaagcgactatgccaatctgggtggtcctactgagtaggataatcatgaaagaaaagcagtcaacaaaggtctacctgtcactaatacccattataagcggggtgctcctggctacagttacagagctcagcttcgatatgtggggcctcgtgagcgcgctggctgcgacactgtgcttttctctccagaacatcttctccaagaaggtgctcagagacagccgcatccatcatcttcggctgttgaacatcctaggatgtcatgcagtcttctttatgattccaacctgggtgctggtagacttgtcggcttttttagtgtcttccgatcttacttacgtctaccagtggccctggaccctgcttctcttggctgtcagcgggttctgtaatttcgcccagaacgttatagcattctctatactgaatctggtgagccccctctcatactcagtagcaaacgcgaccaaaagaatcatggtgatcacagtctcgctaattatgctgaggaaccctgtaacatccacaaatgtgctgggaatgatgaccgcaatactgggcgtgttcctgtataacaagactaaatacgatgctaaccagcaggcccgcaagcatctgctacccgtaactaccgctgatctcagctcaaaagagcggcatcgcagtccattagaaaaacctcataatggtctgctgttccctcaacatggggattaccaatatgggcggaataatattctgactgatcattttcagtacagtaggcagagctatccaaatagctatagcctgaacagatacgacgtctag

SEQ ID NO: 30251 - DNA, 315 bp, Artificial Sequence
  Description of Artificial Sequence: Synthetic coding sequence
atgaaagagaagcagtctacaaaagtctacttatccttaatccccattatcagcggcgtgttactggccactgttaccgaattaagtttcgacatgtggggcctggtcagcgctctggctgccacgctctgtttcagcctgcaaaatatcttctccaagaaagtgctgcgtgattctcgcatacaccacctgcgactgctaaatatcctcggatgtcacgctgttttttttatgattcccacatgggtgttggtggatctgtccgcctttttggtgagctccgacttaggcctcccgtctgagaacgtgctgtag

SEQ ID NO: 30252 - DNA, 801 bp, Artificial Sequence
  Description of Artificial Sequence: Synthetic coding sequence
atgagcagctccgttaagacaccagccctcgaagagctggttcccggaagtgaggaaaagcctaaaggcaggagtccccttagctggggctcccttttcggacaccgctccgagaagatagtgttcgctaagagcgatggcggaactgatgagaacgtgctcactgttaccatcacggagaccactgtgatcgagagcgatctcggagtatggagtagtagggccttgctgtatcttaccttgtggttctttttttccttctgcacactattcctgaataagtacatcttgagccttttgggtggcgagcccagtatgctcggagctgttcagatgcttagtaccactgtgattgggtgcgtaaaaaccctggtgccctgttgtctgtatcagcacaaagctagactgagctacccacctaattttctgatgacaatgctttttgtgggtcttatgaggtttgctactgtcgtgctgggtctcgtttccctgaagaacgtggccgttagctttgccgagacagtgaagtcgtcagcaccaatttttacagtgatcatgtccagaatgatcctcggtgaatacactggccgcccgtcagacagggaagagcgggaggaattgcaattacagccaggtaggggcgccgccgcaagcgatcgacgctcccctgtgccaccaagcgagcggcatggtgttcggccacacggagagaatctgcccggagattttcaagtacctcaggcccttcaccgggtggcactctctatggctctcccttgtcccatgctgcccgcaagttag

SEQ ID NO: 30253 - DNA, 741 bp, Artificial Sequence
  Description of Artificial Sequence: Synthetic coding sequence
atgagtagtagcgtcaaaactcccgcactcgaggagctcgtgccaggatccgaagagaagccgaagggcaggagtcctctgtcttggggatccctgttcggccacagaagcgagaagatcgtgttcgccaagtctgatgggggcacagacgagaatgtgctcacagtcactataacggagaccaccgtgatagaatcagacctgggggtgtggtcctcgagagcccttctgtatctgacgctctggttcttttttagcttctgtaccctgttcctcaacaaatacatcctgagtctgctcgggggggagccaagcatgttaggtgccgtccagatgctttcaaccaccgttatcggctgcgtaaaaactctcgtgccttgctgtctttaccagcacaaggctcgcttgagctacccaccgaattttttgatgacaatgctttttgtcggattgatgcggttcgctactgtggtgctgggactcgtgagcctgaaaaacgtagcagtttctttcgcggagaccgtcaaatcttcagctccgatctttacagtaatcatgagccgcatgatcctcggtgaatataccggaagaccctccgatcgcgaggagcgtgaggaactgcaattacagccaggcaggggagctgcagctagcgataggaggagcccagtgccaccaagcgagcggcatggagtgcgacctcacggcgagaacctcccaggcgattttcaggctcagtag

SEQ ID NO: 30254 - DNA, 741 bp, Artificial Sequence
  Description of Artificial Sequence: Synthetic coding sequence
atgtctagtagcgtcaagaccccggccttagaagaattagttcctggatctgaggagaaacccaaaggccggagcccattgtcgtggggttcccttttcggtcatcgttcagagaaaattgtgttcgcaaagtccgatgggggcaccgatgagaacgtactgactgtcacaataactgagacaaccgtgattgagtccgacctcggggtttggtctagccgggccctgctgtaccttacattatggttcttttttagtttttgtactttatttctcaacaaatacatcctctcgcttttaggaggggaaccctcgatgcttggggccgtgcagatgcttagcacgaccgtcatcggttgcgtcaaaacccttgtgccatgctgcttgtaccagcacaaggcccggctgagctatcccccgaacttcctgatgaccatgctgtttgtgggtctgatgaggttcgccaccgttgtgctcggacttgtgtctctgaaaaatgtcgccgtgagcttcgccgagaccgtgaaaagttccgcccctatctttacagtcattatgagcaggatgatattaggagagtacacggggcgcccttcagaccgggaggaacgtgaagagctccagctgcagccaggaagaggggcagccgcgtctgatagaaggagcccagtacctccctctgagagacatggcgtgaggcctcacggtgaaaatcttcctggggactttcaggcccaatag

SEQ ID NO: 30255 - DNA, 966 bp, Artificial Sequence
  Description of Artificial Sequence: Synthetic coding sequence
atggccctcggggcatgcggactactcctacttctggccgtcccaggtgtgagccttcggacacttcaaccaggatgcggacgacctcaggtcagcgatgccgggggaagaatcgtaggcggccatgccgctccggcaggcgcctggccctggcaggcttccctgcggttacggcgtgtgcatgtatgcggcggaagccttttgagcccccagtgggtcctgactgccgcccattgctttagcggctccctgaattcttcagactaccaggttcacctcggcgaactggagatcaccctgagcccgcacttctcaacagtccggcagatcatcctgcacagctcacccagcggacagccggggactagcggcgatatcgcacttgtcgagctcagtgtgccggtcactctgtcctcacgaatcttaccagtctgtctccccgaagcctctgatgatttttgtcccggcattcgctgctgggtgactggctggggatatactagagaaggcgagccattacctccaccctacagccttagggaggtcaaagtcagtgtggtggacacagagacctgcagacgcgattatccgggcccaggaggctctatacttcaaccagatatgttatgcgcaaggggacctggagacgcctgccaggatgattctggaggcccactggtgtgccaagtaaacggtgcatgggtacaagccggaacagtgtcctggggcgaaggctgcggtcggcctaatagacccggggtttacacgagggttccagcctatgtaaactggattcgccgccatatcaccgcgtctggcggctcagagtctggttatccgagactgcctttgctggcgggtttctttctaccaggactgttccttctgctggtgagttgcgtgcttctggccaagtgccttcttcaccctagtgctgacggcacccccttccctgctcctgactag

SEQ ID NO: 30256 - DNA, 1218 bp, Artificial Sequence
  Description of Artificial Sequence: Synthetic coding sequence
atgagcagtagcgttaagacacctgccctggaagaactggttcccgggtccgaagagaagcccaaaggcaggagccccctgtcttggggctctttatttgggcatagatccgaaaaaattgttttcgcgaagtctgacggaggaactgatgaaaacgttctgaccgtcactattacagagactacagtgatcgaatcagacttaggtgtctggagcagcagggccttactctatttgacactgtggtttttctttagcttctgcacactctttctgaacaagtatatactttcactcctgggcggcgagcctagtatgctgggcgctgttcaaatgctttctacaactgtgattggctgcgtaaaaaccctggttccatgctgtctataccagcacaaggctcgactgagctatccccctaatttcctcatgaccatgttgttcgtaggactgatgagattcgctactgtagttctgggactagttagtctcaaaaacgtggcagtgagcttcgcagaaactgtcaagagttctgccccaatattcaccgttataatgtcacgtatgatattgggcgagtatacagggctgttggtcaatctgagccttataccagtgatgggcggactggccctctgcacagcaaccgaaatctcctttaatgtactcggcttttctgctgcactatcaaccaatattatggactgtttgcagaacgtctttagcaaaaagcttctgtcgggggataagtaccgcttctctgccccagagcttcagttttacaccagtgccgcggcagtggccatgctggtgcctgccagagtcttcttcactgacgtgcctgttataggaaggtccgggaaatcattttcatacaatcaagacgtggtgttactgctcctgactgacggagtgctgttccatctacagtccgtgactgcttacgccctcatgggcaagatcagccccgtcacgtttagtgtggcgtcaaccgtgaaacacgcgttaagtatatggctcagcgtgatcgttttcgggaataaaatcaccagtctcagcgctgtcggaaccgctctggtgacagtgggcgtcctcttatacaacaaggccagacagcatcagcaggaggcactccaatccctggccgcagcaaccggcagagcgccagatgatactgtggaaccactgctgcctcaggaccctaggcagcacccttag

SEQ ID NO: 30257 - DNA, 942 bp, Artificial Sequence
  Description of Artificial Sequence: Synthetic coding sequence
atggccctgttagtggatcgcgtgcggggacattggaggattgcggccgggctcttgttcaatctacttgtgtcaatttgcatcgttttccttaataaatggatctatgtgtatcacggtttccctaatatgtcattaaccctggttcatttcgtggttacttggctcggactgtatatttgccagaagctcgatatcttcgctcctaagagcctgcctcctagcaggctgttgctgttggccctctcattctgtggctttgtcgtttttaccaacttatcccttcagaacaatacaattggaacctaccagttagccaaagctatgacaacacctgtgatcatcgctattcagacattttgctaccagaagaccttcagcactcgcattcaattgaccctcattcctattacgctgggtgtgatcttaaactcctattacgacgtgaaattcaactttctcggcatggtgtttgccgcgcttggcgtgctagtgacttctctgtaccaggtgtgggtcggggcaaaacagcacgaactgcaggtaaattccatgcaactgttatactatcaagcccccatgtcttctgccatgctcctagtggccgtcccattctttgagcccgtgttcggcgaaggaggcatcttcgggccctggagtgtctcagcactgctgatggtgctgttaagcggggtgattgccttcatggtcaatctgagcatttactggatcatcggcaatacctctcctgttacatacaatatgtttgggcatttcaagttttgtataactctctttggaggctatgttttattcaaagacccactgtccataaaccaggcactgggcattctctgcacactctttggtatactggcctatacacactttaaactgagcgagcaggaaggttctagaagcaagcttgcccagcgtccatag

SEQ ID NO: 30258 - DNA, 705 bp, Artificial Sequence
  Description of Artificial Sequence: Synthetic coding sequence
atgtgtagatgcccccccgaacaccacgacggtagaatgacgtctgcggaggtgggggccgctgcaggaggggcacaagcagctggtcctccagagtggccaccaggctctccccaggctttaaggcaaccagggcgcgctcgggttgcaatggccgcactggtgtggctgctggccggtgcttccatgtcctcccttaacaagtggatttttacagtgcatggtttcggaagacctttgctactgagcgctctgcacatgctcgtcgccgcccttgcctgccaccgcggggcacgcaggcccatgccgggcggaactcggtgcagggtcctgttgctgtccttgaccttcggaacctccatggcctgcggcaatgttggtctgcgagctgtgccgctcgacttagcccagcttgtgactacgactaccccactgtttactttggccttgagcgccctgctcttgggtcggagacaccacccgctccagttggcagctatggggcctctctgtttaggagctgcttgttctctggccggcgaatttcgaacaccacctactggatgcggcttcctgctggccgccacttgcttacgtggcctgaagtccgttcagcagagtctgtccttccaaatttgtaagatggagctcatgataccgatggagcgcgtgcggatgcggagtgccgggcaaggtcaggagtag

SEQ ID NO: 30259 - DNA, 1053 bp, Artificial Sequence
  Description of Artificial Sequence: Synthetic coding sequence
atgtgccggtgcccccctgaacaccatgatggaaggatgacatcagctgaggtcggcgccgcggctggaggagcacaggccgctggcccacctgagtggccccctggaagccctcaggcccttagacagcctgggagagcccgagtagcgatggctgctctggtttggttgctggcgggagcgtctatgtccagcctgaacaagtggatattcactgtgcacgggttcggtagacctctcctcctcagcgctctccacatgcttgtggccgctttggcttgtcaccggggcgctcgccgaccaatgccaggtggtaccagatgtagagtgctactactatcgctgacatttggcacctcaatggcgtgtggcaacgttgggttacgagctgtccccctggacttggctcagcttgtaacgaccaccacaccactgtttacccttgctctgtccgctctgctgctggggagaagacaccatcccctgcaactggcagctatggggccattgtgtctgggcgccgcctgttctctggctggagaattcagaaccccacctactggctgtgggttcctattggccgccacttgcttgcgcggactgaagtccgtccagcagagcgcactgctgcaggaggaacgcctggatgccgtgaccctcctgtatgccacttccctgccaagcttctgcctcctcgccggtgccgccctggtccttgaggccggagtggccccgcctccaaccgccggcgactccaggctgtgggcctgcatcctgctttcctgccttctctccgtgctgtacaacttagcaagtttttcattgctcgctttgacctctgcactcaccgtccatgtccttggcaacttgaccgtggtcggcaatctgatcctcagtcgtcttctattcgggtcccggctctctgccctctcgtacgtggggattgcactgacactctccgggatgtttttgtaccacaattgcgagtttgtggcatcttgggccgccaggcgtggcctgtggcgccgggaccaaccttctaagggcctgtag

SEQ ID NO: 30260 - DNA, 705 bp, Artificial Sequence
  Description of Artificial Sequence: Synthetic coding sequence
atgtgtagatgtcccccagaacatcacgatggcaggatgacctccgcagaggtgggggctgcagctggtggggcacaggccgctggacctccagaatggcctccaggcagtccccaggcccttcgtcagcctgggcgggctagggtggctatggccgctctggtatggctccttgccggcgcgagcatgagttctctgaacaaatggatcttcacggtgcacggcttcggccgacccctgttgctgagcgccctgcacatgctcgtcgctgctctcgcgtgtcacagaggtgcaagacgaccaatgccaggcggcactcgatgcagggtcctcctgctctctcttacatttggaacctcgatggcctgtggtaatgttggtctccgcgctgtgccacttgatctggctcaattggttactacaacaactcccctctttaccctagctctgagtgccttgctgctgggtaggagacaccatccattacagctggccgccatgggcccgctgtgcctaggggcagcctgttccctggccggggagttccggacaccccctacgggttgtggcttcctcctcgcggcgacctgtctccggggcctaaagtcagtgcagcaaagcctaagctttcaaatatgcaagatggagctcatgatccctatggaacgcgtcaggatgagaagtgcaggtcaaggacaggaatag

SEQ ID NO: 30261 - DNA, 1227 bp, Artificial Sequence
  Description of Artificial Sequence: Synthetic coding sequence
atgatcccccctgaacagccccaacagcagctgcagcccccttcacctgcaccccccaaccacgtggtcaccactatcgagaacttaccagccgagggctcaggcggaggggggtctttgtcagccagtagccgagcaggagtccggcagcggattaggaaggtcttgaaccgcgagatgctcatctccgtcgccttgggtcaggtgttgtccctcttgatctgcggcatcgggctgaccagtaagtatctgagtgaagacttccatgcaaatacccctgtcttccagtcatttctcaattatattctgttgtttcttgtctatacaacaacacttgcagtccgacagggggaagagaacctgctggccatcttacggcgccgctggtggaagtacatgattttaggcctgatcgacctggaggctaactaccttgtggtgaaggcatatcagtatacaacccttacttctatccaactgctggactgcttcgtgattccagttgtcattttactgtcctggtttttcctgctgatcagatataaggcagtacacttcatcgggattgtggtctgcatattggggatgggctgcatggtcggggcagatgtgttagtgggaaggcaccagggcgccggagagaacaagctggtgggcgatctcctagtgctcgggggggctaccctgtatggcatttccaacgtttgggaggagtacatcatccgcactttgtcaagagtggagttcttgggaatgattggtcttttcggagcattcttcagcgggattcagctggcaattatggaacataaagagctgttgaaggtaccgtgggattggcaaatcggcctactttacgtgggttttagtgcctgtatgtttggactgtattcatttatgcctgtggtcataaagaagacctccgcgacaagtgtgaacttatccctactcaccgccgatttgtactccctgttttgcggcctttttctgtttcactacaagttctcaggattgtatctgctgtccttctttaccatactgatcggcctcgtgctgtattcttctacgagcacctatattgctcaggatccccgggtgtacaaacagttccgaaacccctccggcccagtggtggatttgcccacgacagctcaggtggaaccatccgtcacttacacgtccctgggacaagaaaccgaagaggaaccacacgttagggtggcttag

SEQ ID NO: 30262 - DNA, 681 bp, Artificial Sequence
  Description of Artificial Sequence: Synthetic coding sequence
atggcgctgtcctggttcattttgcacgcgaggtatagagttatccatttcattgcagtggcagtgtgtttgctgggagttggcactatggtgggagcagatatcttagcagggagggaagacaactctggaagcgatgttctgatcggggacatccttgttttgctgggagcctccctgtatgccatttccaacgtgtgcgaagagtatatcgttaaaaagttgtccagacaggaattcctaggtatggtaggtctcttcgggaccatcattagtgggatccagctgctcatcgtggaatataaagatattgctagcattcactgggactggaagattgcactgctgtttgttgcattcgccctctgcatgttctgtttgtacagttttatgccactggtaatcaaggtgacgtccgccacaagcgtcaacctggggattctcaccgccgacctttattccttgttcgtagggctgttcctttttggctataaattctccgggctgtatattttgtcattcaccgtcataatggttgggttcatcctgtattgcagtacaccaaccagaaccgccgaacccgccgaaagcagcgtgccacctgttacctccattgggattgataacctcggactcaaactcgaggaaaacctgcaggaaacccactcagcggtgctttag

SEQ ID NO: 30263 - DNA, 984 bp, Artificial Sequence
  Description of Artificial Sequence: Synthetic coding sequence
atgctgtccctctgcatttgtgggaccgctatcactagtcagtatctggctgagagatacaaggtcaacactcctatgcttcagagctttattaactactgtcttctcttcctgatctacacagtcatgcttgctttcaggtctgggagcgacaacctcctggtgattctgaagagaaagtggtggaagtacattctgctggggctcgccgacgtggaggctaactatgtgatcgtgagagcttaccagtacacaactctaactagcgtccaactcctggactgcttcggtatccccgtgctcatggccctgtcctggttcattttacacgccaggtacagagttatccatttcattgcagtcgctgtttgcctgcttggggtgggcacaatggtgggagctgacatcttggccggacgggaagataactccgggtctgacgtcctgatcggagatattttggttctgcttggggcgtccttatatgctatttccaacgtctgcgaagagtacattgtcaagaagctatccagacaggagttcctcggcatggtgggactgttcgggaccataatttcaggtattcagctcctgattgtggagtataaggatatcgccagcattcactgggattggaagatcgcccttttgttcgtggcctttgctttgtgcatgttttgcctttactctttcatgccactcgtcatcaaagtgacatccgcaacctctgtgaatctggggatcctgaccgctgacctgtactctctgttcgttggcctctttctgtttgggtataagttcagtggcctgtacattctgagttttaccgtgataatggttggctttatcctgtattgtagtacccccacgcgtacggccgagccagctgagagttctgtaccgcctgtcaccagcatcgggatcgacaatctgggactgaaacttgaggaaaacctccaagaaacacacagtgcggtgctatag

SEQ ID NO: 30264 - DNA, 1125 bp, Artificial Sequence
  Description of Artificial Sequence: Synthetic coding sequence
atggaggccgattcacccgccggcccaggagcccccgagccacttgccgagggggccgccgcggagttttcttcgcttctgagacgcattaagggcaaactgttcacttggaacatactgaaaaccattgccctgggtcaaatgctgtccctgtgcatctgtgggacagctattacgtcacagtatctggctgagaggtacaaagtgaacacccccatgctgcaaagttttatcaattactgcttattgtttttaatttacaccgtgatgctggccttccgatctgggtcagacaacctcctggttattttgaagagaaagtggtggaagtatattctcctgggactcgccgacgttgaggctaattatgtaatcgtgagagcctaccagtataccacactcactagcgtgcagctgctcgattgtttcggaattccagttctcatggctcttagctggtttatcctgcacgcccgttacagagtaatacactttatcgcagtcgccgtctgcttactgggtgtcggaaccatggtcggagcggatatcctggctggtagggaggacaacagtgggtccgacgtcttgattggcgacattctggttctcctgggcgcctctctgtacgctatctcaaacgtttgcgaggaatatatcgtaaaaaaactgagcaggcaggagttcctcggaatggtcggcctttttggcaccattatttcagggatccaactgctgatcgttgaatataaggatatagcgtcaatacactgggactggaaaattgctctgttgttcgtggccttcgcgttatgtatgttctgtctttactcattcatgcccctggtgattaaagtgacaagcgccacctctgtcaatctgggaattctgaccgctgacctgtactctctctttgtgggtctgttcttgtttggttataaattctctggtttatatatcctgtcattcacggtgatcatggtgggtttcatcctttattgcagcactccaacccggacggcagaacctgctgaaagcagtgtcccacccgtcacctccataggaatcgataacctcggcctgaaactggaagagaatctccaggaaacacacagcgccgtgctgtag

SEQ ID NO: 30265 - DNA, 1074 bp, Artificial Sequence
  Description of Artificial Sequence: Synthetic coding sequence
atggaggccgattccccagcaggcccaggtgccccagagcctttagcggagggggccgccgccgagttcagcagcctgctacggcgtataaagggcaaactgttcacttggaacattctgaagaccatcgccctgggccaaatgcttagcttatgcatttgcggcacggccattaccagccaatatctcgctgagaggtacaaggtgaacactcccatgctgcaatcgttcattaattattgtctgctttttctgatctatacagtgatgctggcttttcgcagcggatcagacaatctattagtgatccttaaaagaaagtggtggaagtatatcttactcgggctggctgacgtagaggcaaactacgttatcgtgcgtgcatatcagtacacaactctgacatcggttcagctgttagattgctttggcatcccggtcctcatggccctctcgtggtttattctacatgcaagatatagggttatccatttcatagccgtggctgtatgtctgttgggcgtggggaccatggtcggcgcagatatactggcaggacgcgaagataattccggctcagatgttttgattggagatatattagtgcttttgggggcgagcttgtacgctattagcaatgtttgcgaagaatatatcgtgaaaaaattatcgagacaggaatttcttggaatggtcggcctgttcgggactattatcagtggcattcagttactcatcgtggaatacaaggacatagctagtattcattgggactggaagattgctctgctgttcgtcgctttcgcactgtgcatgttctgcctgtattcgttcatgcccctggtcatcaaggtcacgagcgctacaagtgtaaaccttggtatactcaccgcagacttgtatagtctgttcgtcggcctctttctgttcggttacaaagattcaacatcgtgtccgtctttatcctcatggtggggattatcgtgcactgcgcccccactcctggcgcgcccctcacgcctcaaggcagcatgtctccaatctcctgccctcggactgacaacatggggctag

SEQ ID NO: 30266 - DNA, 1125 bp, Artificial Sequence
  Description of Artificial Sequence: Synthetic coding sequence
atggaggcagactctccagcagggccaggtgcccctgagcccctcgctgagggagccgctgccgagttcagctcacttttgcggaggattaaggggaaattgtttacatggaacatactgaaaaccatagctcttggccagatgcttagcctgtgcatctgcgggaccgcgatcacatctcagtatctcgccgaacggtacaaggtgaatacgcctatgctgcagtcttttataaactattgcctgctgtttttgatatacaccgtgatgttagccttcagatccgggtcagacaatctcctggtcattctgaagaggaaatggtggaaatatattctccttgggctcgccgacgtggaagccaactacgtcatagtgcgggcatatcagtatacaacacttacctctgtacagcttctcgattgctttggaatacccgtgcttatggccctgtcgtggttcatccttcatgccagataccgcgtcatccacttcattgctgtggccgtctgtctgctcggtgttggcacaatggtgggagccgacattttggctggacgcgaggataattcaggcagtgatgtactcatcggtgacatcctggtactgctgggcgcaagcttgtacgccatcagcaatgtatgtgaagaatacattgtgaaaaaactgtccaggcaggaattcctcgggatggtggggcttttcggaaccatcatctctggcatccaactgctgattgtggagtataaggacatagcctcgatacattgggactggaaaatcgctctgctgtttgtcgcctttgccctgtgtatgttttgtctctactcctttatgcccctggtcattaaagttaccagtgccacttcagtgaatttgggcatcctcactgccgatttatattcattgttcgtggggctgtttctcttcggatacaagttttctggcctctatattctgagctttacagtcatcatggtcggctttattctgtattgttccacccccacaaggaccgccgagcccgctgaatcatccgttccccctgtgacttccatcggaatagacaaccttggacttaagctagaggagaacctgcaagagacacacagcgccgtgctctag

SEQ ID NO: 30267 - DNA, 1266 bp, Artificial Sequence
  Description of Artificial Sequence: Synthetic coding sequence
atgaaaaaacattccgcccgagtggctcccttgagcgcttgtaatagccccgtgcttactctcactaaagtggaaggagaggaaagaccccgcgacagtcccggtcccgccgaggctcaggcccctgccggagtggaggccggcggacgggcctcccgtcgatgctggacctgtagtagagcacagctgaagaagatcttttggggtgtggccgtggtcctctgcgtctgctctagttgggcaggatcaactcagttggcaaagctcacttttcggaagtttgatgcaccctttacactaacgtggttcgctactaattggaatttcctctttttccccttgtactatgtgggccatgtttgtaaaagtaccgagaagcaaagcgtaaaacagcggtatcgggagtgttgtcgatttttcggggacaacggactaactctgaaagtgtttttcacaaaagccgctccttttggagtcttatggacattaactaattatctgtatctccatgctattaagaaaattaataccacggatgtctccgtgctgttttgttgtaataaggcatttgtttttctgctgtcctggatcgttctccgagatcgcttcatgggggttcgtatcgttgctgccatactcgcaatcgccggtatcgtaatgatgacttatgctgacggttttcactcccactccgtgatcggcatcgctttggtcgtagcatccgccagtatgtccgccctgtacaaggtcctcttcaagcttcttctcggcagcgcaaagtttggagaggctgccttgttcctgagcatcctgggtgtgtttaatatcttgtttataacatgcatcccaatcatcctttactttactaaagtcgaatattggtcatcttttgacgacataccttgggggaacctctgcggattcagcgtcctgctgctgacatttaacatcgtactgaattttgggattgctgtaacttaccccacgcttatgagtttgggcatcgtgctgagcatacccgttaacgccgttatagaccactacacgagccagatcgttttcaatggcgttagggtcatcgccattatcattatcggactcgggttcctgctgttgctccttcccgaagagtgggacgtatggctcatcaaattgctcacacgcctcaaagttcggaaaaaagaggaacctgccgagggtgcggcagacctgagttcgggcccacaatctaagaacaggcgggctcgcccatccttcgccagatag

SEQ ID NO: 30268 - DNA, 1473 bp, Artificial Sequence
  Description of Artificial Sequence: Synthetic coding sequence
atgggtatccgtgaatttccgagcggggctccaaggggcaagagcattgccgtggggatgcggcgcagccctgacgtctctccgaggagactctctgatattagcccacaactccgccagctgaaatacctcgtggtggatgaggctatcaaggaagacctaaagtggtccaggagcgtcgaagacctgacctctggccccgtgggcctgacaagtatcgaggaaaggattctgaggatcaccgggtactacgggtaccagccctgggctgcatcttgtaaacgggaggaacgccctcgggactcccctgggcctgctgaggcccaagccccagcaggggtggaggcgggcggccgagcatctcgcagatgttggacttgctcgagagcccaactcaaaaagattttctggggggtggccgtggtgctgtgcgtctgttcgtcatgggcaggatctactcagctcgccaagttaaccttcagaaagtttgacgccccctttacactcacttggtttgctactaattggaactttctgttctttcccctgtactatgtgggacacgtttgtaaatctacagagaagcaatccgttaagcagcgctatcgggagtgttgtcggttctttggcgacaacggactcacccttaaggtgtttttcacaaaagctgccccttttggagtcctgtggaccctcacgaattatttataccttcatgccataaaaaaaattaatacaactgatgtgagcgttctgttctgctgcaataaagcgttcgtattccttctgtcctggatagttcttcgcgacagattcatgggagtcagaatcgttgcagccatcctcgccattgcaggaatcgtaatgatgacgtatgccgatggattccactctcattcagtcattggtatcgcgctggtggttgcctcagcgagcatgtcggcgctgtataaggtactgttcaaactcctgctcggctccgcaaaattcggcgaagccgccctgtttttgagtatactgggcgtgtttaacattctcttcattacttgcatacccatcatactgtactttactaaggtagagtattggtcttcctttgatgacattccttgggggaacttgtgtggctttagtgttctgttgctgacgttcaacattgtgcttaacttcggaatagcagtcacgtaccctacattgatgtccttgggaattgtcctatcaattcccgtgaatgccgtcatcgatcattacacttcgcaaatcgtgttcaatggcgtcagagtgatcgcaatcatcattatcggactggggttcctgctgctgctgctgccagaggagtgggacgtttggctgattaaactgctgacgcgcttgaaggtcaggaaaaaagaggaaccggcagaaggcgcagccgacctgtctagcggcccccagagcaagaatcgacgggcaagaccttcctttgctagatag

SEQ ID NO: 30269 - DNA, 1566 bp, Artificial Sequence
  Description of Artificial Sequence: Synthetic coding sequence
atggacgagctactgcttgatctatttcacaagctaactagtgggagacagctggctgcaggaaatggtctctgcggtatttcgcataaagagcaggaagtgtggaagccgggccacaacatccttgtaaaaatgcgtaaggaggataaatcattagtctggctgatccatagtacgctggcccgttatacccaggttactaactttctgggtacctctagaagctctgttacaaggtgtaaacccggtgccaattgcccttctagtcacagcgggattagcaggcaactgagccctttgtctgtgactgaagattcctcagcccctatacttgagttgcagaaccaagggtcctctggcgtttgtgggcaccgggtggagagacagaatcgtagcgcagacgacggaacacaaacccactcggagaactccagtcaggaaaacaggatcaaggcccgatgtctcagctgcacatcaatggtgctgaaaggcatttgggggttgctgattattctatccgtctctagctcttgggtcggcaccacacagattgtgaagataacctacaagaatttctactgccccttttttatgacatggttcagcactaactggaacattatgttcttccccgtttactattccggtcatctcgccactgcacaggagaaacagagccccatgaagaaattcagagaatgctcaagaatctttggggaggatggcttaacattgaaactttttttgaaacgcaccgcaccgtttagtatactttggactctgacaaactacctatatttgctggcactgaaaaagttaaccgccactgatgtttctgccctcttctgctgtaacaaggcgtttgtgttccttctgtcgtggatcgtgctcaaggaccgattcatgggtgttcgtatagttgccgcaatcatggcgatcactgggatcgtcatgatggcctacgcagataacttccacgccgatagcattatcggggtggcattcgcggtcgggtctgcttcgacctccgcactgtacaaagtgctctttaaaatgttcctgggcagtgcgaatttcggggaagccgctcatttcgtaagcacgttgggcttctttaatctcatcttcattagcttcacaccggtcatcttatactttacaaaagtggagcactggagtagttttgcggcgctgccttggggttgtttatgcggaatggccgggttgtggctcgcttttaacattcttgttaatgtgggcgtggtgctcacgtacccgatcctaatttccattggaacggtgctcagcgtacccggtaatgccgcagtcgatctcttgaagcaagaggttatctttaacgtggtgcgtctggcggcgaccataattatatgcatcggctttctgctcatgctgcttcccgaagaatgggacgagatcacactgcgctttataaacagcctgaaggaaaagaaaagtgaagaacacgtggacgacgtgacggaccccagcattcaccttcgggggcgtggtagggccaacgggaccgttagcattcccttggcctag

SEQ ID NO: 30270 - DNA, 1572 bp, Artificial Sequence
  Description of Artificial Sequence: Synthetic coding sequence
atggtgccacccaggcggcatagaggtgctggtaggcctggcgtgctaagttcatctccgccattcaggcttcgcagtgccaaattttctggtatcgcactggaagatcttcgccgagctctgaagactaggttacagatggtctgcgtgtttgtcatgaaccggatgaactctcaaaactccggattcacgcagcgacggcgcatggcactagggattgttatcttgctgttggtggatgtgatttgggtggcatcttcagaactgacatcctatgtgttcactcagtataacaagccatttttctccacattcgccaagacaagcatgtttgtgctttatctgctgggctttatcatctggaagccctggcgacagcagtgcacacgtggtctgaggggcaaacatgccgccttctttgccgacgccgaggggtattttgcggcttgcacaacagatacgactatgaactccagtctttccgaacctctgtacgtgcccgtgaaattccatgatctccctagtgagaagcccgagagcacaaacatcgataccgagaaaactcctaagaaatcacgggttagattctctaatatcatggagattcggcagctccccagcagtcacgccctggaggcgaaactgagtcgcatgtcctatccggtgaaagagcaggaaagtattcttaaaacggtagggaagctcactgccacgcaggttgcgaagatctccttcttcttctgctttgtttggtttttggcgaatctgagctaccaagaggcactttccgatacccaagtggccatcgtcaatatcttgagctctaccagcggcctgttcacgttaatcttggctgccgtgttccctagtaactccggtgatcgattcacgctgagtaaactgctggccgtcatcctgtccattggaggggtagtactggtgaatctggccgggagcgaaaaaccggcgggcagggataccgtgggctcaatatggtctctcgcaggagcaatgctgtatgcagtctatatagttatgatcaagagaaaagtggatcgggaagataagctcgacattccgatgttctttggctttgttggtctattcaacctcttactgttgtggccagggtttttcctcctgcattataccggctttgaggactttgagtttccgaacaaagtggtgctaatgtgcattattattaatgggctgatcggaacagtcttgtccgagttcttgtggctatggggatgctttcttacttctagcctaatcggcacattagcactcagtctcaccattcccctgtccattatagcggatatgtgcatgcaaaaggtacaatttagctggctcttcttcgctggcgccatccctgtttttttcagcttctttatcgtcacattactgtgtcactataataactgggatcctgtgatggtgggcatcaggagaattttcgctttcatctgccgaaaacaccgcatccagcgggtgccggaggactccgaacagtgtgagagccttataagtatgcactctgtcagccaggaggacggagcaagttag

SEQ ID NO: 30271 - DNA, 1554 bp, Artificial Sequence
  Description of Artificial Sequence: Synthetic coding sequence
atggactcctcaggatggcggggagtgttatcttcatcgcccccctttaggctgcgctctgccaaattcagcggcattgcactcgaggatcttcgacgcgccctgaaaactagattgcagatggtgtgtgtattcgtaatgaaccgaatgaactctcagaacagcgggttcacacagcggcgcaggatggccctgggcattgtgattttgttattggtggacgtgatctgggtagcatcgtctgagctgacatcctacgtgttcactcagtataacaagcctttcttctccacttttgcgaaaacttctatgtttgtcttataccttctgggcttcattatatggaaaccttggcgacagcaatgcactagaggcctccgcgggaagcatgccgccttcttcgccgatgccgaagggtactttgccgcctgcacaacagatacaacaatgaactcgagcctttcggagcccctgtatgtccccgtcaaattccacgacctacctagtgaaaaaccagaatcaacaaatattgacaccgagaagactccaaagaaatcccgggtgcgtttttcaaatatcatggaaattcggcagctgccgagcagccatgccctcgaggccaagttaagccggatgtcatatccggtcaaggaacaagaaagcattctcaaaaccgtagggaaattaactgccacccaggtggccaagataagcttctttttctgtttcgtgtggtttctggccaatctgtcctaccaggaagcccttagtgatactcaggttgcgatcgtgaatattctgtcttcgacttctggacttttcactctgattttagccgctgtattcccaagcaacagcggagacaggtttaccctgtctaagctcctggccgtaatactgtcgatcgggggtgtcgtgctggtgaatctggccggctcagagaagccggccggccgggacacggtcggaagtatatggtctctcgcaggagcaatgctctatgctgtctacatcgtgatgattaagaggaaagtcgatcgggaagataaactcgacatccccatgttttttggctttgttggtctgtttaatctcctcctgctttggccaggtttttttctgctccattacaccgggttcgaggattttgagttccctaacaaagtggtactgatgtgtattattatcaacgggctgattggcaccgtgctgagcgagtttttgtggttatggggttgttttttaacgtccagtctgattggaaccttggctctctctttgacgattccattgagcatcattgccgatatgtgcatgcaaaaggtgcaattctcctggctgttcttcgcaggcgcaatccccgtgttcttttctttctttatcgtcaccctcttatgccactacaataactgggatccagtgatggtcggtatccgacgcattttcgccttcatttgcaggaagcacagaatacagcgtgtgccagaggacagcgagcaatgcgagtccctgatctctatgcattcagtgtctcaggaagacggggctagctag

SEQ ID NO: 30272 - DNA, 1095 bp, Artificial Sequence
  Description of Artificial Sequence: Synthetic coding sequence
atgaggcctcaggatagcacaggagtggcagagcttcaggagccaggccttcctctaacagacgacgccccgccgggcgcgacggaggagcctgctgctgcagaggctgcgggggcacctgaccgcggccgctgttggttgtgcctgtcatcaccatgttgcagcaggaccgagcccgcaaagaaaaaggccccatgtccagggctgggcctcttctataccctactgtcagcttttctgttttcggtaggttccttgttcgtaaagaaggtgcaagatgtccatgcagtggagatcagtgcgttcaggtgcgtctttcagatgctcgtggtgattccctgtctgatctacagaaagaccggctttatcggaccaaaaggccagcggatctttcttatactccgaggagtcctggggtctaccgcgatgatgctgatatattatgcataccaaaccatgtcactggctgatgccaccgtgataacgttctcatcgccagtctttacgtctatctttgcatggatctgccttaaggagaagtattctccttgggacgcactgtttaccgttttcactatcaccggtgttattctgattgtgagaccacctttcttgttcggctccgacaccagcgggatggaagaatcttacagcggacacttgaaaggaactttcgcagctatcggctccgcagtcttcgccgcttccacactggtgatcctgcgtaagatgggaaagagcgttgattacttcctgtcaatctggtactatgtggtcctcggattagttgagagcgttatcattctgtctgttctgggggagtggtccctgccctactgtggactagatcggctctttcttattttcatcgggctgttcggacttggcggacagatcttcataactaaggctttgcagatcgaaaaggccggaccggtggcgataatgaagaccatggatgtagtattcgctttcatatttcagatcatttttttcaataatgtgccaacttggtggacagttggcggggcactctgtgtcgttgcctctaatgtgggggctgccattaggaaatggtaccagagttcaaagtag

SEQ ID NO: 30273 - DNA, 1098 bp, Artificial Sequence
  Description of Artificial Sequence: Synthetic coding sequence
atgcgaccacaggattcgaccggtgtggctgaattgcaggagcccggcctgcctctgacagacgatgcacctcctggcgctactgaagaaccagccgctgccgaggcagccggggcaccagacagaggacgttgctggctttgtctcagcagcccgtgctgttctcgaacagagcctgaggccaagaaaaaggcaccatgtcccgggctgggcctgttttatacgctactttccgcattcctgtttagtgtcgggtccctgttcgtcaaaaaagtccaggatgtccacgctgtggagatttccgcatttaggtgcgttttccagatgctggttgttatcccctgcctcatctaccgcaaaacaggcttcatcggtcccaagggtcaacggatcttcctaatattgcggggggttctggggtccactgcaatgatgttgatttactacgcctatcaaaccatgagtcttgccgatgcaactgttattacattttccagcccagtgttcacttcaattttcgcctggatttgccttaaggagaaatacagcccatgggacgccctgtttaccgtgtttaccatcaccggagtgatcctgattgtcagaccccctttcctgttcggatccgacaccagcggcatggaagagtcatattctgggcacttgaaggggacctttgctgcaatcggcagtgctgtgtttgcagctagcaccctagtgattcttaggaagatgggaaagtcagtggactatttcttgtctatttggtactacgtagttctcggattggttgagagcgtaatcatcctctcagtgcttggggagtggtccctcccatattgcggcctcgaccgcttgtttctcatcttcattggtctgttcggccttggtgggcagatcttcatcacgaaggcgctgcaaatcgaaaaggctggaccagtggctataatgaagacaatggatgtggtgtttgcatttatttttcagataatctttttcaataacgtgccaacatggtggactgtcggcggggcgctgtgtgtggtcgcgagcaacgtgggcgccgcaatccgaaaatggtatcagtccagcaaatag

SEQ ID NO: 30274 - DNA, 1017 bp, Artificial Sequence
  Description of Artificial Sequence: Synthetic coding sequence
atggccggctctcacccctactttaaccagcctgattctacacaccctagtcccccttcagcccctccaagcttgcggtggtatcagcgatgccaaccttcggacgctacttcaggcctgcttgtcgccttgctgggaggaggcttgcctgccgggtttgttggccctctatcccggatggcttaccaagcctctaatctgccctctttagaacttctaatttggaggtgtttgttccatctgcctattgcactgctgttaaagcttaggggcgatccgctcctcggaaccccagatatcaggtcacgcgccttcttctgcgcactgctgaacatactctccataggttgtgcttatagcgccgtacaggtggtgccagccggcaacgcagctaccgtgcgcaagggcagcagcactgtctgcagcgctgtcttgaccttatgcctggaatcccagggtcttagcgggtacgactggtgtggtctcttgggctgtattttgggactcatcattatagtcggccccggcttatggacgttacaggagggcacaaccggagtgtacacagcccttggatacgtggaagctttcctgggcggattggcgttgtcattacgcttgctggtttatcgcagtctacacttccctccatgcctgcctacagtggctttcctgtctgggctggtaggtctcctgggaagtgtccccggtttgttcgttctgcaggccccagtgcttccctctgacttgctgtcctggtcttgcgtgggagctgtgggtatcctcgctcttgtgagctttacctgcgtgggttacgctgttacaaaggcacacccagcccttgtctgtgccgtgcttcattctgaagtagtggttgcactcatcctccagtactacatgctgcacgagactgtggccccaagtgacattgtggccgccggcgtcgtgctgggatccattgccatcattacagcgcagaacctttcttgtgagcggacaggtagggttgaggaatag

SEQ ID NO: 30275 - DNA, 1017 bp, Artificial Sequence
  Description of Artificial Sequence: Synthetic coding sequence
atggcgggctctcacccctactttaacctgcccgactctactcacccttctcctccctccgcgccaccctctctgcgatggcatcagcgttgtcaacccagcggcgctaccaatgggcttttggttgcactattgggaggtgggttgcctgcgggcttcgtcggcccgctgtcacgcatggcctatcagggaagcaatttaccttcacttgaactgctgatctgtagatgtctgtttcacctccctatcgcccttctactgaaactgcgtggcgaccccttgctgggcccacctgatattagaggctgggcatgtttctgtgcacttctcaacgtgctgagcattggctgtgcgtattctgccgtgcaggtggtgccagccggaaatgccgcaacagtcagaaaggggtcatccacagtatgttcagcggttctgactttatgcctggaatcccaggggttgggcgggtatgagtggtgcggcctgttggggtcgattctgggcctgatcataatactgggtcccggactgtggaccctacaagaaggcacaactggggtgtataccaccctggggtacgtccaggccttcctcggaggactggccctgtcattggggttactggtttatcgctcgttacactttccatcatgcctcccgactgttgccttcctgtctggcctggttggtctgctggggtgtgtaccagggttattcgtcttacaaacccctgtgctcccaagtgacctgctgagctggtcctgtgtcggagccgagggtatcctcgctctagtgtccttcacttgtgtgggctacgcggtaactaaggctcaccccgcactggtatgcgctgtactccattccgaggtggttgttgcactgattttgcagtactatatgcttcacgagacagtggcactgtcagatatcatgggagcaggagttgtgcttggctccatcgcaatcataacagcgagaaacctgtcatgtgagcgcacaggaaaagtcgaagaatag

SEQ ID NO: 30276 - DNA, 1158 bp, Artificial Sequence
  Description of Artificial Sequence: Synthetic coding sequence
atgaggagcagtcttgcacctggcgtatggttctttagagcttttagtcgtgactcctggttccgcggacttatcctcttactaacatttcttatatatgcctgttaccacatgtcccgtaagccgatctccatcgtcaaatcacgcttgcatcagaactgcagcgagcagatcaaaccgattaatgacacccactctctgaatgatacgatgtggtgcagctgggccccgttcgacaaggataactataaggaattgttgggcggagtggataacgcgtttctcattgcgtatgccatcggaatgttcatctcaggggtgtttggagagaggttacccctccgctattacctgtctgcagggatgctgctctctgggctgttcacaagcctgttcgggctgggttacttttggaacatccatgaactctggtattttgtggttatccaggtgtgtaacggcttggtacagaccaccggatggcctagcgtggtcacatgtgtgggcaactggtttggaaaggggaagagaggtttcatcatgggaatttggaactcccacacatccgttggcaatatactggggtccctcatcgcaggtatttgggtcaacggccagtgggggctgtctttcattgtccctggcatcataacagccgtgatgggggttatcacctttttattcctgatcgaacatcccgaggacgtggactgtgctccaccccagcaccacggggagccggccgaaaaccaggacaaccctgaggaccccggtaacagcccttgttcaattagagagtcaggcctagagactgtggccaagtgctcaaagggtccttgtgaggagcctgccgcaattagctttttcggtgctctgcggattccgggggtggtggaatttagcctgtgcttgctgttcgccaagctggttagctatacgtttctgtattggctcccactttatattgcaaatgtggctcatttcagcgccaaagaggcaggggatttgagcactctgtttgatgttggcggtatcatcgatgtacccgttcagcttcactggcccgggagggactgtcagctacactctgacgccgatcatctgtggggcccaggccaatggccgatccgggctcaccatcattgttgtctttgctag

SEQ ID NO: 30277 - DNA, 1518 bp, Artificial Sequence
  Description of Artificial Sequence: Synthetic coding sequence
atgcgctcgagcttagcaccgggggtatggttttttcgcgcctttagcagagacagctggttccgcggtcttatcctccttctgactttcctcatctatgcgtgctaccacatgtctaggaagcctatttcaattgtcaagagcagacttcaccagaactgcagcgagcagattaagcccatcaatgacacacactcgttgaacgatacaatgtggtgttcatgggcacctttcgataaagacaattataaggaactgcttgggggggtcgacaatgcatttctgatcgcgtacgccataggcatgtttatctccggcgtctttggagagcgcttgccgctcaggtactatctcagcgccgggatgttactgtccggtctgttcacaagtctgtttggcctgggatatttctggaatatacacgaactctggtacttcgtcgttatccaggtatgcaacggcttagtccagaccaccggatggccttcagtcgtgacatgcgtgggcaattggttcggcaaagggaaaaggggatttattatggggatttggaatagccacaccagtgtgggaaatatcctggggtccctgatcgccggaatatgggtcaacggacagtggggcctatcattcattgtccccggtatcatcaccgccgtcatgggtgtcattacttttctgtttttgattgaacacccggaggacgtggactgcgcccccccccagcatcatggtgagccagctgagaatcaggataatccggaagaccctgggaactcaccctgctcaatcagagagagcgggctggaaaccgtggctaaatgtagcaaaggcccatgcgaagaacccgctgcaatctcgttctttggcgcgctacggattcccggggtggtggaattcagcctgtgtcttctcttcgcaaaactggtttcctacaccttcctctactggctgccactctatattgccaacgtggcccatttcagcgccaaggaagctggggatttaagcactctgtttgacgtgggcggcatcattggcggaatcgtggctgggctagtgagcgactataccaatgggcgcgcgacaacatgctgtgttatgttaatacttgccgccccaatgatgtttctgtataattatatcggccaagacggcatcgcaagcagcattgtcatgctaatcatctgcggcgggctagtgaacgggccttatgccttgatcactactgccgtttccgcggatctgggaactcacaaaagtctgaagggcaacgccaaggctctgagcactgtgacggcgattattgatggcaccggctcaatcggcgccgctttagggccccttctcgcaggactgatttcccccaccggctggaataatgtgttttatatgctgatatcagctgatgtgctggcttgtctactgctctgcagactggtatataaggaaattttagcgtggaaggtcagcctctcaaggggatcgggcagctctatggtcctaacccatcaatag

SEQ ID NO: 30278 - DNA, 1506 bp, Artificial Sequence
  Description of Artificial Sequence: Synthetic coding sequence
atgcgttcgtcactagccccaggagtgtggttcttccgcgccttcagtcgagacagctggttccgaggattgattctcctgttgacatttctcatctacgcctgctatcatatgagccgcaagcctatctcaattgtgaagtccaggctgcaccagaactgcagtgaacagattaaacctataaatgatacacacagtttgaacgatacaatgtggtgttcctgggccccatttgacaaggataactacaaggagctacttggtggggttgacaacgcatttctgattgcttatgccattggcatgtttatttccggcgtcttcggagagcgcttgccactccgctactacttatccgccgggatgttgctgagcgggctgttcacatcactgtttggcctcggctacttttggaacatccacgagctgtggtatttcgtcgtgattcaagtctgcaacggacttgtccagacgacagggtggcccagcgtggttacatgtgttggcaattggtttggcaaaggtaaaagaggatttataatggggatctggaattcccacacatccgtgggcaacatcctggggtcccttatcgctggtatctgggtaaacggccagtgggggctgagcttcatcgttccgggcattattactgctgtgatgggcgtcatcacatttctcttcctgatcgaacaccccgaggatgtcgattgtgcacctccacagcaccatggggagccagctgaaaatcaggataatccggaggaccccggtaattcaccgtgcagtattagagaatccgggctggagaccgttgcaaaatgtagtaaagggccctgcgaggaaccagccgcaattagtttctttggggccctgaggataccaggggttgtggaattctctctctgtctgttgttcgctaagcttgtgtcctatacatttctctattggcttccactatatatagccaacgttgctcacttctcggctaaggaggccggggacttgagcacattattcgatgttggtgggatcattggcgggatcgtcgccggcctggtgtcggattacaccaatggccgcgctaccacatgctgcgtgatgctgattttagccgccccaatgatgttcctctacaattacataggccaggatgggattgcttcgagcattgttatgctcatcatttgtggaggccttgttaacgggccgtacgctttgataaccacagcagtgagtgccgatctgggcactcacaaatccctgaaaggaaacgctaaggcgctgagcaccgtgacggcaatcattgatgggacaggatcgatcggggctgctctaggcccactgctcgcagggctgatttcacctacggggtggaacaacgtgttctacatgttaatttctgccgatgttctggcttgtcttctgctttgccgactggtgtataaggaaattctggcatggaaggtgtccctgagccgaggttcaggatataaggaaatctag

SEQ ID NO: 30279 - DNA, 1518 bp, Artificial Sequence
  Description of Artificial Sequence: Synthetic coding sequence
atgaggagttctctggccccaggtgtctggtttttcagagctttttctcgggattcttggtttagggggttgatcttgttgctcacattccttatttatgcctgctaccacatgagtcgcaagcccattagcattgtaaagagccgacttcatcagaactgttctgagcaaattaaacctattaatgatacacacagtctcaacgatacaatgtggtgtagctgggccccctttgacaaggacaactataaggagctgctcggtggtgtagacaacgcgttcctcatcgcttatgcaattggcatgtttatatcaggcgtttttggagaacggctccccctgcggtactacctgagcgccggaatgctgctgagcggactcttcacctctcttttcggtcttggctacttctggaacattcatgaattgtggtacttcgtcgtgattcaggtgtgtaacggattggtgcagactaccggctggccgagcgtggttacatgcgtggggaattggtttggcaaaggcaagagaggctttattatgggtatatggaattcccatacatctgtggggaacatcctaggcagccttattgccggaatttgggtgaacgggcagtggggactatcttttatagtgccaggaatcatcacagcagttatgggtgtgataactttccttttcctcatcgagcatccagaagacgtggactgcgcccctccccagcaccacggggaacccgccgaaaaccaggacaaccccgaagatcccggaaattcaccttgtagcatccgtgagtcagggctggagaccgtagcaaaatgttcaaaaggtccctgcgaggagccggccgctatctcattctttggagcgctcagaattccaggggttgtggagttttctctctgcctcctgtttgccaagttagtctcgtacaccttcttgtattggctgcccctctacattgctaacgtggcacatttttcagccaaggaggccggagatctttccaccctgtttgatgtcggaggaatcattggtggcattgtggctggactggtttccgattatactaacggaagggctacaacatgttgcgtgatgctgattctagcggctccaatgatgttcttatataattatattggccaggatggtatagcaagtagtatagtaatgctcatcatatgcgggggtctggtgaacgggccgtacgcacttatcactactgcggtgtcagccgacctcggaacccataagtcgttaaaggggaatgctaaggctctgtccacggtgacagccatcatcgatggaaccggttctattggggcagctctggggcccttgctggctggcctcatctcaccaacggggtggaataatgtgttctacatgctgatttccgctgacgtgctggcatgcctgctgctgtgtcgacttgtgtacaaagagatcttagcttggaaagtgagcttgtcccggggaagtgggagttccatggtactcacccatcagtag

SEQ ID NO: 30280 - DNA, 1485 bp, Artificial Sequence
  Description of Artificial Sequence: Synthetic coding sequence
atggcctggcccaatgtgtttcaacgggggtcattgttgtcccaattctcccaccaccatgtcgtcgtgttcctgcttacgttcttctcatactccctcctgcacgcctctcgcaagacattcagcaacgtgaaggtttccatcagcgagcaatggacaccatcagcatttaatacctcagttgaattgccagttgagatatggtcttcaaaccatctgttcccaagtgctgagaaagcgacactgtttcttggaacccttgacaccattttcctcttttcttacgcagtagggttatttatttctggtatcgtcggggatcggttgaatttgaggtgggtgctgagcttcggtatgtgtagtagcgctctggtcgtgtttgtgttcggcgcacttaccgagtggctgcggttttataataagtggttgtattgctgtctctggattgtaaacggcctgctccaaagcaccgggtggccttgcgtggtagctgtaatgggcaactggttcggcaaggctggcaggggcgtggtatttggtctgtggagtgcctgtgccagcgtaggtaacattcttggtgcgtgtctggcctcttctgtgctgcagtacggctatgaatacgccttcctggtcacagcttcagtacagtttgccggcggtattgtgattttcttcgggctcctcgtgtctcccgaggaaatcggactaagcggcatcgaggcagaagagaacttcgaggaggattcccataggccactgatcaatggcggggagaatgaggacgagtacgagcctaactattctatccaggacgactcaagtgtggcgcaggtaaaagctatctctttctaccaggcatgctgtctacctggcgtcattccctacagcctggcctacgcttgtttaaagctcgtcaactactccttcttcttctggctccctttttacctcagcaacaatttcggctggaaggaagccgaagccgacaagctgtccatttggtatgacgttggaggaatcatcggcggcaccctccaaggttttatctcggatgtcctccagaagagagccccagtgctggcattgtctctgctcctcgctgtaggatccctcattggttattcacggtctccaaacgacaaaagcatcaatgctttgttgatgacagtcactgggttcttcatcggaggcccttccaatatgattagctctgcaatatccgctgacctggggcggcaggaactgattcagaggagcagcgaggcccttgccactgtcaccggcatcgtggacggctccggctccatcggggccgccgtaggacagtatctggtttctctaatcagagacaaactcgggtggatgtgggtgttctattttttcatccttatgacctcttgcacaatcgtatttataagtcccttaatagttagggagatcttcagcctcgttctgagacggcaggcacacatcctgagagagtag

SEQ ID NO: 30281 - DNA, 1332 bp, Artificial Sequence
  Description of Artificial Sequence: Synthetic coding sequence
atggcctggcctaacgttttccagagaggtagtctcctgtcacagttctctcaccaccacgtggttgttttcctgctaactttcttcagttatagccttcttcatgcctcaagaaaaacattctctaatgtaaaagtgtctattagcgaacaatggaccccgtcggctttcaacacttccgttgagctgcccgtggagatttggagttccaatcacctatttccctccgctgaaaaggctacactgttcctgggaactctggacactatatttctgttttcctacgcagtaggactgttcataagtggaattgtaggggaccggttgaatttgagatgggtcctatccttcgggatgtgttcatctgctctggtggtctttgtcttcggggccctgactgaatggctacgtttttacaataagtggctttattgttgtctgtggatcgtaaacggcctgctccagtccactgggtggccgtgcgtggtcgccgttatgggaaattggttcggtaaggctggcagaggggtggtattcggtctgtggagcgcttgtgcttctgttgggaatattcttggggcttgcctggcttcctccgtcctgcaatacggatacgagtacgcatttctggtaaccgcctctgtgcagtttgcaggcgggattgttatctttttcgggctgttagtgagccccgaagaaatcgggctatctggcatagaggcagaagaaaacttcgaggaggacagtcatcgcccactgatcaacggtggagagaatgaggacgagtatgagcccaattactcaatccaggatgatagttctgtagcacaggtgaaagccatatctttctaccaggcctgttgtctccccggcgttattccctactcactggcatatgcatgtctgaaactggtgaactactccttttttttttggctgcctttttatctgtctaataactttggctggaaggaagcagaggccgacaagctgagcatatggtacgatgtcggtggtattattgtatttagcgtgtcagatcctggccaggcccggatggatgtaggattcttgctcttccattcacatgataaactgtataattgcgtctatttggcaatcaactccgaaggaaacattctctctcgggccaaggagaccggatcccacatagagggggttaccggtgcacgtgagacagaacgaactatgtctgccacatcaggcccactggggctcagagtctgcccaaatttgggcctctcacgttctagctcgttaattctggattgccaggcctcattgaacaccgcctctcatctaaggtgttag

SEQ ID NO: 30282 - DNA, 471 bp, Artificial Sequence
  Description of Artificial Sequence: Synthetic coding sequence
atggcatggcccaatgtcttccagagggggagcctgctgagccagttctctcaccaccacgtggtggtgtttctactcaccttcttttcttattcattactccacgcatcgagaaagaccttcagcaacgttaaagtctcaatttcagagcagtggacaccgtctgcctttaatacgtctgtggagttgccggtagagatttggagcagcaaccacctgttcccatctgccgaaaaagcaaccctctttttaggcacacttgacacaatttttctcttcagttacgccgtggggctgttcattagtggcatcgtgggtgatagattaaatttgcggtgggttctgtctttcggcatgtgtagcagcgcactcgtgacaagaagttgcttttggtcgcttgaatgtttgtgtttcggtggccaacactttggatccgtgcccagttttttttgcagttcagtttggctgtag

SEQ ID NO: 30283 - DNA, 1437 bp, Artificial Sequence
  Description of Artificial Sequence: Synthetic coding sequence
atggcttggccaaatgtctttcagcgcggcagtcttctatctcagttcagtcatcatcacgttgtcgtgtttctgctcacgttttttagctactcccttctgcacgccagccggaaaacattctccaatgtgaaagtgtcaatatcagagcagtggaccccctcagctttcaacacatccgtagaactgcctgtggaaatttggagctcgaatcatctttttccatcagctgaaaaagccaccctgtttctcggtacactcgacactatctttctcttctcttacgcggtcggactttttatatccggtatcgtgggcgaccgtctgaatctgaggtgggtcctttcctttggcatgtgctcgtcagctctggtagtctttgtctttggggccctgacagagtggctacgcttctacaataagtggttatactgctgtctgtggatcgtgaatgggctcttgcaatcgacagggtggccgtgcgtcgtagcagttatgggaaactggtttggtaaagccgggagaggagtggtattcggcttatggtccgcttgcgcttcagtgggtaacatcctgggcgcctgcctcgcaagcagcgtactgcaatacggctatgagtacgcattcctggtaactgcctctgtgcagttcgccggtggaattgtgatctttttcggacttctggtgtcacctgaagagatcggacttagtggtattgaggctgaagaaaacttcgaagaggattcacataggcctcttatcaacggcggcgagaacgaggatgaatatgaaccaaattatagcattcaggacgacagctctgtcgcacaggtcaaggccatctccttctatcaggcgtgctgtctgccaggagttatcccctacagcctggcttacgcctgtcttaagctggtgaactactcattttttttctggttacccttctatctgtctaataacttcggctggaaagaggccgaggcagataagctgtcaatctggtatgacgtgggcggaataatcggggggaccctgcaaggcttcatttcggatgtactgcaaaagcgcgcgccagtcctggcgttgtccctcctcctcgccgtaggcagtctgatcgggtattcgcgctttttcattggaggaccaagcaacatgatatcatctgccattagcgctgatctgggacgccaggaacttatccagagaagcagtgaggccttagcaactgtgacgggaatcgtggacgggagcggttccatcggcgctgcagtcgggcaatatttggtcagcctgattcgcgataaactggggtggatgtgggtgttttatttctttatcctgatgactagctgcacaatcgtatttatttcccctctaatagtccgggaaatcttttctttggtgcttagacggcaggcgcacatcctccgggagtag

SEQ ID NO: 30284 - DNA, 45 bp, Artificial Sequence
  Description of Artificial Sequence: Synthetic coding sequence
atggcttggcctaatgtttttcagcggggctccctgttaagttag

SEQ ID NO: 30285 - DNA, 714 bp, Artificial Sequence
  Description of Artificial Sequence: Synthetic coding sequence
atggcctggcccaatgtcttccaacggggtagtttgctgtcccagttttctcaccaccatgtggtcgtgtttttgctaacatttttctcctacagtttgctacacgcgtccagaaagactttcagtaatgtgaaagtgtccatctcggagcagtggacaccatccgccttcaacaccagcgtggagctgcccgtggagatttggtctagcaaccacctcttccccagcgccgaaaaagccacccttttccttggaaccttggatactatctttctattcagctatgccgtgggtctgttcatctcaggtattgttggtgatcgattaaacctgcgctgggttctttccttcgggatgtgctcaagcgcactcgtggtgtttgtgttcggcgcactcacagagtggttgcggttctacaacaaatggctttattgttgcttgtggattgtgaatgggctgctgcagtccactggttggccgtgtgtcgtggccgtcatggggaactggtttggaaaagccggacggggcgtggttttcggcttatggtccgcttgtgcttccgtggggaacattttgggagcctgcttggcctcatccgtcttgcagtacgggtatgagtacgcatttttggtgactgcttcagtgcaatttgctgggggaattgtgattttctttggattgcttgtgtctcctgaggaaattggcaagctctag

SEQ ID NO: 30286 - DNA, 2343 bp, Artificial Sequence
  Description of Artificial Sequence: Synthetic coding sequence
atgacagctgctgcagcttcaaattgggggctcatcacgaacatcgtgaacagtattgtaggagtctctgtgctcaccatgcccttctgttttaaacaatgcggtatagtgctgggggccttactcttggttttttgtagctggatgacccatcaaagttgtatgtttcttgtgaaaagcgcaagcctctctaagaggcggacttatgccggcctggctttccacgcatacgggaaagcaggcaagatgctcgtggagacgagcatgatcggactcatgcttggcacatgcatcgccttttacgttgtgattggcgacctcggctctaatttctttgcccgtctgttcggcttccaggtgggagggacgttccggatgtttctgttgtttgccgtctccttgtgtatcgttctacccctgtccctccaacgaaacatgatggcctcaatccagtcgttctccgcaatggccctgctcttctacaccgtgtttatgttcgtcatagtgctttcttcactcaagcacggtcttttttctggacagtggctcagacgggtgtcttatgtcagatgggaaggggtgtttcggtgcattccgatatttgggatgtcattcgcctgtcaatctcaggtacttcccacctacgacagtctagatgaaccctctgtgaagaccatgtcaagcatcttcgcaagctctctcaatgtggtgactactttctacgtcatggtcggtttttttgggtatgtgtcttttacagaggctacggcgggtaacgtactcatgcatttcccaagcaaccttgtgactgaaatgctgcgggtgggattcatgatgtccgtggctgtcggattccccatgatgatactgccttgcagacaagcgttatcaactctgttgtgcgagcaacaacaaaaggatgggacctttgcagcgggtggttatatgcctcctctgcggtttaaggcactcaccctgtccgtggtgttcggaacaatggtggggggaattctgatacccaacgtggaaaccattcttggcttaacaggcgccactatgggctccctaatttgtttcatatgccctgcactgatctataaaaagattcataaaaatgctctgtcgagccaagtggtgctgtgggtggggcttggggttctcgtggtctcaaccgtcaccacgctgtctgtgtcagaggaggtgcccgaggatctagcagaggaagcccccggcgggagactgggtgaggccgaggggctgatgaaggtagaagccgcgcgactctctgcccaggatccggtggtggcagtagcggaggacggcagggagaagcctaaactgccaaaggagcgagaggagctggagcaggctcagatcaagggtcctgtggatgtgcccggcagagaggacggcaaggaggcccccgaagaggcacagctggatcggcccggccagggcatcgcggttccagtgggagaagcccaccgccatgagccacctgtcccccatgacaaagtcgtggtggatgaggggcaggatagggaagtccctgaggagaataagccaccgagccgacacgccggaggcaaagcaccaggcgtgcagggacaaatggcaccccctttgccagacagcgaacgggagaagcaggagcccgagcagggcgaagtgggaaaaagacctggacaagctcaggcattggaggaggctggcgacttacccgaggacccgcagaaggtgccggaggcagatgggcagcctgcggtccaacccgccaaggaagatttgggtcccggcgacagaggcctgcatcctagaccgcaagcagttcttagcgagcagcaaaatggactggccgtaggcgggggtgaaaaagccaagggcggaccccctccaggcaatgcggccggtgataccggccagccggccgaggactctgaccatggggggaagcccccgctgccggccgaaaagcctgcacctgggcccggactacctccggaaccacgcgagcaaagagacgtcgagcgcgcgggagggaatcaggcggcctcccagctggaaggcaaagccagtgccctccaaccgcccgcatctggacctggatccggatccccccttccccagccttggggggacgcccaggtgattctcggctcacccgcccggcccccgtttagtttccaaccccctgccgaacagactccacggcgggccttctgtagcttacctataagttctctgctctctggaaatttgttgtcagcactcctgcctttcaagcatttgcgccaccggcacatggcttgtgactacaggttcattagcctggctccgctttag

SEQ ID NO: 30287 - DNA, 3360 bp, Artificial Sequence
  Description of Artificial Sequence: Synthetic coding sequence
atgaccgcagctgccgccagcaattggggcctgataactaacattgtcaactcaatagtcggggtctccgtgctcaccatgccgttctgcttcaagcaatgtggcattgtgctcggggctttacttctggtgttttgcagttggatgacacatcagtcttgcatgtttctggtgaaaagcgcatcactgtccaagagacgtacgtacgccggtctggctttccatgcctacgggaaggccggcaagatgctggtggaaacatccatgatcgggctgatgttgggaacgtgcattgcattttatgtggtgatcggcgatttgggctcaaacttcttcgcaaggctgtttgggttccaagttgggggcacatttaggatgtttcttctattcgcagtgagtctttgcattgtgctgccactttcacttcagcgcaatatgatggcaagcatccagtccttctcagctatggccctgctcttttatactgtatttatgtttgtgattgtcctgtcatcactgaaacacggactctttagcgggcagtggctccgacgggtgtcgtatgtgcgctgggagggagtgttccggtgtatccccatatttggtatgtccttcgcctgccagtcccaggtgctgcccacatacgactcgctggatgaaccctcagtgaagacaatgagttccatctttgcaagtagcttgaacgtcgtgaccacattctacgttatggtaggattctttggatacgtttcattcactgaggccactgctggaaacgtgctgatgcacttcccctcaaatctcgtgacagagatgcttcgcgttggatttatgatgtccgtggccgtggggttcccgatgatgattctgccctgccgccaggctttaagtaccctgctgtgtgaacaacagcagaaggacggcacttttgccgccgggggctacatgccccccctgcggttcaaggcactcaccctgtccgtcgtgtttgggaccatggtggggggaatcctcattcccaacgtcgaaacaattctcggattgactggagcgacaatgggatcacttatttgctttatctgtccagcgcttatttataagaagatacacaagaacgccctgtctagccaggtggtgctatgggtcgggttgggcgtcctggtggtctccactgttaccaccctatccgtgtcggaagaggtccctgaagacctggctgaggaggcccccggaggtcgcctgggagaggctgaaggcctgatgaaagtggaggcggcccggctgtcagcccaggatccggttgtggctgtggccgaagacggacgtgagaagcctaagctcccaaaggaaagagaggagcttgaacaggcacagataaaggggcctgtggacgtacctgggcgtgaagacgggaaggaggcccctgaggaggctcaacttgataggcctggtcagggcatagctgttccagttggggaggctcatcggcacgagcctccagtcccccacgataaggttgtggtggatgagggacaggatcgggaagttcctgaggagaataaacctccttcccgccacgccggtggaaaggcaccaggagtgcagggccagatggcacctcctctcccagattctgaacgcgagaagcaagagcccgaacaaggtgaagtcggcaaacgtccaggtcaggctcaggctctcgaggaggctggcgatctccccgaggaccctcagaaggtcccagaagccgatggccagcccgctgtccagcccgcaaaggaagatttagggcctggcgatagaggtctgcacccacggccgcaagcggtgctctccgaacagcagaacggactcgctgtgggtggcggagagaaggccaaaggcggcccgccacccggcaatgcagctggagataccggccagcctgccgaagatagtgatcacggcggaaaaccgcctctgcccgcagagaagccggcacccggacccggtctcccgccagagccacgtgagcaaagagacgttgaacgtgccggaggcaatcaggcagctagtcagctggaagaagcagggagagccgagatgctggatcatgctgttctattgcaggtgataaaggaacagcaggtccaacagaagaggctgctcgatcagcaagaaaagcttttggctgtgatagaagagcagcacaaggaaatccatcaacagcgccaagaagacgaggaagataagccccgccaggtggaggttcaccaggagccgggagccgcggtaccccgcggtcaggaggctcctgagggtaaagcaagagagacggtggagaacctgccccccctccctctcgaccctgttctgagagcacccggtgggcggcctgcacctagccaagacctaaaccagaggagcctcgaacactccgagggtccagtgggcagggaccccgctggacccccggatggcggaccagatacagagccccgggcggcacaggctaaattaagggatggccagaaggacgccgcacctcgcgccgccggtaccgttaaggagctacccaaagggcctgagcaggtaccggtgcccgaccccgccagggaggcaggcggccctgaagagcgtctggccgaggagtttccaggccagtctcaagatgtcaccggtgggtcacaggaccgaaaaaaacctggaaaagaagtggctgccaccggcactagtatactgaaggaagccaattggttggtggcggggcctggcgccgaaaccggggacccccggatgaagcctaagcaggtgtcgagagatctaggccttgctgcggacttgccgggaggcgctgagggcgctgcagcgcagcctcaggcagttctcaggcagcccgaactacgcgtcatcagcgatggcgagcaagggggtcagcagggacatagattggaccacgggggccacttggaaatgcgcaaagcccgcggcggagaccacgtcccagtgagtcacgaacaaccccggggtggagaagacgcagccgttcaggaaccccgccaacgtcctgaaccagaactgggactcaagcgggccgtacctggggggcaaagaccagacaatgcgaagcccaatcgcgacttaaagctgcaagcaggatccgatctgagacgtagacgcagggacctgggaccccacgcagaaggtcagctcgccccccgcgacggtgtgatcattggactgaatcctctgcctgatgtgcaggttaacgatcttagaggcgccctagacgcccaactgagacaggccgccggaggggcccttcaggtcgtccatagtcgccagctccgccaggcgccaggaccacctgaggaaagctag

SEQ ID NO: 30288 - DNA, 1155 bp, Artificial Sequence
  Description of Artificial Sequence: Synthetic coding sequence
atgaagcaggccggcttccccctgggcatcctgttgctcttttgggtgtcatatgttactgacttctcactggtactgctgatcaaaggcggtgccctgagtggtaccgacacatatcagagtctggtcaataagacttttgggttccccgggtatctattactttccgttctccagttcttatacccttttattgtggacccagagaatgtgtttattggtcgacactttattatcggcctgtccactgtgacctttacactgcccctgagtttgtacaggaatattgcaaaattggggaaggtttcactgatcagcacaggactgacgacacttattctgggaatagtgatggcccgcgccatctctctcggacctcacattcccaagacagaagacgcttgggtgtttgccaaacccaatgccattcaagccgtgggggtcatgtccttcgcttttatctgccaccataattcattcctggtttattcctcattagaggagcccactgtggccaagtggagccggctgattcacatgtcgattgtgatctcagtgtttatatgcatcttcttcgcgacatgcggttaccttaccttcacagggttcacacagggtgatctctttgagaattattgtagaaacgacgatctggttacatttggacgtttttgttacggcgtcaccgttatcctgacttatccaatggaatgctttgttacccgagaggtgatcgccaacgtcttttttggaggcaatcttagttccgtgtttcacatcgtggtaaccgtgatggtgatcacggtggccaccctagtgagcttgctgatagattgcctcggcattgtccttgaactgaatggggtcttatgcgcgactcccctcatatttataattccttcagcctgttatttgaagttatccgaggagccgcgcacccactctgataagatcatgtcatgcgtaatgctcccaataggagcagttgttatggtgtttgggttcgtgatggccattacaaatacacaggattgtacccacggccaggagatgttctactgctttcccgataatttcagcctcaccaacacctcagagtctcacgttcagcagaccacacaactttcaaccttgaatatatctatattccagtag

SEQ ID NO: 30289 - DNA, 1221 bp, Artificial Sequence
  Description of Artificial Sequence: Synthetic coding sequence
atgaagcaggcggggtttcccttaggcatcttgttgctgttctgggtgagctacgtcactgacttttctctcgtattattgattaagggaggtgccctgtccggcaccgacacctaccagagtttagttaataagacctttggctttcctggctatctgctgttgtctgtgcttcagtttttatatcccttcatcgctatgatctcctacaacattatagccggtgatacgctctctaaagtgtttcagaggatccccggagtggacccagagaacgtctttattggccgtcactttataataggcctgtccactgtcacattcacattgcctctaagcctgtaccggaacattgccaaattgggaaaggtctccctgatttccaccggtttaactacccttatcttgggcatcgtgatggcacgggccatatcactgggaccccatatccccaagaccgaggatgcttgggtgttcgctaaacccaatgccatccaggctgtgggagttatgtctttcgctttcatttgtcaccataattcatttcttgtgtactcctcactggaagagccaacggtggccaagtggtcacgccttatacatatgtcgattgtgatctctgtctttatctgtatcttctttgccacatgcgggtatttgacatttaccggcttcactcagggtgatttattcgagaactactgtaggaacgacgacctggtcaccttcggccggttttgctatggcgtgaccgtgattcttacataccctatggagtgtttcgttactagggaagtgatcgcgaacgtgttttttggcggtaacctctccagcgttttccacattgtggtgaccgtaatggtaattaccgtcgctactctcgtatctttgctcatcgattgtctgggcatcgttctggagttgaacggagtgctgtgtgctacgccactgatctttatcatccctagtgcctgctatttaaaactgagcgaggagccacggactcattcagataaaatcatgtcatgtgtgatgctgccaatcggcgcggtggtgatggtcttcggatttgtgatggccatcaccaatacgcaagactgcacgcatggacaagaaatgttttactgcttcccagacaatttcagcctgaccaatacgagcgaatctcacgtccagcagactacccagctgagtactttgaatatctcgatctttcagtag

SEQ ID NO: 30290 - DNA, 1221 bp, Artificial Sequence
  Description of Artificial Sequence: Synthetic coding sequence
atgaaacaggccggctttccactgggaattctgctgctgttttgggtgtcctacgtcacagactttagcctcgtccttttgataaaaggaggtgctctgagcgggaccgatacatatcagtcactggtcaacaagacattcggcttccctggttatctgctgctttccgttctccagtttttgtacccttttatcgccatgattagttacaatattatcgctggtgacaccctgagtaaggttttccagagaattccaggggttgatccagaaaacgtttttatcgggaggcatttcatcatcggtctgtctacggtgaccttcactctgccattgagcctgtatagaaacattgcaaaattaggcaaagtcagcctcattagcacaggtttgacgaccctgatcttaggcattgttatggcccgtgccatttccctgggacctcacattcccaaaacagaagacgcttgggtgtttgcaaaacctaacgcgatacaagctgtgggtgtcatgagtttcgcctttatctgtcaccataatagtttcctggtgtacagctccttggaggagcccaccgttgctaaatggtctaggcttatccacatgagtatcgtaatctcagtttttatttgtatttttttcgccacatgcggctacttgacattcaccgggttcacgcaaggcgacctttttgaaaactactgccgtaatgacgatcttgttacttttggcaggttttgttacggcgttacagttatcttgacttacccaatggagtgcttcgttactcgagaggtgattgcaaatgtattttttggaggaaatctcagctccgtatttcacatcgtggtgactgtgatggtgatcactgtggctacacttgtaagccttctaatcgattgcctgggcatcgtgctggaactgaacggcgttctgtgtgcgacgcctctgatcttcattatcccctcagcatgctatctgaagctatccgaagagcctcggacccattctgacaagataatgtcgtgtgttatgcttcctatcggcgcagttgtcatggttttcgggtttgtgatggcaatcacaaatacacaggattgtacacatggtcaggagatgttctactgcttcccagacaatttcagcctgacaaataccagcgagagccacgttcagcagacaacacaattgtctacgctgaacatctccattttccagtag

SEQ ID NO: 30291 - DNA, 1371 bp, Artificial Sequence
  Description of Artificial Sequence: Synthetic coding sequence
atggaagctagttggggcagttttaacgcagaacgcggctggtacgtctccgttcaacagccggaagaggccgaggcggaagaactttcaccgctgctgtctaacgaacttcataggcagcgtagtcccggcgtgtccttcggcctgagcgtgttcaatcttatgaacgcaatcatgggttccggaatcttgggtctggcatatgtgctagccaacacaggagtctttgggttttcttttttactgctgaccgtggccttgctggcctcctatagcgtacatctgttgctcagcatgtgcattcagacagccgtgacctcttatgaggaccttggccttttcgcctttggacttcccggaaaactcgtcgttgccgggacaatcatcatccagaatatcggggccatgtcttcataccttctgataattaagacggaacttccagccgccattgcagagtttctgaccggtgattatagtaggtattggtacttagacggacagacacttcttatcataatttgcgtggggattgtatttcccctcgctctcttacccaagataggatttcttggatacacgagcagcttaagtttcttctttatgatgtttttcgccctggtcgtaattatcaaaaaatggtccattccatgtcccctcactcttaattacgtggagaagggcttccagattagtaacgtcactgatgattgcaagccaaagctgtttcatttcagcaaagaatcagcatatgcacttcccaccatggctttttcattcctgtgtcacacttccatactgcccatttattgcgagctgcagagcccatcaaagaagcgcatgcaaaatgtcaccaacactgctattgccctgagtttcctgatctatttcatctccgctctctttgggtacttgaccttttacgacaaagtggagagcgaactccttaaagggtacagcaaatacctgtctcacgatgttgtcgtcatgacagttaaattatgtatcctgtttgccgttctacttactgtacccctgattcatttccctgcacgcaaagcagtcactatgatgttcttctccaactttcccttttcatggatccgccatttcttgatcaccctcgccctgaacattatcatagtgttgctggccatttatgtcccggatattcgaaatgtcttcggagtggttggggcctctacttcgacttgtctcatattcatctttcccggtctattttacctgaagcttagtagggaggacttcttgagttggaagaaactgggcgccttcgtgttgttgatcttcggaattctcgtcgggaactttagcttagcactgatcatttttgactggataaacaaatag

SEQ ID NO: 30292 - DNA, 1566 bp, Artificial Sequence
  Description of Artificial Sequence: Synthetic coding sequence
atggaggccagctgggggtctttcaatgcagagagagggtggtacgtatctgtccaacagccagaagaggctgaggctgaagagttatctccgctgctgtctaatgagctgcaccgacagagatctcccggagtgtctttcggcttgtcagtctttaacctaatgaacgccattatgggttccggcattctgggattggcttacgtgctcgcaaatacaggagtcttcggcttttcctttctcctgctcaccgttgcactccttgcctcctattccgtccatctgcttctctccatgtgcattcagactgccgttacctcctatgaggatctgggactctttgctttcgggctccccgggaagctggtagtcgctgggacgatcattatccagaatatcggtgccatgagttcatacctgctgataattaagaccgaactgccagctgcaattgcggaattcttgactggagactactccaggtactggtacttggacggccagactctcctgattatcatctgtgtggggattgtatttccactggctctcctcccaaagataggtttcttaggatacactagcagtctcagtttctttttcatgatgttttttgcgttggtggtaatcatcaagaagtggagcataccctgccccctgactctcaactacgtggagaagggcttccagatttcaaacgtgaccgacgactgcaaacccaagttatttcacttcagtaaggagtctgcctacgccttacccaccatggcatttagtttcttatgtcataccagcatcctgccgatctactgcgagctgcagagcccatccaagaaacggatgcagaatgtcacaaacactgccattgcgttatcatttctcatctacttcatcagcgcgctgtttggatatcttactttttatgacaaagtggaaagcgaactgttgaagggctacagtaagtacctgtcacacgacgtggtggtgatgactgtcaaactgtgtattctgtttgcagtcctgctcactgtgccacttatacactttccagctcgcaaggcagtcaccatgatgtttttcagtaactttccctttagttggatcaggcattttctcattaccctggccttaaacatcatcatcgttctgctagccatctacgtgccagatatccgcaatgtgtttggggtcgttggcgcctctacgtctacttgcctgatttttattttccccgggctgttctatctgaaacttagccgagaggatttcctctcatggaagaagttaggcgggctcatcctttcacatcgcttggcttgcagcggggtgatcagcgcgcactgtaacctgtgcctccccgatagctccaaccctcccaccagtgctagtagagtggctgaaaccactggcagggatactatggaaatgtgcacacagaggaaaggccatgcgcgaacacagcaagagggaaactgcttgcaagccaagggcagaggactgagacggacgaaacgggtgcataccttgattctgcattttcccacgtcacggactgtgtcaaaatag

SEQ ID NO: 30293 - DNA, 1551 bp, Artificial Sequence
  Description of Artificial Sequence: Synthetic coding sequence
ggatctttcaatgccgagcgcggctggtatgtgtctgtgcaacagccggaagaggccgaggccgaggagttgtctcctctgctgagtaacgaactccaccggcaacgtagtccaggtgtgagttttgggctctctgtgtttaacctgatgaatgctattatggggtcaggcattctgggtctggcctacgtgctcgccaataccggggtgtttgggtttagctttctcctgctgaccgttgccttgcttgcctcatattctgtccatctgcttctgagcatgtgcatacagacagctgtcacatcttacgaggatctaggccttttcgcatttggtctgcctgggaaattagtggtagctggcaccatcattatacagaatattggagccatgagttcgtacctactcattattaagacggagttacccgccgctattgctgagttccttactggggattactcccgttattggtacctcgacgggcagaccctgctgatcataatctgcgttggtatcgtgttccctctagcactcttgcctaaaatcggctttctcggctatacttccagcctgagttttttctttatgatgttctttgcattggtggttataattaagaaatggagcatcccctgccccctgacccttaattacgttgagaaaggattccaaatctctaatgttacagacgactgcaagcccaaactttttcacttcagtaaggaatcggcttatgcactcccaacaatggctttttcattcctttgccacacctcaattctgccaatctactgtgagctccagtccccatccaaaaagagaatgcaaaatgtaaccaataccgcgatcgcactgtcctttctcatatactttatcagcgcgctgttcgggtatttgacattttatgataaggtggagtccgagcttctgaaaggctatagtaagtacctgtctcatgacgtcgtggtgatgactgtgaagttgtgcattctgtttgccgtcctgctgaccgtgcctctgattcatttccctgcgcgaaaagctgtgaccatgatgttcttcagcaacttccccttttcctggattcggcatttcttgataactctggctctgaacataatcatcgtgctactggcaatttacgtgcctgacattcggaacgtgtttggtgtcgtcggagcgagtaccagcacttgcttgatcttcattttcccgggcctcttttacctcaagcttagcagggaagacttcttaagttggaaaaagcttggaggcttgatactcagtcaccgactagcctgttccggagtgatatctgcacactgcaacctctgcctgcccgactcctctaatccccctacctctgcttcgcgggtggccgaaactacagggcgagataccatggaaatgtgtacacagcgaaagggccacgcaagaacccaacaggaagggaattgtctgcaagcaaagggaagagggcttagacgaacgaagcgggtccataccctcatacttcacttccccacaagccggactgtatccaagtag

SEQ ID NO: 30294 - DNA, 1464 bp, Artificial Sequence
  Description of Artificial Sequence: Synthetic coding sequence
atgtccggcccacgcatcatgtactccctgctgctcgagctgcatcgtcaaagatcaccaggagtgagctttgggttgtctgttttcaacctcatgaacgcgattatgggaagtggtatattgggattggcttatgttctggctaatactggcgtctttgggttttccttcctcttattaaccgtggccttgctagctagctactctgtgcatcttcttctgagcatgtgcatacaaaccgccgtaacctcctacgaggacctgggtcttttcgcattcggccttcctggaaaactggtggttgccgggaccatcattattcagaatatcggggctatgagtagttatctcctgattatcaagaccgagctgcccgcagctattgctgagttcctgacaggagattattcccggtattggtacctcgatggacagactctactgattatcatttgtgtgggaatcgtgttccccctcgccctgcttccaaaaatcggatttctggggtatacctccagcttgtccttctttttcatgatgttctttgccctggtagtgattatcaagaaatggtctatcccctgtccactgaccctgaactatgtcgagaaaggattccagatctctaacgtgaccgatgactgcaagccgaagctgtttcattttagcaaggagtctgcttacgcactgccaacaatggcctttagtttcttgtgtcacacatcgattctgcccatctattgcgagcttcagtcaccctcaaagaaaaggatgcagaatgtcacgaatactgctatcgcgttaagttttttgatttacttcattagcgctttgttcggttaccttaccttctacgacaaagtggagtccgagctcttaaagggatatagcaagtatctgtcacatgatgtggtggtcatgactgtgaaactttgtatcctatttgcagtgctgttgaccgtgcccctaatccacttccccgcacggaaggccgtcaccatgatgtttttctcaaatttcccattcagttggattaggcatttccttatcacattagcactgaatatcattatagtgctgcttgccatttatgttccagacattcggaacgtgtttggggttgtaggagcctcaacaagcacatgtctcattttcatttttcccggccttttttatctgaaactatcccgcgaggactttctatcctggaaaaaactgggcggcctcattttgtctcaccgccttgcgtgctccggtgtgatctcagcccactgcaatctgtgcctaccggacagcagtaatccaccaacatccgccagcagggtagctgaaaccacagaaaaggaagagatcccctggaggtgcgcccccagaggaaaggccacccagggccactctaagaaggccactgtctataagcctcgcgaagaggcttcaggcgagccaaatgtgtccaccccctag

SEQ ID NO: 30295 - DNA, 1686 bp, Artificial Sequence
  Description of Artificial Sequence: Synthetic coding sequence
atggctaacatgaatagtgatagccggcatctgggcacctcagaagtggatcacgagagagacccagggccaatgaatattcaattcgagccctcagatttaagatccaagcggccgttctgcatagaacccactaatattgtcaacgtgaaccatgtcatacaaagggtgagcgaccacgcgagcgccatgaataaacgcatccactattacagccgtctgacaacccccgctgacaaggccttaatagcacctgaccatgtggtgccagcccctgaagaatgctatgtgtattcacccctgggcagcgcatataagctacagagttacaccgagggttatggcaaaaacacttctctggtgactattttcatgatttggaatacaatgatgggcaccagtatcctttccatcccttggggaatcaagcaagccggcttcaccaccggcatgtgcgtcatcatcctcatgggactattgaccctgtactgctgctaccgggtcgtcaagagcagaacgatgatgttcagcctggacactacttcctgggaatatcccgacgtgtgtaggcactactttggttcattcggtcaatggagttctctgctgttctccctggtttcattgattggggcgatgatcgtttactgggtactgatgtccaactttttgttcaacacagggaagttcatttttaatttcatccatcatatcaacgatacggatactatcctctctactaataactcaaacccagtgatttgtccctctgcaggaagcggagggcaccctgataactctagcatgatcttttacgccaacgatactggggcccaacagtttgagaaatggtgggacaaaagccggaccgtccccttctaccttgtgggcttgttactgccactcctgaacttcaagtcccccagcttcttctctaaattcaacattttagggactgtgagcgtcctgtatttgatctttttggtcacgttcaaagcggtgcgactagggttccacctggaattccattggttcattccaactgagttcttcgtgcccgaaatccggttccagttcccccagttgactggggtactgactctggctttttttattcacaattgcatcatcacgctcctgaagaacaataagaagcaggaaaacaatgtgcgggacctctgcatcgcctacatgttagtaactctcacctacttgtacattggggtgctcgtgttcgcctcttttccctctcctcctttgagcaaagactgcattgaacagaacttcctggacaacttcccttcatccgacactctgtcttttattgcccgaatatttctgttgttccagatgatgacggtgtatcctctgctggggtatctggcaagggtccagctgttgggtcatatcttcggcgatatttacccctctatctttcatgtattaatactgaatttgattatagtgggcgctggagtgattatggcctgcttctatccaaatatcggtggtatcatcagatacagtggcgctgcatgcgggctggcattcgtttttatttatccgagcctcatctacattatctcgttgcatcaggaggagcgtctgacctggcccaagctgatctttcatgtgttcatcatcatcttgggagtcgcaaatttgattgtgcaattcttcatgtag

SEQ ID NO: 30296 - DNA, 1686 bp, Artificial Sequence
  Description of Artificial Sequence: Synthetic coding sequence
atggccaatatgaactccgactctaggcatctgggcacctcggaagtggaccacgaaagggatccaggccccatgaacatccagttcgaaccatccgatctgcggagcaaaaggcctttctgcatagagcctaccaacattgtgaacgtaaatcatgtgatacagcgcgtcagcgatcacgccagtgcaatgaacaagcggatccactattacagccgcctcacgacccccgcggacaaagccttgatcgcgccggaccacgtagtcccggcaccagaagagtgctatgtttactctccgctgggaagcgcttataagcttcagtcttacacagaaggttatgggaagaatacctcactcgtgaccatctttatgatatggaacactatgatgggaacaagtatcctgtcaatcccctggggcataaagcaggctgggttcaccacaggcatgtgcgtaataatcctcatgggtttgctgacactgtactgctgctaccgggtcgtcaagtccaggaccatgatgttctctctggacactaccagttgggaataccctgatgtttgcaggcactacttcggcagttttggccagtggtcatcactcctgttctccttggtatccctgatcggcgctatgatcgtatactgggtgctgatgagtaactttctcttcaacactggcaagtttatcttcaatttcattcatcacatcaatgacacagataccattttgagtacaaacaattccaatccagtcatctgcccctctgcaggctcaggaggacatccggataactcctctatgatattctatgcaaatgacacgggagcgcaacagttcgaaaaatggtgggacaagtctaggacagtgccattttacctagtaggcctgcttcttcccctactcaatttcaaaagtcctagtttcttcagcaagttcaatatcctgggcaccgtgagtgtcttgtatcttattttcttagtgacctttaaggctgtgagactcggcttccacctggaattccattggttcatcccaaccgagtttttcgtgcctgagatcaggtttcagttcccccagctgaccggcgtactgaccctggccttctttatccacaactgtatcattacgctgttgaagaacaacaaaaaacaagagaataatgtgcgggacctgtgcattgcttacatgttggtgacacttacttacctgtacattggcgttctggttttcgcgtcatttccttccccaccattaagtaaggattgcatcgagcagaacttcctggacaacttcccgtccagcgatacattgtctttcattgcgagaattttcctactctttcagatgatgacggtgtacccacttctggggtacctcgcgcgcgtgcagctgctgggacatatatttggagacatttaccccagtattttccacgtgctcatactcaatctcatcattgttggcgcaggcgtgattatggcctgtttctacccaaacatcggcgggatcattcgctattctggggcggcatgtggcttggcgtttgtctttatctatccatcactcatttacataatctctcttcaccaggaggaacgccttacatggccaaagctaattttccacgtctttatcatcattctcggtgtggccaacctgattgtacagttctttatgtag

SEQ ID NO: 30297 - DNA, 1314 bp, Artificial Sequence
  Description of Artificial Sequence: Synthetic coding sequence
atgatctggaacactatgatgggcacaagcattctttcgatcccttgggggattaagcaagctgggttcacgactggcatgtgtgtgataatcctgatgggactgctgaccttatattgctgctacagagtggttaaatcacgcactatgatgtttagcctggacaccacttcctgggagtatccggatgtatgccggcactactttggaagctttggccagtggagtagcctgctcttcagtctggtctccctcattggcgcaatgatagtgtactgggtactcatgtcaaactttcttttcaatactggaaagtttatctttaactttattcaccacataaatgacacagacaccattctgtccacaaataatagcaaccccgtcatctgcccttcagctggctctggcggccacccggacaatagcagcatgattttctacgccaatgacacgggagcacagcaattcgaaaaatggtgggataagtccagaacagtgccgttctatctggtaggcctgctgctgcccctcttaaatttcaagtcgccgtctttttttagtaaattcaacatccttggaactgtaagtgtgctttacctcatattcctcgtgacctttaaggctgtgcgcctgggcttccatctcgaatttcattggttcatcccaacggagttcttcgtacctgagatccgattccagtttccccagctgaccggcgtccttaccctggctttttttatccacaattgcattatcacacttcttaaaaacaataagaagcaggagaataacgtccgcgatttatgcatcgcgtacatgctggtgactctcacatatctctatataggcgtcttggtgtttgcttcgttcccatcaccgcctttgtccaaggactgcattgaacagaactttctggacaacttcccctcttctgacactctgagctttatcgctcggatctttctgcttttccagatgatgaccgtgtatccacttttgggttacttggccagggtgcagcttctgggacacatattcggagacatctatccctccatatttcacgtgctgattctcaacctgattattgtcggcgcaggagtcataatggcctgcttctatcctaacattggaggaatcatccggtactccggagccgcttgcgggttggcgttcgtgtttatctatccatcgctcatttacattatcagtctgcatcaggaggagagacttacctggcccaagttgatttttcatgtctttatcataattctgggtgtggccaacttgatcgtccaattctttatgtag

SEQ ID NO: 30298 - DNA, 396 bp, Artificial Sequence
  Description of Artificial Sequence: Synthetic coding sequence
atggccaatatgaattctgacagccggcacttgggcactagcgaagttgaccatgagcgcgacccaggaccgatgaacattcagtttgagccctctgacctacgctccaaacgaccattctgcattgagccaactaacatcgtgaacgttaaccacgttatacaaagagtatccgatcacgcctccgctatgaacaaaagaatccattactattcccgactcaccacccccgctgataaggcactgattgccccagatcatgtagtccctgcccccgaagaatgctatgtttattccccactcggtagtgcctacaaactacagagttacacggaaggctatggtaagaataccagtctagtcacgatatttatgatatggaataccatgatgtag

SEQ ID NO: 30299 - DNA, 114 bp, Artificial Sequence
  Description of Artificial Sequence: Synthetic coding sequence
atggccaatatgaactccgattccagacatctcgggacatcagaagtcgaccacgaacgtgatccaggtccaatgaatatacagtttgagccgtcagacctacgaagtaaatag

SEQ ID NO: 30300 - DNA, 114 bp, Artificial Sequence
  Description of Artificial Sequence: Synthetic coding sequence
atggccaacatgaatagtgacagccggcacctcggaacctctgaagtcgatcacgaaagggatcccgggccaatgaacattcagttcgaaccatccgaccttcggtccaagtag

SEQ ID NO: 30301 - DNA, 1497 bp, Artificial Sequence
  Description of Artificial Sequence: Synthetic coding sequence
atggccatctgtatcttaacttggagaatcagacccttctgcatagaacccacgaatatagtgaacgtaaatcatgtcatccagcgggtatccgaccatgctagtgcgatgaataaacgcatccactactactctagactgactactcccgcggataaagctctgatcgctccagaccacgtggtgcccgcccctgaagaatgctatgtgtattccccccttgggagcgcgtacaagcttcagtcatatacagaaggctacggcaaaaacacatctctggtgactatctttatgatctggaacacaatgatggggacatctatcctgagtatcccctggggcattaagcaagctggctttaccactggcatgtgcgtgattatattgatggggttattgactctctattgttgctatagagtggtgaagagccgcaccatgatgttctcactagataccacttcttgggagtatcctgatgtatgccgacactacttcggcagctttgggcaatggagcagcctcctgttttccttggtcagcctgattggcgccatgatcgtatattgggtattgatgtcgaacttccttttcaacacagggaaatttattttcaatttcatccaccacatcaatgataccgatacaattctgtcaacaaacaattccaatccagtcatatgtcccagcgcaggttccggaggacaccctgacaattccagcatgattttttacgccaatgatacaggagcgcagcaatttgagaaatggtgggacaaatcccggacggtccctttctacctggtcgggctgctgttgccactgctcaatttcaaatcacccagttttttctcaaaatttaatatcctcgagataagattccagtttccccagctgaccggcgttcttacactcgctttttttattcataattgtatcatcaccctcctcaagaacaacaagaagcaggagaataacgtcagggatctgtgtatagcatacatgcttgtgacacttacctatctctatataggcgtactcgtctttgccagctttccatccccccctctaagcaaggattgcatcgagcagaactttctggataacttccctagcagcgacactctgagctttattgctagaattttcctgttgtttcagatgatgacagtgtacccgctgttgggatatctggccagggttcaactgttgggacacattttcggagacatctatccaagcatcttccatgttctgattttaaaccttatcatagtgggcgcaggcgtgatcatggcctgcttttacccaaacatcggtggaattatcagatattcaggcgcagcttgtggattagctttcgtttttatatacccgagtctcatctacatcatctccctgcaccaggaggagaggctcacctggccaaaactgatttttcacgtgtttatcataattctcggagtggccaatctcatagtccagttcttcatgtag

SEQ ID NO: 30302 - DNA, 81 bp, Artificial Sequence
  Description of Artificial Sequence: Synthetic coding sequence
atggccaacatgaacagcgactctagacacctcggaacatctgaggtggaccatgagcgggaccccggacccatgaactag

SEQ ID NO: 30303 - DNA, 294 bp, Artificial Sequence
  Description of Artificial Sequence: Synthetic coding sequence
atggctaatatgaattctgattctcggcatttgggcacctccgaggtcgatcatgagagggaccccggtcccatgaacattcagtttgagccttccgatctgagaagcaagcgaccattctgtattgagcctacaaatatagtgaacgtcaatcacgtcatacaaagggtctctgatcatgcctctgctatgaataagcggattcattattattcccggctgacaacacccgccgacaaagctctcattgcacctgaccacgtcgtacctgcccccgaagagtgctatgtgtag

SEQ ID NO: 30304 - DNA, 1497 bp, Artificial Sequence
  Description of Artificial Sequence: Synthetic coding sequence
atgaataagcggatccactattacagtaggctgaccacacctgcggataaagcactcattgctcctgaccatgtggtcccagcacctgaggagtgctatgtttatagccccctggggagcgcttacaaattgcagagctacaccgaggggtatggaaagaacacatcactggttacaatcttcatgatatggaataccatgatgggcacttctatcctgtccattccttggggtatcaagcaggcgggattcaccactgggatgtgcgtgattattttaatggggctgctcacactttattgttgctatcgggtcgtcaagtctcgcacgatgatgttttcacttgacaccaccagttgggagtatcccgatgtttgtcgacactattttggctcattcgggcaatggagcagcctccttttcagcctagtgagcctcatcggcgctatgattgtctattgggtgctgatgagcaacttcctattcaatactggtaagttcatcttcaatttcatacatcacataaacgatacagatacaatcctctcaactaacaactcaaatccagtgatttgccccagcgccgggtctggcggtcatcctgataactcaagtatgatcttttatgccaacgacaccggtgctcagcaattcgagaaatggtgggacaagagccgaactgtgcctttctacctggtcggtctgctcctacctcttttgaactttaaaagtccatcttttttcagcaagttcaacattctggggacagtttcagtcctgtatcttatctttctcgtgacctttaaagcagtacgtctgggcttccacctggagttccactggtttattcccactgagttctttgtaccagagattaggtttcagtttcctcagcttactggcgtcctcacactggcattttttattcataattgtattatcactctcctgaaaaataacaagaagcaggagaataatgttcgagacctctgtattgcctacatgctcgtgactctcacttatttatatattggcgtgttggtgttcgctagctttccatcgcctccactgagcaaagactgtatcgaacagaatttcctcgataactttccatctagcgatacactgtcctttattgctaggatttttctgttgttccagatgatgacagtgtaccccctcttaggctacctagctcgcgtgcaactcctgggtcatattttcggggacatctacccgtccatcttccacgtgctgattttgaacctgatcattgtcggtgctggcgtaattatggcctgtttctaccccaacattggcggaatcattcgttacagcggagccgcttgcgggttagcttttgtttttatttacccatcccttatctacattatctctctgcaccaagaagagagactgacatggccgaagctgattttccacgtcttcataatcatcctgggagtggcaaacctcatagtccaattcttcatgtag

SEQ ID NO: 30305 - DNA, 1389 bp, Artificial Sequence
  Description of Artificial Sequence: Synthetic coding sequence
atggctaacatgaacagcgatagtagacatttgggaacttcagaggtggaccacgaaagggaccctggccctatgaacatccagttcgagccatccgatctcaggtctaagcgcccattttgcatcgaacccaccaatatcgtgaacgtaaatcatgtcatacagcgcgtgtccgaccacgcttccgctatgaataagcgaattcactattattctaggttgacaacccctgcggacaaggccctgatcgcaccagaccacgtggtgcctgcccctgaagagtgctacgtttattccccacttggtagtgcatataagctgcagtcttatacagagggatacggaaaaaacacttcattggtgaccattttcatgatctggaatacaatgatgggtacgtccattctcagtattccttggggaattaaacaggccgggttcactactggcatgtgcgtgataatcctgatgggactcctaacgctgtactgttgttaccgggtcgtgaagtcccgcacgatgatgttttcccttgatacgacatcttgggagtacccagatgtctgccgacattatttcgggtcatttggtcagtggtctagccttttattcagcttggtaagcctgattggagctatgatagtgtactgggtgctgatgtccaatttcctgtttaatactggcaaatttatcttcaacttcatccatcatattaacgacacagataccatcctcagtaccaataattccaatccagtgatctgcccttctgccgggtcaggaggtcaccccgataacagttcaatgattttctatgccaatgataccggcgctcagcaattcgaaaaatggtgggataagagcaggaccgtgccattctacctcgtgggtctgctattgcctctgctgaactttaagagcccatcatttttcagcaaattcaatattctgggtacagtatccgtcctatacctgatctttctggtgacctttaaggctgtgcggctaggattccatctggaattccattggttcatccctacagagttcttcgttccggaaattcgattccagttcccccaactgacaggtgtcctgactctcgctttctttatacataattgcatcatcacattactcaagaataacaaaaagcaggagaacaatgtgcgggacctgtgcatcgcttacatgctggtgaccctaacatacctttatattggcgttctcgtgttcgcctcctttccgtcccccccactgagtaaggattgtattgaacaagttaggcatcgggttccatcactttgtgactgcgttcattttcacgtgtttatcgtcggaagggtaattcagtggcaagatatcacctctgaccgtcccggtttttag

SEQ ID NO: 30306 - DNA, 1008 bp, Artificial Sequence
  Description of Artificial Sequence: Synthetic coding sequence
atgctgcagggacactcatcggtcttccaggccctgttgggcaccttttttacttggggaatgacagctgcaggggccgcgttagtctttgtgttctcttctggacagcgtcgcattctggatggttccctgggatttgccgccggggttatgctggccgcctcctattggtcccttctggccccagcagttgagatggccacatcatcgggagggtttggcgcatttgcatttttcccagtcgcagtaggtttcaccctcggcgcagcttttgtctacttggccgatctgctcatgcctcatcttggcgccgcagaggacccgcagacaactttggcactgaacttcggtagcactcttatgaagaagaaatccgatcccgaaggccccgccctgctgtttcctgaaagtgagctttcaattagaattgacaaatccgaaaacggggaggcctatcagcggaagaaagcagcagcaaccgggctacctgagggacccgctgtcccagtgcccagtcgcggtaatttggctcaacctggcggctcatcttggaggagaattgctctcctcatcctcgccattacgatccacaacgtcccggagggccttgccgttggcgtgggttttggcgctatcgagaaaaccgcctcagccactttcgagagcgctaggaatctggcaatcggaatcggaattcagaatttccccgagggactggccgtctccctgcctttgaggggggctggcttctcaacttggcgggcattctggtacggccagcttagtggtatggtggaaccccttgccggagttttcggtgctttcgcagtggtcctcgctgagccaatcctgccgtacgcactggccttcgcggcaggcgctatggtgtatgtggtgatggacgatattataccagaggctcagatcagtgggaacgggaagcttgcatcatgggcttccattcttggatttgtggtcatgatgtccctggatgtgggactcggctag

SEQ ID NO: 30307 - DNA, 1029 bp, Artificial Sequence
  Description of Artificial Sequence: Synthetic coding sequence
atgttgcaaggtcactctagcgttttccaggccctgctgggtacgttttttacttggggtatgactgcagccggtgccgcactggtatttgtgtttagcagcggtcaaaggagaatcctggacgggtccctgggtttcgccgccggcgtgatgctggccgcgagctactggtccctcctggccccagcggtggagatggcaacatcttccggcggcttcggggcttttgccttctttcctgtggctgtaggtttcacactcggcgcagcattcgtttatcttgccgatctgctgatgccacacctgggcgcggctgaggacccccaaactacgctggctctgaatttcggctctaccctcatgaagaagaagagcgacccggaggggccagctctcctgtttccggaatccgagttatcaatcagaatcggcagagctgggctgctctcagataagtcagagaacggcgaggcatatcagaggaaaaaggccgcagctaccggattaccggaaggccccgccgtgcctgtgccatcccggggaaatctcgcccaaccgggcggctcctcttggcggaggattgccctcttaattctggccatcacaatacacaacgtgccggaagggctcgccgtcggtgtcggcttcggtgctatcgagaagacggcgagcgctacatttgagtcggcccgtaatctggccattggtattgggattcaaaattttcccgaggggcttgctgtcagcctaccgctgcgaggcgcaggctttagcacatggcgggcattctggtacggccagctctcaggaatggtggaacctctcgcaggggtgttcggcgcctttgcggtggtactggcagagccaattctcccttatgctctggcattcgccgccggggcaatggtatacgtcgttatggatgacatcattcccgaggcccagatctctgggaacgggaagcttgcctcttgggcaagcatactgggcttcgtggtcatgatgagcctggacgtcggactggggtag

SEQ ID NO: 30308 - DNA, 1623 bp, Artificial Sequence
  Description of Artificial Sequence: Synthetic coding sequence
atgatgggctctccagtgtcacacctgctggcgggtttttgcgtttgggttgtacttggctgggtgggcggcagcgtgcccaacctcggtccagcagaacaggagcagaatcactacctagcacaattgtttggattatatggagaaaacgggacgttaaccgccggagggctcgcaagattgctgcacagtttgggcttgggacgcgtgcaggggctgcgtctgggacaacacggaccattgactggacgtgctgcctctccagccgccgacaactcaacccacaggcctcagaaccccgagctaagcgtggacgtatgggctggaatgcccctcgggccgtccgggtggggagaccttgaagaatccaaggcaccgcaccttcctcgggggcctgcaccatcaggactagatctcctgcaccgactcctgctattggatcactcccttgcagatcatttaaatgaggattgtttaaacgggtcacagcttctagtaaattttggtcttagtccggctgcacctcttaccccgcggcagttcgctctgctgtgcccagctctactgtatcaaatcgactctagggtgtgcattggtgcccctgccccggcccctcccggagatctgttgtcagctcttctgcagagtgcactggctgtactcctgctgtccctgcctagccctctctctctcctccttttgcgcttgttgggacctcgcctgttgcggccactgctaggctttttgggcgcgctggccgtggggacactctgtggagacgccctgctccacttgctgccccatgcccaggagggtcgccatgccggtcccggcgggctgccagaaaaggatctaggacctggcttgagcgtccttggggggttatttctgctgttcgttctggagaatatgctcggcctcctgcggcacagggggctccgacctcggtgttgcagacgaaagagaaggaacctggagacgcggaacctggacccagaaaacggcagtgggatggccctccagcccctgcaggcggcccccgagcctggtgcacaaggtcaacgagagaaaaactcccagcatccaccagcactagctccccctgggcaccaaggacatagccacgggcaccaggggggtactgacatcacttggatggtactactaggtgatggactccacaacctgacagatggcttggctattggggccgccttctctgacggcttctcttctggcctaagcaccacactggccgtcttctgccatgaactcccccatgaattaggagacttcgccatgctgctgcagtctgggctctcctttcgcagactgcttctcttaagtctggtcagcggagctctgggtctcggcggagccgttctgggtgtcggcctgtcacttggaccagtgcctctgactccctgggtgtttggagttactgcaggagtgttcctctacgtcgccctggtcgacatgctccctgccctccttcgaccccctgagccactccccacaccacatgtgttgctgcagggcctgggactgcttctcggggggggccttatgctggctattacattgctagaggagcgtctattgcctgtcaccactgaaggctag

SEQ ID NO: 30309 - DNA, 390 bp, Artificial Sequence
  Description of Artificial Sequence: Synthetic coding sequence
atgatgggatcccccgtttctcacttgctggcagggttctgtgtctgggtggtccttggttgggtgggcggaagcgtgcccaacctgggcccggccgagcaggaacagaaccattacctcgcccagctcttcggcttgtacggcgagaatggcaccctgacagcgggcggcctggccagacttctccacagtttaggcctgggacgtgtacagggacttaggctcggacagcacgggccattgaccggaagagctgcctctcctgctgcagacaactccactcatagaccccagaatccggaattgagcgtcgacgtgtgggccgggatgccattaggtccctccggctggggcgacctggaggagtcaaaggccccgcaccttccctag

SEQ ID NO: 30310 - DNA, 471 bp, Artificial Sequence
  Description of Artificial Sequence: Synthetic coding sequence
atgatgggctctcctgtttctcaccttctggcaggcttttgcgtgtgggtagtgcttgggtgggtcggcggatctgtgccaaacttaggcccggctgagcaggagcagaaccattaccttgcccaactctttggattatacggtgaaaacggtaccttaacagccggtggcttagctagactgctacactccctgggactgggccgcgtacaagggctgcggttaggtcagcatgggccccttacaggccgagctgccagcccagctgccgataatagtactcatcgcccacagaatcccgagctttctgtcgacgtatgggctggcatgcctcttggcccttctgggtggggggatctcgaagaatcaaaggcacctcacctgcctcgaggccctgcaccatctggcttagacctcttgcacagactgctccttctggatcattctttggccgaccacttgaacgagtag

SEQ ID NO: 30311 - DNA, 372 bp, Artificial Sequence
  Description of Artificial Sequence: Synthetic coding sequence
atgatgggctcccctgtgtcccacctgctcgctggcttttgcgtctgggtcgtgctgggttgggtcggcggtagcgtgccaaaccttggcccagctgagcaggaacaaaatcactacctggcccagctgtttggtttatacggcgaaaacgggacacttacagcgggtgggcttgctagactgctgcactccctggggctgggccgagtgcagggattgaggctaggacagcatggcccactgacaggacgggccgcttctccagctgccgataatagtactcacagaccccagaatccagagctgagcgttgatgtatgggccgggatgccacttggccccagtgggtggggagatctcgaagagtcttag

SEQ ID NO: 30312 - DNA, 381 bp, Artificial Sequence
  Description of Artificial Sequence: Synthetic coding sequence
atgatgggttctccggtctctcatctgctggccgggttctgcgtgtgggtcgtcctcggttgggtcggaggatccgtgccaaatctcgggccagcggaacaagagcagaaccattatttagcccaactgtttgggctgtacggcgagaatggcacactaacagctggcgggctggccaggctgctgcacagtctggggctgggccgggttcaggggttaagactcgggcagcatggtccactgaccggcagggccgccagtccggccgccgataactccactcaccgcccccaaaatcccgagctttccgtggatgtctgggcagggatgcctctaggaccctcaggttggggggacctcgaagaatctaaagctccatag

SEQ ID NO: 30313 - DNA, 1623 bp, Artificial Sequence
  Description of Artificial Sequence: Synthetic coding sequence
atgatggggtcccctgtgtcacacctgcttgcaggcttctgtgtgtgggtggtgctggggtgggtcggcggttcagtgccgaatctgggccccgcagagcaagagcaaaaccattatctagcccaactgttcgggctgtacggggagaatggcaccctgacagcaggcggtctcgcgcggctgttgcactctctggggctggggcgcgtccagggcctgcgcctaggccagcacgggcccttgaccggtcgagctgcctcaccagctgccgataatagcactcataggccacagaacccggaactcagcgtcgacgtgtgggccggcatgcctttgggcccctccggctggggagacctggaggaatccaaagcccctcatttacctcgaggaccggccccgtcaggcctggatctcctacaccgcctgctgctacttgaccacagtcttgcagaccacctgaacgaggactgtttgaacggttcccagctgctggttaactttggccttagcccagcagcccccctgacacctcgccaatttgcgctgctctgcccggcactcctgtaccaaattgattcccgtgtttgcatcggagccccggccccagcccctcccggcgatctgttatctgctctgctgcagtccgccctcgctgtcctcctcctttctctgccttctcctttaagcctgctgctgcttcgcctcctaggtccacgcctgctccggccactactgggcttcctgggcgcacttgccgtcggaacactctgcggcgatgctctgctgcacctgttacctcatgcccaggaaggcaggcatgctggtccaggcggcttgcctgagaaggatcttgggcccgggctgagcgtgctaggaggcctgttcctgttgtttgtactggagaacatgttaggcctactgaggcacaggggcttaaggcccagatgttgtcgccgaaaacggcgaaacctggagaccaggaatctagatcctgaaaacgggtccggcatggccttgcagcccttgcaggcggctccggagcccggggctcagggccagagggaaaaaaatagccagcaccctcccgcccttgctccccctgggcatcagggccattctcatggtcatcagggcgggaccgatataacttggatggttcttttgggcgacgggcttcacaacctcaccgatgggctggccattggagcagccttctcagacggtttctcttctggcttgtccaccactctggctgtgttttgtcatgagctgccgcacgagctgggcgatttcgcaatgctgctccagtctgggctgagtttcagacggttgttattgctgtccttggtgagtggcgccctcggcctggggggagccgtgctgggtgtgggtctttcgctcgggcctgtgcctctgaccccctgggtgttcggcgttaccgcgggtgtattcctctacgtagcgctggtggatatgttacctgccttgcttcgaccccccgaaccactaccaaccccccacgtcctgctgcaaggactaggcctgcttctggggggcggactcatgcttgccattacacttcttgaagaacgcctcctccctgttaccaccgaggggtag

SEQ ID NO: 30314 - DNA, 699 bp, Artificial Sequence
  Description of Artificial Sequence: Synthetic coding sequence
atggacgactttatttccatcagcctgttgtcgctggccatgttggttggctgctacgtcgccggaattatccccttggccgtcaattttagtgaggaaagacttaagctcgtcactgtcttgggtgctgggctgctttgcgggacagccctcgccgtaatcgtgcccgaaggggtgcacgccttgtacgaagatatccttgaagggaagcaccaccaggcctctgaaacccataatgtgatcgccagcgacaaggccgcagagaaatccgtggtgcacgaacatgaacattcacatgaccacacccagctgcatgcctacattggcgtcagccttgttctcgggtttgtgttcatgcttctggtagatcagatcggaaacagccacgtgcatagcaccgacgaccctgaggctgcccggtcgagtaactcaaaaattacaactaccttgggtctcgtcgtccacgccgcggcagacggggtagcactgggggccgcagcctctacttcccagactagtgtacaattgatcgttttcgttgcaattatgcttcacaaggcccccgcggctttcgggctggtttcttttttgatgcacgccgggttggagcggaatagaatcagaaagcaccttttggtcttcgctctggccgcccctgtcatgtcgatggtgacttacctcggtctatccaaggattag

SEQ ID NO: 30315 - DNA, 2496 bp, Artificial Sequence
  Description of Artificial Sequence: Synthetic coding sequence
atgaaagtgcacatgcacacgaaattttgcctgatatgtctgcttaccttcatcttccaccattgtaatcattgccatgaggaacacgatcatgggcccgaggcccttcatcggcaacatcgaggtatgactgagctggaaccaagcaagttctcaaaacaagccgctgagaatgagaaaaaatattacattgaaaagctatttgagaggtacggcgaaaatgggagattatctttttttggattggagaagttactgacaaacttgggcctgggggagcggaaggtagtcgaaatcaatcacgaagacttaggacatgaccatgtttcacacctagatattttggccgttcaggaaggcaagcactttcacagtcataatcaccagcattctcataaccacttaaattctgagaaccaaacagttactagtgtatcaacaaaacgcaaccacaagtgtgaccccgagaaagaaaccgtggaagtgagcgtcaagtctgatgataaacatatgcacgaccacaatcatcggcttagacaccaccacagactccaccatcatttggaccacaacaacacccaccatttccacaatgacagtattaccccatcagaacggggggaaccaagcaatgaaccttccacagagacaaacaagacacaggagcagtcggatgtgaagctgccgaagggcaagcgtaaaaagaagggccgaaagtctaacgagaacagcgaggttattactcctggctttccgcccaaccatgatcagggggagcagtatgaacacaaccgcgtgcataagccagaccgagtgcataacccagggcattcacacgttcatcttccagagcgcaatggccacgatcctggccgaggacaccaagatctcgacccagacaacgagggggagctgcgtcacaccaggaagcgagaagcgccccacgtgaaaaataatgccattatctctttgagaaaggacttgaacgaagacgatcatcaccatgagtgcttgaacgttacccaactgttgaaatactatgggcacggcgccaatagccccattagcacagatttgttcacgtatttgtgccccgctttgctttaccaaattgattctcgcctgtgcatcgagcatttcgataagctgctggtggaggatataaacaaagacaagaacctggttccggaagatgaggccaatataggcgcctccgcttggatttgcggcattatctcgatcacagtgatttcgctgctgtccctgctgggggttatcctggtccccattatcaaccagggatgtttcaagttcctgcttacattcttggtggccctagctgtggggacgatgagcggagatgcactcctccatttactgccacactcccagggaggtcacgatcacagtcaccaacacgcgcatggccacggacactcacacgggcacgaaagcaataagtttttagaagaatacgacgccgttctgaagggccttgtagctctcggcggtatttacctcctttttattatcgaacactgtattagaatgtttaagcactataagcagcagagaggtaagcagaaatggttcatgaagcaaaatacggaagagagcactatcgggcgtaagcttagtgaccacaagctgaacaacacccctgacagtgactggctgcagcttaagcctctggccggtacagacgactccgtggtctctgaagatcgcttgaatgaaacagaactaacggacctcgaaggacagcaggagagccccccaaagaattatctttgcatcgaggaggagaagatcatcgaccatagccattccgatggactccacacaattcacgagcacgaccttcatgctgctgcccacaatcatcacggggagaacaaaacagtcctgcggaaacataatcaccagtggcaccacaagcactcccaccactcacatggcccctgtcattctggttcagatctgaaggagaccgggatcgccaacattgcgtggatggtgatcatgggagatggaatacacaacttctctgatggacttgcgatcggcgctgccttctctgctgggcttaccggaggaataagtacttccattgctgtattttgccacgagctccctcacgagttgggtgactttgctgttttgctcaaggcaggcatgacggttaagcaggccattgtgtataacttactgtctgctatgatggcctatatcggcatgcttataggaacagccgtgggacagtatgccaacaatattaccctttggattttcgctgtgaccgccggcatgtttctgtacgttgctctggtggatatgctgccggagatgctgcatggcgatggtgataacgaagaacatggcttctgtcccgtggggcagtttatccttcagaacctgggcttgctctttggttttgcaatcatgctcgtaatagccttatatgaggacaagatcgtcttcgatattcagttctag

SEQ ID NO: 30316 - DNA, 2496 bp, Artificial Sequence
  Description of Artificial Sequence: Synthetic coding sequence
atgaaagtgcacatgcatactaaattctgcctgatttgtctactgacatttatatttcatcactgtaaccattgtcacgaagagcatgatcatggacccgaggcactgcaccgacagcatcgcggcatgaccgagctcgaaccctcaaagttctctaagcaggcagctgaaaacgagaaaaagtactacatcgaaaaactgtttgaacgctacggtgagaacgggcggctctctttttttgggcttgaaaaattgttgacgaatctggggcttggcgagcgcaaagtcgtcgaaatcaatcacgaagatctgggccatgaccacgtgtcccatctggatattttggccgttcaggagggaaagcactttcactcccataatcatcaacattcacacaaccaccttaactctgaaaatcagacagtcacttccgtctcaaccaagcggaaccacaaatgcgaccctgaaaaggagactgtcgaggtctccgtgaagagcgacgacaagcatatgcacgaccataatcacagacttcgccatcatcaccgactgcaccatcacctcgaccacaacaatacccaccatttccataacgattctatcacccccagcgagcgcggagaaccatctaatgagccttcaaccgaaacgaataaaacccaggaacaatcagatgtgaaactcccaaaaggcaagcggaaaaagaagggccggaagagtaacgaaaacagtgaagtgatcacacccgggttccccccaaatcatgaccagggcgagcaatacgagcacaatagggttcacaagccagacagagtccataatccgggtcattcccatgtgcaccttcctgagcgcaatggccacgatccaggaagagggcatcaagacctggatccggacaatgaaggagaactgaggcacacacgaaagagagaggcccctcacgtgaaaaataacgccatcataagcctgcgcaaggaccttaacgaggatgatcatcatcacgagtgcttgaacgttacccaactgttgaagtactatggacacggcgccaactctcccatcagtacggatctcttcacatacctgtgccctgcgctcctgtaccagatagactcacgactatgtatagaacattttgacaaacttctcgtcgaggatattaacaaggataagaatttggtacccgaagatgaggcaaacatcggcgcctccgcttggatatgcggtattatctctattacagtcataagtctgctcagtcttctcggagtgattctagtacctattattaatcagggatgttttaagttccttctaacttttttagttgctttggcagtcggcaccatgtcaggcgatgcactgctacacctgctgcctcacagccagggcgggcatgaccattcacaccagcacgctcacggccacggccactcccatggccacgagtcgaataagtttctggaggagtatgatgccgttctcaaagggcttgtcgcattgggcggcatttaccttctttttatcatcgaacactgcatccgcatgttcaagcactataaacagcagaggggaaagcaaaaatggtttatgaaacaaaataccgaagagtcaaccatcgggagaaaactgagtgatcacaagcttaataatacaccagactccgattggctgcaattgaaacccttagcagggaccgacgattcagtggtctccgaggaccggcttaatgagaccgagctgacagatctggagggtcaacaagagtcgcctcccaaaaactatctgtgcattgaagaggaaaagatcatcgatcactcacatagcgatggcctgcataccatccatgagcatgacctgcatgcagctgcccataaccatcacggggagaacaagactgtcttgaggaaacacaatcaccagtggcaccacaagcacagccatcatagccatgggccatgtcactccgggagtgatcttaaggagactggaattgccaatattgcctggatggtcatcatgggcgacggaattcacaatttcagtgacgggttagccattggagcagcattctccgcagggctcactgggggaatatctactagcatagcggtgttctgccatgagctcccccacgagctgggcgatttcgctgtgttattgaaggcaggcatgacggtcaaacaggcgattgtgtacaacctcctttccgctatgatggcttatattggcatgttgattggtacagctgtgggccaatatgcaaacaatatcacattatggatcttcgctgtgactgccggaatgtttctttatgtcgctctggtagacatgttgcccgagatgctgcatggcgacggagacaatgaggaacacggattttgccctgtgggtcagttcatcctccaaaatctggggcttctgttcggctttgccattatgctggtaattgccctctacgaggataagattgtcttcgatatccagttctag

SEQ ID NO: 30317 - DNA, 117 bp, Artificial Sequence
  Description of Artificial Sequence: Synthetic coding sequence
atgaaagtccacatgcacacaaagttctgccttatctgtctgctgaccttcatctttcaccactgcaatcactgccacgaagagcatgaccatggtccagaggccttgcatcgttag

SEQ ID NO: 30318 - DNA, 393 bp, Artificial Sequence
  Description of Artificial Sequence: Synthetic coding sequence
atgaaggtgcatatgcatactaaattctgtctgatttgtctcctgacctttatattccatcactgcaatcactgccatgaggagcacgaccatggtccagaagccctgcaccgacaacacagaggcatgaccgagttggagccgtctaaattttccaagcaagcagccgaaaatgagaagaaatattacatcgaaaaactttttgagcgctacggggagaatgggcgtctgtccttttttgggctagaaaagctcctgaccaatctgggccttggcgagagaaaggtggttgaaatcaatcacgaggacctaggccacgatcatgtttcccatcttgacatcttggccgtccaagaaggaaagcattttcattctcataaccaccagcactag

SEQ ID NO: 30319 - DNA, 381 bp, Artificial Sequence
  Description of Artificial Sequence: Synthetic coding sequence
atgaaagtgcacatgcatacaaaattttgtctcatatgtttactgaccttcattttccatcattgtaatcactgtcacgaagagcatgaccatggaccggaggccttgcatcgtcagcaccgcgggatgaccgagctggagccttccaagttctccaaacaagcagccgagaacgaaaaaaagtattacattgagaagctctttgagcggtacggagagaatggacggctgtccttctttggactggagaagcttttaaccaatctcgggttaggcgaacgtaaggttgtcgagattaaccacgaggatctcgggcacgaccacgttagccacctcgatatcctggcggtgcaggagggaaagcattttcactcccactag

SEQ ID NO: 30320 - DNA, 1146 bp, Artificial Sequence
  Description of Artificial Sequence: Synthetic coding sequence
atgagcggagacgctctgctgcacctgctgccccactcacaaggtggtcatgatcacagtcaccagcatgcccacggacacggtcattcccacgggcacgagtcaaataaattcctcgaggagtacgatgcagtgctaaaagggctagttgccctgggaggtatctatttattgttcattattgagcactgcatcaggatgtttaagcactataaacagcagagggggaagcagaagtggttcatgaaacaaaacacagaggaaagtacaatcggcaggaagctgtccgatcataaattaaacaacacacctgacagtgactggctccaactgaaaccactagcaggtaccgacgactccgtggtctccgaggaccggctaaatgaaaccgaattgactgacctggaaggccaacaggagagcccaccaaagaactatttgtgcatagaggaagagaagataattgatcacagccactccgatggactgcacacgatccacgaacacgatctgcatgccgctgcccataatcaccacggggaaaataagaccgtcctccggaagcacaatcatcaatggcaccacaaacacagtcaccacagtcacgggccctgccactcaggctcagatttgaaggagactggaattgctaatatagcctggatggtcatcatgggcgatgggatccacaactttagtgatggcctcgcaattggagctgcattctcggcgggcctaacaggggggatttccacatctattgcagtattctgtcatgagctcccccacgagcttggggactttgcagttctgttgaaagccggcatgacagttaagcaggccatagtgtacaacctcctatcggctatgatggcttatatcgggatgttgatcggcaccgcggtcggtcagtacgccaacaacattaccctttggatctttgctgtcacagctggcatgtttctgtacgttgcgctggtagatatgctccctgagatgctgcacggtgatggtgataacgaggaacatggcttttgcccggttgggcagtttatcttgcagaatctgggtcttttattcggcttcgccataatgctcgttatcgctctgtacgaggataagattgtctttgatatccagttctag

SEQ ID NO: 30321 - DNA, 2076 bp, Artificial Sequence
  Description of Artificial Sequence: Synthetic coding sequence
atgtgcttcaggaccaagctaagtgtctcatgggtccctttgttccttctgttatccagggtcttcagtacggaaactgacaagcccagtgcccaggattcgaggtcgaggggcagcagcgggcagccagcagacctgttgcaagtgctgtcagctggcgaccaccctccacacaaccattcgagaagcctgattaagaccctgctggaaaaaaccggatgccccagacggcggaacggaatgcaaggagactgcaacttgtgttttgagcctgacgccctattactcatagctggaggcaactttgaggatcagctgcgagaagaagtcgtgcaaagggtaagcctcctgctgctgtattatatcatacatcaggaagaaatatgtagctctaagcttaacatgtcaaacaaggagtacaaattctatcttcattccctgctgagtctgagacaggatgaggattctagttttttgtcgcagaacgaaaccgaagacatcttggccttcacaagacaatacttcgacacttctcagagtcagtgcatggagactaagaccctccaaaagaaaagtggcattgtgtctagcgagggagcaaatgagtccacattaccccaattagccgctatgatcatcacactcagcctgcagggagtgtgtctcggacagggaaacctgccttctcccgactatttcactgagtacattttttcttccctgaacaggacaaacactttgcgtttgagcgaattggatcagcttctgaacactctttggaccagatccacttgtataaaaaacgaaaaaattcatcagtttcagcggaagcaaaacaatatcattacccatgatcaagattactctaatttctcttcatccatggaaaaggagtccgaagacggacccgtgagctgggaccagacttgtttttcggctagacagctggttgaaatcttcctgcagaagggcctgagcctcataagtaaggaagattttaaacaaatgtccccaggaatcattcagcaactcctgagctgctcatgccatttacctaaggaccaacaggcgaagctccccccaacgactcttgagaaatatggttactctaccgtggccgtgaccctgttgaccctgggctccatgttgggcactgctcttgtgttgtttcattcatgcgaagagaactaccggctgatcctgcaactcttcgtcggactcgccgtgggcacactgagcggcgatgccctgctgcacctcataccccaggtgctgggcctccataaacaggaagcccctgagttcgggcactttcacgagagcaagggccatatttggaagctaatgggcttgatcggcggtattcatggcttcttcttgattgaaaaatgtttcatactgctggttagtcccaatgataagcagggtttgagcttggtgaatggacacgttgggcatagtcaccacttggcattgaactcagagttgagtgaccaagccggaaggggcaaatcagctagcacaattcagcttaaatcacccgaggatagtcaagcagctgaaatgccgattgggagcatgactgcgagtaaccgcaaatgtaaagctatctcactccttgccattatgattttggtgggagatagcctgcacaacttcgccgacggtctcgctatcggggcagctttctcatctagctcagagagcggcgtcactacaactatcgcaatcctgtgtcatgaaatccctcatgaaatgggtgactttgccgtgctcctgagttcaggactctccatgaagacagccattctgatgaacttcatctcatctctgactgccttcatgggattgtatataggactttcagtgtccgctgatccatgcgtccaggactggatcttcacggtcacagctggtatgttcttatatctttccctggtcgagatgctcccagaaatgacccatgtccaaactcaacggccgtggatgatgttcctcctgcagaactttggcttgatattgggatggctttcccttttactgctggctatttatgaacaaaatataaagatctag

SEQ ID NO: 30322 - DNA, 2073 bp, Artificial Sequence
  Description of Artificial Sequence: Synthetic coding sequence
atgtgtttccggacaaagctgtcagtatcttgggttccactgtttctgctcttgtcgagagtgttttctacagaaactgacaagcctagcgcccaagactccaggagcaggggtagctcagggcaacctgccgatctcctgcaggttctcagcgccggtgaccacccgccacacaaccactcccgatcacttattaagaccctgctggagaaaactggatgtccccgtcgcaggaatggaatgcagggtgactgtaatttatgcttcgagcccgacgcactgttgttgattgccggggggaattttgaggaccaactgagggaggaggtggtccagcgggtctctctcttgctcctgtactatattatacatcaggaggaaatctgtagttcaaagcttaacatgagtaataaagagtataaattctatctgcactccctgttgtccctgagacaggatgaggatagctcttttctgtctcagaacgaaaccgaagatatcctggccttcaccaggcagtactttgacacatctcagagtcagtgtatggaaactaagacccttcagaagaaatctggaattgtatccagtgagggggccaatgagagcacactacctcagctagctgctatgatcataacactgagtctgcagggggtgtgcctcgggcagggcaatttaccttcgcccgattacttcaccgaatacatctttagttccttgaacagaacaaatactctgagactgtccgaacttgaccagctgttgaacactctgtggaccagatcaacatgtattaagaatgagaaaatccatcaattccaaaggaaacagaataacataattacgcacgatcaggactacagcaactttagttcttcaatggagaaggaatccgaggacggtccagtgagctgggaccagacatgttttagtgcaagacaactggtcgagatcttcctccagaaggggttgagtctgatttctaaggaggactttaagcagatgtcacctggaattattcagcagctgttgtcatgcagttgtcacctgcccaaggaccagcaggccaagctgccccccacaaccctggagaagtatggctatagcaccgttgccgtgacactgctgactctgggaagcatgttgggcaccgcactggtcctgtttcattcatgtgaagaaaactaccgattgatcctccagctgtttgtgggactggcagtgggcactctttctggtgatgcgcttcttcatctcatacctcaggtccttggcctgcataagcaggaggctccggaatttggtcattttcatgagtctaaaggccacatttggaagctgatgggcttaatcggggggatacacgggttcttccttatagaaaaatgctttattctactggttagtccgaatgacaagggtttatccctagtgaatggacacgtgggtcacagccatcacctagctctgaacagcgagttgtcagaccaggccggccgcggtaaaagcgccagtaccatacagttgaaaagcccggaagacagtcaggcagccgaaatgcctataggcagtatgaccgcgagcaacaggaagtgcaaggctatttcactgttggcaattatgatcctggtaggtgactctctccataactttgctgatgggctcgcgattggggctgccttcagtagctccagcgagagcggggtcaccactacaatagccatcctgtgtcatgaaatcccacacgagatgggagattttgcagtgttgctgagctcaggcctctccatgaagacggccatccttatgaatttcatttccagtctgactgcgtttatgggactgtatattggccttagcgtcagcgccgacccctgtgtgcaggactggatattcaccgtcacagcagggatgttcctttacttgtctttggtggagatgctgcctgagatgactcacgttcagacacaacgcccttggatgatgttcctgctgcagaatttcgggctgatccttggctggctgtctctactcctgctagcaatttacgaacagaacatcaaaatatag

SEQ ID NO: 30323 - DNA, 1965 bp, Artificial Sequence
  Description of Artificial Sequence: Synthetic coding sequence
atgtgtttccgaaccaaactgagcgtgtcctgggtaccccttttcctcctcctgtcacgagtattctcaactgaaactgacaaaccctcagcacaagatagccgaagtcgcggctcttcaggacaacctgctgatctgctgcaggttctcagtgctggagaccacccccctcacaatcattctcggtccctgattaaaacactgctcgagaagactggttgcccccgccgcaggaacggtatgcaaggcgattgtaatctctgctttgagccagatgcactgttgcttatcgccggaggtaacttcgaggatcagctgcgcgaagaggtggtgcagagagttagcctgctgctcctttactatatcatccatcaagaagaaatttgctcctcaaagctgaatatgagtaacaaagaatataagttctacctgcactcgttattatccctgcgccaagacgaagattcctctttcctcagccagaacgagaccgaggacattttggcattcacaaggcagtatttcgacaccagccagtcccagtgcatggaaaccaaaactctccagaaaaagtctggcattgtatcctccgagggagctaacgagagcaccctcccccagctggctgcaatgattatcactctctccctgcagggtgtgtgcctcggtcaggggaatctgcccagcccagattatttcacagagtatattttcagttctcttaatagaaccaataccctgcgcctatctgaactggatcagttgctcaatacactgtggacccgctcaacttgtataaagaatgaaaagatccaccagtttcagcgaaagcagaacaatatcattactcatgaccaggactactccaatttctcgtcgtctatggaaaaagaatcagaggacggcccggtgtcctgggaccagacctgcttcagtgcacggcaactggttgagattttcctgcagaaaggcctgagtctcatctcaaaggaggattttaagcagatgagtcccggtatcatccagcagctactcagttgttcctgccacctcccaaaggaccagcaagcgaagctgcctcctacgaccttggaaaaatatgggtacagtaccgttgccgtgaccctgcttacactgggcagcatgctggggaccgccctcgtgctatttcattcatgcgaggaaaattatcgcctcatcctgcaactattcgtgggtttggccgtaggaaccctgagcggtgatgccctgctgcatctgatcccacaggtgctgggtctgcacaaacaggaagcccccgagttcggccactttcatgaaagtaaggggcatatttggaagctcatgggactcataggcggaatccatggctttttcctgattgagaaatgttttatattgctggtctctcccaacgacaaaaaatccccagaggactcacaagctgctgagatgccaattggttcaatgaccgcatccaaccgtaagtgtaaagccatatctctgctcgcgataatgatcctggtcggagactccttgcacaattttgcggacggactggctattggggcggcatttagctcttcgagtgagagtggcgtgactaccacaatagccattttgtgtcatgaaattccccacgagatgggcgacttcgccgtactattatctagtggcctgtctatgaagaccgcgatactcatgaatttcatctcgtccctgacggcgttcatgggtctgtacatcggcctgtccgtgagtgcagacccctgtgtgcaggattggatctttaccgtcacagccggaatgttcctgtatttaagtcttgtggagatgctccctgaaatgacacacgtgcagacccagaggccatggatgatgttcctactgcagaattttggcttgatcctggggtggctaagcctgctactgctcgctatctacgagcagaatataaaaatttag

SEQ ID NO: 30324 - DNA, 1836 bp, Artificial Sequence
  Description of Artificial Sequence: Synthetic coding sequence
atgcagggtgattgcaacttgtgttttgaaccagatgccttactcctcattgcaggtggcaactttgaagaccagcttcgcgaagaggtggttcagcgagtgagtctgctcctattatactatattattcaccaggaagaaatctgttcttccaaacttaatatgtctaacaaggagtacaaattctatcttcactcactgcttagcttgcggcaggatgaggactcaagctttctgtcccagaatgaaacagaggatatcctggcctttacccgtcagtactttgataccagccaatcccagtgtatggagaccaaaactctccagaagaagtccggcatcgtgtctagcgagggagccaatgagagtaccctgccccaactggcagccatgatcatcaccctctctttgcagggcgtctgtctgggacaaggcaaccttccaagtccagattacttcactgagtacatctttagctctctgaacagaactaacaccctcagattaagtgaacttgatcaactgctgaatacgctatggacccgaagcacatgcatcaagaacgagaaaatacaccagttccaacggaaacagaataatatcataacccacgaccaggactatagcaatttctcttcgagtatggaaaaggagagtgaagatgggccagtcagttgggatcagacatgtttctcagcacggcagctggtcgagatcttcctccagaagggcttaagcttgataagcaaagaggatttcaagcagatgtccccagggataattcagcagttactctcctgctcatgtcacctgcccaaagaccagcaggccaagttacctccaaccaccctggagaagtacgggtactcgacggtcgctgttactttactaaccctggggtccatgctgggcactgccctggtgctgtttcattcatgcgaagaaaattaccggttgatactccagcttttcgtgggattggcagtgggtacactgtcaggagatgctctgctccatctgatcccacaggttctaggtctccacaaacaggaagcacccgagtttggccattttcacgagtccaaaggtcatatttggaagctaatgggattgataggaggcattcatggcttcttcttgatcgagaaatgtttcatacttctcgtgtctccgaatgataagcagggcctgtccctggtcaacggccatgttgggcattctcaccacttagcgcttaactctgaactctcagaccaagctggccgcgggaagtcagcgtcaacgatccagctcaaaagtccggaggactctcaggcagccgaaatgcctatcggaagcatgaccgcctccaatcgcaagtgcaaggcaatttctctgttagccataatgatcctcgtgggagactccttacacaactttgcagatggcctagcaataggagcagctttcagctccagtagtgaaagcggcgtgaccacaacaattgctatcttatgtcacgaaataccacacgaaatgggggatttcgctgtccttcttagctctggcttatcaatgaagaccgcaatcttgatgaactttatctcttcactcactgcctttatgggactttatatcggcctcagtgtatcagccgatccttgcgtgcaggattggattttcaccgttactgcaggtatgttcctctatctgagcctcgtcgagatgctgcctgaaatgacgcacgtgcagacgcaacggccttggatgatgtttcttctgcagaatttcggtctcatcctgggctggctaagcctgctgcttctagccatttatgagcagaatattaaaatttag

SEQ ID NO: 30325 - DNA, 1674 bp, Artificial Sequence
  Description of Artificial Sequence: Synthetic coding sequence
atgagcaataaggagtataagttctacctgcacagtctgctctcattgagacaggatgaggacagttcattcctgtctcagaacgagacagaggacattctggccttcacccgtcagtatttcgatacgagtcagagccagtgtatggagactaagaccctgcagaaaaagtccgggatcgtctccagtgagggcgccaatgagtctaccttgccccagttggctgccatgatcattacactcagtctacagggggtgtgtttgggccagggcaacctgccttcccccgattattttacggagtatattttttctagcctgaaccggactaacacattgaggctctccgagctggaccaactactgaatacgctttggacaagaagtacatgtataaaaaatgaaaagatccaccagtttcaaaggaaacagaataatataatcacgcacgaccaggactactccaatttttcctcaagcatggaaaaggagtcagaagacggcccagtttcctgggatcaaacctgtttttcagctcggcaactcgtggaaatatttcttcagaaaggactgtcactgataagtaaggaagatttcaagcaaatgagtccaggcattatacagcagttgctgtcatgtagctgccatcttcctaaggaccagcaggccaaacttcctccaactactctcgagaaatatggatactcaactgtggccgtcactctgctcaccctggggagcatgctcggcactgcactcgttctgtttcacagttgcgaggaaaattacagactaattctccagctgttcgttgggcttgctgttggtaccttgtcaggagatgcactcctccatctcatcccccaggtgctggggctgcacaagcaggaggcaccggagtttgggcatttccatgagtccaaaggtcacatctggaaactgatgggcctcattggaggaatccacggcttttttctgatagaaaagtgtttcatcctcttggttagcccaaatgacaaacaaggcctctccctggtcaatgggcacgtaggccactctcaccatctcgccctcaatagcgagcttagtgatcaggcaggccggggcaagtccgcatccaccatccagctaaagagccctgaagatagtcaggccgctgaaatgccaatcggttccatgactgcttccaaccgaaagtgcaaagctatatcactgctggccatcatgattctggttggagacagtttacacaactttgccgacggacttgcaatcggagccgcctttagctcctcaagtgaaagcggtgtcaccacaaccatcgcaattctgtgccacgaaatcccccatgaaatgggagattttgcagtcctactctcgtcaggactatccatgaagactgctattctgatgaactttatctcatctttgacggcgtttatgggactctacatcggtctgagcgtttctgcggatccttgcgttcaagactggatattcaccgtgacagcaggcatgtttctatacctgagcctagtggagatgctgcctgagatgactcacgtgcagacccaacggccttggatgatgttcctgctgcaaaactttggtttgattctcgggtggctctctctcctactgctggcaatatacgagcagaatattaagatttag

SEQ ID NO: 30326 - DNA, 1446 bp, Artificial Sequence
  Description of Artificial Sequence: Synthetic coding sequence
atgaaactgctcctgctgcatccagcatttcagtcctgcctgttgcttaccctactagggctgtggcggactacccctgaagcgcacgctagctctctaggggccccagccatctccgcagcttcattcttgcaggacttaatccataggtacggagagggtgactctcttaccctgcagcagctgaaggccttgctcaaccatttggatgttggagttgggaggggcaacgtcactcagcatgtgcagggccatcgaaatttatcgacatgcttttcctctggggacttattcacggctcacaacttttccgaacagagtcgcatcgggtcctccgaactgcaagagttttgtcctacgattctccagcagctggattccagagcatgcacatcagaaaaccaggagaatgaagaaaacgaacagactgaagaaggcagacctagcgcagtggaagtttggggatacggtctgctgtgcgtgacagtgatctccctgtgtagcctgctgggagccagcgtcgtaccctttatgaaaaagaccttctacaagcgcctgctgctctattttatcgcgctggcaattggcactttgtacagcaatgccctgttccagcttattcctgaggctttcggtttcaatcctttggaagattactatgtatctaagagcgctgtggttttcggtggcttttatctgttcttcttcaccgagaaaatcttgaaaattttactcaagcagaagaacgagcaccatcacgggcattcacactacgcctcagaaagcctcccctccaagaaggatcaagaggagggagtgatggaaaagttgcagaatggggatctggatcatatgattccgcaacactgcagtagcgagctagatggcaaggcccctatggtggacgaaaaggtgatcgtgggctctctgtccgtccaggacctgcaggcttctcaatcggcttgttattggcttaaaggagtgcggtattctgacattggcaccctcgcgtggatgatcacgttgtctgatgggctgcataactttatcgacggcctcgcgatcggagcaagtttcacagtgagtgtttttcagggcatttctacatcagtagctatcctgtgcgaggaattcccccatgagctcggcgattttgttatcctcctgaatgctggaatgtctatccaacaagctctgttctttaacttcctgtcggcatgttgttgttacctgggtctggccttcgggatactggccgggagtcatttcagcgccaattggattttcgccctggcgggaggaatgttcctttatatttctctggccgacatgatggagttttgctcagtggcccaagctggggtccagtggtgccacctgtcatctctgcagcccctgccgttgggcctgaaacggctgtcctgcttatcactgccatctaactag

SEQ ID NO: 30327 - DNA, 1479 bp, Artificial Sequence
  Description of Artificial Sequence: Synthetic coding sequence
atgaagcttctgctcctgcatcctgcatttcagagttgtttactgctgacactacttgggttgtggaggacgacacctgaagcacacgcctcaagcctgggcgctcccgccatttctgccgcatcatttctacaggacctgatacacaggtatggcgaaggggattcacttactttgcaacaattgaaagctctgctgaatcacctggacgtcggggtcggaagaggtaacgtgactcaacacgtgcagggccacaggaatctgtctacgtgtttctcatctggagacctttttaccgcccacaacttcagcgagcagtcacgcattgggtctagcgagttacaagagttttgtcccactatactacagcagttagattccagggcctgcacttctgaaaaccaagagaatgaggagaacgaacagacagaggaggggcggcccagcgctgtcgaagtatgggggtacggcctgctctgcgtgaccgtaatcagtttatgttccctgctgggcgcctcagtcgtgccctttatgaagaagaccttttacaagagactattgctgtactttatcgctctcgccatagggacattgtactctaacgcattgtttcagttgatacccgaggcctttgggtttaaccctctggaagactattacgttagtaaatctgccgtggtctttgggggcttttacctcttcttcttcaccgaaaaaatcctgaagatcctgctaaaacagaaaaatgaacatcatcacgggcatagccactatgcatccgagtcactgccatctaagaaagaccaagaggagggagtgatggagaaacttcagaacggagaccttgaccacatgatcccgcagcattgcagcagtgaattggatggcaaagctcccatggtcgacgaaaaggtgattgtcggctccctaagcgtccaggatcttcaggccagccaatcagcttgctattggttgaaaggagttcggtattcagatatcgggaccttggcctggatgatcacactctcagatggactgcataatttcatcgatggcctcgctataggggcatcctttaccgtgagtgtttttcaggggatcagtacatccgtggcaattctgtgtgaggagtttcctcatgaactcggcgatttcgtgatactgcttaacgcgggaatgagtatccagcaggcactgttcttcaacttcctttctgcctgttgttgctatctgggtctcgcttttggaatcctggcgggatcccacttcagcgcaaattggatctttgcccttgctggaggcatgtttctctatatatctctggcagatatgtttccggaaatgaacgaggtgtgtcaagaagacgagaggaaagggtctatcctgatcccctttattattcaaaatctggggctactgacagggtttactattatggttgtgctgacgatgtacagtgggcagatacaaatcggttag

SEQ ID NO: 30328 - DNA, 1479 bp, Artificial Sequence
  Description of Artificial Sequence: Synthetic coding sequence
atgaaacttctgcttttgcatccagccttccagagttgtcttctcttgaccctgctggggctttggaggactacccctgaagcacatgcgtcatctcttggcgcaccggccatctctgcagcatccttcctgcaggatctaatccaccggtacggcgagggagacagcctgacactccaacagctaaaggctctgctgaaccacttagacgttggtgtgggtcgtggtaacgttacgcaacatgtgcagggacatagaaatctgtctacttgtttctcctctggggatttgttcactgcacacaacttctctgaacagagtcggatcggcagctctgagctgcaggaattctgtccaacgatcctgcagcagctcgacagtagagcatgcactagcgagaaccaagaaaatgaagaaaacgagcagacagaagagggccgcccaagcgccgtggaggtgtggggctttggattcctgagtgttagtttgatcaatcttgcttccttgcttggcgtgctcgtcctcccctgtactgagaaagcttttttttctcgcgtgctcacttactttatagcactatctatcggtacactcttatctaacgccctgttccagctgattccagaggcatttggattcaaccctctggaggattattatgtctctaagtccgctgtggtattcggagggttctatttgttttttttcactgagaaaattcttaaaattctcctgaagcaaaagaacgagcatcatcacggccatagccactacgccagtgagtccttaccaagtaaaaaagaccaggaggaaggggtgatggagaaacttcaaaatggagatctggaccatatgatcccccagcattgttcctctgaactggacgggaaggcacccatggttgacgagaaggtcatcgtgggctcactgtctgtgcaagacttacaggctagtcagagtgcgtgttactggctgaagggcgtgcgctactccgacatcggaaccctcgcatggatgatcacactgagcgacggattgcataattttatcgatggactggcgataggagccagtttcaccgtgagtgtgtttcaaggtatctctactagcgtggctattctttgcgaagaattccctcacgagctcggcgactttgtcattctgttgaatgccgggatgtcaattcagcaggctctttttttcaatttcttgagtgcatgttgttgttatctgggcttggcgttcggcattctggccgggagtcacttttctgcaaattggatctttgctttagccggtggcatgtttttatatatttctctggccgacatgttcccagagatgaacgaggtttgtcaggaggatgaaagaaaagggtcaatcctgattcctttcatcatccaaaacctgggtctcctgactgggttcacgattatggtcgtactgactatgtattccggccagatacaaataggctag

SEQ ID NO: 30329 - DNA, 1479 bp, Artificial Sequence
  Description of Artificial Sequence: Synthetic coding sequence
atgaaactgttattacttcaccctgcctttcagagctgcttgttgctgacgctcctaggcttatggagaaccacccctgaagcacatgctagtagtctaggcgcccccgcaatctccgccgctagcttcctgcaggatttgatacaccgctacggtgaaggagacagtctgactctgcagcagctcaaagctctcctgaatcatctggacgtgggtgtcggacggggtaatgtgacccagcatgtgcagggacatcggaacctgagtacttgctttagcagtggcgacttgtttacagcccacaatttttctgagcagtcccgcatcgggtcctcagaactgcaggagttctgtcctaccatcctacagcagctggattccagagcgtgcacatcagagaatcaggagaacgaagaaaacgagcagacggaagaggggcgtccgtcggccgtagaggtttggggctacggactgctgtgcgtgaccgtgatctctctgtgttccttgctaggtgcatcagtggttccctttatgaaaaaaactttttacaagagattgcttctgtattttattgccctggccatcgggaccctgtatagtaacgcgctgtttcagctgatccccgaagctttcggtttcaaccctctggaggactactatgtttctaagtcggccgttgtgttcggaggattctacctgttcttctttaccgaaaagattctgaagatacttctaaaacaaaaaaatgaacatcaccacgggcactcgcattatgcatcagagagtctgccctcaaagaaagatcaagaagagggtgtgatggagaaactgcagaatggagatctggatcacatgatcccccaacactgtagctccgaactcgacggcaaagccccaatggtcgatgagaaggtcatcgttgggtccctaagcgtgcaggacctccaagcttcccaatccgcatgttactggttgaaaggcgtgaggtatagcgacatcgggacacttgcctggatgataactctgagtgatggactccataatttcatcgatgggcttgcaattggagcgagctttacagtatccgtcttccagggaatctcaacatcggtggcgatcttgtgtgaagagttcccacacgaactcggggattttgtgatccttctcaacgccggaatgtctatccagcaagccttattttttaacttcttgagcgcatgttgctgttatctgggattggctttcggaatcctggccggctcccatttttcagccaactggattttcgccctcgcgggcggtatgttcctgtatataagcctagccgatatgtttccagaaatgaatgaggtatgccaggaagatgaacgcaagggttcaatcttgataccattcattatccaaaaccttggactcttaaccgggtttacaattatggttgttttaactatgtactcaggccagatccagatcggatag

SEQ ID NO: 30330 - DNA, 1383 bp, Artificial Sequence
  Description of Artificial Sequence: Synthetic coding sequence
atggctccagggagggcagtggcaggtttgctactactagccgcagcagggctcggcggagttgctgagggacccggtctggcgttctccgaagacgtgttgtctgtgtttggcgctaacttgtctctcagcgctgcgcagctgcaacacctattggaacagatgggggccgcctcgcgtgtgggtgtgcccgaacctggccaactgcattttaaccaatgcttaaccgctgaagagatcttcagtctgcatgggttcagtaacgcgacacaaattacttcttcaaaattctcagtcatctgcccggccgtcctgcagcagcttaacttccacccttgtgaggatcgccccaagcataaaaccagaccttcacactccgaagtatggggctatggcttcctgtccgtaaccatcattaacctggcatccctcctcggactcatattaactcccctgatcaaaaagtcttattttcccaagattctgacattctttgtagggttggccattggcacactgttttcaaatgccatctttcagctcattcctgaagcgtttggctttgacccaaaagtagattcatacgtggagaaggcggtggcagtgttcggcgggttttacttactgttttttttcgagagaatgctcaaaatgctgctgaaaacgtatggtcaaaacggccacacccacttcgggaacgacaatttcggtccccaggagaaaacacaccagccaaaagcccttcctgcaatcaatggggtaacgtgctacgccaacccagctgtgaccgaagctaatgggcacatacacttcgataacgtctccgtcgtctccttgcaggacggtaagaaagagcctagttcttgtacctgcttgaaaggtcctaaactgtcagaaattggtaccattgcctggatgatcaccctttgcgatgccttacacaatttcatcgatggtctggctattggggcttcatgcaccctttcattgcttcaggggttaagtacttcgattgccattctctgcgaggaatttccccacgaattgggagactttgtgatattactgaatgccgggatgtctacaaggcaggctcttttgttcaacttcctatccgcgtgctcatgctacgtgggtcttgccttcgggattctagttggcaacaacttcgctcccaacatcatctttgccctggccggcgggatgtttctttacatatcgctcgccgacatgtttcctgagatgaacgatatgttgcgcgaaaaggtgacaggtagaaagacagattttactttcttcatgatccaaaatgctggcatgctgaccggatttacagccatcctcctgattacattgtacgcaggtgagatagaactggagtag

SEQ ID NO: 30331 - DNA, 1383 bp, Artificial Sequence
  Description of Artificial Sequence: Synthetic coding sequence
atggcccctggtagagccgtggccgggctactgcttctggcagcagccggcctgggcggcgttgcagagggacctggactggcttttagcgaggacgtgttatcagtgttcggagcaaatctgagcctgagcgcagcccagctgcagcatctgctggaacagatgggagccgcttcccgggtgggcgtgccagagcccggccaactgcattttaatcagtgcctgaccgccgaagagatattcagcctgcacggcttttccaatgcaactcagatcacatcttcaaagtttagcgtcatctgccccgccgtgctgcaacagctcaacttccatccttgtgaggaccggcccaaacataagactcgaccatcacatagcgaggtctggggctacgggtttctgagcgttactattatcaacctggcctctttgctcgggcttatcctgacgccactgattaaaaagtcatacttccccaaaatcttaacgtttttcgtgggattagcaatcggcaccctgttcagcaatgccatttttcaactaataccagaagcctttgggttcgaccccaaagtggatagttacgtggagaaggctgttgccgtcttcgggggcttttacctgttgttcttcttcgagagaatgctcaaaatgctactcaagacgtatgggcagaatggacatacccactttggcaacgataacttcggacctcaggaaaagactcaccagcctaaggcccttcctgccattaatggcgtcacctgctacgctaacccggctgtaacagaggctaatggacacattcacttcgacaacgtcagcgtcgtgagcctacaggacggcaagaaagaaccctccagctgtacttgcctgaagggaccgaaactctccgaaatcggcacaattgcctggatgatcactctctgtgacgcactacacaactttattgatggtctggccattggcgccagctgtacacttagccttctccagggtctctctacttcgattgccatcctgtgtgaagaatttccccatgagctgggcgacttcgtgattctactgaacgctggtatgagcactagacaggccttactgttcaacttcctctccgcttgcagctgctacgtaggcctggcgtttggcatcttagtaggtaacaattttgcaccaaatattattttcgctttggcgggtggtatgtttctgtatatcagcttggcggacatgtttcccgagatgaatgatatgctgagggaaaaagtgacagggcgaaagactgacttcactttcttcatgattcagaatgctggaatgctcacgggtttcactgccatcctcctgattacactctatgctggagagatcgagctcgaatag

SEQ ID NO: 30332 - DNA, 1335 bp, Artificial Sequence
  Description of Artificial Sequence: Synthetic coding sequence
atggctcccggcagggccgtagcgggactgctcctgctggcagctgcgggactggggggggtggccgaaggcccaggcttagcttttagcgaagatgtgctctctgtctttggggccaacttatccctgagtgctgcacaattacagcaccttctggagcagatgggggccgcaagccgggttggagtgcctgagcctggacaacttcatttcaatcagtgcctcaccgccgaggaaattttcagtctgcatggcttttcaaatgccacccagattacctcctccaagttctcagtgatctgtccagctgtgctccagcaactcaactttcacccttgcgaggataggccaaaacataagacccgcccgtcccatagcgaagtctggggctacggctttttgtccgtgactatcataaatttagcatcattgctcggcctgattctgacaccactgatcaagaagtcttatttccctaagatccttacattctttgttggcctggcaattggaacattgttttccaatgcgattttccagttaattcctgaagcattcggtttcgaccctaaggtagatagttatgttgagaaagctgttgctgtgttcgggggcttttatcttctcttcttcttcgagcgcatgctcaaaatgttactcaagacctacgggcagaatggacacacgcattttggtaacgacaattttggcccacaggagaaaactcaccagcccaaggccctgccagctattaatggcgtgacttgctacgccaatccagccgtgactgaagccaacggtcatatccattttgataatgtgagcgtagtttccttgcaggatggtaaaaaggaaccgagcagttgcacgtgcctgaaaggacctaagctgagtgaaatcgggaccatcgcctggatgataacgctgtgtgatgctctgcacaattttatcgacgggctcgctattggtgcttcctgtactttgtcactgctccaaggactgtcaacatctatcgcaattctctgcgaggagttcccccacgaactaggcgattttgtgatcctcttgaacgctggcatgagtacacgacaagcgctcctgtttaatttcttgagcgcttgttcctgttacgtgggtctggcgtttgggatcttagttggcaataacttcgctcccaatatcatcttcgctttagccggcggcatgtttttatacattagtctggctgatatgtttcccgaaatgaacgatatgcttcgcgagaagatcatcaaatgggctaccgatgacatcaagagtcagctacatttgctgtggatctacaccgctagatag

SEQ ID NO: 30333 - DNA, 924 bp, Artificial Sequence
  Description of Artificial Sequence: Synthetic coding sequence
atggatgacttcatttctatctctctcctgtccttagctatgttggttggttgttacgtggctgggatcatcccattggcagtgaatttcagcgaggaacgtcttaagttagtgactgtgctgggcgcaggactgctttgcggcaccgccttggctgtgattgtaccagaaggggtgcacgcactgtatgaagacatcctggaaggtaaacaccaccaggcctctgagacacacaacgttatagccagcgacaaggctgccgaaaagtctgttgttcacgaacacgagcatagccacgaccatacacagttgcacgcatacattggtgttagtcttgtgctaggattcgtgtttatgctgctggtggaccagataggcaactcccacgtgcactctactgacgacccagaggccgcccgatcaagcaattctaagattaccacaacccttggactggttgtgcacgccgctgctgacggggtggctctcggtgcagctgcgtccacttctcaaactagcgttcagctgatcgtttttgtggctatcatgctgcacaaggctcccgctgcgttcggcctggtatcattcctgatgcacgcagggcttgaacgcaataggattcggaagcatctgctagtgttcgccttggctgcccccgtcatgtcgatggtcacttacctcgggctatcaaagtcctccaaagaagcattatcagaggtaaacgctacaggggtggcgatgctgttttcagccggcacgtttctctacgtggctacagtgcatgtcctgcccgaggttggcggcataggccatagccataagcccgatgctactggcggtagagggttgtctaggttagaagttgccgccctggtactgggttgcctaataccgcttattctgagcgtgggacatcagcactag

SEQ ID NO: 30334 - DNA, 924 bp, Artificial Sequence
  Description of Artificial Sequence: Synthetic coding sequence
atggacgactttatctcgatatctctactgagtctcgctatgctggtaggttgttatgtggccggcattatcccgttagccgtgaattttagcgaggaaaggctcaagctggtaactgtgttgggtgccggccttctatgtggcactgcccttgctgtcattgtgccggagggcgtccatgctttgtatgaggacatattagaggggaagcaccaccaggccagcgagacacacaacgtgattgcttccgacaaagccgccgagaagtctgtcgtgcatgagcatgagcactcacatgaccacactcagctccatgcgtacataggagtgtctctggtgctgggctttgtgtttatgctgctggtggaccaaatcgggaatagccacgtgcacagcaccgatgaccccgaggcagcccgaagtagtaacagcaaaattaccacaacactggggctcgtggttcatgccgctgcagatggagtagccttgggggccgccgccagcacctcccaaacgtcagtgcagcttatcgtctttgtggcaataatgctgcacaaggcacctgccgcgttcggacttgtctcatttttgatgcacgcaggcctggagagaaaccggattagaaagcatctgctggtgtttgcgctggcagccccggtgatgtccatggttacgtatctgggcttgagcaaatcttctaaggaggccctgtccgaagttaatgccacgggcgtggctatgcttttcagcgccggaactttcctttacgtagcgaccgtgcacgtcctgcccgaagttggaggtattggccattcacacaagccagacgcgaccggggggaggggcctttcacggctggaggtcgccgcactggtactgggatgtctgatcccactaatattgagtgtgggacaccaacactag

SEQ ID NO: 30335 - DNA, 2691 bp, Artificial Sequence
  Description of Artificial Sequence: Synthetic coding sequence
atggagatgaaactcccaggacaggaaggctttgaggcctcatcggcaccacggaatatacccagcggagaattggatagcaacccagatccaggcaccgggccaagccccgatgggcccagtgatacagaaagcaaagaactaggtgtcccgaaggacccactgctgtttatccagctgaacgagctcctcggctggccacaggctctcgagtggagagagacgggtaggtgggtattgtttgaagagaagctggaagttgccgccggaaggtggtcagcaccccatgtacccacattggccttgccctcccttcagaagttgagatccctgctggctgagggcctggtgctcctcgactgtcccgcacagtcactgctggaactggtggaacaggtgacccgggtggaatccctgtcccccgaattgcgtgggcagctccaagctctcctgctccagagaccccagcactacaaccagaccaccggtacacgtccatgctggggatctacccacccccggaaggctagtgataacgaagaggcccctttaagagaacagtgccagaatccactgaggcagaagctgccaccaggagcagaggccgggactgtcctcgcaggagagcttgggtttctggcacaacctctgggagctttcgttcgtcttagaaacccagtggtcctcggttctttgactgaagtctctctgccttctcggtttttttgtctcttgctagggccatgtatgttgggaaaggggtatcatgagatgggcagggctgccgccgtgctgttgtctgatccccagttccagtggtccgtcaggcgtgcttcaaacttgcacgatttgctcgccgcactggacgcatttctggaggaagtcacagttctgccccctggacgctgggatcccacagctcggatcccgccccctaaatgcctcccttcccagcataaaaggctaccttcccagcagagagaaatccgggggcctgcagtgcctcggctcacatctgctgaagatcggcataggcacggtccccatgcacactctccagaactccaaaggacaggtaggttgtttggtggcttaattcaggatgtgaggcggaaagttccttggtatcccagtgattttttggatgcacttcatttgcagtgctttagcgccgtgctgtatatttacctcgcaacagtgacaaacgcgatcacatttggcgggctcctcggcgatgcaactgacggcgcccagggagtgttggagagctttctgggcacagccgtagccggcgcagctttctgcttgatggccgggcaacccctcactatcctgtcctctactgggcccgtgctagttttcgaacggctgctcttttctttctccagagactattctctggattatttgccctttcggctatgggtaggaatatgggtggccacattctgtctggtgctcgtagctactgaagcctcagttctcgtgcgttactttactagatttactgaagaaggcttttgtgcgttaatcagtctgattttcatttacgacgccgttggcaagatgctgaatctgactcacacctaccccattcagaagccagggagttccgcgtacggctgcctgtgtcaatatcccgggccgggggggaacgagtctcagtggatccgtacaaggccaaaagatcgagacgatatcgtcagcatggtgcggaaggggctcagcgacttctcctccgtgctggcaatcttgctagggtgtgggttagacgcattcttgggcctggccaccccaaaacttatggtgccgcgcgaattcaagcctaccctgccaggacgagggtggctcgtctctccctttggtgcaaacccgtggtggtggtccgtggctgccgcacttccagctctcctgttgtctatcctgatcttcatggatcagcaaattactgcagtcatacttaacaggatggagtataggttgcagaagggggcaggattccatcttgacttattctgtgtggccgtattgatgctgctgaccagcgccctcggactgccttggtacgtgtccgcaaccgtgatctcactggctcatatggactccttgagacgggagtcaagggcctgcgcacccggggaacgcccgaacttccttggaattagggaacaacgtttgacagggttggttgttttcattctgacgggcgcgagcatctttctagccccagtattgaaattcatccctatgcctgtgctgtatgggatcttcctgtacatgggggtcgcagcgctttcttccattcagtttaccaatagggtaaagttgttgctaatgccagcaaaacatcagccagacctgctgctgctgcggcatgtgccactgacgagggttcacctgttcactgcaatccaactggcctgtctgggactgctgtggattataaagtcgactcccgcagctatcatctttcccctgatgttgttaggcctggtcggcgtccgcaaagcattggagcgcgttttttcaccacaggagttgctctggctcgatgagctcatgccggaggaagaaagatctatccctgaaaaggggctggagccagagcattccttctccgggtctgattcagaggactctgaactgatgtatcagcccaaggccccagagattaacatctcggttaactag

SEQ ID NO: 30336 - DNA, 3780 bp, Artificial Sequence
  Description of Artificial Sequence: Synthetic coding sequence
atggccaacggtgtgatccctccacctggcggtgcatccccgttaccccaggtccgagttcccctcgaggagccgcccctcagcccagatgtcgaggaggaagacgatgacctggggaagaccctggccgtcagccgcttcggcgatctaatcagtaagcctccagcatgggatccagagaagccctcaagatcttactccgagcgagacttcgaatttcatcggcacaccagccatcatacgcaccaccctctgagcgctcgccttccccctccacacaagcttcgtcgcctcccaccgactagcgctagacacaccaggaggaagcggaaaaaagaaaaaacgtccgccccaccttctgaggggactcctccgatccaggaagaaggaggcgccggcgtggatgaggaggaagaggaagaggaggaggaggagggggagtctgaagccgagcctgtggaacctccacattcaggcaccccccagaaggcaaagttttcaatcgggtctgatgaggatgacagtcccggattgcctggacgggccgctgttaccaagccgctccctagtgtcgggccccacacggacaaatccccccagcactcgtctaggccctgcagcgaactccgggatggcgacggcaccactgacctggcactgtccagtcccaggctcctgtgctgcctcccatcgagcccgtcgccccgcgctagggcctccaggctggcaggagaaaagagtagaccatggtcccccagcgctagctatgatctgagagagcgcttgtgccccggctcggcgctggggaaccccggcggacctgaacagcaggtgccgaccgatgaagctgaagcacaaatgctgggctcagccgatcttgatgatatgaagagccatcggctggaagacaatcctggtgtgagacggcacctcgttaaaaaacctagccgcacgcaggggggcagagggtccccaagcgggctagccccaatcctcagaagaaaaaaaaagaagaaaaagctggaccgcaggccgcatgaagtctttgtcgagcttaatgagttaatgctcgaccgatcgcaggaaccacactggcgggagaccgccagatggatcaaatttgaggaggatgtcgaggaggaaacagaaagatgggggaaacctcacgtggcttcactctctttccggtctctgctggaacttcgccggacaatcgcccacggggcagcccttctagaccttgagcagaccacgttacccgggatcgcacacctggtggtagaaacaatgatcgtctccgatcagattcgaccagaggaccgtgccagcgttctcaggaccctgctgctgaagcactcgcaccccaacgatgacaaagatagcggcttctttccgagaaacccgagctcctctagtatgaactctgtgttggggaaccaccaccccactcctagccacgggcccgacggtgctgtccccaccatggctgacgatttaggggagcccgcacccctgtggccacacgacccagatgcaaaagagaagcccctgcatatgcccgggggagatgggcatcggggtaagtccctcaaacttttagagaaaatcccagaagatgctgaagctaccgtcgtgctcgtgggatgcgtgcctttcctcgaacagcccgcagctgctttcgtgcggcttaacgaggcagtcctactggaatccgttcttgaggtcccagtaccagttcgcttcctgtttgttatgttgggcccctcccatacgagcaccgactaccacgagcttggccgcagcatcgccacgctcatgtctgacaaactgttccacgaagccgcgtaccaggccgacgacaggcaggaccttctgagcgcaatctctgaattcctggacggctctattgtgattcctcccagcgaagtagagggaagggacctgctgaggagtgtggccgctttccagagggaactgttacgaaaaaggagggaacgtgaacagactaaagtcgagatgaccacaagagggggctacaccgcacccggaaaggaactgtccctggagctggggggctccgaggctactccagaggatgatcctctgcttaggacaggctctgtatttggagggctggtccgagacgtgcgcagaagataccctcactacccctccgacctccgggatgcactgcactcacagtgtgtcgcggccgttctttttatttactttgccgcgctttcaccagccataactttcggcggactcctcggcgagaagaccgaagggttgatgggtgtctccgagttaatcgtctcaacagcggttctgggagttctgtttagcctgctaggtgcccagccactgctggtggtgggctttagcggccctctccttgtctttgaagaagcattctttaagttttgcagggcgcaagacttggaatacttaacaggacgggtttgggtgggcctctggttggtggtgtttgttttggcgcttgttgcagccgaaggaagctttctcgtccgatacatatccccgtttacacaggaaatttttgcattccttatctctctgatattcatatatgaaactttctacaaactctacaaggtcttcaccgagcaccccctgttgcctttctatcctccggaaggtgctctggaggggtcactcgacgcaggcctggaacctaacggctccgccctcccccctactgaaggcccaccctcgcccagaaaccagccaaacacggctctgcttagcttgatcctcatgctcggtaccttcttcatcgctttttttttgcgaaagtttaggaattctcgtttcctaggcggcaaggccagacggatcataggggatttcggcatccccattagcattctcgtaatggtgcttgtggattattctattacggatacgtatacccaaaagcttacagtgccaacaggactgagcgtgacctcccctgataaaagaagttggtttattccccccctcgggtcagctaggccattcccaccctggatgatggtggcggccgcggttccggccctgctcgtgttaatactcatctttatggagacccagatcaccgctcttatcgtatcgcaaaaggccagaagactactgaagggctccggttttcacctggatctcctgttaatcgggagcctcgggggcctgtgtggcctcttcggcttgccctggcttaccgccgccacagtgcgatctgtgacacacgtcaacgctttaactgttatgaggaccgcaattgccccgggcgataagccccaaatccaagaagtccgcgaacagagagtcactggcgtgctgatcgcgagcctcgtcgggctgtctattgtaatgggagcagtgctgcggcgcattcccctggctgttctcttcggcatcttcttgtacatgggggtgacatctctgtctggcattcaattgtcccaacggctgcttttaatcctgatgcccgctaagcaccacccggagcaaccctacgtcaccaaagtaaaaacatggaggatgcacctgtttacgtgtatacaactggggtgtatagccctactctgggtggtaaagagcactgcagcctccctcgcattcccgttcctactcttgctaacagtccctttaaggcactgtctcctgccccggctcttccaagacagggaacttcaggcactggattctgaggacgcagagccaaacttcgatgaggacgggcaagatgagtataacgagttgcatatgcctgtttag

SEQ ID NO: 30337 - DNA, 3699 bp, Artificial Sequence
  Description of Artificial Sequence: Synthetic coding sequence
atggccaacggcgtgatcccaccacccgggggggcctcaccactgccacaggtgcgggtccctttagaagagccgccacttagccccgacgtggaggaggaagacgacgacctcggaaaaaccctcgctgtctcccgattcggcgacctcattagcaagccacccgcttgggaccccgagaaacctagcagatcctatagcgaaagagactttgagtttcaccgccacaccagtcatcacacccatcacccactgtcggcccgactgcccccacctcataaactgcggcgcctccctcctacctcagctaggcacacaagacggaagaggaagaaggaaaagacaagtgcacccccctccgaaggcacccctccgatccaggaggaggggggggcaggggtggacgaggaagaagaggaggaagaggaggaagagggggaaagcgaggcagagcccgtggagccacctcactccggtacgcctcagaaggctaagttctccattggctccgatgaggatgactcaccgggtctccccggccgcgccgccgtcacaaaaccactcccctcggtcgggcctcacactgataagtcaccccaacattcctccagttcgccaagtccccgggctagagcatctaggctcgcaggcgagaagagccgcccttggtccccaagcgcatcatatgatttgcgggaacggctctgcccgggctcagcacttggaaaccccggcggtccagagcagcaggtcccgacggatgaggccgaggcccagatgctgggtagtgccgatctggacgacatgaagtctcaccgtttggaggataaccccggcgtgcgcagacacttggtgaagaaaccctccaggactcagggcggccgcggctctccctccggccttgccccgatccttcgcagaaaaaagaaaaagaaaaagctagataggaggccacatgaggtgtttgtagagctgaacgaacttatgcttgaccggagccaggagccgcattggagagaaacagcacggtggattaaattcgaggaagacgttgaggaggagacggagcgatgggggaaaccccacgtggcctccttaagttttcggagcttactggaactgcgcagaactatagctcatggagcggcgttgctggaccttgagcagacaaccctgccggggattgctcatttggtagtcgagaccatgattgtgtcagaccaaatcaggccagaagaccgtgcttcagtactgagaaccctccttctgaagcactcccatccaaatgatgataaagacagtggattctttccccggaatccttcctccagctcaatgaatagtgtgcttggaaatcatcacccgactcccagccacggaccggatggcgctgtccccacaatggctgatgacctgggcgagccagctcccttatggcctcatgacccggacgcaaaagagaaacccctgcacatgcccgggggagacggacaccgggggaagtcactgaagctcttagagaagatcccagaagacgctgaggcaaccgttgttctggtcggttgtgtgcccttcctagagcagcccgcggcagcttttgtgcgcctgaatgaggcagtgttgcttgaaagcgtattggaggtgccggtgcctgtcaggttcttgttcgttatgttgggtcccagtcacacgagcacggactaccatgaactcgggagatccatcgctactctgatgtccgataaattgttccacgaggcagcttatcaagcagacgaccggcaagatctgctgtcggccatttcagagttcctggacggttcaatcgtaatccctcctagcgaagtggaggggcgcgatttactgagatcagttgcagccttccagagagagctgctccggaagagacgtgagcgcgagcagacaaaggtagaaatgacaacgcgagggggctacaccgctcctggcaaggaactctccctggagctggggggtagtgaggcgacgccagaggacgaccccctgctccgaaccgggtccgttttcggcggcctggttagggatgtacgtcgccgctatccacattatccatccgacctgcgcgatgccctgcactctcagtgcgtcgcggcagtgctctttatttacttcgctgccctttccccagctattaccttcgggggtctgcttggagagaaaacagagggcctgatgggggtctctgagctgatcgtgagtacagcggtgctgggcgtactgttctccctcctaggcgcacagccactgctggtcgtcggattttctgggcctcttctggtctttgaagaggccttttttaaattctgccgagcccaggacctcgagtacctgaccggacgcgtgtgggtgggcctttggctggtggtttttgttctggcacttgtggccgctgagggatcttttctggtgcgatacatctctccattcactcaggagattttcgctttcctaatctcactaatctttatttacgagacattttacaagctttacaaagtgttcacggagcatccactgttaccgttctatccccctgaaggcgctctcgaggggagcctcgacgccgggttggaacccaatggttccgccctaccacccaccgaaggcccgccaagcccccgcaatcaacccaatacagccctcttgtcactcatcctgatgctgggaaccttttttatcgctttcttcctgcggaagttcaggaactccagattcctgggagggaaagctaggcgcataatcggagatttcggcattccgatttccatcctggtgatggtactggtggattactccatcacggatacttacacacagaagctgaccgtcccaaccggactgtcagtgacctctcctgacaaacggtcctggttcattccgcccttggggagtgcccgcccatttccaccttggatgatggtggcagccgcagttcctgctctgctggttcttattttgatcttcatggaaacacagatcacggcattaatcgtctcccaaaaggcccgcaggttactgaagggctctggatttcacttggatctgctactcataggtagcctgggagggctgtgtggattattcggcctgccctggcttacagctgccacagtgcggagtgtcacacacgtgaacgcactcaccgtaatgagaactgcaattgcaccaggagacaagcctcagattcaagaggtgcgcgagcagagggtcaccggagtgctgatcgcgagtcttgttggactgtccattgtgatgggggcagtcctgcggaggattcccctcgccgtgttgttcgggattttcttgtacatgggagtgactagcttgagcggcattcagctgagccaacgcctgctgctgatcctaatgcctgcaaagcatcacccagagcagccgtacgtgactaaagtgaagacatggcggatgcacctttttacatgtattcaactcgggtgcatcgctttgctgtgggttgtgaaaagcaccgcggcctctcttgccttcccctttctgttactgctgacagttcccctgcgtcactgcttgctcccaaggttgtttcaagaccgcgaactccaggccctcgacagtgaagatgccgagcccaactttgacgaagacgggcaggatgagtataacgagctgcacatgccagtgtag

SEQ ID NO: 30338 - DNA, 1203 bp, Artificial Sequence
  Description of Artificial Sequence: Synthetic coding sequence
atgggggtctctgagttaatcgtgtccacagccgtcctgggagtattattctctctgttaggcgcccaacctttactagtggttgggttttctggcccactcctggtctttgaggaggcattttttaagttttgtagagcccaggacctggagtacctgacaggacgagtctgggtaggcctctggttagtagtgttcgtcctggccttggtcgcagcggaagggtccttcctggtgaggtatattagccccttcacacaagagatttttgctttcttaatatccctgatcttcatatacgagacattttacaaactttataaagtgttcaccgagcatcctctcctgccattctaccctcccgaaccagggggagtaccaggctgttggtctggtgcgaaatggcaattgcccccaactgaaggccctccctcacccaggaaccaaccaaatactgccctgttgagcttgatcctgatgttagggaccttcttcatcgctttctttctcaggaagtttagaaactcccgttttcttggaggcaaggccaggcgtattataggggacttcggcatccccatcagcatcctggtgatggtcctcgtcgactacagcattacggatacctatacccagaaactaaccgtccctactggcctctcagtcactagccccgataagaggtcttggtttatcccacccttaggatccgccaggccattccccccctggatgatggtagctgcagcagtgccagctttactggttcttattctgatcttcatggaaacacaaatcaccgccctgatcgtgagccagaaggccaggcggctcttgaaggggtcaggtttccacctggatctgctactcattggatcacttggaggcctgtgcggtctctttggacttccatggctgactgcggctaccgtgcgctccgtgacccacgtgaatgccctcacagttatgcgaacagccatcgcacccggcgataaacctcagattcaggaggtgcgtgagcagagggtgaccggcgtccttatagcgagcctggtcggtttatccatcgtgatgggcgctgttttgagaagaatacctttggctgtactttttggtatatttctgtacatgggtgttacatccctatcaggcatccagttgagccagcggttgctgcttattctcatgcccgctaaacactag

SEQ ID NO: 30339 - DNA, 3699 bp, Artificial Sequence
  Description of Artificial Sequence: Synthetic coding sequence
atggctaatggtgtgattcccccacctggcggcgcatcccccctgccccaggttcgggtgcctctggaagagcccccactgagcccagatgtggaagaagaggacgacgatcttgggaaaaccctcgcagtttctagattcggggacctgatttctaaaccccctgcctgggatccggagaagccatcacgctcatattccgaacgggacttcgaatttcatcggcacacctcccatcacactcaccaccccctgtcggccaggctaccccctcctcataagttgaggcggcttcctccaacctccgccagacacacccgccggaagagaaaaaaggaaaagacttcagctccccccagtgaagggaccccgcccatccaggaggaggggggcgcgggcgtggatgaggaggaagaggaggaagaggaggaggagggtgagtcagaggcggaaccagttgagcctcctcattcaggtactccccagaaagctaaattttctatcggcagcgatgaagatgattcccccggcctcccaggtagagccgcagtgacaaaaccgctgccaagcgtaggacctcacactgacaagtcgcctcaacactcttcctcaagccctagtccaagagcccgtgcatctcggctggcgggcgagaaatcccggccatggtctcctagcgcgagctatgatttacgtgagcggctctgcccggggtccgctctaggcaatcctggtgggccggaacagcaagtaccaacggacgaagcagaggcacagatgctcggatctgccgatctggatgacatgaagagccacagactcgaggacaacccgggggttagacgccatttggtgaagaaacctagccggacacagggcgggcgcgggagcccatcagggctggcgcccatacttcggagaaaaaagaaaaagaaaaaacttgacagaagacctcatgaagtgttcgtggaactcaacgagctgatgctggatagaagccaggagccccactggagggagacagcgaggtggattaaattcgaagaggatgtggaagaagaaaccgaaaggtggggcaaaccccatgtggcttctctgtcttttaggtcactgctggagctccgcagaacgatagcccatggtgcagcattgctggacctagagcagactaccttgcccggcattgcacacctggtcgtggagactatgatcgtttcagatcaaatccgcccagaggaccgggccagcgtgctgaggacccttctgttgaaacacagccatcccaacgatgataaggacagtggattctttccaaggaacccctcctccagctccatgaattcagtgcttggcaaccaccacccgaccccatctcatggtccagatggagccgtgcccaccatggcagacgacctgggcgagcctgcacccctgtggccccatgaccccgatgccaaggagaagcccctgcacatgccaggaggtgacggacaccgggggaaaagcctcaagctgctggagaaaattcctgaggatgctgaagcgactgtagtgcttgtaggctgcgttccattcctggagcagcccgccgccgcctttgtgcgtctgaacgaggccgttctgctcgaatccgtgttggaggttccagtgcctgtacggttcctatttgttatgcttggaccttctcacactagcacggattatcatgaactgggacgctccattgccaccctcatgagcgataagcttttccatgaggccgcatatcaggccgacgataggcaagaccttctcagcgccatttccgagttcctggacggatctatagtcatcccccccagcgaggtcgaaggcagagacctgctaaggagtgtggccgcatttcagcgtgagctgctcaggaagagaagagaaagagagcaaactaaggtagaaatgactacgaggggcgggtacaccgccccaggaaaggagctcagtctggagctagggggctctgaggccacgccagaagatgatccgctgcttagaactgggtctgtatttggggggttagtgcgcgacgtgcgacggcgatatcctcactacccgtctgatttgagggacgctcttcactcccagtgcgtggccgctgtgctatttatttatttcgcagccttgtcccccgccattacctttggtggcctcctcggcgagaagaccgaaggtctgatgggcgtctcagagctgatcgtcagcaccgctgtcttaggggtgcttttttcactgttgggtgcccagcctttactcgttgtaggcttttcaggtccactgctcgtcttcgaagaggctttcttcaagttctgtagggcccaagaccttgagtatctaaccggaagggtgtgggttgggctgtggctcgtggttttcgtccttgcattggtggcagctgaagggtcatttctggtgcgatatatctccccttttacacaggagatcttcgcctttctgatctcgctgatctttatatacgaaaccttttataaactgtataaggtgttcacagagcaccccttgctgcccttttaccctcctgagggggcactcgagggaagcctggacgcagggctggagcctaacgggtctgcactgccacccacagagggccccccctcccctcggaaccaaccaaataccgctctcctatctctgatcctcatgctcgggacatttttcattgccttcttcctgcgtaagttccgcaacagccggttcttgggtggcaaagcgcgccgaattatcggggatttcggtatccccatctcaatcttagtcatggtgctcgtggactacagcatcactgacacatacactcaaaaactcacagtgcctaccggacttagcgtgacctctccggacaagcgaagctggtttattcctcctctgggtagcgcacggcccttccctccatggatgatggtggccgccgcagtaccagctctgctggtgctaatactgatttttatggagacccagatcaccgctctcatagtttctcagaaggctaggaggctcctgaaaggctccgggtttcatttggacctgttgttgatcgggagcctgggaggcctgtgcgggctcttcggactgccctggctgactgctgccaccgtgaggtccgtaacccacgtgaatgctcttacggtaatgcggaccgcaattgcgccgggtgacaaacctcagatccaggaagtccgcgagcagagggtgacaggggtgttgattgcctcactggtcgggctgtcaattgtgatgggggccgtcctgcgtagaataccccttgccgttttgtttggcatcttcctttacatgggcgtaacctctctctccgggatccagctctctcagcggttgctgctgatccttatgccggcaaaacaccatcctgaacaaccgtatgtaaccaaagttaagacttggcgtatgcatttattcacgtgtatccagctgggctgtatagccctgctctgggtggtcaagtccaccgccgctagtcttgcttttccattcctgctccttctcacggtgcctctcaggcactgcctactccctcgactattccaggaccgcgagctgcaggccctcgatagtgaggacgccgagccgaactttgatgaagacggtcaggacgagtataacgagctgcacatgcctgtttag

SEQ ID NO: 30340 - DNA, 3699 bp, Artificial Sequence
  Description of Artificial Sequence: Synthetic coding sequence
atggctaacggcgtgatacctcccccaggaggcgcctctcctcttccccaggtgcgggtgcccctggaggagccaccattgagccccgatgtcgaggaagaggacgacgatctggggaaaacattggccgtctctcgctttggtgacctcatcagtaagcctcccgcttgggatcctgaaaaaccttctagatcctactccgagcgcgatttcgaattccaccggcacacatcccaccacacccaccacccgttgtctgcaagactgccccccccacacaaactacggcgcctccctcccacgagtgcacgtcacacgcggcgaaagcggaagaaagagaagacgtccgcgccaccctcggaaggaaccccccccatccaggaagagggcggggctggagtggatgaagaagaagaggaggaagaagaggaggagggcgaatcagaggccgagcccgtcgagccaccacactccggaactcctcagaaggccaagttttcgatagggtccgatgaagacgatagcccaggtctgcccggaagggccgcagtcaccaagcctcttcccagcgtgggcccacacacagataaatcaccacagcacagctcaagctcaccttcacctcgcgcacgcgctagccgccttgctggggagaagtcaagaccttggtctccgagcgcttcatatgacttgcgcgaacgcctgtgtcccgggtcagcccttgggaacccgggaggccccgaacagcaggtccctactgacgaggcagaggcccagatgctaggcagcgccgacctggatgatatgaagtctcataggctggaggacaacccgggcgtaagaaggcacctcgttaagaagccttcaaggacccagggcgggcgggggtctccctcaggcctggcccctatactccggagaaaaaagaagaagaaaaaactggatcggagaccacacgaggtgttcgtagaactgaatgagctgatgcttgacaggtctcaggagccccactggagagaaactgcccgctggatcaagttcgaggaggatgtggaagaagagacggagaggtggggaaagcctcatgtggcttcactgtcctttcgttctcttttggaactgcgtcggacaatagcccacggcgcggcactgttggacctggaacagacgactttacctgggattgcacacctggttgtagaaacaatgattgtttctgaccagatcagaccagaggatagagccagtgtgttacggacactgctgttgaaacattcccatcctaacgacgacaaggacagtggcttctttccacgaaatccatcttcctcctctatgaatagtgtcctcggtaaccaccatcccacaccctcacatggaccggatggcgcagtgccaacgatggccgatgatttaggggaacccgcgcctttgtggccacatgaccccgacgctaaagagaaacccctgcatatgccaggaggcgacgggcatcggggcaagtctctgaaactgcttgagaaaatccctgaggacgctgaggctactgtggtcttggtagggtgtgtcccattcttggaacaacctgcagccgcctttgtgcgtcttaacgaggcagttctccttgagagtgtgcttgaagtaccagttcccgtcaggtttctgttcgtcatgcttggccctagccatacatctaccgactaccacgagttgggaaggtccatcgcgaccctcatgagcgacaagttatttcatgaggccgcatatcaggccgatgacagacaagatttacttagtgcaattagcgagtttctagatggaagcatcgtgattcctccctccgaggtcgagggtagggatttgctgagatccgtcgccgcctttcagcgggaactgctgaggaagaggagagagagagagcagacgaaggtggagatgaccacccgagggggttacaccgcacctggcaaagaattatccctcgaactgggcggcagcgaggcaaccccagaggatgaccccttactgcgcacagggtcagtattcgggggattggttcgggacgtgagacgacgctacccacattaccctagcgatttgcgagacgcacttcactcacagtgcgtggcagccgtgttgtttatctattttgcagccctatcacctgctataacattcggaggcctgttaggagaaaagactgagggccttatgggggtcagtgagctgatagtcagcacggcagtcctcggcgtgctttttagtctcctcggagcgcagccccttctggtcgtcggattctccggcccccttcttgtgttcgaggaggccttcttcaaattctgtcgggctcaggacctagaataccttaccggcagagtgtgggtcggcctgtggttagtggtgtttgtcctggcactggttgctgccgagggctcttttctagtccgctacattagtccctttactcaagagattttcgcattcttgatatcccttatttttatctatgagaccttctacaaattgtataaggtgtttaccgagcacccgctgcttccattttatcctcccgagggcgccctggagggttctttagacgctgggctggaacccaatggtagcgccttaccccccactgagggccctccttcgccccgtaatcagcccaacactgccctgctctcactgatcctcatgctcggcaccttttttatcgctttctttctacgtaaattccgcaactccaggtttctgggtggaaaggcgcgtcgcataatcggcgatttcgggattcctatatctatcctcgtcatggtgctcgtcgattattcaattactgatacatacacacaaaagctaacggtcccaacgggactcagcgttacctcgccagacaaaaggtcctggttcatccctcccctgggaagcgcacgccctttccccccctggatgatggtggcagcggcggttcctgcacttctggtgctcatcttaatttttatggaaacgcagattaccgctctgatcgtatctcagaaggcgaggcgcctgctaaagggatccggtttccacttggatctgctgctgatcgggagcctgggcggactgtgtggtctattcggcctaccctggctgactgccgcaaccgtgcggagcgtcacgcacgtgaatgccctcactgtgatgagaacagctattgcccccggggacaaacctcagatccaagaggtccgagaacagagagttactggggtgctcattgcgtcccttgttgggctgtccattgttatgggcgccgtgttgcgacgcattccactcgcggtcttgttcgggattttcttatatatgggagtgacgtctctttcagggatccaattaagccagcggctcctactgattctcatgcctgcgaagcatcacccagagcagccctatgtcaccaaggtgaaaacatggcgcatgcacttgtttacctgtatccagctggggtgcatcgctctcctctgggtcgtcaaatccaccgccgctagtctggcttttccattcctccttctgctcactgttcctctgaggcattgtctgctgcctaggctgtttcaggaccgcgagttgcaggccctcgattctgaggatgcagagcccaatttcgacgaggatgggcaggacgagtataacgaactccatatgcccgtgtag

SEQ ID NO: 30341 - DNA, 3780 bp, Artificial Sequence
  Description of Artificial Sequence: Synthetic coding sequence
atggcgaacggagttatccccccccccggcggtgccagtcctctgcctcaggttcgggtcccgctcgaggaacctcccctgtcgccagacgtggaggaggaagacgatgatctcggcaaaacactcgcagtttccaggttcggggatctgattagcaaaccgccagcttgggatcctgagaagccctcaaggagctatagtgagcgcgattttgaattccatcgacatacatcccaccacacacaccatccccttagtgccagactccctcccccccataagttgcgccggctcccacccacttcagcacgtcacactagacgtaaaaggaaaaaggagaagaccagcgcccctccatctgagggaacccctcccatccaggaggaaggtggcgcgggcgtggatgaggaggaagaggaagaggaggaagaagagggtgaatctgaggcagaacctgtggagccacctcatagcggcactccacagaaggctaaattcagcatcggctctgacgaggacgatagcccgggactgccagggcgagccgccgtcaccaaacctttgccaagcgtgggacctcacaccgacaaaagtcctcagcactccagccgcccatgcagtgagctgcgggacggcgacggcaccactgacctcgctctgagcagccctaggctgttgtgctgtctgccaagcagtccctcaccacgggcgagggcttcccgactcgctggtgaaaagagtaggccctggtccccctctgcatcctatgatctgcgggagaggctctgccccggcagcgccctaggtaaccccggaggtccagagcaacaggtccccaccgatgaagccgaagctcagatgctgggatccgccgatctggatgatatgaagtcccatcgcctggaggataacccaggggtgcggcgacacctggtaaagaaaccttcacggacgcaaggaggccgcgggagcccgagcgggctggctccgatcctgcggcggaagaagaaaaaaaagaaacttgacaggcgacctcacgaggtgtttgtcgagttgaacgagttgatgctggatcgctctcaggaaccccattggagagagactgcgagatggattaaattcgaggaagatgtcgaggaagaaactgaacgctggggtaagccacacgttgccagcctgagcttccgatctctactggagctgagacggactatcgctcacggggcggcactattagatctagaacaaaccacgctcccaggcatcgcgcatctggtagttgagactatgattgtgtctgatcagatcaggcctgaggacagggcatctgtgctgcgaacattgttactgaaacattcccacccgaatgacgacaaggattctggcttcttcccacgcaacccttctagcagttccatgaactccgtactgggaaaccaccacccgaccccttcccacggccccgacggcgccgtcccaaccatggcggatgacctgggtgagcccgctccactgtggcctcatgatcccgacgctaaggaaaagcccctgcatatgccggggggagatgggcaccgaggaaaaagcctcaagctacttgaaaagatccccgaagatgccgaagcaacagtcgtcctagtggggtgtgtcccgttcctggaacagcctgcagccgctttcgtgaggctgaacgaggccgtccttcttgaatcagtgctagaagtgcccgtccctgttagatttttgtttgtgatgctcggtccttcccacacatcaacagactaccatgagctcggccgctccattgctacattaatgtccgataaattattccacgaggctgcctatcaggcagacgaccggcaggacttactgtccgctatcagcgaattcctggatggctccatcgtgattcctccatccgaagtcgagggcagagatctgctgcggtctgtggcagccttccaacgggagctgctaaggaagcgccgcgagcgcgaacagacaaaagtcgagatgaccaccagaggaggctataccgccccaggcaaggaactttctcttgaactgggtgggtctgaggcaacccccgaggatgatccactgctgagaacaggttcagtttttggaggtctcgtgcgagatgtacggcggagatacccacactatccgtctgatttgagagatgctttacacagccagtgtgtcgctgccgtgctatttatttacttcgccgcattgtctcccgccatcacctttggagggctgttaggcgagaagaccgaggggctaatgggggtttcagagctcatcgtcagcacagcggtcctcggagtactatttagtttattaggtgcacagccccttctggtggtgggattctcagggcccttactggtcttcgaagaggcattctttaaattctgccgagcgcaggatctggagtacctcaccgggcgcgtctgggtgggtttatggctcgttgtctttgtgctggccctcgtcgctgcggaaggcagcttcttggtgaggtatatctctccattcactcaagaaatattcgcttttctgattagcctaatttttatatatgaaacattctacaagttgtataaggttttcaccgagcacccactgctgccattctacccccctgagggcgctttagagggcagtctggacgccggattggagcccaacgggagcgccttgccacccacagagggcccaccaagtccccgtaaccagcctaacacggctctactatccttgatactcatgcttggcacgttttttatcgcctttttcctgcgaaaattccgcaacagtagattcttagggggcaaagcccgccgcattatcggggactttggaataccaatctctatcctggttatggtgctggttgattattccattactgacacgtacacacagaaacttacagtgcctacaggcctaagcgtgacgagcccggataagcggtcatggtttatccccccactgggatccgccagacccttccccccatggatgatggttgcagctgccgtcccagcgttactggtgctgatcttaatcttcatggaaacacagatcaccgccttgatagtctcacaaaaggcaaggcggcttttaaaaggttctgggtttcatttggacctgctactcattgggtcccttggcggtctctgcggcctcttcggtctcccatggctgaccgcagccaccgtgagaagcgtgacccacgtgaacgctctaacagtgatgagaaccgccattgcccccggggacaaaccacaaattcaggaggttagagagcaaagggttactggagtcctcatagcgagccttgttggactgtcaatcgtaatgggagccgtcctccgccggattcctctcgcagtattgtttggcattttcctgtatatgggcgtgacctcccttagcggaatccaactctcgcagaggctgctcctcatccttatgcccgctaaacaccacccagaacaaccctacgtaacaaaggtgaagacttggcgcatgcacctgtttacttgcatccaattgggatgtattgccctgctttgggtggttaaatccactgcagcgtccctggcctttccattcctcttgttgctgactgtgccactgcgacattgccttctgcccaggttgtttcaggaccgggaactccaagctttggattctgaggatgcagagccgaatttcgacgaggatggtcaggacgagtacaatgaactgcacatgcctgtgtag

SEQ ID NO: 30342 - DNA, 684 bp, Artificial Sequence
  Description of Artificial Sequence: Synthetic coding sequence
atgacttctcccttggagaaggatcctgagccaaacggagccctctcccccggccctggcgatacaaactcctgggggtttggcagggaccccgcccctagccccagggactctctcgctcccgaagacctggaaatgttcgtgctggattttgaggatggggatctctgggagtccatacgcggccagctgggccccatggctggccctcctacatgccaccggcttgaggacaaccccggggtccgacggcacctggtaaaaaagccatcaaggactcagggcggccgaggtagcccctctggtctcgctccaattctgagaagaaagaagaaaaaaaaaaaactcgaccgtagaccccatgaagtctttgtcgagctgaatgagctgatgctcgacaggtctcaagagccccattggcgagagaccgcaagatggatcaaattcgaagaagatgttgaagaggagacggaaaggtgggggaaaccacacgtagcgtcactgtcctttagaagcctgctggaactgcgacgcacgatcgctcatggagcagccctcctggatctggaacagacaacgctgcccgggatagcccacctcgtggtggagaccatgatcgtttccgaccagattagaccagaggaccgcgccagtgtgcttcggaccctgctgctgaaacattag

SEQ ID NO: 30343 - DNA, 627 bp, Artificial Sequence
  Description of Artificial Sequence: Synthetic coding sequence
atgaaacttctccccagtgtggtgctgaagctcttcttggccgctgtcctctctgcgttagttacaggagagtccctggaacgcctccgtcgtggactggccgccggcacctctaaccccgatccacctaccgttagcaccgaccagttgttaccgctcggggggggcagagacaggaaagtgcgcgacctgcaggaggccgacctggacttgcttcgcgtgaccctctccagcaagcctcaagccttagcaactccaaacaaggaagaacatggaaaacgcaagaagaagggcaagggactaggaaaaaagagggatccttgtttaagaaaatacaaggatttttgtatccacggtgagtgcaagtacgtaaaagagcttcgggctccctcatgcatctgccatcctggttatcacggagagaggtgccacgggctgtcactccccgtcgagaaccgcctatatacctatgatcacaccaccatcctagctgttgtcgccgtcgtgcttagttctgtctgccttttggtcattgtcgggcttctgatgtttagataccataggagaggcggatatgatgtggagaacgaggagaaagtcaagttgggcatgaccaacagtcactag

SEQ ID NO: 30344 - DNA, 2838 bp, Artificial Sequence
  Description of Artificial Sequence: Synthetic coding sequence
atggagatgaaactgcccggccaagagggcttcgaagccagctctgctccccggaatataccatcaggcgagctagactccaaccccgaccctggaaccggcccttcgcccgatggaccttctgacacggagagcaaagagcttggtgtgcccaaggatcctctactgtttatccagctgaatgagttgctggggtggccgcaggccctggagtggcgcgaaaccggaagatgggtgttattcgaagagaaactggaagtggctgccggacggtggagcgctccccacgttccgaccctggctttaccaagcctccagaaacttcgttccttgcttgcagagggattggtgctgcttgattgcccggctcaaagcctgctggagctcgtagagcaggtgacacgggtggagagcttaagtcctgagcttcgcgggcagctgcaggctttgctgctccagcgcccacagcactacaatcaaaccacaggaacccggccatgctggggctctacacatccgcggaaagcaagtgacaatgaggaagccccacttcgggaacaatgccaaaaccctctgagacagaagttgccacctggggccgaggcaggtaccgtgctggccggtgagttgggattcctggctcagccgcttggcgcttttgtcaggctccggaacccagtggtcttggggtcgctgactgaagtttcgcttcctagtaggtttttttgcctattgctcgggccatgcatgcttggcaagggttatcatgagatggggcgggcggcagcagtcttgctcagtgatccacagtttcaatggtcagtgcggagggcgtcaaacctccacgatctgcttgcggcgctggatgcatttttggaagaagtcaccgtgctgccacctggcaggtgggaccctaccgctaggataccgcctcctaaatgcctgccttcccaacacaagaggctacccagccagcagcgggagatccgcgggcccgccgtccctagacttacaagtgcagaagatcggcaccgccacggcccccacgctcattcaccagagttgcagcgcacagggagaaaagtcccatggtatccaagtgatttcctggatgccttacacctccagtgcttctccgcagtcctgtatatctacctggctacggtgacaaacgctatcaccttcggagggctgcttggagacgccactgacggggcgcaaggcgtgctggagtccttcctcggtactgcagtggctggtgctgctttctgcttaatggctggtcaacctctaaccatcctttcctctactggaccagtgctcgtgttcgagcgcctgctattcagtttttcgcgcgattactcattggattatttaccttttcgcttgtgggtgggtatctgggtcgctacgttttgcctagtgttagtggctactgaagcttcagtgctggtgaggtattttacccgttttacagaggaaggattttgcgccctgattagcctcatctttatctacgatgctgtgggtaaaatgctgaacctcacgcacacataccccatacagaagcctggctctagtgcttacggttgtctgtgccagtaccccggacctgggggaaacgaaagtcagtggatccggactaggcccaaggatcgggacgacatcgacttaggcctgataaacgctagcctgctccctccccccgagtgcaccagacagggcggacaccctaggggacctgggtgccatacggttccagacatcgcattcttcagcttgctgctgtttctcacttcttttttcttcgcaatggcactgaagtgcgtgaagactagcaggtttttcccgtcagtagtacgaaaggggctgtcggatttcagctctgtccttgctatcctcttgggctgcggactcgacgccttcttaggcttggcgacacctaaactcatggtgccacgagagtttaaacctactcttcctgggcgcggatggctggtgagcccctttggcgcaaacccctggtggtggtctgtggctgccgccttgcctgccttgctcctgtccattttgatttttatggaccaacagattactgccgtgatacttaataggatggaatatagattgcaaaagggggctgggtttcaccttgatctcttctgtgtggcagtgctgatgctcctaacttccgcactcgggttaccctggtacgtctccgcgaccgtaatatccttagcacatatggattctcttaggcgggagagcagggcctgcgccccaggagaaagacccaacttcctgggtatccgggagcagcgcctgactggtctcgtggtatttattctcaccggcgcttctattttcctggcccctgtattaaagttcatccccatgccggtgctgtacggcatattcctctacatgggcgtggcagccctctcttcaatccaatttaccaatagagtaaaactgctgctaatgcccgcaaaacatcagcccgacctacttttgttacgtcatgttccccttaccagggtgcacttatttaccgccatccagcttgcctgcctgggccttctttggatcatcaagtccacccctgcggcgattatatttcccctgatgctgttgggcctcgtaggggtccgcaaagcactcgagcgggttttctcaccgcaggagctgttgtggctagacgaactcatgcctgaggaagagcgcagcattcccgagaagggcctggagccggagcacagcttctcaggaagcgacagtgaggattcagaactgatgtatcagccgaaagctccggagatcaacatctcagtcaactag

SEQ ID NO: 30345 - DNA, 2880 bp, Artificial Sequence
  Description of Artificial Sequence: Synthetic coding sequence
atggaaatgaaactgcctggtcaggaagggttcgaggcaagtagtgctccaagaaatatccccagcggtgagctggatagtaatccagatccagggacaggaccttccccagacggaccctccgatacagaatctaaagagctgggcgtacctaaggatccactgctgttcattcagctcaacgagctgctgggctggccacaggctcttgaatggcgggagacgggccgctgggtactgttcgaggagaagcttgaagttgccgcaggccgctggtcagctccacatgtccctacgctcgccttgccatctctgcagaaattgaggagcctgctggctgagggtctagtgcttctcgactgccccgcacagtcactgcttgagctcgtcgagcaggtgactagggtggagtctctcagccctgagctgcgtggccagttacaggccctcttactgcagcggccgcaacattataaccagaccacaggtactcggccatgctgggggtcaacccaccctcggaaagccagcgacaatgaagaagctccgctccgggagcaatgccagaacccactgaggcagaaactgccaccaggagcagaagctggcaccgtgctggccggggagcttggctttctggcgcagcctctgggggccttcgttaggctcagaaaccccgtggtgcttggaagcttgactgaggtcagcctgccctcacggtttttttgtctgctcctgggcccctgcatgctgggaaaaggttatcatgaaatgggcagagccgctgcggtactgctgtctgatccccaattccaatggagcgtgaggcgcgcctctaatcttcatgatcttctcgcagcgctggacgcttttcttgaagaagttacagtcctgccaccaggccggtgggatcctaccgcaaggattcctcctcccaaatgtctcccttcccaacacaagcgactgccaagccaacagcgagagattaggggccctgcagtgccacgactgacgtccgccgaggataggcaccgccacggacctcacgcacatagccctgaactccagaggacaggacgcctgttcggcggccttatacaggacgtgaggagaaaggtgccatggtacccaagcgacttcctagacgcactgcatttgcagtgcttcagtgctgtcctgtatatctacctggccacggtgaccaacgctattacatttgggggtctgctgggagacgccactgacggggctcaaggtgttttggagtcttttttgggaacggctgttgctggggctgcattttgtctgatggccggtcagcccttgacaatcctatcctcaaccggcccagtcttggtcttcgagagactcctgttcagcttttcccgcgactattccctggattacctcccgttccgcctgtgggtagggatatgggtggcgactttctgcctggtactggtggccaccgaagcttctgtgctggtgcggtatttcactcggttcactgaggaagggttctgcgcgctcatctcactcatctttatttacgacgcagttggtaaaatgttgaatttgactcatacttatccaatacagaaaccaggttccagcgcgtacggctgcctctgtcaatacccaggaccagggggtaacgaaagtcaatggatcaggacccgtcctaaggatcgggatgacattgtgagcatggaccttggcctcattaatgctagcctgctcccacctcccgaatgcacacgtcagggtggtcatcctcggggacccggatgtcacactgtgcctgacatcgccttctttagcctgctcctgtttttgaccagcttcttttttgcgatggccctgaagtgcgtgaaaacttctcgtttttttccaagcgtggtgcggaagggactgtctgacttttccagtgtcctggctatactcctggggtgtgggcttgacgctttcttaggcctcgccacccccaaattgatggttcctcgggaattcaagccgacacttcctggccgcggttggctagtaagcccgttcggcgcgaacccttggtggtggtcagttgccgccgctctgcctgcactcctgttaagtatactgattttcatggatcagcaaattacagcggtgatcctgaatagaatggaatatcggctgcagaaaggagccgggtttcacctggatctgttttgcgttgccgtgctgatgctgctcacatcagcccttggcctgccatggtatgtatctgccacagtcatctctcttgctcacatggacagtctcaggcgtgaaagtagagcctgcgcacccggcgagaggcccaattttctcggcattcgggagcaaaggcttaccggactggtcgtgttcatcctcacgggagcgtcaatattcctggcaccagtcctgaagttcatacccatgccagtcttatacggaattttcctgtacatgggtgtggcagccctttcctcaatccagtttacgaacagagttaagctccttctcatgcctgccaaacaccagccggatctcctgctgctccgccatgtgcctttaacccgagtgcatctctttactgccatccagctggcctgtctcggactcctttggatcatcaagtccacccccgctgctatcattttccccttaatgctcttagggctggtgggcgtgcgcaaagctcttgaacgtgtgttcagcccacaggaactgctctggctcgacgagctgatgccagaagaagaacgttccatccctgaaaagggcctggagcctgagcattccttttctggttccgactccgaggacagtgaacttatgtaccagccaaaggctcccgagattaacatttctgtgaactag

SEQ ID NO: 30346 - DNA, 2952 bp, Artificial Sequence
  Description of Artificial Sequence: Synthetic coding sequence
atggagatgaagctgcctggtcaggaggggttcgaggcatcttcggcgcctaggaatatcccttctggcgagttagattcgaacccggatcccggcactggtccctcaccagacggccctagcgacacagagtcaaaggaactgggtgttcctaaggacccactactctttatacagttaaacgagctccttggttggccccaagccctcgaatggcgggagaccggaagtagttccgcatctctgctcctggatatgggagaaatgccttcaattacattatctactcacctgcaccaccgatgggtgctgtttgaagagaagttggaagtagccgctggaaggtggtcggccccacatgtaccaaccctagccttgcccagtctgcagaagctgcgatcactgcttgccgagggcttggtactcctcgattgccctgcccagagcctgcttgagctggtcgagcaggtgacccgggttgagtccctctcccccgaactgcgaggacagctgcaggccctgctgctgcaaagacctcagcactacaaccagacgacagggacaaggccatgttggggctccactcatcccaggaaagccagcgataatgaggaggcacctctacgtgagcagtgccaaaacccacttcgacagaaattgcccccaggcgccgaagccggaacggtgctggccggggagctggggtttttggcacagcctctcggcgctttcgtcagattgagaaaccctgtcgtgcttggatccttaacggaagtctcgctcccctccagattcttctgcctgttgctggggccttgtatgttaggtaaggggtaccacgaaatgggcagagctgccgccgtgctgttgtctgatccacagtttcaatggtccgtgcgtcgcgcctcgaaccttcatgacctgctggcagccctagatgccttccttgaggaggtgaccgtgctgccacctggccgctgggatcccactgcgcgcattccaccccccaaatgcttaccatctcagcacaagagattgccaagtcagcagcgcgagatccggggacctgccgttcccaggttgacttccgccgaggataggcaccggcatggaccccacgcccatagtccggaactgcagagaactggtagactgtttggtggcctgattcaggatgttagaagaaaagtaccctggtacccctcagactttctcgacgccctgcacctccaatgcttctccgctgtgttatacatatatctggccactgttacgaacgctattacttttggcggccttctgggggacgcgacagatggggctcagggggtgctggaatctttcttgggcaccgcggtagccggagccgcattctgtctaatggccgggcagcctttgacaatcctgtcgtccaccgggccggtgctggtgtttgaaaggcttttattttccttttctagggattatagtttagattatttaccgttcaggctttgggtcgggatttgggttgctacattctgcctggtgctggtagccaccgaggcctcagtgcttgtccgatactttacaagattcacggaggaagggttctgtgccctcatctccctgatcttcatatacgatgccgttggtaagatgttaaacctgacacacacctaccccatccagaaacctggtagtagcgcctacggatgtttgtgtcagtaccccggccccgggggcaacgagagccagtggatcagaacacggccaaaggatagggatgatattgtatccatggacctcggactgatcaacgcctcccttctcccacccccagagtgcactcgacaggggggtcatcccaggggacctggttgccacactgttccagacattgcttttttcagcctcttgttatttctcacaagcttttttttcgccatggccttgaagtgcgtgaagacatcgagattctttcctagtgtggtgagaaaaggtctcagcgatttttccagcgtactggctatactgctcggctgtgggcttgatgcattcctgggtcttgccaccccaaaactaatggtcccgagggaattcaaacctaccctgcccggtagaggctggctggtgtctcccttcggggccaacccatggtggtggtccgtggctgccgcactcccggctctgcttctcagtatcctgatatttatggatcaacagattacagccgtgatcctgaatagaatggaatacagactgcagaagggcgcggggtttcatcttgacttgttctgcgtggctgttctgatgttgctgaccagcgccctgggtctaccttggtacgttagcgccaccgtgatttcactggcccatatggacagtttgcgacgggaatctcgggcctgcgcaccaggggagcgccccaacttcctaggcatcagagagcagcgcctgaccggcctcgtggtattcatcttaacaggcgcgtctattttcctcgcgccagttctgaagttcatccctatgccggtcctgtatggtatttttctctatatgggcgtggctgccttgtcaagcatccagttcacaaaccgtgtgaagcttcttctaatgcccgctaaacatcagccggacttgctacttctgagacacgtacctcttactcgggtccatctttttacagccatccagctggcctgtttgggtctcctgtggatcattaaatccacaccggccgctataatctttccgctgatgttgctgggtcttgtgggtgtgaggaaggctttagaacgcgttttcagcccccaggaactcctgtggctggacgagttgatgcccgaagaggagaggtcgattccagaaaaagggctggaacctgagcactcattttccggaagtgactccgaagattccgagctgatgtaccaaccaaaggctccagaaatcaatatctctgtgaactag

SEQ ID NO: 30347 - DNA, 1476 bp, Artificial Sequence
  Description of Artificial Sequence: Synthetic coding sequence
atggcgggccaaggactgcccctgcacgtggcaactctactaacaggtctcctcgaatgtctaggttttgcaggcgtgctcttcggatggccgagccttgtgttcgtgttcaagaatgaggattatttcaaggacctgtgcgggccagatgcagggcctatcggcaatgccacaggacaggctgactgtaaagcccaggatgagagattctccctcatcttcacacttggtagctttatgaacaactttatgacctttccaactggctatattttcgatcgattcaagactactgtggccaggctaatcgctattttcttctacactactgcaaccttgataatcgctttcacgtcggctgggagtgccgtgttgcttttcctggccatgcccatgctgaccattgggggaatcctattccttataacaaacctgcagatcggcaatctgttcgggcaacatcgttctaccataattaccctgtataacggcgcctttgactcctcctctgccgtgttcctgattataaaactgctgtacgagaaaggtatatcactgcgcgcctcgtttatttttatcagtgtgtgcagtacatggcatgtcgcccggactttcctgctaatgccacgaggccacatcccatatcccctacccccaaactactcttacggtctgtgtccaggcaacggaacaaccaaagaggaaaaagaaactgcagagcacgagaatagggaactgcagtctaaggagttcctctccgccaaggaagagacaccaggcgcgggacagaagcaggaactgaggtccttctggtcttatgccttctcccggcgctttgcttggcatctcgtgtggttgtccgttattcagttgtggcactatctctttatagggactctcaactcattgctaacaaacatggcaggcggagacatggcgcgcgtcagcacctacactaacgcatttgcattcacacagttcggtgttctctgtgcaccttggaacggcctgctcatggacagacttaagcaaaagtatcagaaggaggcacgtaagacaggcagctccacacttgcggtagcactttgcagtactgtgccctcgctggcgctgaccagcctcctatgcctgggctttgcactatgcgccagcgtgcctatacttccactacaatacctgacttttattctacaggtgatctctcgcagtttcctctacggttcaaacgcagctttcctgaccctagcttttccctcagagcattttggcaagctcttcggcctagtcatggctctgagcgctgtggttagcctccttcagttccctatctttacccttattaaggggtccctgcagaatgatccattctacgtgaatgttatgttcatgctcgccatccttctgacctttttccatccctttctcgtatatagagaatgccgcacatggaaggagtccccatcggccattgcatag

SEQ ID NO: 30348 - DNA, 1476 bp, Artificial Sequence
  Description of Artificial Sequence: Synthetic coding sequence
atggcgggccagggcctgcctcttcacgttgctaccctactgactggactgctcgaatgtttgggtttcgccggcgtgttgtttggctggcctagcttagtgtttgtgttcaagaatgaggattatttcaaggacctctgcggacccgacgccggacccattggaaacgcaaccggtcaggccgactgcaaagcccaagatgaacgtttctccctcattttcacactgggatcatttatgaataacttcatgacgttcccaacgggatatatttttgaccgcttcaagacaaccgtagccagactgatcgctattttcttctacactaccgccaccttgataattgcttttacgtctgctggtagcgccgttcttctcttcttggcgatgcctatgctgacgatcggaggtattctgtttctaattacaaacctccaaattggaaatcttttcggacagcaccggtctaccatcatcacattgtataatggggcatttgacagcagttccgccgtgttcttgattattaagcttctgtacgagaaaggtatttccctcagggcttctttcatctttatcagcgtgtgtagtacgtggcatgtggcacgcacgttcctcctcatgcccagagggcacattccctacccactcccacctaactacagctacgggctctgccctggtaatgggacgaccaaggaagagaaggagaccgcggaacacgagaatcgagagctccagagcaaggaattcctgtctgccaaggaagaaacccccggggccgggcagaaacaggagcttagaagtttctggtcttatgcgttctcccgtcggttcgcgtggcatttagtgtggctttcagtgattcagctgtggcattatctttttattggcacgctaaacagtctcctgacaaatatggcgggcggggacatggcacgcgtatcgacttacactaacgcattcgcttttacccagtttggcgtgctatgcgctccctggaatggtcttctgatggatcggctgaagcaaaaataccaaaaagaagcacgcaaaaccggctccagcactctggccgttgccctgtgtagcactgtcccctctctggccttaacgtctctgctgtgtttgggcttcgctctctgtgcaagcgttcccatcctcccattgcagtatctcaccttcattttgcaggtgataagtcgcagttttctttatggttccaacgctgcattcctaactctggcatttccctctgagcattttgggaaactctttgggcttgtcatggcactgagcgccgtggtgagcctgcttcagtttcccattttcacccttattaaggggtcattgcagaacgacccattttacgtgaatgttatgtttatgttagccattttgctaacattttttcatccatttctggtgtacagggaatgtcgaacctggaaagagagtccgagcgcaatcgcctag

SEQ ID NO: 30349 - DNA, 1476 bp, Artificial Sequence
  Description of Artificial Sequence: Synthetic coding sequence
atggctggtcagggcttgccactgcacgttgctactttgttgaccggcctgctggagtgtctgggtttcgccggagtcctgttcgggtggccctcccttgtgtttgtgtttaagaatgaagactacttcaaggatctttgcggtcctgatgccggtcctattggaaacgccacagggcaggcagactgcaaagcccaggacgagaggttcagcttgattttcaccctgggatccttcatgaataacttcatgaccttcccaacgggatatatttttgacagattcaaaactaccgtggcccgcctgattgctattttcttctacacaacagctacactgattattgccttcacatcagcagggagcgcagtactcctgttcttagcaatgcctatgctgacgataggaggtatactcttcctaataacgaatctccagattggaaatttgttcgggcagcatcgctctactattattaccctctacaatggcgccttcgactcatcctcagccgtttttttgatcatcaaactcctgtatgagaagggaatttctctgcgggcctcatttatcttcattagcgtgtgctccacctggcacgttgcacggacctttctgctcatgccccggggccatattccttacccactcccacccaactacagctatggactatgtcctggtaatggaactacaaaggaagagaaagagacagctgagcacgagaatcgtgagctgcagagcaaagaatttctgtcagcaaaggaagagacgccaggtgctggccagaagcaggaactccggtccttttggagctatgctttttctcggcgctttgcctggcatctcgtgtggctatctgtgatacagctgtggcattacctgtttattggtacactgaatagcctgctcacaaatatggctggaggcgatatggccagagtcagtacctacactaacgccttcgccttcacccaatttggggtgctctgtgcaccttggaacggcctgctcatggaccgactgaaacagaagtatcagaaggaagcacgtaaaaccgggtcttccactctggcagtggcattgtgtagtactgtccctagcctggctctgacctctctgctgtgtctcggttttgccctgtgcgcatccgtgccaatactccctctgcagtatctgaccttcattctccaggtgatcagtcgctccttcctatatggcagtaatgccgcttttctgacgctcgccttcccatcagaacacttcgggaagcttttcggcctagtcatggctttgtccgccgtcgtgagcctgctgcagttccccatctttactctgatcaaggggtccttgcagaacgatcctttttacgtgaatgtcatgttcatgctggcgattctgttgaccttctttcatccctttctcgtgtaccgggagtgtcgaacctggaaagagtctccctccgccatcgcctag

SEQ ID NO: 30350 - DNA, 309 bp, Artificial Sequence
  Description of Artificial Sequence: Synthetic coding sequence
atggctggccagggcctgcccctccatgtcgcaactctcctcacagggctgctagagtgcttgggattcgcaggagtcctgttcgggtggcctagcctggtgtttgttttcaagaacgaggactactttaaagatctgtgtggccctgatgccggcccaatcgggaacgctacagggcaggccgactgcaaagcacaagatgagaggttctccctcatattcactttggggtcctttatgaataactttatgacctttccaactgggtacatttttgacaggttcaaaacaactgttgcacgcctttag

SEQ ID NO: 30351 - DNA, 510 bp, Artificial Sequence
  Description of Artificial Sequence: Synthetic coding sequence
atggcaggacagggactccccctgcacgtcgctaccttgctgactggtctgctggagtgcctcgggtttgctggcgtcctgttcggatggccctccctggtgtttgtatttaaaaatgaggactattttaaagacttatgcggcccggatgccggtcccattggaaacgccacaggccaagctgattgtaaggcacaggatgagaggttcagcctgatcttcacactcgggtctttcatgaataacttcatgactttcccaacgggatatatctttgatcgctttaaaaccacggtggcaagactgattgccatctttttctacacaacggcaacccttatcatcgctttcacttctgccggatctgccgtgcttttgttcctggccatgcctatgctgactattgggggcattctgttcctgattacaaacctacagatcggtaatctgttcgggcagcatcgcagtacaattattacactctataacggtgcctttgactcaagctag

SEQ ID NO: 30352 - DNA, 195 bp, Artificial Sequence
  Description of Artificial Sequence: Synthetic coding sequence
atggccgggcagggcctgcctttacatgtagcaactctgctgaccggcttgctcgagtgcctgggctttgcaggagtattgtttggctggccttccctggtgttcgtgtttaaaaacgaggactacttcaaagacctgtgtgggccagacgctggtcccataggcaatgcgaccggtcaggctgggaggctttag

SEQ ID NO: 30353 - DNA, 447 bp, Artificial Sequence
  Description of Artificial Sequence: Synthetic coding sequence
atggcggggcaaggcttacctctgcacgtcgccacgctcctgaccgggctgcttgagtgcctgggcttcgccggagtgctattcggatggccaagcctggtgtttgtatttaaaaatgaggattattttaaagacttgtgcggacccgacgccgggcctatcgggaacgccaccggccaagctgattgcaaggcccaggacgaacgcttttccctgatcttcaccttaggctcattcatgaataactttatgaccttcccaactgggtacatattcgatagatttaagaccacagtggctaggctgatcgcaattttcttctatacgaccgctacactgataatcgccttcacttcagcaggtagcgccgtcttgctgttcctggcaatgcccatgttgacaattgggggcattctgttcctgattacgaaccttcagatcgggtag

SEQ ID NO: 30354 - DNA, 360 bp, Artificial Sequence
  Description of Artificial Sequence: Synthetic coding sequence
atggctggccagggcctcccattgcacgtagccaccctcctgacaggtctgctcgaatgcctgggatttgcaggcgtgctatttggatggccctcgctagtcttcgtgttcaagaacgaagattactttaaagacctgtgcggccccgacgcaggtcctatcgggaatgctaccggccaggccgattgcaaagcccaggatgagcggtttagtctgattttcacactgggctcatttatgaataactttatgactttccccacagggtatatcttcgaccggttcaaaactacagtggctaggttaattgctatctttttttatactacagccacattgattatagcgtttaccagttag

SEQ ID NO: 30355 - DNA, 1476 bp, Artificial Sequence
  Description of Artificial Sequence: Synthetic coding sequence
atggctggtcagggacttcccctgcatgttgcaaccctgctgacaggcctccttgaatgtctgggttttgcaggcgtgctgtttggatggccaagcttggtatttgtttttaagaacgaggattatttcaaagatctctgtggaccagacgccggccctattggcaacgccaccggccaggccgactgcaaagcccaagatgagagattctctctgatctttactctggggagcttcatgaataattttatgacattcccgaccggctatattttcgaccgttttaagacaaccgtggccaggctgattgccatttttttttacaccactgcaaccctaatcatcgcttttacttcagcaggtagtgccgttctgctctttctagcaatgcccatgctgacaattggggggatcctgtttctgatcaccaacttgcagatcggcaacctgtttggacaacatcgaagcacgattatcacactgtataacggggcttttgatagctcatctgctgtgttcctcatcatcaaactgctgtacgaaaagggcattagcttaagagcttcattcatctttatcagtgtatgttctacttggcacgtcgctaggacctttctgcttatgccacgcggacacatcccatatcctctgcctcctaattactcctacggactgtgtccagggaacgggacaacaaaggaggagaaggagacagcagaacatgagaatcgtgagctacagtccaaggaattcttgtccgccaaggaggaaactcctggcgccgggcagaagcaggagctaagatccttttggtcatatgcctttagtcgacgcttcgcttggcatctggtgtggctatctgtgatccaattgtggcactacctgttcattgggactctcaactccctcttgaccaacatggctggcggggacatggcacgggtatcaacttataccaacgctttcgctttcacacagtttggcgtgctttgcgcaccatggaacggattgctgatggataggctgaagcagaagtaccagaaggaagcacgtaagacggggagcagcacacttgccgttgccctgtgctccaccgtgccttccttggctttgaccagcctactgtgtctgggcttcgccctgtgcgcatccgtgccaattttgccactccagtacctcactttcatccttcaggttattagtcgatcctttctatatgggagcaacgccgcttttctgacactcgcctttccgagtgaacatttcggaaaactctttggtctggtgatggccttgagcgctgtcgtatctctgctgcaatttccaatctttactctgattaaaggttctcttcagaacgatcctttttacgtcaatgtaatgtttatgctcgcaatcctcctgacgttcttccacccatttttagtgtatagagaatgcaggacatggaaagaatcccctagtgcaattgcttag

SEQ ID NO: 30356 - DNA, 69 bp, Artificial Sequence
  Description of Artificial Sequence: Synthetic coding sequence
atggctggccaagggttgccgctgcacgtggccacactcttgacaggcctgcttgaatgtctaggttag

SEQ ID NO: 30357 - DNA, 996 bp, Artificial Sequence
  Description of Artificial Sequence: Synthetic coding sequence
atggctggtcagggtctccccttacacgtggctactctcctcactgggttgctggagtgtcttggttttgctggtgtgctgttcggctggcccagcctggtgttcgtttttaagaacgaagactacttcaaggacctctgcggtccagacgccgggcccattggcaatgcaaccggtcaggccgattgtaaagctcaggacgagaggttttccctcatctttaccttaggtagctttatgaacaacttcatgactttccctacagggtatatttttgaccgttttaaaaccaccgtggccagactgatagctatcttcttctataccactgcaaccctgatcatagcctttacaagtgccggcagtgctgtattgctcttcctggcgatgcctatgctcaccattggcggcatccttttcctgattacaaacttacagatcggcaacctgtttgggcagcacaggagcaccatcattaccctgtataacggagctttcgatagtagttctgcagtgttcctgatcatcaaattgctgtatgagaagggaatttcactgcgggcaagcttcatcttcatttctgtctgctcaacctggcacgttgcccggacatttcttctcatgccgagaggacatattccgtatcctctgccccccaattacagttacggcttgtgcccaggcaacgggaccaccaaagaagaaaaagagacggcagaacacgagaacagggagctccagagtaaggaattcctcagtgccaaggaggagacccctggagccggtcaaaagcaagaattgagatctttctggagttacgctttcagcagacgtttcgcatggcaccttgtttggttgtctgtgattcaactgtggcattatctttttatcggcacccttaactccctgttgaccaacatggctggaggcgacatggcgcgagtgtccacctatactaacgcttttgccttcacccagttcggagttctgtgctag

SEQ ID NO: 30358 - DNA, 135 bp, Artificial Sequence
  Description of Artificial Sequence: Synthetic coding sequence
atggccggccaggggctgccccttcacgtagccaccctgcttacgggtttactagagtgtctgggctttgccggtgtgttgttcggttggccaagcttggttttcgtgttcaaaaacgaggactacttcaagtag

SEQ ID NO: 30359 - DNA, 9 bp, Artificial Sequence
  Description of Artificial Sequence: Synthetic coding sequence
atggcgtag

SEQ ID NO: 30360 - DNA, 297 bp, Artificial Sequence
  Description of Artificial Sequence: Synthetic coding sequence
atggcagggcaggggctcccactacacgtggcgacactgttaactggcctcttggagtgcctcgggtttgcaggcgttctgtttggctggccatctttggtcttcgtctttaaaaacgaggactactttaaggacctgtgcggacccgacgctggacctattggtaacgcaaccggtcaggcggactgcaaagcacaggacgagaggttctcattaatctttaccctgggatcctttatgaacaactttatgactttccctaccggctatatctttgataggttcaaaacaacttag

SEQ ID NO: 30361 - DNA, 237 bp, Artificial Sequence
  Description of Artificial Sequence: Synthetic coding sequence
atggcaggccaagggttaccactccacgtggcgaccctgctgacaggacttctggagtgcttaggctttgctggcgtgctgttcggctggccctcacttgtgtttgtgttcaaaaacgaagattactttaaagacttgtgtggcccggatgccggccccattggcaatgctaccgggcaagctgattgcaaagctcaagacgagcggttctcccttatttttacactcggcagctag

SEQ ID NO: 30362 - DNA, 324 bp, Artificial Sequence
  Description of Artificial Sequence: Synthetic coding sequence
atggcaggacagggccttccgctgcacgtcgccacccttctcaccggactcctagagtgcttgggatttgccggggttctctttggatggccttctctggtcttcgtctttaagaatgaagattactttaaagatctgtgcggaccggacgccggacccataggcaacgccaccgggcaggccgactgtaaagcacaggatgagcggttctcactcatcttcacgctgggttcttttatgaataattttatgacattccccaccggttacattttcgataggttcaagaccactgtagcccgtctcatagcaatttttttctag

SEQ ID NO: 30363 - DNA, 333 bp, Artificial Sequence
  Description of Artificial Sequence: Synthetic coding sequence
atggcagggcagggtctgccactgcacgtcgccaccctgttgactgggctgcttgagtgcctgggattcgccggcgttctgttcgggtggccctcactggtgtttgtcttcaaaaatgaggattacttcaaagacctgtgcggcccagatgcaggccctatcggtaatgcaacagggcaggctgactgtaaagcacaggatgagcggttttccctgatctttaccctcgggtcttttatgaacaattttatgacattcccaactgggtacatttttgatcgatttaaaacaaccgtggccagactgattgccattttcttctacacaacatag

SEQ ID NO: 30364 - DNA, 1758 bp, Artificial Sequence
  Description of Artificial Sequence: Synthetic coding sequence
atgcactgcctgggggctgaatacctcgtttttattatgggctactccgtcgtggccggggctgccggaagattgttatttggttatgactctttcggcaatatgtgtgggaagaaaaatagtcccgtggaaggagctccactctccggccaggacatgaccctaaaaaaacacgttttcttcatgaatagctgtaatctggaggtgaaggggagcttcctgtgtgtttactctcttaattccttcaattacacacattctcccaaggcagattccctttgtccaagactacccgtgcctccaagcaaatcattcccattatttaaccgctgcgtcccgcagaccccagagtgttatagccttttcgccagcgtcctcattaatgacgtggataccctgcaccggatactctctgggatcatgagtggaagagacaccattttgggtttgtgcattttggctctcgccctttcattggcaatgatgtttacgtttcgcttcataaccacactcttggtacacattttcatctcacttgtcatattaggattactgtttgtgtgtggagtgctatggtggttgtactatgactataccaacgacctttcgatcgagctggacaccgaacgcgagaacatgaagtgcgtccttggattcgccatcgtgtccacaggaatcacggccgtgttgctcgtgctgatatttgtgctcagaaagcgcattaaactgacggtagagctgttccaaatcacaaataaggcaataagcagcgcaccgtttctgctgttccaacccctctggacattcgctatccttatctttttctgggtcctttgggtggctgtgctgctgtcacttggaactgcaggagccgcccaggtgatggagggcggacaggttgagtataaaccactaagcggcattcgatacatgtggagctaccacctcatcggacttatctggacttctgagtttatcctcgcctgtcaacaaatgacgatcgccggggcggtggtgacttgctacttcaataggtccaagaacgatcctccagatcaccctattttgtcttctctttcgatcctctttttctaccaccagggcacagtcgtcaagggcagcttcctaatatctgtcgtcaggatcccacgcataatagtgatgtatatgcagaatgcgctgaaagagcagcaacacggcgctttgtcccgctacttattccggtgctgttattgctgtttttggtgcctagacaaatacctgctccacctcaaccaaaacgcttacaccaccacagctatcaacggtacagacttttgcacaagtgccaaagatgcgtttaagattctgagcaaaaattctagtcacttcacctctattaattgcttcggagattttattatctttctggggaaagtgctggtggtctgttttacagtctttgggggacttatggcgttcaattacaatcgggcgtttcaggtgtgggccgttccactccttctggttgcgtttttcgcttatctcgtggctcactcatttctcagcgtattcgagaccgtacttgatgcactatttctgtgtttcgctgtggatcttgaaaccaatgacgggagcagtgagaaaccatatttcatggaccaggagttcctgtccttcgttaagcggtcaaacaaactgaacaacgcccgtgcacagcaggataaacacagcttaaggaatgaggaaggcaccgagttgcaggctatagtccggtag

SEQ ID NO: 30365 - DNA, 1863 bp, Artificial Sequence
  Description of Artificial Sequence: Synthetic coding sequence
atgcactgcctcggcgccgagtacttagtttcggccgagggcgcacctcgccagagagagtggaggccacaaatttaccgcaagtgcacggacaccgcctggttgtttctgttcttcctgttttggactggactcgtgttcatcatgggttatagtgtggttgcgggcgccgcaggacggttattattcgggtatgacagttttgggaatatgtgtggcaaaaaaaacagccctgtcgagggagcccccttgtccgggcaggacatgactctgaagaagcatgtcttctttatgaacagctgcaatctcgaggtcaaggggtcattcctgtgcgtttattccctgaattctttcaactatacccatagtcccaaggccgattctctttgtcccagactacccgtccccccatcaaaatctttcccattgttcaatcgatgcgtgccccagactcctgaatgttactccctattcgcctccgtgcttatcaatgatgttgatacactacacagaatcctatctgggatcatgtcgggacgtgataccatactcggcctctgcattcttgccctagccttgtctctggccatgatgtttacctttcggttcatcaccactctgctggtacacatctttatctctctcgtgattctgggcctgttattcgtctgcggtgtgctgtggtggctgtactacgactatacaaatgatcttagcatcgaattagacacagagcgtgagaatatgaaatgcgttctgggcttcgccatcgtatccacaggcatcacagccgttttattggttttgatattcgtgctacgtaagagaatcaaattgactgtggagctcttccaaattactaataaagccattagcagcgccccattcctgttgtttcagccactctggacatttgcaatccttatattcttctgggtattgtgggtcgccgtgttgctgtctctgggaacggcaggggccgcccaggtgatggaaggggggcaggtcgaatataagccattgtcaggaattcggtatatgtggtcataccacctcatcggcctaatttggacatctgagttcatcctcgcctgtcagcagatgaccatcgcaggcgctgtggtgacctgctactttaatcgaagcaaaaatgacccgcctgaccaccccatccttagttccctgtcaatactcttcttctaccaccagggcacagtagtgaagggctccttcctgattagcgttgttcgaatccctcgtataattgtgatgtacatgcagaacgccctgaaagagcagcacggcgcactgtccagatatttattcaggtgttgttattgctgcttctggtgccttgacaagtatctgcttcacctgaatcagaatgcctataccaccactgccattaacggcactgatttttgcaccagtgcaaaggatgcctttaagattctgagcaagaactctagccacttcacctcgattaactgcttcggcgatttcattattttccttggcaaggtgctcgtagtctgtttcaccgtttttggtggcctaatggcatttaactacaaccgcgcatttcaggtgtgggccgtgccactcttgctggtggctttcttcgcttatcttgtagcgcatagtttcttgtcagtcttcgagactgtactggacgccctgtttctgtgttttgcagttgatctcgaaacaaacgacggcagctctgaaaaaccttatttcatggaccaagagtttctgagctttgtgaagcggtctaataaattaaacaatgcacgcgcccagcaggataagcatagcctccgaaacgaagaagggacagaactccaggctattgtcagatag

SEQ ID NO: 30366 - DNA, 1962 bp, Artificial Sequence
  Description of Artificial Sequence: Synthetic coding sequence
atgcattgcctgggtgccgagtatctagtgagcgccgaaggggctcccagacaacgcgaatggagacctcaaatttaccggaaatgcacagacacagcctggttgttcctgtttttcctgttctggacaggtcttgtgttcatcatgggttacagcgttgttgccggagccgcaggccgcctcctgttcgggtacgattcctttggaaatatgtgcggcaagaagaatagccctgtggagggggcccccctttcaggtcaggacatgacactgaagaaacatgtatttttcatgaatagctgtaacctggaggtgaagggcactcaactgaacagaatggcactgtgtgtatcaaattgtccagaagaacaattggactcactggaggaggtgcagtttttcgctaacaccagcggctccttcctttgcgtctacagcctgaacagctttaactatacccattcccccaaagctgacagcctgtgtccacggctccccgttcccccgtcaaagtccttccccctgttcaatcgctgtgtcccccagacacctgagtgctactcactgttcgcttccgtgctgattaacgatgtcgatacactccacagaatactgtctggcatcatgtcggggcgcgataccatcttgggactctgtatcttagcccttgcactgtctttagccatgatgtttacctttcggttcatcaccactcttctggtgcacatcttcatttccctggttatccttgggcttttgttcgtgtgtggtgtactctggtggctttattatgactacactaacgatttatcaattgagttggataccgagcgggagaacatgaagtgcgtgctaggttttgcaattgttagcaccggaatcacagcggttctgttggtgctgatcttcgtcctgagaaaacgaataaagctgactgtggaactgtttcagattactaacaaggcaatctccagcgccccatttctgctattccagccgctgtggacattcgctattctaatctttttctgggtcctctgggtggctgtgctgctgagtctggggacagctggggctgcccaagtgatggaggggggacaagtcgagtacaagccactgtccggcatccggtatatgtggagttaccacttgatcgggttgatatggacaagtgagtttatactggcttgccaacagatgacgatcgccggggccgtcgttacctgctacttcaatcggagtaaaaacgatcctcccgaccacccaattttgagctctctgtctatactgttcttctatcaccaggggaccgtggtcaaaggatcattccttatcagtgtggtccggattccccgcatcattgtaatgtacatgcagaatgctctcaaggagcaacagcacggagcactctctagatatttgttcagatgctgctattgctgcttctggtgcctggataaatacctcctgcatcttaatcagaacgcatacaccacgaccgcaattaatggaacggatttttgcactagtgcaaaggacgctttcaaaatactgtcaaaaaactcttcgcactttacctccatcaactgtttcggcgatttcatcatatttctaggaaaggtgctggtagtgtgctttacagtgttcggtggcttaatggctttcaactacaatcgggccttccaggtatgggccgtgccgctgcttcttgtggcctttttcgcctaccttgtcgcccacagcttcctcagcgttttcgagactgtgctcgacgcactctttctgtgctttgctgtcgacctggagaccaatgacggaagcagtgaaaaaccatattttatggaccaggagttcttgtcgtttgtcaaacggtctaataagttaaataacgctcgcgcccagcaagataagcatagtttacggaatgaagagggaaccgaactccaggccatagtgcggtag

SEQ ID NO: 30367 - DNA, 492 bp, Artificial Sequence
  Description of Artificial Sequence: Synthetic coding sequence
atggggtatagtgtcgtggcaggcgctgccggtcgactgctttttgggtacgactctttcggcaatatgtgcggcaagaagaactcaccagtggaaggggcccctctgagcggtcaggatatgaccctgaaaaagcatgtattcttcatgaatagctgcaacctggaggtgaagggcacgcagctcaatcggatggccttgtgcgtttcaaactgccctgaagagcagttagattcactggaggaagtgcaattcttcgcaaacacctcgggaagctttctgtgtgtgtactctctgaacagctttaattacacacacagccccaaggcggactctttgtgccccagactgcctgtgcctcccagcaagagctttcccctgtttaaccgttgcgtccctcagacaccggagtgttactctctgttcgcttcagtcttgattaacgatgtggatacactgcaccggatattgtccggaatcatgtcgggatag

SEQ ID NO: 30368 - DNA, 1854 bp, Artificial Sequence
  Description of Artificial Sequence: Synthetic coding sequence
atgcactgtttaggagccgaatatctggtgttcatcatgggctactccgtggtggctggggccgccggacgcctgctatttggttatgactctttcggcaatatgtgcggcaagaaaaactcgccagtggagggcgcaccgctatctggccaggacatgacattgaaaaaacatgtgttcttcatgaactcatgcaatctcgaggtgaagggaacacagctaaatcgaatggccctgtgtgtgtcgaactgccctgaggaacagctcgacagccttgaggaagttcagttttttgctaatacctccggaagctttctctgcgtgtactcactcaactcttttaactatacccattccccaaaagccgattccctgtgtccacgtctgcctgttcctccttcgaagtctttccctctctttaatcgatgtgtcccacagactccggagtgctacagcctttttgctagcgttctgattaacgatgttgacacattgcatcggatactcagtggcatcatgagtgggagggatacgatcctagggctatgcattctggcccttgctctctctctggctatgatgtttacgtttaggtttattacaactctcttagtacatatttttatctccttagtaatactggggctgcttttcgtgtgcggtgtgctgtggtggctgtattacgactataccaatgatctctctattgaacttgacacagaaagagagaacatgaaatgcgtcctgggtttcgcaatcgtgagcaccgggatcacagctgtcttgctggtgctgattttcgtgctcagaaaaaggattaagctcaccgtggagctgtttcagatcaccaataaggccattagcagcgctccctttctcttgtttcagccactgtggacatttgctattttaatctttttctgggtgctgtgggttgcggtgctgctttctttgggcactgccggggcagcccaggtcatggaggggggacaggttgaatacaagccccttagcggcattcgctatatgtggtcatatcacctgatcggacttatatggacctcagagttcatcctggcatgtcagcagatgactattgctggagccgttgtcacttgctatttcaatcgaagcaaaaacgatccccccgaccatccaattctgtctagtctgtccatcctcttcttttaccaccaaggcacagtggtgaaaggctcctttctgatttcagttgtacggattccaagaattatcgtgatgtacatgcagaacgctctcaaggaacaacagcacggcgcgctgagccggtacctctttcgctgttgttactgctgtttctggtgtcttgataagtacctcttacatctcaatcagaatgcttacactaccactgcaatcaatggaactgacttctgtacttccgccaaagatgcattcaagattttaagtaagaactcttcacatttcaccagcattaactgctttggggactttattatattcttgggtaaggtccttgtggtgtgcttcaccgtgtttgggggtcttatggcattcaattataatagggccttccaggtgtgggccgttcctctactcctggtggcctttttcgcctacctagttgctcattcattcctgagtgtgttcgagacagtgctggacgcgctgtttctgtgtttcgccgtcgacctggagacaaacgatggatccagtgaaaaaccttactttatggaccaggagttcctgagctttgtcaagagatctaataagttaaacaacgcaagggctcagcaagacaaacatagcttgcgcaatgaagaaggaacagagttacaggcaatcgtgcgctag

SEQ ID NO: 30369 - DNA, 1818 bp, Artificial Sequence
  Description of Artificial Sequence: Synthetic coding sequence
atgggttattcagtggtggcaggagcagccggcagactgctgttcggatacgattcatttggaaacatgtgcggaaaaaagaacagccctgtggagggagcccccttatctgggcaggacatgacacttaaaaagcatgtgtttttcatgaactcctgtaatctagaggtgaagggaactcaacttaatcggatggcactgtgtgtatcaaactgcccggaggagcagctcgatagtctcgaggaagtgcagttctttgcgaacacaagcggttcattcctgtgcgtttacagtctaaactctttcaattacacccactcacctaaagccgacagtttgtgccctcgactgccagtcccgcctagtaagtcattcccactttttaatagatgcgtgcctcagacacctgagtgctattccctgttcgcaagcgtgttaatcaacgatgtcgacaccctccatcgaattctgtctggaataatgagcggccgagatacgattctcgggctttgcattctggcattggccctgtccttggcaatgatgtttacatttagattcatcaccaccctgctcgtgcatattttcatcagcttggtcattctggggctcctgttcgtctgcggagtgctgtggtggttgtactacgattataccaacgatctttcaatcgagctcgataccgagcgagagaacatgaagtgcgtgctgggcttcgccatagtgtcaaccggaataacagcagtccttttagtgctcatcttcgtccttagaaaacgtattaaattaacagttgagttgttccagataaccaataaagcaatctcttctgcccccttcctgctcttccagcctctgtggaccttcgccatactgatctttttctgggtgctctgggtcgctgttctgttgagcctgggtaccgccggggccgctcaggttatggaaggaggccaagtagagtataagcctcttagtggcataagatatatgtggagctaccacctaattggtctgatctggacatcagaatttatcctggcctgccagcagatgacaatcgcaggcgctgtggtcacctgttactttaacaggtctaaaaatgaccctcccgatcatcccattctctctagcctgtccatcttattcttttaccaccagggaactgtcgtcaagggatcttttctgatctcagtagtgagaattccaagaatcatcgtgatgtatatgcagaacgccttaaaggagcagcagcatggtgccctgagtcggtacctctttaggtgctgttattgctgcttctggtgccttgataaatacttacttcacttaaatcagaacgcgtatacgacaactgctattaacggaaccgacttttgtacatccgctaaggatgcttttaaaatccttagcaaaaattctagccattttacctctatcaactgctttggtgactttataatcttcctgggcaaagttctagtcgtgtgcttcacagtatttgggggcctcatggccttcaattataacagggcattccaggtgtgggcagtgcctctgctgctcgtggcctttttcgcatacctggttgcccattctttcttatccgtattcgagaccgtcctcgatgcactgttcctgtgcttcgcagtggatttggagaccaatgacggcagctcagaaaaaccttatttcatggaccaggaatttctcagcttcgtgaaacgctcgaacaagcttaataatgcccgcgcccaacaggacaagcattcacttagaaatgaagagggtaccgagctgcaggccattgtgcgctag

SEQ ID NO: 30370 - DNA, 2160 bp, Artificial Sequence
  Description of Artificial Sequence: Synthetic coding sequence
atgaacgataccgaaaagcctgccgacactccttccgaagaggaagattttggcgaccccagaacctacgatccagacttcaagggaccagtcgcaaataggtcctgtacagatgtcctatgctgtatgatctttctgctctgcatcattggctatatagttttaggcttggtcgcgtgggtacacggagatccccggcgcgctgcttatcctaccgactctcagggtcacttctgtggccagaagggcaccccaaatgagaataaaaccatcctgttttattttaatctgcttcgatgtacttcccctagtgtacttttgaacttacagtgccctacaacacaaatatgcgtctctaaatgtcccgagaagtttctgacctatgtggaaatgcagcttctgtataccaaggataagtcctattgggaagattaccgccaattctgtaagacaaccgcaaaacccgtgaaatcattgacccagctgctactggacgacgactgtcctaccgcaattttcccatccaagccatttctacaaagatgctttcccgatttctcaactaagaatggcaccctgactataggatccaagatgatgttccaggatggaaatgggggtactagaagcgtagtcgaactaggaatcgcggccaacggcattaataagttgttggatgccaagagcctaggcctgaaggtgtttgaggactatgctaggacatggtactggattttgatcggattgacgattgccatggtgctgagctggatctttctcatactgctgaggttcatcgccggatgcctgttctgggtttttatgatcggggtgattggcatcatcggctatggcatctggcactgttatcagcaatatacgaacctgcaggagcgccctagttctgtgctgactatctacgatattgggattcaaactaacatttcaatgtattttgaacttcagcagacctggtttaccttcatgatcattctgtgcatcattgaagtgattgtgattctgatgctaattttcctgagaaatagaattagggtggccattattctgttgaaggaggggagcaaggcaatagggtacgtgccatccacattagtataccctgcgctaacatttatcctgctctcgatatgcatctgttattgggtcgtgaccgccgtctttttggcgacgtcaggggtcccagtttacaaggtgattgcacccggaggccactgcatacacgaaaatcaaacctgtgaccccgagattttcaatacaacagagattgccaaagcatgtcccggtgcattgtgtaattttgccttttacggaggcaagtccttgtatcaccaatacatacccacatttcacgtttataacctcttcgttttcctttggctcataaactttgtcattgcactggggcagtgtgccctggcgggagcatttgccacctactactgggcgatgaaaaagcctgacgacattccgcggtatccactcttcaccgcatttgggcgggccattcgctatcacactggcagtctggccttcgggagcctaataatcgcgctgattcagatgtttaaaattgtgttagaatacctcgatcacagactgaaaagaacacagaacactctttccaagttcttacaatgctgcctgagatgctgcttttggtgtctggaaaacgctataaagtttctcaataggaacgcttacatcatgattgccatttacggcaggaatttttgccgcagtgccaaagatgcatttaacttgttaatgagaaacgtcctaaaagtggctgttaccgacgaagtcacttacttcgtcttgtttcttggcaagctcctggtagccggatctatcggcgtgctcgctttcttgttcttcacacaaagattgccagtcattgcccagggccccgcctctcttaattactattgggtgccgctcctgacggtgatcttcggtagctatctcattgcacacggatttttctcggtgtatgctatgtgtgtcgaaacgatttttatctgcttctgtgaagacctggagagaaacgacggcagcaccgaaaagccatattttgtcacaccaaaccttcatggtatattgatcaaaaagcagttggtgcctcagaagcagaaagaatag

SEQ ID NO: 30371 - DNA, 2154 bp, Artificial Sequence
  Description of Artificial Sequence: Synthetic coding sequence
atgaacgatactgaaaagcctgcagacacaccatccgaggaagaagactttggagaccctcgcacatatgatcccgacttcaaaggtcccgtcgccaatagaagttgcacggacgtgctgtgttgcatgattttcctgttatgcatcatagggtatatcgtattaggcctggtggcctgggtccacggggaccccagaagggctgcctacccgacagattcgcagggccacttttgtggacagaaaggaacccccaacgagaacaagaccattcttttctactttaacttgcttagatgcacctcccccagcgtcttactcaacctgcagtgtcccactactcagatatgtgtaagtaaatgcccagagaaatttcttacttacgtagagatgcagctgttatacacgaaggacaagtcctattgggaagattataggcagttttgcaaaactacagcaaaaccagttaagtctctgacgcagctgctgctggatgacgactgtccgacagccatctttccatcgaaaccatttttgcaacgctgctttcccgatttttctacgaaaaacggcaccttgaccatcggcagtaagatgatgttccaggatggtaatgggggcactagatctgttgtggagctgggtatcgccgctaacgggataaacaagctgctcgacgccaagtctcttggcttgaaagtgtttgaagactacgcacggacgtggtactggattctcatcggtctgactatagccatggtactgtcatggatcttcctgatcctgcttaggtttattgctgggtgcctcttctgggtattcatgattggggtgatcggcatcatcggttatggcatttggcattgctaccaacagtacaccaacctacaggagagaccatctagcgtccttacgatatacgacatcggaatccaaacgaatatatctatgtattttgagttacagcaaacgtggtttaccttcatgatcatactgtgcatcatcgaagtcatcgtgattctgatgcttatctttcttagaaaccgtatcagggttgcgataattctactgaaggaaggctctaaggctataggatacgttccctcaacccttgtgtatcctgccctgacctttatccttctttcaatatgtatttgctattgggttgttacggcagtttttctcgccacctccggcgttccagtatataaagttatagcaccaggcggacattgcatccacgagaatcagacttgcgaccccgaaattttcaataccaccgagatcgcgaaagcatgtccaggtgccctgtgcaactttgcattctacggaggaaaatctctgtaccaccagtacatccctacttttcacgtgtataatctctttgtgttcttatggctgattaattttgtgattgccctcggacagtgtgccttggccggtgcattcgctacttattactgggctatgaaaaaaccagatgacatccctagatacccgctattcactgcatttgggagagcaattcggtaccacaccggcagtttggcctttggatccctcatcatagcacttattcagatgtttaagattgttctggagtacctggatcacagactaaagaggacacaaaacactttgtccaaatttttacagtgttgtctacgctgctgtttctggtgtctcgagaacgccattaaattcctgaatagaaatgcgtacattatgatcgcaatttacggccggaatttctgcaggtctgctaaagatgcctttaacttgcttatgcgaaacgttctgaaggtggcagttacggacgaggtcacgtattttgttctgtttctcgggaagttactggtggcaggcagtatcggagttctcgctttcctttttttcacgcagcgactgcctgtgattgcacaaggacccgccagcctgaactactattgggtcccgctcctgaccgtcatcttcggatcctatctgattgcccacggcttcttcagtgtctacgccatgtgtgtcgagactatattcatctgttttctggaagacctggaacggaacgacggaagtactgcaagaccttattatgttagtcaacctcttctgaagatcttccaggaagagaaccctcagacccgcaaacaatag

SEQ ID NO: 30372 - DNA, 1770 bp, Artificial Sequence
  Description of Artificial Sequence: Synthetic coding sequence
atgcaacttctgtatacaaaagataaaagctattgggaggactacagacagttctgcaagactaccgccaagcctgtgaaatcactcacgcaattgttgcttgatgacgattgtccaacagctatttttccgagcaagcctttcctgcagagatgttttcctgatttttctaccaagaacggcactctcacaattggctcgaaaatgatgtttcaggacgggaatgggggaacacgttcggtggtagagttgggaatcgcagccaacgggataaacaagttgctagatgctaagtctttgggcttaaaggtttttgaagattacgccaggacttggtattggatcctcattggcctcaccatagctatggtactcagttggatcttcttgatcctgttgcgcttcattgcgggctgtctgttctgggttttcatgatcggcgttattggaataatcggatatgggatctggcactgctaccagcaatacactaatctgcaggagcggccatcctccgtgctcactatttacgacatcgggattcaaaccaacattagcatgtatttcgagctgcagcagacctggttcacctttatgataattctgtgcattatagaagtgatcgtgatcctaatgcttatctttcttaggaatcgcatcagggtcgctattattctgctcaaagagggcagtaaggccatcggctacgtcccttcgaccctcgtatatccagcactgacctttattctgcttagcatttgtatttgctattgggtggtgacagcggttttcctcgctacatcgggcgtgccagtgtataaggtgatcgctcctgggggacactgtatccacgaaaatcaaacttgcgacccggaaatttttaatactactgagatcgccaaggcttgccctggtgcgctctgcaattttgcattttacggcggcaagtctctttaccaccagtacatcccgacattccacgtgtataatctgttcgtctttctctggctgataaacttcgtaatcgcactgggacagtgcgcgctggcaggcgctttcgcaacgtattattgggcaatgaaaaagccagacgacatacccagatatcctctgtttaccgcattcggtcgagcaatacgatatcacaccggatccctggcttttggcagtcttataatcgccctgatacaaatgttcaagattgtattagaatatctagaccaccgcctgaagcggacccagaacactctgtctaagtttctgcagtgctgcctaagatgctgcttttggtgcctcgagaatgccataaaatttctgaatcgcaatgcctacattatgatcgccatatatggacggaacttctgtcggagcgcgaaggacgcctttaacctgttgatgcgcaatgtcctgaaagtagcagtgactgatgaagtgacgtactttgtgctgtttctaggcaagcttctcgtagccggatctattggagtccttgcctttctattcttcacccagcgactacccgtcattgcgcagggccccgcaagcctgaattattattgggtccccctgctgacggtgatcttcggctcctatttaatcgcacatggtttctttagcgtgtatgccatgtgtgtcgaaacaatttttatttgcttctgcgaggacctggaacggaacgacgggtcaacagaaaagccctattttgtgacccccaatctacatggcattctcattaagaagcagcttgtccctcagaagcaaaaggagtag

SEQ ID NO: 30373 - DNA, 2139 bp, Artificial Sequence
  Description of Artificial Sequence: Synthetic coding sequence
accaaggcaaaaaagcggccgtccaacgctggtgacccccgcacctacgacccagatttcaagggtcctgttgcgaacaggagctgcaccgatgtgctttgttgtatgatttttttattgtgcatcattgggtatattgtgttgggactcgtggcctgggtgcacggggatcctcgcagggcggcctatccgactgatagccaggggcacttttgtgggcagaaggggacaccaaatgaaaacaaaaccatcttgttttatttcaacctgcttcgttgcacttcaccgagcgtgctcctcaacctgcagtgcccgacgacccaaatatgcgtgtctaaatgccctgagaaattccttacatatgtcgaaatgcaactgttatacactaaggataagagttactgggaggactatagacagttctgcaagacaaccgccaagccggtgaagagtctgacccagttgttgcttgatgatgactgcccaactgccatatttccatccaaaccttttctccagaggtgtttccctgattttagcaccaaaaatggtaccctgacaatcggttcaaagatgatgttccaggatggtaacggcggaacgagatcagtggtagagttaggaattgctgccaatggcataaacaaacttctggatgccaagagcctgggccttaaggttttcgaggattatgcgagaacctggtactggatcctcattgggctaactatcgccatggtcctgtcttggatttttcttatacttttgagatttattgcaggatgccttttctgggtgtttatgatcggggtgatagggattatcggctatgggatctggcattgttaccagcagtataccaacctgcaagagagaccaagcagcgtactgaccatttacgatattggcatccagacgaacatctctatgtacttcgaattgcaacagacgtggtttacattcatgatcatcctgtgtattattgaggtgatcgtgattctgatgttgatctttcttaggaaccgcattcgcgtggccattattctgctgaaggaaggctccaaggctattggctacgtaccgagtaccctggtttatccagccctgacgtttatcttactgtctatatgcatctgttattgggttgttactgcggtgttcttggccacatccggagtaccagtatacaaagttattgcccctggtggccattgcatccacgagaaccagacctgcgacccggagatttttaatactactgagatcgccaaggcttgccccggggcactttgcaacttcgcgttttatggagggaaaagcctgtaccaccaatatatccctacttttcatgtgtacaacttgttcgtttttctatggcttattaacttcgtgattgccttagggcaatgcgcccttgcaggcgcttttgccacatattattgggccatgaagaaaccagacgatataccccggtatccactttttacagctttcggccgcgccatcaggtaccacactggatctctggccttcgggagcttgattatagctctgattcaaatgttcaagattgttcttgaatacctcgaccatcggcttaaacgcacccagaacactctgtccaaattccttcagtgctgtttgagatgctgcttctggtgcttggagaatgccattaaattcctgaacagaaatgcttatataatgatcgccatttatggacggaatttctgtcggagcgctaaagatgcatttaatctgttaatgaggaatgttctcaaagtggcagtgacagacgaggtgacttatttcgtgttgttcctgggtaagctgctagtcgctggctcgatcggtgtcttggccttcctgtttttcacgcagcggcttcccgtgattgcccaaggccccgctagtctgaattattattgggtgcccctgctgactgtgatattcggaagttacctgattgctcatgggttcttttcagtgtatgccatgtgcgtagaaaccatttttatctgtttttgcgaggatttagagaggaatgatgggagtactgagaaaccatatttcgtgactccgaatctgcacggtattctgatcaagaagcagcttgtgcctcagaagcagaaggaatag

SEQ ID NO: 30374 - DNA, 2271 bp, Artificial Sequence
  Description of Artificial Sequence: Synthetic coding sequence
atgtctcgggtgccacagttcaaaatgcagaaatctcccgctttttgcgtcgatctcgccggctctcaccgcccagagctgttcctcttcggacatttggcaagtcatctgttcctgtgcttctttctagaaaagccagccgacacacccagtgaagaggaggactttggcgacccacgtacttatgatcccgattttaagggcccagtcgcaaacagatcatgcaccgacgtgttgtgctgcatgatattcttgttgtgcattattggttatatagtcctgggccttgtggcttgggtgcacggagaccccaggcgggctgcataccctaccgattcacagggacatttttgtggacaaaagggaaccccaaatgagaacaagacgatccttttttacttcaatcttcttcgttgcacatcaccttcagtgttactgaacctccagtgcccaaccactcagatttgcgtgagtaagtgtcctgagaagttcctgacctatgttgagatgcagctgttgtataccaaagataaatcttactgggaggattaccggcagttctgcaaaactacagcgaaaccagtcaagagtctgacacagcttctcctggacgacgactgtcccaccgccatctttccctctaagcccttcctgcagaggtgttttcccgactttagtacgaaaaacggaaccctcaccataggttctaaaatgatgtttcaagacggtaatggcggaacccgatcagtagtagagcttgggattgccgccaatggaataaacaaactgctcgacgcgaagtccttggggttgaaagtctttgaagactacgccagaacttggtattggatactcatcggcctgactattgctatggtactttcctggattttcttgatcctgctgcggttcattgctggctgcctgttttgggtctttatgataggagtcattgggatcattggttatgggatctggcactgttatcagcaatatactaacctgcaggaacgtccttcttcagtcctgacaatctatgatattggcattcagacaaatatctccatgtacttcgaattacagcagacatggtttacattcatgattattttgtgtatcatcgaggtgattgtcatcttgatgttgatcttcttgaggaatagaatccgcgtggctatcattttgcttaaggagggctctaaggctattggttatgtgccaagcacgctagtctatcccgcattaacctttatactcctaagcatttgcatctgctactgggtggtcactgcagtgtttctggcaacctccggcgttccggtgtacaaagtcatcgctcccggaggacactgcatccatgaaaaccagacatgtgatccggagattttcaacaccactgaaattgccaaggcctgtcccggcgcgctgtgtaattttgccttttacggcggcaagagcctgtaccatcagtatattcccaccttccatgtttataatctgtttgtattcctgtggctcataaacttcgtaattgccctcgggcagtgtgccttagctggtgccttcgcgacttactactgggccatgaaaaaaccagacgacatcccccgataccctctcttcactgccttcggtcgtgctatccgctaccataccggttcactggcatttggtagtctgatcattgctctgatccagatgttcaagatcgttttagagtacctggaccacagactgaaaagaactcaaaacaccctgtctaagtttctccagtgctgtttgcgctgctgcttttggtgccttgagaatgcgattaaatttctgaacagaaatgcctacattatgatcgctatctatggcagaaacttctgcaggagcgcaaaggatgcctttaatctcctcatgcgtaacgtgctcaaggtggccgtgactgacgaggtaacctattttgtgctcttcctgggaaagctgctcgtggcgggatctatcggggtactcgctttcctgtttttcacccagaggctgcctgtgattgcgcagggacccgcatcactgaactattattgggtgcctctacttacggtcatattcgggagctatttgatagcccatggcttcttctcagtctacgctatgtgtgttgaaactatctttatttgcttcctggaagacttagaaaggaatgacggaagcacagcccggccatactatgtctcacagcctttgctgaaaatcttccaggaagagaatccccagacccgcaaacagtag

SEQ ID NO: 30375 - DNA, 1386 bp, Artificial Sequence
  Description of Artificial Sequence: Synthetic coding sequence
atgaagatcctcttcgttgaaccagcaattttcctgtctgcttttgccatgacattaaccgggcctcttactacccagtatgtgtaccgtcggatctgggaggagacaggaaactacacattcagctcagactccaacatcagcgaatgtgaaaagaataaaagtagtcccattttcgccttccaggaggaggtacagaaaaaggttagtaggtttaaccttcagatggatataagcggactgatccccggtcttgtgagcacattcattctgttaagcatctccgatcactacggccggaagtttcccatgattttgagctctgtgggagcattagccaccagcgtctggctgtgcctgctgtgttacttcgcattcccctttcagctgctcatagcgtcaaccttcataggggctttttgcggcaactatactaccttctggggtgcgtgttttgcctatatcgtggatcagtgcaaggagcacaagcaaaaaaccatccggattgccattatcgactttttgctaggactcgtgactgggctgaccggcttgtcatccgggtacttcattcgagaactcggatttgaatggtcgttcctcatcattgccgtgtccctggcagtcaacctgatctacatcctcttctttttgggggaccccgtgaaggaatgttcctcacagaatgtcaccatgtcttgcagcgagggattcaaaaatcttttctatcgtacctatatgttgtttaagaatgctagtggcaagcgtcgcttcctcctgtgccttctcctgttcaccgtcattacatatttctttgtcgttattggcatcgcacctatattcatcttatacgagctggactctcccctatgttggaatgaggtgttcattggctacggatccgcactgggcagcgcctccttcctcacaagttttcttgggatctggcttttctcctactgtatggaagacatccatatggctttcattggtatttttacaacaatgactgggatggcaatgaccgcattcgcctccacgacgttaatgatgtttttggccagagttcccttcctgttcaccatagtgccgttcagtgtactgagaagcatgctgtccaaagtggtccgctccaccgaacaaggcactctgtttgcctgcatagcattcctcgaaacactgggcggcgtcaccgccgtgtctacgttcaacggcatctattccgcgaccgtcgcttggtatcctggatttaccttccttctctctgctggactgctcctgctgcccgccatctccctctgtgtggttaagtgtacatcatggaatgaagggtcttacgaactgctcatccaagaagaaagtagcgaggatgcttcagatcgctag

SEQ ID NO: 30376 - DNA, 1392 bp, Artificial Sequence
  Description of Artificial Sequence: Synthetic coding sequence
atgaagattctgtttgtggagcctgccatattcctgtccgccttcgctatgaccctgaccggccccctgacgacccagtacgtgtacaggcgcatctgggaggaaactggcaattataccttttccagcgattcaaacatctcagagtgtgagaaaaacaagtcatcacccatttttgcgttccaagaagaggtccagaaaaaagtttcccggttcaatctccagatggacatctctggcctcatacccggtctggtaagcactttcatcctgctgagtattagcgatcattatggtcgtaaattccctatgatactgtcctcagtcggagctttagccactagcgtctggctgtgtctactgtgctattttgcctttcccttccagttgttaatcgcctctacctttataggagccttctgtggcaattacacaaccttttggggcgcttgctttgcctacatagttgaccaatgcaaggaacacaagcagaaaaccattaggatcgcaatcatcgacttcctgttaggtctcgtcacgggcttaaccggcctgtcctccggctatttcattcgggaactggggttcgaatggagttttctcatcattgctgttagcctggctgtcaaccttatttacatcctctttttcctgggcgaccccgtgaaagagtgctcatcacaaaacgtaacaatgtcctgctccgagggcttcaaaaaccttttctatcgtacatacatgctgttcaaaaatgcatcagggaagcgccggtttctgttgtgtctcctgctgtttacagtcataacctacttttttgtggtaatcggaattgccccgatattcatactgtatgaattggactctcccctttgttggaacgaggtgttcatcgggtacgggagcgcactgggttccgcatcattcctgaccagcttcctggggatctggctattcagctactgtatggaggacattcatatggctttcattggaatttttaccacgatgactgggatggcgatgacggccttcgcgagcaccactctaatgatgttcctggcccgggtgccttttctgttcactattgtcccttttagcgtgctcagaagcatgctctcaaaagtggtgaggtctaccgagcaaggaactctgttcgcttgcattgcattcctggagaccctcggtggtgtgactgcagtgagtacctttaatggaatctatagtgctactgtcgcttggtaccccgggtttacctttttactgtctgctggtttgttattacttccggcaatttccctctgcgtggtgaaatgtacgagctggaatgaagggagttacgagctgttgatccaggaggagtcttccgaggacgcttccgatcgggcatgttag

SEQ ID NO: 30377 - DNA, 453 bp, Artificial Sequence
  Description of Artificial Sequence: Synthetic coding sequence
atggccccatcacggctgcagcttggactgcgtgcagcctacagtggtatctcttccgttgctggtttctctattttcctggtgtggacagtggtgtataggcagccgggtaccgctgctatggggggcctggcaggggtactggccctctgggtgctggtaacccacgtgatgtatatgcaggattactggcgcacatggctcaagggactgcgaggatttttctttgtgggcgtgttgttctcagccgtgagcatagccgctttctgtacattcttggtgcttgctattacccgacaccagagcctaactgaccctacctcctattacctgagtagcgtgtggtcctttatctccttcaaatgggctttcctgctaagccttccaaagtgctgggactaccggtgtgaacctccctgtccggcgtggatttgtttcttgtccactcagtag

SEQ ID NO: 30378 - DNA, 441 bp, Artificial Sequence
  Description of Artificial Sequence: Synthetic coding sequence
atggcaccatcacggctccaactaggcctgcgagctgcttacagcggaatatcttctgtggccggattctctatctttctcgtgtggactgtcgtgtacaggcagcccggaacagctgcaatgggcggcttagcgggggtgttagcgttatgggtcctcgtcacacatgttatgtacatgcaagactactggcgaacgtggctcaagggcctcagaggattcttcttcgttggagtactgtttagcgctgtctccatagccgcgttttgtacatttctggtcctggccattacgcgtcaccagtcacttaccgatcccacctcttactacctcagttctgtttggagcttcataagcttcaagtgggcttttctgttgagcttatatgcccatagatatagagcagacttcgcagatatcagcattttgagcgatttttag

SEQ ID NO: 30379 - DNA, 270 bp, Artificial Sequence
  Description of Artificial Sequence: Synthetic coding sequence
atgtacatgcaagactactggagaacctggctgaagggactaagaggcttcttctttgttggcgttctatttagtgctgtctccatagcagctttctgtaccttcctggtcctggcaattactagacaccagagcctgaccgacccaacatcgtattaccttagctccgtctggagcttcataagttttaaatgggctttccttctgtcgctttacgcccatcgatacagagccgattttgcagacataagcatcctctctgacttctag

SEQ ID NO: 30380 - DNA, 270 bp, Artificial Sequence
  Description of Artificial Sequence: Synthetic coding sequence
atgtacatgcaggactactggcggacgtggctgaagggactcaggggctttttctttgtgggagtgctgttctcagccgtctctattgcagcgttctgcacatttctggtgctcgccatcactagacaccagtccttgactgaccccactagctattatctttccagtgtctggtcattcatttctttcaaatgggcgtttctgttatcactctacgcacacaggtatagagctgacttcgccgatatatccatcctcagtgatttttag

SEQ ID NO: 30381 - DNA, 111 bp, Artificial Sequence
  Description of Artificial Sequence: Synthetic coding sequence
atgtatatgcaggattattggagaacttggttgaaaggccttcggggatttttcttcgtgggcgtgctcttctcggcagtctccattgccgcattttgtactttcctgtag

SEQ ID NO: 30382 - DNA, 51 bp, Artificial Sequence
  Description of Artificial Sequence: Synthetic coding sequence
atgtacatgcaggactattggagaacctggctaaagggactcagggggtag

SEQ ID NO: 30383 - DNA, 1743 bp, Artificial Sequence
  Description of Artificial Sequence: Synthetic coding sequence
atggcattccacgtcgagggacttatcgccattatcgtcttctacctgctgatcctgctcgtcgggatctgggcagcgtggcgtactaaaaatagcggatctgccgaggagcggtctgaggccattatcgttgggggcagggacataggtttgttagtgggcggttttaccatgactgccacatgggttgggggcgggtacattaatggcacggcagaggctgtttacgtccctggctacggccttgcttgggcccaggcccctatcggttatagcctcagcttgattctcggcggcttgttttttgcaaaaccaatgcggagcaaaggctacgttacgatgctggacccgttccagcagatctatggcaagcgtatgggaggcctgctgtttatccccgcgctgatgggggagatgttttgggctgctgccattttttcagcacttggagcaacgattagcgtcatcattgatgtggacatgcatattagtgtgattatcagtgctctgatcgccaccctctacacgctggtcggtggactctatagcgtcgcctacacagatgtggtgcagctgttctgtatcttcgtgggactctggatcagcgtgccatttgctctgtctcaccctgctgttgccgacattggctttacagcagtgcacgccaagtaccaaaagccatggttgggtacagttgattcctcagaggtgtacagctggttagactcctttcttttactgatgctcggaggtatcccttggcaagcttattttcagcgggtgctgtcgtccagcagcgctacctacgcgcaggttctctcatttctggccgccttcggatgcctggttatggctatcccagccatcctgattggggcaatcggggcaagcacggattggaatcagacggcctatgggcttccagaccccaaaacaaccgaagaagccgatatgatcttaccaattgtgcttcagtatttatgccctgtttatatttctttctttggcttgggggcggtgtcagctgcggtcatgagttccgcagacagctcaatcttatccgcgtccagcatgtttgcgcgtaatatatatcagctgagtttccggcagaatgcctctgataaggaaatagtgtgggtcatgaggattactgtgttcgtttttggggcttccgctaccgccatggcccttctgactaagactgtgtatggcctgtggtacctcagcagtgacctcgtttacattgtaatttttccacagctgctctgtgttttgtttgtgaaaggcactaacacgtatggcgccgttgctggttatgtgtcagggctgttcctgcggatcaccggaggcgaaccatatctgtatctgcagccactaatattctaccctggctattacccagacgacaacggtatctataaccaaaagttccccttcaagactctcgcgatggtaacctccttccttactaatatttgcatttcctacctggccaagtatctgttcgaaagcggcaccctgccccctaagctcgatgttttcgatgccgtggttgctcgacactcagaagaaaacatggacaagacaatcctggtgaagaatgagaatatcaagctggacgagcttgccctcgtcaagccccggcagtctatgaccctgagctctacattcacgaacaaagaggcctttctcgacgtggactctagtcccgaagggagtggtaccgaagacaatttgcagtag

SEQ ID NO: 30384 - DNA, 1743 bp, Artificial Sequence
  Description of Artificial Sequence: Synthetic coding sequence
atggcatttcacgtcgagggcttgattgcaattatcgtgttttatttgctgattctcctcgtcgggatttgggccgcatggcgaacaaaaaactccggatctgccgaagaacggtccgaggcaatcattgtaggaggccgggatatcgggctgcttgtgggtggcttcaccatgaccgctacatgggtgggtggaggatatattaatgggactgccgaggcagtttacgtccccggatatggcctggcctgggctcaggccccaataggctactcactgagtctaatcctcgggggtctattctttgctaaacccatgcgttccaaaggctacgtgacaatgctggacccatttcagcagatatatggaaagagaatgggcggcctgctgttcatacccgcactgatgggggaaatgttctgggcagccgccatcttttccgcgctgggagccacaatatcagtcattatcgacgtcgatatgcatatttccgtcatcatttctgctttaattgccaccctttacactctggtcggaggcctctattcagtagcctatactgatgttgtacaattgttttgcatcttcgtgggcctgtggatttctgtaccttttgcactgagccaccccgcagtggctgacatcggtttcaccgctgtgcacgctaagtatcagaagccatggttagggaccgtggattccagcgaggtgtacagttggttggactcctttcttctgctgatgctagggggcatcccttggcaagcctactttcagagggtgctctcaagctcctctgcgacatacgcccaggtcctcagttttctggccgcatttgggtgccttgtgatggcaattccggccatactcatcggtgccatcggcgcatcaacagattggaatcaaactgcttacggcctacctgatcctaaaactactgaggaggccgatatgatcttgcctatcgtactgcaatacctgtgtcctgtttacatttccttcttcggtctgggcgccgtgtccgccgctgtgatgtcgagcgctgatagttctattctgtcagcatcttcgatgtttgctagaaatatttatcagctgtcatttaggcagaacgcttccgacaaggagattgtctgggtgatgagaattacagtattcgtgttcggcgcttcggctacggcaatggccctgctgactaagacggtgtacggtctctggtacctgtcttccgatcttgtctatattgttattttccctcagctcctgtgcgtactgtttgtgaagggcacaaacacttatggagccgtggctgggtatgtgagcgggctgttcttgaggattacggggggggaaccatatctgtacctgcagccactcattttttatccaggctattatccagatgataatggaatttataatcagaaattcccatttaaaaccctggcaatggtcacatctttcctgactaatatctgcatcagttacttagccaaatacctcttcgaaagcggaaccttgccccccaagctggatgtgtttgatgccgttgtggcacggcattccgaggagaacatggacaaaacgatcctggtgaagaatgagaacatcaaactggatgagctcgctctcgtgaaaccccggcaaagtatgaccctaagctctactttcactaacaaagaagctttcttagatgtcgattcctctccagaaggctctggcaccgaggacaatcttcagtag

SEQ ID NO: 30385 - DNA, 1428 bp, Artificial Sequence
  Description of Artificial Sequence: Synthetic coding sequence
atgcggtctaaaggatacgttaccatgctggacccattccaacagatctatgggaaacgaatgggaggcctgctgttcattcccgcactgatgggagagatgttctgggccgcagccatattcagtgccctgggagccacaattagtgtcatcattgatgtggacatgcatatttccgtcatcatttcagccttaatcgccactctctacaccttagtgggagggctctactccgtggcttatactgatgtggtgcaacttttctgcatctttgtcggcctgtggatttccgtgccctttgccttaagccacccagcggttgccgacataggtttcactgcagtgcatgccaaatatcaaaaaccttggctgggcaccgtggacagcagcgaagtttactcctggctggacagcttccttttacttatgttgggaggcatcccatggcaggcatattttcagagggtgttatcaagctcatcagcaacctatgcccaagtcctgtcctttctagctgcttttggatgccttgtgatggccatccccgctatattgattggagccatcggagccagtactgattggaaccagaccgcctatgggctccccgatcccaaaacaacagaggaggccgatatgatcttgccaatcgtactccagtacctctgtcccgtgtacatctctttttttggcctgggggccgtttccgctgctgtcatgtcctcagctgacagctctatcctgagtgcttcctctatgttcgccagaaacatctatcagcttagtttcagacagaatgcctcagataaagagattgtgtgggtcatgcgaataaccgtatttgtatttggcgccagcgccacagctatggccctcttgaccaagaccgtgtacgggctctggtacctgagttcagacctggtttacattgttatcttcccccaactgttatgtgtgcttttcgtgaaaggcaccaatacttacggggccgtggccggatatgtttcaggcctctttctgcggatcacgggcggcgaaccctatctctacttgcaacccctcattttctatccagggtattaccccgatgataatggcatctataatcaaaagttccctttcaagacactcgcgatggtgactagcttcctgaccaacatctgcatctcctatttagctaaatatctcttcgaatcgggtaccctcccaccaaagttagacgtttttgacgcagtagtggcgcggcatagcgaagaaaacatggataagactatattggttaagaacgagaatatcaaattggatgaattggcactggtgaagccaagacagagcatgaccctgtcttccaccttcaccaacaaggaggctttcctggatgttgattcatccccggagggatctgggacagaagacaacctgcaatag

SEQ ID NO: 30386 - DNA, 1980 bp, Artificial Sequence
  Description of Artificial Sequence: Synthetic coding sequence
atggcgtctaccgtgagtccaagcacaattgctgagactccagaaccaccccctcttagcgaccatatccgcaacgcggcggacatatccgtgatcgtcatctacttcctggtagtgatggctgtgggattgtgggcaatgctcaagaccaaccgggggactatcggtgggttcttcctcgcagggagagacatggcgtggtggccaatgggcgcctcattgttcgcaagtaatatcggatctaatcactatgtgggactcgccggtacaggagcggcctcaggagtagccactgtcacattcgaatggacaagttcggtcatgctcctgatcctcgggtggatttttgttcctatttatattaagtctggagtgatgaccatgccagagtacctgaagaaacgattcggtggagagagactccaagtatatctgtccattttaagtttattcatttgcgtcgtgctgctgatcagcgccgatatctttgccggagccatattcatcaaattagccctggggctggatctgtacctggccatctttatcctgctggcaatgaccgccgtgtacaccaccacgggaggactggcatccgtaatatacactgacacgctgcagacaataatcatgcttatcggctccttcatacttatgggatttgcctttaacgaggtaggcggttatgaatctttcacagagaagtacgttaacgctacccccagtgtggttgagggagataacctgaccatttccgcctcctgctacactcccagggccgattcttttcacatctttcgtgacgcagtgacgggcgatatcccctggccgggtatcattttcgggatgccaattaccgccctgtggtactggtgcacaaatcaagttatagtgcaaagatgcctgtgtggtaaggacatgtcccacgtaaaagccgcttgtatcatgtgcgcatatcttaaactgctgccaatgtttctaatggtgatgccggggatgatctcccggatcctctacacagacatggtcgcctgcgtcgtgccctctgaatgcgtgaagcactgtggtgtggatgttggatgcactaattacgcatatccaactatggtgctcgaattgatgccacagggcctccgcgggcttatgctgtcagtcatgcttgccagccttatgtcttcattgacctctatattcaactctgctagtacactatttacaattgatctttacaccaagatgcggaagcaggcttctgaaaaagaactgttgatcgcgggtagaatatttgttttgttgctgacagtcgtgtcgatcgtgtgggtgcctctggtgcaggtatcccagaacgggcagctgatacattacaccgagtctatcagtagctatctggggcctcctattgccgctgtttttgtgctggcaatattctgtaaacgagtgaacgagcagggggcgttctggggcctgatggtcgggctcgccatggggctcatacggatgattactgagttcgcatatgggactggatcctgcttagccccatctaactgtccaaagataatttgtggagtacactacctttactttagtatcgtcctcttctttgggagtatgttagtgactctcgggatttctcttcttaccaagccgattccggatgtgcatctatacaggctgtgctgggttctgaggaactccacggaggaacgcattgatatcgacgcggaagaaaagtcacaggaagaaacagacgacggggtggaagaggattacccggaaaagtcacgcggctgcctaaaaaaagcatacgatctgttttgcggcctccagaaggggcctaagctcactaaggaggaggaggaggctcttagcaagaagctgaccgatacctctgagagaccctcatggcggaccattgtaaacataaatgcgattctgttgttggccgttgtggtgtttatacatggatactatgcctag

SEQ ID NO: 30387 - DNA, 1836 bp, Artificial Sequence
  Description of Artificial Sequence: Synthetic coding sequence
atggtctggtggcccgtcggcgcgtcccttttcgcctccaatgtggggtccggccacttcattgggctggctgggagtggagccgctaccggaatcagcgtctccgcctatgaattgaatgggctgtttagcgtgcttatgctcgcctggatcttcctgccaatttacatcgccgggcaagtgacaactatgcctgagtatctgaggaagcgcttcggcggcatccggatacccattatcctggccgtcctgtacctctttatttatatttttacaaaaatcagtgtcgatatgtatgcaggcgccatctttatccaacagtcactgcacctcgatctgtacctggccatcgtgggactgttagcaattacggcggtttacaccgtggccggaggccttgcggcagtgatctatacagatgccctacagactttaatcatgttgatcggcgctctcacactgatgggctacagttttgcagctgttggtgggatggaggggctgaaagagaagtacttcctcgcattagcttcaaataggagtgagaactccagttgtggtcttcctagagaagatgcatttcacatattcagagaccctctcactagcgatctcccatggcccggtgtactgtttggcatgagcatccctagcctttggtactggtgcaccgaccaggtcatagtgcaaaggacactcgccgccaagaacttgagccacgctaaagggggtgcccttatggcagcctatctgaaggtgctacctctgtttatcatggtctttccgggaatggtgtctcggattctcttccccgaccaagtggcgtgcgcagatccagagatttgccagaaaatttgcagcaacccgtccggctgctccgatatcgcctacccaaaactcgtgctggaactgctgcccactggcctgcgtggcctgatgatggccgttatggtggcagccttgatgagctctctcaccagtatttttaatagtgcttccaccattttcaccatggacctgtggaaccatttacgtcctagagccagcgaaaaggagctgatgattgtgggaagagtgtttgttcttctgctggtgctggtatcaatcctgtggataccggtggtccaggcaagtcaaggtggacagctgttcatctacatccaaagcataagcagctacctgcaacctccagtggcggtagtgttcattatgggttgcttctggaaaagaacaaatgagaagggcgcgttttggggtctgattagcggtctccttctggggctagtccggctggtcctagactttatctacgtgcagccccgatgcgatcaaccggatgaacgtcctgtgctcgtcaaaagcatccactacctatatttctccatgatcctctcaaccgtgacactgatcaccgtatcgacggttagttggtttacggaaccgccttccaaggaaatggtctcacacctgacctggtttaccagacacgatccagttgttcagaaggagcaggcaccacccgcggcacctctgtccctgactctgtcccaaaatggtatgcctgaggcctcatctagcagcagcgtccagttcgagatggtgcaggaaaataccagtaagactcactcttgtgacatgactccaaagcagtccaaagtggtcaaagctattctttggctgtgcggaatccaagagaaaggcaaagaggaactgcccgcaagggcggaggccataatcgttagccttgaagaaaacccactggtcaaaactttattggatgtgaacctgatcttctgtgtttcctgtgctatcttcatttgggggtactttgcttag

SEQ ID NO: 30388 - DNA, 1701 bp, Artificial Sequence
  Description of Artificial Sequence: Synthetic coding sequence
atgacatggtggccaataggtgcctcactctttgccagctccgagggatccggactcttcatcgggcttgccggtagcggagccgccggcggtctcgcagtggcgggttttgaatggaacgccacttatgtgcttttggcgctggcatgggtctttgttccaatctatataagttcagagatcgtaactctgccagagtacatccagaagcggtatggtggccagcggattcgcatgtatttatccgtgctgtctctgttgctttccgtgtttacaaagatcagcctcgatctctacgctggagcattattcgtgcatatctgcctagggtggaatttctatctcagcacgatcctaactttggggataaccgcattgtacaccatcgctgctttcgatcagatcgggggctacggacagctcgaggcagcctatgcacaggcaattccgagtcggacaatcgcaaacacgacatgccatctgccaaggactgatgctatgcatatgttccgcgacccacataccggagacctgccttggaccggaatgacattcgggttgacgattatggctacctggtattggtgcaccgaccaggtgattgtgcagcggtcactctcagctcgggacctgaatcacgccaaggctggcagtatcttggcctcctatcttaagatgctgcctatgggcctgattattatgccaggcatgatcagccgagctctgtttcctggcgcgcatgtgtacgaagagcggcaccaagttagtgtgtcccggacagatgatgtcggatgtgtggttccaagtgaatgtctcagagcatgtggagcagaggttggatgtagtaacatcgcctatcctaagctggtgatggaactgatgcccatcgggttgcgtggacttatgatcgctgtcatgctagctgcacttatgagcagcctgacatcaatattcaacagtagtagcacgctcttcaccatggacatatggaggcggctgcgtccccgctccggtgaacgagaattgcttctggtgggtcggaccgggattccatcgacaccccccgctccgcagagcaggctcagcttcctgctccctgagacacctccactggaaagatatttgctggggctggtagtaatggacctgtggttagtcattgttgcattgattggagtgtcagtcgcctggattccagtgctgcaggattcaaattcagggcaactattcatttacatgcagtcagtcacttcttctctggctccccccgtcacagccgtgttcgtcctgggcgtcttctggaggcgagctaacgaacagggtgcattttgggggttgattgctggcctagtggtgggtgcgaccaggctggttctcgaattcctaaatccggcgccgccttgcggggaacccgatacgcgcccagccgtgcttggtagcatacactatctgcacttcgccgtggctctcttcgcgctgagcggagctgttgtcgttgctggaagtctacttaccccacctccccaatcagttcagatagagaacctgacttggtggacgcttgctcaggatgttccactcggaactaaggcaggagacggccagacaccgcaaaaacatgctttctgggcaagagtttgcggtttcaacgccattttgctgatgtgcgttaatatcttcttctatgcttatttcgcatag

SEQ ID NO: 30389 - DNA, 1701 bp, Artificial Sequence
  Description of Artificial Sequence: Synthetic coding sequence
atgacctggtggcctatcggggcttctctctttgctagctctgagggttctggactgtttatcggccttgccggctccggcgccgcaggcgggcttgccgtggccgggtttgagtggaacgccacttatgttctgctggcactcgcctgggtatttgtccccatttacatttcttcagaaatcgttacgcttccggaatacatacaaaaaagatatggcggacagagaattaggatgtacctgtcggtgctcagtctcctgctctcagtgtttactaagatcagcctggacctgtacgcgggggccctgttcgtgcatatctgtcttggctggaatttctatcttagcacaatcctcacactggggatcactgccctgtatacaatagcagcctttgaccaaatcggcggctatggacaactggaagcagcctatgcccaggctatcccctctaggacaatcgccaacacaacttgccatctcccccgtaccgacgccatgcacatgttccgagatccccacaccggggatctgccttggactggcatgacatttgggctcaccataatggcaacatggtattggtgtactgaccaggttattgttcagaggtccctctcagctcgggacctgaatcatgccaaagcaggctcaatcctggcctcctacttaaagatgcttccgatgggtcttattattatgccagggatgatttctcgggctctgttcccaggggcgcacgtgtatgaggagaggcaccaagtgtccgtgagtcgcactgacgatgtcgggtgtgtggtaccctctgaatgcctgcgggcctgcggcgccgaggtcggctgctctaacatcgcttatcccaagctcgtcatggagcttatgcctataggactgcggggtctcatgatcgcagtgatgctggccgctttaatgagtagcctcactagcatctttaacagctcaagcacactctttaccatggatatctggaggaggctccggccgaggagcggggagcgagaattattattagtggggagaactggcatcccttcaacaccccctgcgcctcagtccaggctcagcttcctccttccagagaccccccccctcgaaaggtatctgttgggactcgtggtgatggacctgtggctggtcattgtggctctgataggtgtgtcagtcgcttggattcctgtgctgcaggattcaaattccggtcagcttttcatttatatgcagtctgtaactagctcgctggcaccccctgtgactgccgtgttcgtcctgggggtgttttggaggcgcgccaatgaacagggagccttttggggtttgattgcgggcttagtggtcggcgccacgagactcgtacttgaatttctcaatcccgcccccccgtgcggggagccagatacccggccagccgttctcggcagtatacactatctgcattttgccgtggctctcttcgctttgagtggcgctgtggttgtagctggctctctgctgacccctccgccacagagcgttcaaatcgagaacctgacatggtggaccctggcccaagacgtcccgctgggaactaaagccggcgatggacagactcctcaaaagcacgcgttctgggccagggtctgtgggttcaacgctatacttctgatgtgcgtgaatatttttttctatgcatatttcgcttag

SEQ ID NO: 30390 - DNA, 1710 bp, Artificial Sequence
  Description of Artificial Sequence: Synthetic coding sequence
atggctgccaacagtacgtctgatctccatacgccaggaacacaattgagtgttgcagatattatcgttatcacggtctacttcgctctcaatgtggccgtcggtatctggtcgagctgcagggcctctcgaaacaccgtgaatggatattttctcgccgggcgagatatgacttggtggcccattggcgcctccctgtttgccagttctgagggatccgggctatttatagggttggctggcagcggtgccgccgggggtctggccgtggccggcttcgagtggaacgccacctatgtcttacttgccctggcttgggtttttgttcccatttatatttcctcggaaattgtgacgctccctgagtatatacagaagcggtacggcggacagcgcattaggatgtatctgtcagtcctgtcccttcttcttagcgttttcacaaaaatttccctggacctgtacgccggcgctctgttcgtccacatctgcctcggatggaacttttatctctcaaccatcttaacactgggcataaccgctctgtatacaatagcagccttcgaccagattggcgggtacggccaactggaagcagcttacgctcaggcaattccaagccgaacgattgcaaacaccacttgccatctgccacggacagacgcaatgcacatgttcagggatccccatacaggtgatctaccatggacagggatgactttcggcctcacaattatggccacctggtactggtgcacggaccaggtcattgtacaaaggagcctgagcgcccgggatttgaatcacgccaaggccggcagcattctagcttcttaccttaagatgctcccaatgggcctgatcatcatgccagggatgatttccagagccctgttcccagatgatgtcggctgcgtggtgccctctgagtgcttacgcgcctgcggcgccgaggtggggtgttcaaatatcgcataccccaaattggtgatggagctcatgcctattggactacggggcttgatgattgctgttatgctggcggctttaatgtctagtctgacatcgatattcaattcatcctccacgctgttcaccatggacatatggcgacgcttgcggccccgttccggcgaaagggagctactgcttgtgggccggctggtgatcgttgctttgatcggcgtcagcgtggcctggatcccggtgttacaggactccaacagcgggcagcttttcatttacatgcagtctgttacaagttcgttagcgcctcctgtcactgctgtcttcgtcctcggcgtcttttggcgcagggctaatgagcaaggcgccttttggggactcatagccgggctggtcgttggcgctacccgactcgtcttggagttcctgaatcctgccccgccatgtggtgagccagatacccggccggctgtcctggggtctatacactatttgcactttgccgtagcacttttcgccctgagtggagcagttgtggtggcagggtctctcttaactcctcccccacagtctgtgcaaatcgagaatctgacatggtggacactcgctcaggatgtgcctctgggtacaaaggccggcgacggccagacccctcagaagcatgcgttctgggcaagagtgtgtggattcaatgcgattctgttaatgtgcgtgaatatctttttttatgcttactttgcctag

SEQ ID NO: 30391 - DNA, 1791 bp, Artificial Sequence
  Description of Artificial Sequence: Synthetic coding sequence
atggccgccaactccacctccgatctacacaccccaggcactcaactgagcgtcgctgacatcattgtcattacagtgtatttcgctctgaacgtcgcagtcggaatatggagtagctgccgggcctcccgcaacaccgtaaacggctattttctggcaggccgcgacatgacatggtggcctattggggcctccctgttcgcctcatccgaaggatccggtctctttattggcctagcgggcagtggcgcagccggggggttggcagtcgccggattcgaatggaatgctacctatgtcctcctcgcgcttgcctgggtctttgttcctatatatatttctagtgagattgtgactctcccagaatacatccagaagcgctacggcggtcagaggatacgtatgtacttaagcgtcttgtctctcttgttaagcgtgttcacaaagatcagccttgatctgtatgccggggcgctgtttgtgcatatttgcctcggctggaatttctaccttagtaccatccttaccttgggaattacagcgctttacaccattgccggaggactcgccgcggtgatctacacagatgctctgcagacactcattatggtggtcggcgcagtgattttaaccattaaagcgtttgaccagatcggcggttatgggcagctggaagctgcttacgctcaggccattccatcacgaacaatagccaataccacatgccatcttcctcggacagacgccatgcatatgtttcgggacccccacactggggatctgccctggacgggtatgacatttgggttaactataatggcaacttggtattggtgcaccgaccaggtcatagtgcagcggtcactaagcgcccgggacttgaaccacgccaaagccgggtccatcctcgcatcctaccttaagatgctgcccatgggtctcatcatcatgcctggtatgattagccgcgccttgtttcccgacgacgtcggatgtgtcgtccccagcgagtgtctccgggcctgtggagcagaagtgggttgctcaaatatcgcctaccctaaactcgtgatggagttgatgcccatcggactgaggggtttgatgattgctgtgatgttggccgcattaatgagcagtctgactagtatattcaactccagctcaacattatttacaatggatatttggcgccgactgaggccccgaagcggagagagagagctgctgctggtcgggaggttggtgattgtggctctcatcggtgtgagtgttgcttggatccctgtgctgcaagactcgaactccggacagctcttcatctacatgcaaagcgtcacctccagcttagcacccccggttacagccgtttttgtcctcggagtgttttggcgcagagccaatgagcaaggtgcgttctggggcctgatcgccgggctggtggttggagcaactaggctagtcctggaattcctgaatccagctcccccatgcggtgagcctgacactcgtcccgctgtcttgggcagcatccattacttacattttgccgtggctctttttgcgctgtccggggccgttgtcgtcgctgggtctctcctcaccccccccccccagtcagtgcagattgagaaccttacatggtggactctggctcaggacgtacctctgggtaccaaagccggtgacggtcaaacacctcagaagcatgcattctgggcaagagtctgtggatttaacgcaattttgttaatgtgtgtgaatatctttttttatgcctatttcgcgtag

SEQ ID NO: 30392 - DNA, 1839 bp, Artificial Sequence
  Description of Artificial Sequence: Synthetic coding sequence
atggctgccaactcgacgagtgatcttcacaccccgggcactcagctgagcgtggcagatataatcgtcatcacagtgtactttgccctgaatgttgcagtgggcatttggagttcttgtagagccagtaggaatactgtgaacgggtacttccttgccggccgtgatatgacctggtggcctattggcgcatccctgtttgcttcatctgaaggcagcgggttgttcataggactggccggcagtggcgctgcgggcggcctggctgtagccggcttcgagtggaacgccacctatgtcctactcgccctggcctgggtatttgtccctatatacatctcttctgaaattgtaaccctgccagagtatattcagaagcggtatggcggccaacgcatccggatgtatctcagcgtgctgtctctcctcctatcagtgtttactaaaatcagcctggatctatacgcgggggcattatttgtgcacatttgtctaggctggaatttttatctgtctacaattcttacattaggcatcactgcgctgtataccatcgccggaggactggcggctgtcatctacaccgacgcccttcagactctgattatggtggtgggcgcagtgatcctgaccattaaggctttcgatcagatagggggttacggccagctggaggcagcctacgctcaagccataccaagccgaacaatcgctaacacaacgtgccacctcccacgaacagacgcaatgcacatgttccgggacccccacaccggcgacctgccttggacggggatgacatttgggcttactatcatggccacctggtattggtgcaccgatcaagtgattgtccaaagatcactgtccgcccgtgacctgaaccacgctaaggcaggcagtattcttgcaagttacctgaagatgctcccgatggggttgattataatgccaggaatgattagtcgagctttgtttcctggcgcccacgtatacgaggagaggcatcaagtttccgtttcacggacagacgatgtgggctgtgttgtgccaagcgaatgcctgcgtgcatgcggcgccgaagtggggtgcagcaatatagcttatcctaaattagtgatggagttaatgccaattggtctccggggcctgatgatcgcggttatgcttgcagcgctcatgtcctcgctcacctccatcttcaatagctctagtaccctgttcacaatggacatctggcgtcgcctacggccccggtctggcgagagagagctcctgctggtggggcgactcgtgattgtagctctgatcggagtgtcggtcgcctggatacccgtcctacaggactcaaactctggccagctgttcatctatatgcagagtgtgacatccagtctggccccccccgtcaccgcagtgttcgtgctcggggtcttctggcggagagccaatgagcagggagcattctggggcctgatcgctggtttggtggtgggcgccacaaggctcgtgttggagttcttaaatccagcgcccccgtgtggagagcctgacacccggccggccgtccttgggagtatccattacttacacttcgctgtggcattattcgcgcttagtggcgccgttgttgtcgcaggatcactgctcacaccgccacctcagagcgtacaaatcgaaaacctgacgtggtggacactcgctcaggacgtcccactcggaaccaaggctggagatgggcaaacaccccaaaagcacgccttttgggcccgtgtgtgtggcttcaacgccattctgctcatgtgtgttaatatctttttctatgcttattttgcctag

SEQ ID NO: 30393 - DNA, 1683 bp, Artificial Sequence
  Description of Artificial Sequence: Synthetic coding sequence
atggccgccaattctacctctgacctgcacacacctggaacacaactatccgtggcagatatcatcgtaatcacagtctatttcgctctgaacgtagctgtcggcatctggtccagctgcagagctagccgaaatacagtcaacgggtactttctggcagggagggacatgacctggtggccaatcggggcatccctgtttgccagctccgaggggtcagggctcttcatcggcctggccgggtccggcgccgctggcggacttgctgtagctgggtttgaatggaacgctacctatgttcttctcgccctggcctgggtgtttgtccctatctacatatcctcggagattgtcactctgcccgaatacatccagaagcgatacgggggccagcgaattcgcatgtatctctctgttctgagtttgctgctttctgtgtttactaagatctcccttgacctttacgcgggagcattgtttgtgcatatctgcttggggtggaatttctacttgagcacaatattgaccctggggatcaccgcactttacacaattgccggcggcttggccgccgtgatctacaccgacgcattgcagacgctaattatggtggtgggcgccgtgatcttgactattaaagctttcgaccagattggcggctatggacagttggaggccgcttacgcccaggcaatcccaagccggacaatagccaatacgacttgccacctgcctagaaccgatgccatgcatatgttccgggatcctcatacaggtgacctgccctggaccgggatgactttcggacttaccatcatggcaacctggtattggtgtactgaccaggtcatcgtccagaggtctttaagtgccagggacctgaaccatgcaaaggccgggtcgatcttagcgtcctacctgaaaatgctgcccatgggcttgattatcatgcctgggatgatttccagggctctgttcccagggctgcgtggactgatgatcgctgtaatgctcgcggctctgatgagctcactgacaagcattttcaatagtagtagtaccctgttcacaatggatatctggaggagactcagaccacgctccggagaacgggagctgctcctggtgggcaggctggtgattgtggcactgattggtgtctccgtggcttggattcccgtgcttcaggacagcaattctggacaactctttatctacatgcaatcagtgacctcctcgctggctcctcccgtcacagcagtgttcgttctgggcgtgttctggcgcagagctaatgagcagggagcgttctggggcctgattgcaggattggtggtgggagccacaaggctcgtgctggaatttctgaaccccgcacccccttgcggggagccagataccaggcctgcagtgcttggttccatccattacctgcactttgctgtcgcgctgttcgctctgagcggtgctgtcgtcgtggccggctcactcctcacacccccaccccagtcagtgcagatcgagaacctgacctggtggactctggcgcaggatgtgccgctgggaacgaaggctggcgatggtcaaaccccacaaaagcatgctttctgggcaagagtgtgcggatttaatgcaatccttttgatgtgcgtgaacatattcttttatgcgtactttgcctag

SEQ ID NO: 30394 - DNA, 2028 bp, Artificial Sequence
  Description of Artificial Sequence: Synthetic coding sequence
atggagtccggaacttcatctcctcagcccccacagcttgatccactggatgcgttccctcagaagggcctcgagcccggcgatattgcggtactggtgttgtacttcctgttcgtattagccgtagggctgtggtccaccgtcaagacaaagcgagataccgtgaaaggctacttcttagcaggaggcgatatggtgtggtggcctgtcggagccagcttgtttgcctctaacgtgggtagtggccattttattggcctagcgggatccggggctgcaacaggtatttcagtcagcgcctatgagctgaacggcctgttttccgtgctcatgctggcatggattttcttgccgatctacatagcagggcaagtgacaacaatgccagaatacctccggaagaggtttggtggaattcgcattccgataattctggccgtgctctatctgttcatttacatcttcaccaaaatctccgtagatatgtatgccggagctattttcatccagcagagtctccatttggatttatacctcgccatcgtgggcctcttagcaattacagcggtatacaccgtggccggcggcttggctgcggtgatttacaccgacgccctgcagaccctcatcatgttgattggggccctgaccttgatgggctactcctttgcggcagtaggcgggatggaaggcctgaaggaaaagtactttttagctctcgctagtaatcgctcggaaaacagctcttgcggcttgccgagagaggacgcttttcatattttccgagatcctctgacctctgatctgccatggccaggagtgttattcggaatgtccatcccctctctctggtactggtgcactgaccaggttatcgtgcagcgaacactggctgccaagaatctttcacatgcaaagggcggcgctctgatggccgcctacctgaaagtattgccactgtttatcatggtgttccctggtatggtatcccgcatcctgtttcctgaccaggtcgcctgtgccgacccggagatttgtcagaaaatatgctccaacccatccggctgttccgacattgcctaccctaagttggtgctggagctgctgcccaccggactcaggggcctaatgatggcggtgatggtggcagccctaatgagtagtctgacttccattttcaactccgccagtactatttttactatggatctgtggaatcacctcagacctcgtgcatccgagaaggagctgatgatcgtcggacgggtttttgttctgttgctcgtattggttagcattctttggatccccgttgtgcaagctagtcaaggtggccagctattcatatacattcagtccatttcaagttacctccagcctcctgtagcggtggtgttcattatgggatgcttttggaagagaactaacgaaaaaggtgccttttgggggttaatatctgggctgctcctgggcctggtgagactagttcttgatttcatatatgttcagcccagatgtgatcaaccagatgaacgccccgttctggtcaagagcatccactatctgtactttagtatgattctttcaaccgtgaccctgatcacagtgtcaacagtgtcctggtttaccgaacctccctcaaaggagatggtgtcccacttgacctggttcacccggcatgatccggttgtccagaaggagcaggctcccccagcagccccgctgtctttgacattatctcagaatggtatgccagaagcatcctcttcaagttctgtccagttcgagatggtgcaggaaaacacaagcaaaacgcactcctgtgacatgacacctaagcaatccaaagttgtaaaggcgattttatggctttgcgggatccaagagaagggcaaggaagagctccctgcccgtgccgaggctatcatcgtgtctctggaggaaaatccactcgtgaagacactgctggatgttaatctgattttttgcgtctcatgcgctatatttatctggggttattttgcatag

SEQ ID NO: 30395 - DNA, 1923 bp, Artificial Sequence
  Description of Artificial Sequence: Synthetic coding sequence
atggagtctggaacaagcagcccgcaacctccacaactggatcctctcgacgcctttcctcaaaaagggcttgaacccggtgacatagctgttcttgtgctgtacttcctgttcgtcttggcggtgggcctgtggtccacagttaagacaaaacgcgatacagtgaaaggctatttcctggctggaggtgacatggtatggtggccggtgggggccagtttattcgcaagcaacgtggggtcggggcatttcattggccttgccgggagtggcgctgcaactggtataagtgtgtcggcttacgaactgaacggactcttcagtgtcctgatgctggcttggatctttctgcctatctacatcgccgggcaggtagacatgtatgccggggcaatcttcattcagcagagcctccatctggacttatacctagccattgtaggtttgctcgcaattacggcagtttatactgtcgctggcggtcttgcagcggttatctataccgacgcactgcagacactcataatgctcattggggccttaactctgatgggctattcttttgctgccgtcgggggaatggaggggctcaaagagaaatactttttggccttagccagcaataggtcagaaaactctagctgcggcctgccgagagaagatgcctttcacatattcagagatccccttacaagcgacttgccgtggcccggtgtgctgtttgggatgtccataccttccctctggtattggtgcacagaccaggtcatagtccaacgtaccctcgccgcaaaaaatctttctcacgctaaaggcggcgccctcatggcagcgtatttaaaagtgctgccactgtttatcatggtcttcccgggtatggtcagcagaatcttattcccagatcaggtcgcctgcgcagaccctgagatctgccagaaaatttgctcaaaccccagcgggtgtagcgacattgcctatcccaagttagtccttgagcttctgcctaccgggctccggggccttatgatggctgtcatggtcgcagccctgatgtcatcactgactagtatcttcaatagcgcgtcaactatcttcactatggatctttggaatcatctgcgcccacgggccagtgaaaaggagcttatgatcgtggggagagtttttgtgctgctcttggtgttggtgagtatcttgtggatcccagtcgtgcaggcaagtcaaggcggccaactgttcatctatatccagtcgatcagcagctatctacaaccacccgtggctgtagttttcatcatggggtgcttctggaagcgtaccaacgagaagggggcattttgggggctaatctccggcctgctcctgggactcgtcaggctcgtgttggacttcatctacgtccagcctagatgcgaccaacccgacgagcgcccagtcctagtgaaaagtattcattatctctactttagcatgattctgagtactgtgaccctcataacagtctccacagtgtcctggtttacagaacctcctagtaaagagatggtgtcgcatctgacatggtttacccgacacgaccccgtagtccagaaggagcaagctcccccagccgctcccctcagccttaccctgagccaaaacgggatgccggaagcatccagtagcagctcagtccagtttgagatggttcaggaaaacacatccaaaacccactcctgtgacatgactcctaaacaatctaaggtggtcaaagctatcctgtggctgtgcggtatccaggagaaagggaaggaggagctgccagctcgagcagaagcaataattgtctccctggaggagaatcccctcgtgaagacgctgctggatgtgaacctcattttctgcgtttcttgtgcgatttttatttgggggtattttgcgtag

SEQ ID NO: 30396 - DNA, 1560 bp, Artificial Sequence
  Description of Artificial Sequence: Synthetic coding sequence
atggtctggtggcctgtcggtgcctccctgttcgcatctaatgtggggtccggacatttcatcggattagccggatctggggccgcaacaggcatatcggtttcagcttatgagttgaacggcctattctctgtcctcatgctcgcctggatattcttgcccatttatattgcaggccaggtcacaacgatgccagaatacctgcgcaaacgcttcggcggaatccgcataccaattattctggctgtgctgtacttgttcatatatatttttacaaagatcagcgtggatatgtatgctggcgccatttttatacagcagagcttgcaccttgatctatacctagcgatagtggggctcctggccattacagccgtttacacagttgccggaggcttggccgcggtgatctacactgatgccttgcagaccctcataatgctcattggggccttgactctgatgggatattcggattgccccgccgactcaggctgccaggaaccagtgccatgccagcggcggtgctctgatggctgtattcccgagggtgccgcaccactgcacaacggggtgccctgggatggtcaaccccatcctctgccgagaagcagcggactttgcaggagtcgtgacctccctgaggacttacagcagcccctgcggcttttcggacacagggtctcccagacccgcgctggaaccccagctcatagtgcctccaccatcttcacaatggatttatggaaccatttaaggccccgcgccagcgagaaggaactgatgattgtaggccgggtatttgtactcttgctagtcctcgtcagtattctgtggattccggttgtgcaggcctcgcaggggggacagttatttatatatatacaaagtataagttcgtatctgcaaccccccgtagcagttgtgtttatcatggggtgcttttggaaacggacaaacgaaaagggcgctttctggggattgatcagtggcctgctgcttgggctcgtaaggttggtcttagactttatttatgtccagcctcgatgcgaccagcccgacgaaagacccgtcttggtgaaatcaattcactacctttatttctctatgattctgagtaccgtgacactgatcaccgtgagtacagtgtcctggttcactgagcccccaagcaaggagatggtaagccatctcacctggttcacccgtcacgaccccgtcgtccagaaagagcaggcaccaccagccgcccccttaagccttacgctgtcccagaacggaatgcctgaagccagtagctccagtagcgtacagttcgaaatggttcaggaaaacacaagcaagacgcacagctgcgacatgacacctaaacagtctaaggtcgtgaaggctatcctgtggctgtgtggaattcaggagaaggggaaagaagaactgccagcccgggctgaggctatcatagttagcttggaggagaacccgctggtcaagacactactcgacgtgaacctgatcttctgcgtgtcttgtgcaattttcatctggggatattttgcctag

SEQ ID NO: 30397 - DNA, 1836 bp, Artificial Sequence
  Description of Artificial Sequence: Synthetic coding sequence
atggtttggtggccggtcggggcatccttgtttgcatctaacgtgggtagtggccactttattggcctagccgggtccggagcggccaccggcattagcgtgtccgcctacgaacttaacgggctctttagtgtgctcatgcttgcatggatttttctgcctatctatatcgccggacaggttaccactatgccggagtaccttagaaagcggttcggtggaatccgtattccaattatcctcgctgtgctgtacctgttcatttatatattcaccaagattagcgtagacatgtacgccggggctatctttattcagcagagcctccatttggatttgtacctggctatagtgggcctgctagcaatcacagcagtttataccgtcgcaggcggactagcggctgttatatatacggatgcactccagaccctcataatgctgattggggctctgaccctaatgggctattccttcgctgccgtggggggcatggaaggtttaaaggaaaaatactttctcgcactcgcctccaacaggagcgagaatagtagctgcggcctcccgcgggaagatgccttccatattttcagagaccccctcacatctgatctaccgtggcctggtgtcctcttcggaatgagtatcccctccctgtggtactggtgtacggatcaggtgatcgtgcagagaactctggccgctaagaacctgtctcacgctaagggaggggcactaatggcagcttatcttaaagtgctccctctttttattatggtctttccggggatggtgtcacgcattctgttcccagatcaggtcgcttgcgccgatcctgagatttgccagaagatttgtagtaatccttccggctgttctgacattgcatatcctaagctcgtcttagagttacttcccacgggacttcgaggactcatgatggcggtgatggtggcagcgctgatgtcaagcctgacatcaattttcaattcagcttcaacgatttttacgatggatctctggaatcacctgagacctagagcttctgagaaggaactaatgattgtgggcagggtttttgtgcttctgctcgtattggtgagtatcctgtggatccccgttgtccaggcatcccagggcggtcaactgttcatttatatacaatccatcagcagctacctgcagccccccgttgccgtcgtgtttataatgggatgcttctggaagcgcaccaacgagaaaggggcgttttggggcctgattagcgggcttctattgggcttggtgcggctggtgctagacttcatctacgttcaaccacgctgcgatcaacctgacgaacggcccgtattggtaaaatctatacactacctgtactttagcatgatcttatcaaccgtgacactgatcactgtgtcaaccgtctcctggtttactgaaccaccgtctaaagaaatggtgagccatttaacatggtttacgaggcacgatccagtagtgcagaaagaacaggccccaccagctgcccccttgtcgcttaccttgtcgcagaatggaatgcctgaagcttcaagttcatcgtccgtacagtttgagatggtgcaggagaacaccagcaagacccacagttgtgacatgacccctaaacagtccaaggtcgtcaaggccatcctgtggctttgcggcatccaggagaaggggaaagaggaattgccagcacgggccgaagcaatcattgtttcccttgaagagaaccctctcgtaaaaacactgctggatgtgaaccttattttctgcgtctcctgcgccatctttatctgggggtactttgcttag

SEQ ID NO: 30398 - DNA, 1818 bp, Artificial Sequence
  Description of Artificial Sequence: Synthetic coding sequence
atggaatccggaacttcgtctccacagcctccacagttagaccccttggacgcttttccacaaaagggattggagcctggcgacatagcagttttagtcctgtattttctgttcgttctggccgtgggtctctggagtaccgtgaagacaaaacgggatacagttaaggggtatttcttggccggcggtgacatggtttggtggccagggctgttcagcgtgctgatgctagcttggatctttcttccgatctatattgcagggcaagttgatatgtatgccggagccatctttatccagcagtctctgcacctggatctttatcttgccatagtagggctgcttgctatcaccgccgtgtacacagtggctggtggcctggccgctgtaatatatacagacgcactgcagaccttgattatgttgataggagccctcacccttatgggttactccttcgcggctgtgggaggcatggagggtctgaaggagaaatacttcctagctctcgcatcaaatcggagcgaaaactcgtcttgtggacttccaagggaggacgccttccatatattccgcgatcctttaacttccgacttaccttggcccggtgtcctgtttggcatgagcattccctccctgtggtactggtgtacagatcaggtcattgtacagcgaactctggcagccaagaacctgagtcatgccaaggggggtgcactgatggccgcctatttaaaggtgttgcctctctttattatggtctttcctggaatggtctcaaggattctgttcccagaccaggtggcttgtgctgaccccgagatttgccagaagatttgctccaacccatcaggctgcagcgacatcgcctaccccaaattggtgttggagttgctgccaactggcctccgaggccttatgatggcagtaatggtcgcagcactcatgagcagtctgacaagtattttcaactcagcctctactatttttacaatggatctatggaatcatcttaggccaagagcctcagagaaagaactcatgatcgtggggcgcgtctttgtcctgctcctggtcttggtctccattctgtggattcctgtggtgcaagcttcacagggcggccagctgttcatttacattcaatcgatatcgtcataccttcagccccctgtagcagttgtgttcattatgggatgcttttggaagcgaactaacgaaaagggtgccttttgggggttgataagcgggctccttctgggcctggtcaggctggtgctggactttatttacgtacagccgcgctgcgaccagccagatgagagacctgtacttgtgaaatctatccattacttatatttctccatgatcctcagtacagttacgctgattaccgtgagcaccgtctcctggtttacggaacccccatcaaaggaaatggtgagccacctcacttggtttacaaggcatgatccagttgttcaaaaggagcaggctccacctgccgccccactgagcttgaccctgagccagaatgggatgcccgaagcttcttctagttctagcgtgcagtttgagatggtacaggaaaacacctcgaagacccacagctgtgacatgacgcctaaacagtccaaagtcgtgaaagcaatcctgtggctgtgcggcatccaagaaaagggaaaagaagaattgccggctagagccgaggctattatcgtgtcgctagaagagaatccccttgtgaagaccctgctggacgttaacctgatcttttgtgtgtcctgtgcaattttcatatgggggtactttgcctag

SEQ ID NO: 30399 - DNA, 2121 bp, Artificial Sequence
  Description of Artificial Sequence: Synthetic coding sequence
atgtctaaagaactggcagccatgggtcccggagctagcggggacggcgtccgaaccgagaccgctccccatatagcgttggacagccgagtcgggctgcacgcgtatgacatttcggtggttgtgatctattttgtgtttgtcatcgcagtgggcatatggtccagtatcagagcctcgcgcggtactattgggggctatttcctcgccggtaggtcgatgagctggtggccaataggtgcttccctcatgagtagcaacgtggggagcggtctgttcatcggtctggcgggcaccggggccgccggaggcctggcagttggcggctttgagtggaatatgaggaaaagtcgctctgggggggatagaggcattcacccaaggagtcacggcagaactggggttcgcagccaggcaacatggcttctgctggctttaggatgggtctttgtgcctgtctacattgctgctggagtcgtcacgatgccacagtatctgaagaaacggtttgggggacaaaggatccaggtgtatatgtcagtcttgtctctgattctttacatcttcaccaagatttcgactgacatcttctctggtgcactgttcattcagatggccttgggatggaatctgtacctgagcacaggaattcttctcgtggtcacagcagtctacactattgctggcggactaatggcagtgatttacactgatgccttacagacagtgatcatggtgggtggcgcgttggtactgatgttcctcggatttcaagacgtgggctggtatccagggttggagcagagatatcgacaggcaatccccaatgttaccgtgcccaataccacatgtcaccttccacggcctgatgctttccacattctgagagatcccgtgtctggggacattccttggcctggcctgatattcgggctgacagtactggccacctggtgttggtgtacagaccaagtcattgtccagcgatccctcagcgctaagtcactgagtcacgcaaagggtggcagcgtgctgggcggatacctaaagatactccccatgttttttatagttatgccagggatgatttcaagggctctctttcccgacgaggttggctgtgtggatcctgatgtttgtcagcgcatatgcggtgctcgcgttggctgcagcaacatagcttatccaaaactagtgatggccctcatgccagtcggcttacggggactgatgattgctgtgatcatggcagccttgatgtccagcttgacatccatctttaattccagtagtactctgttcacgattgacgtgtggcagaggtttaggcggaaatctactgagcaagaactgatggtcgtcggccgcgtgttcgtagtgttcctcgtggtcatttcaattttgtggatacctataatccagtcgtccaattccggtcagctgtttgattatattcaggctgttacttcctacttagctccgcccatcacagccctgttccttctcgcgattttctgcaagagggttacagagcctggggccttctggggcctcgtgttcgggctcggggtgggcctcttgcggatgattctggaattcagctaccccgcgcccgcttgcggagaagtcgacagacgacctgcagtgctaaaggacttccactacctctatttcgctatcctcctttgtggactgaccgccatcgtcatcgtgatcgtgtctctgtgcaccacacccattccggaggagcaactcacacggctgacatggtggacaagaaattgccccctttcagagttggagaaagaggcccacgagtctacccctgaaatctctgaacggccagccggcgagtgtcccgccggggggggagcggcggaaaattcctcgctgggacaggaacagcctgaggctccttctcgcagctgggggaaactcctctggtcgtggttctgtggcctgagtggcactccggagcaggctctttccccagcagaaaaagccgccctcgaacagaagctgacttccatcgaagaagaacctctctggcggcacgtctgcaacataaatgcagtcttactccttgctattaacatattcctgtggggttactttgcatag

SEQ ID NO: 30400 - DNA, 501 bp, Artificial Sequence
  Description of Artificial Sequence: Synthetic coding sequence
atgggccccggcgcctccggggatggagtgcgcacagaaaccgctccccatatcgccctggactctagggtggggttgcacgcctatgacatttccgtcgtagtgatatattttgtctttgtgattgcagtgggaatatggagctcaatcagggcttcccgaggaaccattggagggtacttcctggccggaagaagtatgtcctggtggcccatcggagctagcctcatgtcgtccaacgtaggctctggcctcttcatagggcttgccggaacaggcgccgccggtggacttgctgtgggcggattcgaatggaacgccacctggctccttctcgctctgggctgggtctttgtacccgtgtacattgccgcaggcgtggtgaccatgccgcaatacctgaagaaacggtttggaggccagcgcattcaggtgtatatgtctgtcctatcactgatcctgtacatctttactaagatttccggaagttgctggtggtag

SEQ ID NO: 30401 - DNA, 2046 bp, Artificial Sequence
  Description of Artificial Sequence: Synthetic coding sequence
atgagtaaagagctcgctgccatggggcccggcgctagtggagatggtgtcagaacagagacggccccccacatcgcgctggactcgcgagtggggctgcacgcttatgatatcagcgtcgtcgtgatttatttcgtgttcgtgattgctgtgggcatatggagctctatcagggcctctagaggcacgattggcggttatttcctggccggccggtctatgtcgtggtggcctatcggggcctctttaatgtccagtaacgtggggagcggtctgtttattggcctcgcagggacgggcgcagccggagggttagccgtgggaggcttcgagtggaacgctacgtggctgctgctggcactcggatgggtgttcgttccagtctacattgctgccggtgtggtgacaatgcctcagtacttaaagaagcgcttcggcgggcagcgtattcaggtgtatatgtccgtgctctctctcatcctgtatatatttacaaaaataagcaccgatattttctcaggcgccctattcatacagatggctttaggatggaacctgtatctttcaacaggaatactgctggtggtgacggctgtgtacacaatagccggcgggcttatggcagtgatctacaccgatgccctacagactgtgatcatggtgggcggggcgctggttcttatgtttctcgggttccaggatgtgggctggtaccctggcctggagcagcgttatagacaggccattcctaatgtcactgtgcccaatacaacctgtcatctgcctcgaccggacgcttttcacatcctacgcgaccccgtgagtggcgatattccatggccagggcttattttcgggctgactgtgctcgctacttggtgctggtgcacggatcaggtcatcgtccagcggagtctgagcgccaaaagcctgtcacatgctaagggcggcagcgtgttggggggctatctgaaaatcctgccaatgttcttcatagtaatgcccgggatgatttctagggccctctttccagatgaagttggatgcgtggacccagacgtgtgtcagcgcatatgcggggcaagggtgggctgctctaacatcgcatatcccaagttagtaatggccctgatgcccgtgggcctgagaggcctgatgatcgcagtaatcatggcggcactgatgtctagtcttacgagcatcttcaatagtagcagtactctgttcacaattgacgtgtggcagagatttcgccgtaaaagcacagaacaggagctcatggtagttgggcgtgtgtttgttgtgttcttagttgttatcagcattctatggatacccattattcaatcctccaactctgggcagctatttgattacatccaagccgttacatcgtacctcgcaccacccatcaccgccctgttcctgcttgccattttctgtaaaagagtgacagaacctggcgccttctggggcctggtgttcgggctgggagttggcttactgagaatgatacttgagttttcttaccccgcaccagcctgcggcgaagtagatagaaggccagccgtgttgaaagatttccattacctttacttcgccatcctcttgtgtggtttaaccgcaatcgtgatcgtcatcgtgtccctgtgcaccaccccaatccctgaggagcagttaacacgtctgacctggtggactcggaactgccctttgagcgaactggagaaagaagctcatgagagcacaccagagatcagcgaacgtccagccggggaatgccccgccggagggggagccgcagagaattcttctttgggccaggaacaacccgaggccccatcccgtagctggggcaaattgttatggtcctggttttgcggcctctccggtaccccagaacaggctctgtccccggccgagaaagccgccttggaacaaaagttgacatcgatcgaggaggagccgctgtggagacacgtgtgcaatatcaatgctgttttgctgctcgctataaacattttcctttgggggtatttcgcgtag

SEQ ID NO: 30402 - DNA, 522 bp, Artificial Sequence
  Description of Artificial Sequence: Synthetic coding sequence
taaagtaaggagctagccgccatgggccccggcgcctctggcgacggggttagaacggagacagccccccatatagccctagatagccgagtggggttgcacgcttacgatattagcgtggttgttatttattttgtgttcgtgatcgcagtgggtatatggagctcgatccgagcaagccggggcactattggcggctacttcctagccggcagatcaatgagctggtggcccatcggcgcaagcctgatgtctagcaatgtggggagcggccttttcattggtctcgctggcaccggcgcagcagggggactggccgtcggcggcttcgagtggaatgcgacatggctcctgctcgcccttggctgggtctttgtgcccgtctatattgctgccggggtcgtgaccatgcctcagtatctgaagaagcgattcggaggccagcgcatccaggtctacatgagcgtcctatcattaatcctttatattttcacgaagattagcggctcttgttggtggtag

SEQ ID NO: 30403 - DNA, 1908 bp, Artificial Sequence
  Description of Artificial Sequence: Synthetic coding sequence
atgagcgtgggggtgagtacatccgcccccctaagtcctacatccggtaccagtgtgggtatgagcactttttcaattatggattatgtagtgttcgttctgctgttagtgctgtctctggccatcggattgtatcacgcctgtcggggctgggggcggcatacggtaggtgaacttttgatggccgacaggaagatgggttgcttgccagtggctctgtcacttctggcaaccttccagtctgccgtcgctatcttaggggtgccaagcgagatctatcgatttggcacacaatactggttcttaggttgctgttactttttgggcttgctcatccctgcccatattttcattcccgtgttttatagactgcacctcacttctgcttatgagtacctcgaactccgattcaataaaaccgtgcgcgtctgtggaacagtgaccttcattttccagatggtgatctatatgggtgtggtgctctacgctcccagcttggccctgaacgccgtaacaggattcgacctctggttgtcagtgctggcactggggatcgtatgcacagtttacacagccctcggtggtctcaaggccgtgatctggactgacgtatttcagaccctggttatgtttttggggcaactggccgtgatcatcgtagggagtgccaaggttggaggccttggtcgagtgtgggctgtcgccagccagcatggccggatcagtgggtttgagctcgaccccgatccttttgtacggcatacattttggaccttagcttttggcggagtgttcatgatgctttccttgtacggtgtgaatcaggcacaggttcaacgctacttatcttcacggacagagaaggccgctgttttatcatgttacgcagtttttcccttccagcaggtcagcctatgtgtcgggtgcctaatcggtttagtgatgtttgcatactaccaggagtatccgatgtccatccagcaggctcaggcagcacctgatcagttcgtgctatatttcgttatggatttactgaaaggactgcctggcttgcctgggctgtttattgcctgtctattttctggttccttgtcaaccatttccagcgccttcaattcgcttgccacagtgacaatggaagatctcattcggccttggttccctgaatttagtgaggcacgagctattatgctgtcaagaggtctcgccttcggttacgggctgctgtgtctcggcatggcttacatatcctcacaaatgggccccgtactccaggccgccatctccatttttggaatggtgggcggcccgttactcggcctgttctgccttgggatgttcttcccctgcgccaaccctcccggtgccgtcgtaggattacttgcgggtctcgtcatggccttctggataggaatcggctcaatcgttacatcaatggggagctctatgcctcctagcccatccaacgggtcaagcttctccctaccaactaatctcaccgtggcaactgtcacgactttgatgcccctcaccacattctccaaaccaaccgggctgcagcgattttacagtctgtcctacttatggtattctgcccataattccaccaccgtgatcgtagtgggcctgatcgtttctctcctaacgggcagaatgcgaggtaggtcgctgaatcctgctacaatttatcctgtgctaccaaagttactctctctgctacctttgtcctgtcagaaaagactgcactgccgctcatatgggcaggaccacctcgacaccgggctgttcccggagaagcctcgaaatggggtgcttggggattcaagagacaaagaagccatggcgttagacggcacagcttatcaggggtcctcatctacctgcatactgcaagagacctccttgtag

SEQ ID NO: 30404 - DNA, 444 bp, Artificial Sequence
  Description of Artificial Sequence: Synthetic coding sequence
atgtctgtcggggtgtccacaagcgctccgctgtcacccacctctggaactagcgttgggatgagcacatttagcattatggactacgtggtgttcgttttgctgctggtgctgtcccttgctatcggattgtaccatgcttgccggggttgggggcggcacactgtgggagagctgctgatggccgatagaaaaatggggtgtttgccggtagctcttagtttactcgcgacatttcaatctgctgtggccatcctgggtgtgccttctgaaatttaccgcttcgggacccagtattggttcctggggtgttgctacttcctaggactattgatacctgcacacatcttcatcccagtcttttaccgtctgcatctgactagcgcctacgaatacctggaactacgctttaacaagaccgttcgcgtctgtggaacagtgtag

SEQ ID NO: 30405 - DNA, 1908 bp, Artificial Sequence
  Description of Artificial Sequence: Synthetic coding sequence
atgtcagtgggggtatccacatctgcaccactgtcgcctacctctggcactagcgttggtatgagcacgttcagtattatggattatgtagtcttcgtactgctgttggtcctgtcattggcaatagggctgtatcacgcttgccggggttggggacgtcacactgtcggtgaacttctgatggcagacaggaaaatgggctgtctgcccgtggcactgagcctgctggccacattccagagtgccgtggccattctgggggtgccctctgaaatatatagatttgggacacaatattggttccttggctgctgttactttttgggactgctcatccccgctcacatcttcatcccagtattttacagactgcacctgaccagcgcatacgagtacctagagcttagattcaataaaaccgtcagggtgtgtggaaccgttacctttattttccagatggtaatctatatgggagtagtactctacgcccccagcctcgcgctgaacgccgttaccgggttcgatctgtggctgtcggtgttagctctgggtatagtgtgtaccgtttacacggccctcggcggacttaaggcagtaatctggactgacgtctttcaaacactggtgatgtttctgggccagcttgccgtaattattgttggaagtgccaaagtcggtggattaggtcgggtgtgggccgtggctagccagcacgggcgtattagcggatttgaactggatcctgatcccttcgtccggcacacattctggaccctagctttcggcggcgtgttcatgatgttaagtctgtacggcgtgaatcaggcgcaggtgcagagatatttaagctcccggactgagaaggcagcagtcctgtcttgctacgccgtcttccccttccagcaagtgtcactctgcgtaggatgcctgattgggttagtgatgtttgcctactaccaggagtatcccatgtctatccaacaggctcaggccgcacccgatcagttcgtgctgtacttcgtgatggacttgctgaaggggctgcctggcttacctggtctattcattgcttgcctgtttagcggcagccttagcaccatcagcagtgctttcaactcgcttgcaacggtgaccatggaagatctgatccgcccatggtttcctgagttctcagaggctagagccattatgctctcacgaggtctcgctttcggatatggtctgctctgtctgggtatggcttacatcagttctcagatggggcccgtactgcaggctgctatctccatcttcgggatggtcgggggcccattacttggactcttctgcctcggcatgttttttccatgcgctaatccacctggagccgtcgttgggcttcttgcgggccttgtaatggctttttggattggcattggatcgatcgtgacttctatgggaagttctatgccgccatctccttccaacggatctagttttagcttaccaacgaacttgacagtagctaccgtgactactcttatgcctctaaccacgttcagtaagcccacaggtctgcagcgattttactctctgtcttacctgtggtactccgcccataatagtacaacggtcatcgttgtcgggctgatcgtcagtctactgaccggacgaatgagagggagatccctcaaccctgccaccatctacccagtgctgccaaagctgctgtcactccttccactttcatgtcaaaagagactccactgtcggagctacgggcaggaccacctcgataccgggctgtttccagaaaagcctcggaatggagtgcttggagattccagagacaaggaggcgatggctctggatggaacagcctatcagggaagctcaagcacgtgcattctgcaggaaacctccctctag

SEQ ID NO: 30406 - DNA, 582 bp, Artificial Sequence
  Description of Artificial Sequence: Synthetic coding sequence
atgtctgtaggggtgtctaccagtgctccgctgtcgcctacatcagggaccagtgtcggtatgagcacattcagcatcatggattatgttgtgtttgtgttgctgctcgtgctgagtcttgctatcggactctatcatgcttgtagggggtggggtagacacactgtaggtgaactccttatggctgaccgcaagatggggtgcctgccagtggctctttccttgttagccactttccaatcagccgtagccatacttggcgttccctcagaaatttaccggttcggcacacagtattggtttctgggctgctgctattttctggggctgctgataccagctcatatctttatccctgtcttttatcgactgcacctgacaagtgcatatgaatacctcgagctccggtttaacaagaccgtgagagtgtgcgggacagttaccttcatcttccagatggtcatttacatgggagtcgtcctctacgctcctagtttggccctcaacgcagtgacaggcttcgacttatggctcagcgtcctggctctcggcattgtttgtaccgtctacacggccctttag

SEQ ID NO: 30407 - DNA, 237 bp, Artificial Sequence
  Description of Artificial Sequence: Synthetic coding sequence
atgagtgtaggcgtctcaactagtgcgcccctgtcacccacaagcggcacttctgtcggcatgtctaccttctctatcatggattatgtggtgtttgtgctgctgctggtattaagtttggccattggtctgtatcacgcatgccgggggtggggtaggcacaccgtcggagagctcctgatggctgacaggaagatgggttgtctgcccgtggctcttagcctacttgccacatag

SEQ ID NO: 30408 - DNA, 348 bp, Artificial Sequence
  Description of Artificial Sequence: Synthetic coding sequence
atgtcagtgggagtgtcgacctctgcccctctgagccccacgtcaggcacatcagtcgggatgtcgactttctccataatggattacgtcgtttttgtgctcttactagtcctatctcttgcaattggcctgtaccatgcctgccggggctgggggaggcacaccgtgggcgaactgcttatggcagaccgaaagatgggctgcctacccgtggccctatccctcctggccacattccaaagcgctgtcgctatacttggcgtgcctagcgagatttatcgctttggcacccaatactggtttctagggtgctgctatttcttgggactgttaattcccgcacattag

SEQ ID NO: 30409 - DNA, 180 bp, Artificial Sequence
  Description of Artificial Sequence: Synthetic coding sequence
atgagtgttggcgtctccacgtcagctccgctgagcccgactagcgggaccagtgtagggatgtctaccttttctatcatggattacgtagtgtttgtcctccttctggtactttctctggccattggactgtaccatgcttgcagaggttggggccgacacactgtgggggagttatag

SEQ ID NO: 30410 - DNA, 120 bp, Artificial Sequence
  Description of Artificial Sequence: Synthetic coding sequence
atgtcagtcggcgtgtccacttctgctccgctctcccccacctctggcacatcagtggggatgtcaactttttcgatcatggactatgtggtgtttgtattactactggtgctgagctag

SEQ ID NO: 30411 - DNA, 402 bp, Artificial Sequence
  Description of Artificial Sequence: Synthetic coding sequence
atgagtgtgggagtctccacctcagcccccctgagccctaccagcggcacatccgtcggcatgagcaccttctcaataatggattatgtcgtgtttgtgctcttgctggtactgtccctcgcgatcgggctataccatgcatgtcgggggtggggaaggcacacagtgggcgaactccttatggccgaccggaagatgggctgtctgccagtggccctttccctgctcgcaactttccagtccgcagtggctatcctgggagttccctcagaaatctaccgatttgggacccagtattggttcctgggctgctgctacttcctgggacttctgatccccgcacacattttcatcccagtattctacagattgcacctgactagcgcctatgagtatttatag

SEQ ID NO: 30412 - DNA, 84 bp, Artificial Sequence
  Description of Artificial Sequence: Synthetic coding sequence
atgtcagtaggagtgtctacaagcgcccccctatcccccacatctggaacgtctgtcggaatgagtacgtttagcatcatgtag

SEQ ID NO: 30413 - DNA, 462 bp, Artificial Sequence
  Description of Artificial Sequence: Synthetic coding sequence
atgagcgtgggcgtttctacaagcgccccactgagcccgacctcagggacaagcgtaggcatgtcaacatttagtatcatggattacgtggtctttgtgctgctgctcgtcttgtcccttgctattggactgtaccatgcttgtcgagggtggggacgccacaccgttggggagcttcttatggccgaccggaagatgggctgcttacccgtggcactttccctactggccacctttcagtccgccgtggcaattcttggagtgccgtcggagatctacagattcgggacgcagtattggtttcttggctgttgctattttttgggacttcttatcccagcacatatctttatccctgttttctaccgtctgcacctcacctctgcttacgaatacttagagctccgttttaataagacagtcagggtgtgtggcacggttaccttcatcttccagatgtag

SEQ ID NO: 30414 - DNA, 1746 bp, Artificial Sequence
  Description of Artificial Sequence: Synthetic coding sequence
atggaacgacaaaaccagtgtatccagtcttggaagaggcggcggaaaatggccccttggagcggggggaccggtacaacaagatggagcttatgcaacgtctggcggttcccatacctgtgttacaagaatgggggcggtgcgttttttatcccttaccttgtttttctcttcacttgtgggatcccggttttcctgctggaaactgccctagggcaatacacatcccaggggggcgtgacagcctggcgtaagatttgtcccatctttgaaggcattggctatgcctcccagatgattgtgattcttctgaacgtgtactatattatcgtccttgcttgggccctgttttatctattctctagcttcaccatcgatcttccttggggcgggtgctaccatgagtggaatacagaacattgcatggaatttcagaagaccaacggatctcttaatgggacgtccgagaatgcaacgagccccgtcattgaattctgggagcggagggtgcttaagatctcagatgggattcagcaccttggcgcactacggtgggaactggccctttgcctactgctagcttgggtaatttgctatttctgcatctggaagggcgtgaagtccacgggcaaggtcgtgtacttcacagctactttcccttacctaatgcttgtggttcttctcatacgcggtgtgaccctgcccggagctgcccagggaattcaattctacttgtatcccaatctgactcggttatgggaccctcaagtgtggatggatgccggcacacagattttttttagctttgccatctgcctcggttgcctcacagccctgggctcatataacaagtatcacaataactgctaccgggattgtatcgccctgtgctttctaaactccggcacttcattcgttgcgggatttgccattttctctattctggggtttatgagccaagagcaaggggtgcctatcagcgaagtggccgagtcagggccaggcctggcctttattgcttacccacgggccgttgtcatgttacctttctcaccgctgtgggcctgttgctttttctttatggtggtccttctcggactcgacagtcagttcgtctgtgtcgaatccttggtaacggcccttgttgacatgtatccccatgtgttcagaaagaaaaaccgtcgcgaagtccttatcctcggcgtcagtgtggtatccttcttagtcgggttgatcatgctgacagaaggcgggatgtacgtgttccagctgtttgattactatgccgcttccggcatgtgtctgctgttcgttgctatatttgaaagtctttgcgtcgcttgggtgtacggcgctaaaagattttacgataacatagaggacatgataggatatcgcccgtggcctcttatcaaatactgttggctctttttgactccggctgtgtgcaccgcaacatttctattcagtttgattaaatatacccccttaacttataacaaaaaatatacatatccatggtggggcgacgctctggggtggctccttgccctgagctcgatggtgtgtataccagcctggagtctgtacagactgggtacattaaaaggaccctttcgcgaaaggatacgccaactgatgtgcccagcagaggacttaccgcagagaaaccccgcaggacctagcgctccagctacaccacgtacttcactgctcaggctcaccgagttggagtctcattgctag

SEQ ID NO: 30415 - DNA, 1809 bp, Artificial Sequence
  Description of Artificial Sequence: Synthetic coding sequence
atggactcaagggtgagcggaaccacctcaaatggggaaacgaagcctgtctacccggtcatggaaaaaaaagaagaagacggaacactcgagaggggtcactggaacaataaaatggaattcgtgctgagcgtggccggtgaaattattgggctgggcaatgtctggagattcccctacctctgttataagaatgggggaggcgcgttctttatcccatatcttgtattcctgttcacctgcggaatcccagtttttctcctggaaacggccctgggtcagtacacctctcagggaggggtgactgcatggaggaagatctgccctatcttcgaaggcatcggctatgcttcacagatgatcgtgatccttctgaacgtttattatataatcgtgctcgcctgggctctgttctacttattttccagcttcaccatcgatctgccatgggggggctgctaccacgaatggaatacagagcactgcatggagttccaaaagaccaacggttcgctgaatgggactagtgagaacgccactagtcctgtaattgagttctgggagcgccgggtgctcaagatcagtgatgggatacagcatctgggtgcattgagatgggagttagccttgtgcctgcttctagcctgggtaatctgttacttctgcatttggaagggcgttaagtctacaggaaaggtggtgtatttcaccgccacattcccctatctgatgctggtggtgctgctgataaggggcgtaacattgcccggggccgcacagggcattcagttctatctctatcctaatctgacccggctgtgggaccctcaggtgtggatggatgcgggtacgcaaattttcttctccttcgctatctgcctcggctgtctgacagctctcggcagttataataaatatcacaataactgctatcgggattgcatcgccctatgttttctgaatagcggaacaagcttcgtggcggggttcgcaatttttagcatactgggcttcatgagccaagaacaaggggttcctatcagcgaagtggcggagagcggcccaggcttggcttttattgcatatcctcgcgctgtggtgatgctcccatttagtcccctatgggcttgttgcttcttcttcatggttgtgctgctggggctcgattcacaatttgtgtgtgtggagtctctggtcacagcgttggttgacatgtacccgcacgtgtttcggaaaaaaaatagaagggaagtgttgattctcggagtgtcggtggtcagttttctggtgggcctgatcatgctgaccgaaggcggcatgtatgtgttccaactgtttgactactacgcagcctcaggcatgtgcctgctgttcgtagcgatctttgaatctctttgtgtggcgtgggtatacggtgccaagagattctatgataacattgaagatatgattgggtaccgaccctggccattgataaaatattgttggctttttttgacgccagcagtctgtaccgcaacattcctcttcagcttaattaagtacacccctctaacttataataaaaaatacacttacccttggtggggcgacgcccttgggtggctgctggcacttagttcgatggtgtgtatcccagcctggtccctctatcgcttgggaaccctgaagggcccatttcgcgagcggatcaggcagttaatgtgccctgcggaggacctgccacagcggaaccccgctggcccgtcagcccccgctacccccaggactagcttactgagactgacggagctggagtcccactgttag

SEQ ID NO: 30416 - DNA, 294 bp, Artificial Sequence
  Description of Artificial Sequence: Synthetic coding sequence
atggactccagggtctcgggtacgacaagtaatggtgagacaaaacccgtgtacccagtcatggaaaaaaaggaggaggacggtaccctggagaggggccactggaataataagatggagtttgtgctctccgtggcaggggagattataggccttggcaatgtgtggaggttcccctacctgtgctataagaatgggggaggtgaaatgcgcgctctcgtgcctccacaccccttgcttgagggcgggtatttccatctgttgcacctgagaccactgtggggggtgccgtag

SEQ ID NO: 30417 - DNA, 1533 bp, Artificial Sequence
  Description of Artificial Sequence: Synthetic coding sequence
atggacagccgtgtctctgggactacttctaatggtgagaccaagcccgtctatcctgtgatggaaaaaaaagaggaggatggaacactggagaggggacactggaacaacaaaatggagtttgttttgagcgtcgctggggaaattatagggctaggcaacgtgtggagattcccttacttgtgttataagaatggtggagaacactgcatggaatttcagaagaccaatggaagccttaatggaacttctgagaacgcaactagcccagtaatcgagttttgggaacgacgcgtgctgaagatttcagatggaatacagcatcttggcgcattgaggtgggagctggccctatgccttctactggcctgggtcatatgttacttctgtatttggaagggcgtgaagagcactggaaaggtcgtctatttcaccgcaacattcccgtacctgatgctggtggtactgctgattcgcggagttacattgcctggtgctgcccagggcattcaattttacttgtatcctaacctgactcgtctgtgggacccccaggtgtggatggacgccggaacacagatcttcttttcatttgcaatctgcttaggctgcctcaccgccctaggctcctacaacaagtatcataacaattgttaccgagactgcatagccttatgcttcctgaatagcggaacgagttttgtcgcgggttttgccatcttcagcattcttggctttatgtcgcaggagcaaggggtcccgatttcagaggtcgctgagtccggaccgggcctcgcatttattgcttaccccagggccgtggtcatgctgcccttttcgcctctgtgggcatgctgcttctttttcatggttgttctgctcggcctcgactcacaattcgtctgtgttgaatcactggtgacagccttggtggatatgtatcctcacgtttttaggaaaaagaaccggagagaggtgcttattctcggcgttagtgtggtctcatttctcgttggcctcataatgctcacggaaggcgggatgtatgtgttccagctcttcgactactacgcggcttctggaatgtgtctgttgtttgtggcaatcttcgaatctctgtgtgtcgcatgggtttacggagccaagagattttacgacaatatcgaggatatgattggctacaggccgtggccgctcataaagtattgctggctgttcctcacaccagccgtctgtacggccaccttcctttttagtctgatcaagtacacccccctgacatacaacaaaaagtatacctacccctggtggggcgacgcgctgggttggctcctcgcgttgagctccatggtgtgcattcctgcatggtctttatatagactagggacgctgaaaggtcctttccgggagcgcataaggcagctcatgtgtccagccgaggatctgccacagagaaaccctgccgggcctagtgccccagccacccctcggacaagcttgcttagactcacagagcttgaatcccattgttag

SEQ ID NO: 30418 - DNA, 2193 bp, Artificial Sequence
  Description of Artificial Sequence: Synthetic coding sequence
atgccaaaaaactccaaggtggttaagcgggagctggacgacgatgtgacggagtccgtcaaggacctgctgagcaatgaagatgcggccgatgatgccttcaagaccagtgagctcatcgtggacggtcaagaggagaaggatactgatgtagaggagggatcggaagtagaagatgaacgccccgcgtggaattctaaactgcagtatattcttgcccaggtgggtttctccgtggggctcgggaatgtatggcgctttccctatttatgccagaagaatgggggcggggcctatttgcttccctatctgatcctgctcatggtcatcgggataccccttttctttctcgagctttcagtggggcagcgcattcggcgcgggagtattggcgtgtggaactacatcagccccaaactgggaggcattgggttcgccagttgcgtggtgtgctatttcgtggccctttattataacgtcatcatcgggtggagcctgttttatttttcacagtcgtttcagcagccactgccttgggatcagtgcccacttgtgaaaaacgcctcccacacatttgtggaacccgagtgcgagcagtcatccgccactacctactactggtaccgcgaagcgctgaacatcagcagtagtatatcagagagcggaggactgaattggaaaatgacaatatgtctcctggctgcctgggttatggtctgcctcgcaatgatcaaggggattcagtcctccgggaagataatttacttttcctcgctgttcccgtatgtagtgctgatttgtttcttgattcgcgcctttttgctgaacgggtccattgacggtatccggcatatgttcactcctaaactagagatcatgctggagccgaaggtgtggcgcgaagctgccactcaggtgtttttcgccctcggtctcggtttcggaggcgtcatagccttttctagttataacaaaagggataataactgccacttcgatgctgtgcttgtttcttttatcaatttttttacatccgtgctagccaccctcgttgtgtttgcagtgctcggctttaaagcaaacgtcataaatgagaagtgtattacacagaattcagaaaccatcatgaagtttttgaagatgggcaacatttcacaggatataattccccaccacataaatctgtctacagtgactgctgaggattaccacctggtgtatgacatcatccaaaaagtcaaagaagaggaatttccagccctccatctgaattcctgcaaaattgaagaggaactcaacaaagccgtccaagggacaggcttagcgttcattgccttcacagaggcaatgacacattttccagcatcacccttttggtcagttatgtttttcttgatgctcgtaaatctggggttggggtccatgtttggcactattgagggaatcgtgaccccaatagttgacaccttcaaagttcgcaaggagatcctgacagtcatttgttgcctgctagccttctgcataggactaatctttgtccaacgaagcggaaactacttcgtgacaatgtttgatgattatagtgctaccctgcccctgctgattgtggtgattctagagaacatcgcagtttgttttgtatatggcattgataagttcatggaggatctgaaagatatgcttggcttcgccccttcgaggtactactactatatgtggaagtatataagcccactcatgcttctctcactgctcatcgcctcagttgtgaatatggggctgtccccccctgggtataacgcctggattgaggacaaagcttccgaggaattcctgtcctaccctacttggggcctagtggtttgcgtgtccttagtggtttttgctattctgcccgttccagttgtgttcatcgtgcgcagatttaacctgattgatgactctagcggaaatctcgcctccgtgacttataaaaggggcagagtgctgaaagagccagtgaatttggagggcgatgatacctccctgatccatggaaagataccttcagaaatgccctcccctaatttcggaaagaatatttacaggaaacagagcggaagcccgacattggatacggcccctaatgggaggtacgggatcggttacttaatggccgacattatgccagatatgcccgagtccgacctttag

SEQ ID NO: 30419 - DNA, 750 bp, Artificial Sequence
  Description of Artificial Sequence: Synthetic coding sequence
atgttcactcccaagctggaaatcatgctcgagccaaaggtctggcgcgaggccgcaacacaggtgttctttgcactcggtctcgggtttgggggtgtcatagctttcagctcttataacaagcgagacaataactgtcacttcgacgccgtactagtgtccttcattaacttcttcacctccgtcctggcaacccttgttgtgttcgcagttttgggcttcaaagccaatgtcatcaacgagaaatgcatcacacagaattccgagaccatcatgaaatttctgaaaatggggaacataagccaggatattatccctcaccatattaacctgtcaaccgtaactgctgaggattatcacctcgtttacgacatcattcaaaaagtcaaagaggaggaatttccagctctccatctgaacagttgcaagatcgaggaggagctcaataaggcagtccagggcacgggtctggctttcatcgccttcaccgaagcaatgacccacttccccgccagccccttctggtccgtcatgtttttcctcatgctagttaaccttgggctgggctctatgttcggaactatcgagggaatcgtcacaccgatcgtggatacatttaaggtccgtaaggagattttgactgtgatttgttgtctgctcgccttttgtatcggtctgatcctgtgtaacgccctcgagatcacgctcttacagtgtttgatgattatcctcctgcactgtctgtgttag

SEQ ID NO: 30420 - DNA, 870 bp, Artificial Sequence
  Description of Artificial Sequence: Synthetic coding sequence
atgcctaagaactccaaggtcgtaaagcgtgagttggacgatgatgtgacagagagtgtgaaagacctgctgagcaatgaggatgccgcagatgatgcctttaagacatcagagctcatcgtggacggccaagaagaaaaggatacagacgtggaagagggcagcgaggtggaggacgagagacctgcgtggaattctaaattgcagtatattctggcccaggtggggttcagcgtaggactaggaaacgtttggcggttcccctatctctgtcagaaaaacggcggtggagcttacctcctgccgtacctcattctgctcatggtaattggaatacctttgttcttcctggagcttagtgttggacaacggatcaggcgtggctcaatcggcgtatggaactacatttcccctaaactgggtggaatcgggtttgcgagctgcgtggtatgctatttcgtcgctttgtactacaatgtgataattggctggtctctgttttatttcagccagagtttccaacagcccttaccatgggatcagtgtcctttggttaagaatgcttcacacacctttgtggaaccagagtgtgagcagtccagcgcaactacgtactattggtatagagaggccttgaacatcagtagcagcatttccgagtcaggtgggttaaattggaaaatgactatatgcctactcgccgcctgggtcatggtgtgcttggccatgattaagggcatccagagtagcggaaaagtctctatgctcgagccatttcttatcctactgatcacaattagtggattcatcccactgtccaattctgtcactgacttctgcgggcagatcacacacaacacctccttctag

SEQ ID NO: 30421 - DNA, 291 bp, Artificial Sequence
  Description of Artificial Sequence: Synthetic coding sequence
atgcccaagaactctaaggttgtgaaacgcgagctggacgatgatgtgacggaatctgtgaaggatttactgagcaatgaggacgccgcggatgacgcgttcaaaacctccgagctgattgttgatggccaggaggagaaagatactgatgtggaagaggggtcggaggtggaggatgaacggccagcatggaacagtaagctccagtacattttagcccaggtgggcttttccgttggattgggtaacgtttggaggtttccttatctctgccaaaagaatggtggctag

SEQ ID NO: 30422 - DNA, 1872 bp, Artificial Sequence
  Description of Artificial Sequence: Synthetic coding sequence
atggtgatcggtatccccttgttttttttggagctgtccgtgggccagcggattagaagagggagcatcggggtctggaactatataagtccgaagctcggcgggattgggttcgcaagttgcgtggtgtgttactttgtcgcgttgtattacaatgtcataattggatggtctctgttttatttctcccagagctttcagcagccattaccatgggatcaatgccctctggtgaaaaatgcatctcacacttttgtagaacccgagtgtgagcagagttcagccaccacctattattggtaccgcgaggccctaaatatcagcagttcaatatccgaaagcggcggactgaattggaaaatgacaatctgcctgttggcagcttgggtgatggtctgcttagcgatgattaagggcatacagtcgagtgggaaaataatctatttctcttcactgtttccttatgtggtcctgatctgtttcctcattagagcgttcctcctgaacggtagtatcgacggcatacgtcatatgtttaccccaaaactcgagattatgctggaaccaaaggtctggagggaagccgccacccaagtcttcttcgcccttgggctagggttcggcggagtgattgcattttcctcctacaataaacgcgacaacaattgtcattttgatgccgtcctggtgagcttcatcaatttttttactagtgttctggcaacgttagtggtgttcgctgttcttggattcaaggccaacgttattaatgagaaatgtattacacagaacagcgagactattatgaagtttcttaagatgggcaatatctcgcaggacattatccctcaccacattaacctgagtacggtgacggcagaggattaccacctcgtgtacgatattatccaaaaggtgaaagaggaggagttcccagccttgcacctgaattcctgcaagatcgaggaggaactgaacaaagcggtacagggcacaggcctggcttttattgcgttcactgaggccatgacccacttccctgcctcacccttctggagcgtcatgtttttcctgatgctagtgaacctgggtctgggatccatgttcggaacaattgaagggatcgtgacgcccattgtggacacctttaaagtccggaaggaaatcttgacggtcatttgctgcctactagcgttctgcatcggcttgattttcgtgcagcgcagtggcaattacttcgtgaccatgtttgatgactattccgcaaccctgccgttgttgatcgtcgttattctagaaaatatcgcagtgtgttttgtgtacgggattgataagttcatggaagatctgaaagacatgctgggatttgctccgtctaggtattattattatatgtggaagtacatttcacccctcatgctgctcagcctgctcattgcttccgtagtcaatatgggcttgtctccccctggatacaatgcatggatcgaagacaaggccagtgaagaattcctcagctacccgacctggggcctggtggtttgcgtttccctagtggttttcgctatcttgcccgtgccagttgtctttatcgtgcgtagattcaatctaattgatgattcctctggtaacctggcctccgtcacctacaaacgcgggagggttctgaaggaacccgtcaatttggaaggagatgacactagtctgatacacggaaaaattccatctgaaatgccaagtccgaacttcgggaagaacatttaccgcaagcagtccggctcgcctaccctcgacacagctcctaatggtaggtatggaattggatacctcatggccgatatcatgcccgatatgccagaaagcgacctgtag

SEQ ID NO: 30423 - DNA, 2211 bp, Artificial Sequence
  Description of Artificial Sequence: Synthetic coding sequence
atgaagacggaagcacagccctctacatccctcctagcaaacactagctggaccggtacagttatctcagatagcgtacctggatcgcagacttgggaagataaaggttctctcacacgcagcgctaccagctggacatccgaagcacaggttagcgccgcccgcgtagcagaggcccaagcgaggacaagccagcctaagcaaattagcgtcctggaggccctcaccgcctccgccctcaaccaaaagcctacccatgaaaaggtgcagatgactgagaagaaagaatcggaggttctgctggctagacctttttggtccagtaaaaccgagtacattttggcacaagtcgggttctcaatgaagccgtcgtgtctttggagattcgcctacctctggctcaattctgggggctgctcttttgctgctatttatattttcatgttgtttctggtcggagtgcccttgttgtttctggagatggccgcgggccagtctatgaggcagggaggtatgggagtatggaaaatcatcgctccttggatagggggggtcggctattcttcgttcatggtgtgtttcattctaggactttatttcaatgtcgtcaacagttggattatcttttatatgtctcagagcttccaattcccggtgccttgggagaagtgcccgctgaccatgaacagtagcggtttcgaccctgagtgtgagcgtaccaccccatctatttacttttggtaccaacaggccctcaaagcatcagataggattgaagatggcgggagtccagtatattctttggtcctacctttttttctctgttggtgcctggtcggcgctttcatgatcaatgggttgaagagcaccgggaaagtaatttacgtgctcgtgctcctgccatgctttatcatagtgggcttcttcatccgaaccctgctgttagagggggccaagtttgggctccagcagctagtggtagccaagatcagtgatgtatacaatatgtccgtatggagcttggcagggggacaggtgctttccaacacaggaattggcctggggagtgtcgcatcgctggcctcttacatgccccagtctaacaactgtctgtccgatgcgtttcttgtctctgtgattaaccttctaacactgttggtattcacttcgttcaacttctgtgtgcttggcttttgggccactgttattacccacagatgctgcgagcgcaatgccgaaatactgctgaagttaatcaaccttggcaagctgcctccggacgcaaagccaccggttaatctgctgtacaacccaacatccatttataacgcctggctgtccggcctccctcagcatattaaaagtatggtgctccgagaagttactgaatgcaacatcgagacacagttcctgaaagctagcgaaggcccaaagttcgctttcttgtcttttgtggaggcaatgtcatttctgcctccttccgtattttggtcattcatcttcttcctcatgctcctcgccatggggctctcttctgcaatcgggatcatgcaaggtatcatcacaccacttcaggataccttctctttctttaggaagcataccaagctcctgatcgtgggagtgtttctactcatgtttgtgtgcgggctgttcttcactaggcccagcggaagctatttcattcgcctgttgagcgattattggattgttttccccattatcgttgtggtggtgtttgaaaccatggccgtgagctgggcatacggagcacgtcggtttctggcggacctgaccattctgctcggtcacccaatcagtcctattttcggctggctgtggccgcacctgtgccctgtggtgttgctgataattttcgttacgatgatggtacacctctgtatgaaacccataacgtacatgagctgggatagcagtactagtaaggaggtgctccgcccctaccccccttgggccctcctactgatgatcaccctttttgctatcgtaatcctgcccatccccgcctattttgtgtactgcagaattcatcggataccctttcgacccaaatccggcgatggcccaatgacggcgagcacgtccttacctctgtctcatcagttgacaccctccaaagaagtgcagaaggaagagatccttcaggtggacgagaccaagtaccctagtacttgtaacgttacatcctag

SEQ ID NO: 30424 - DNA, 1980 bp, Artificial Sequence
  Description of Artificial Sequence: Synthetic coding sequence
atgaagacagaggctcaaccatctacatccctcttagcaaatactagctggacaggaacggtaataagtgatagtgtgcccggatcacagacttgggaagacaaggggtcccttacacgcagcgctacttcttggacctcagaggcccaggtgagtgccgcccgagttgcagaggcacaggcaaggacatcacaaccaaaacagatctccgtgctggaggccttgaccgctagcgctctgaaccaaaaaccaactcacgagaaggttcagatgactgaaaaaaaagagtccgaagtcctactcgctcggcccttctggagctccaaaactgagtatatcttggcacaggtcggattttctatgaagccatcctgcctgtggagattcgcctacctgtggctgaactccggcgggtgctcctttgctgctatatacatttttatgttattcctggttggagtccccctgttgtttctcgaaatggccgccggtcagagtatgcgccagggcgggatgggagtctggaagattattgcaccatggataggaggtgtagggtatagtagcttcatggtatgtttcatcctggggctctacttcaacgtggtaaattcatggatcatattttatatgtcacagtcttttcaattccctgtgccatgggaaaagtgccccctcactatgaattcttccggattcgatccggaatgtgagagaacaacgcccagcatctatttttggtatcagcaggcgttgaaagcttccgatagaatcgaggacggcgggtcaccggtgtactctctggttttgccatttttcttatgttggtgcttggttggcgcattcatgatcaatggactgaagtcaacgggaaaggtcatctacgtgctggtgcttttaccctgtttcatcatagttggcttctttataagaactctgcttctagagggtgccaagtttgggctccagcagttagtggtcgccaaaattagtgacgtctacaatatgtcagtctggagcctcgccgggggccaggtcttgagtaataccgggatagggctgggtagcgtagcaagtctagccagctatatgccgcagtctaacaactgcctgagcgacgcctttctcgtaagcgtgatcaatcttctcactttactggtcttcacatcttttaatttttgtgtgctcggtttttgggcaactgttatcacccataggtgctgcgagcggaatgcggagatactgctgaaactcatcaatctgggaaagttgccacccgacgcaaagccccccgttaaccttctgtataatcctacctccatctataacgcctggctgagtggcctgcctcagcacataaaaagcatggtgctccgcgaggttacagagtgcaacattgagacgcaattcctgaaagcgtccgaggggccaaaatttgccttcttatcattcgtggaggcgatgtcctttctgccaccatccgtgttctggagctttatattttttctgatgctgttagcaatggggctgtcctccgcaatcgggatcatgcagggcatcattactcctcttcaggacactttctccttctttcggaagcacaccaagttattgatagtgggggtctttctgcttatgttcgtgtgtggtctgttctttacccgcccatctggatcgtatttcatcagactgctcagtgactactggattgtttttcctattattgtcgttgtggtgttcgaaactatggccgtttcttgggcttacggcgcgaggcgcttcctggctgatcttacaatcctactgggtcatcctatctcccctatcttcggttggctgtggccccatctttgtcccgttgtgctgcttataatcttcgtgacaatgatggtacacctgtgtatgaaaccgatcacctacatgagttgggattcttcaactgtgtcgttaccgcaagatcccgagcccttatgggagtag

SEQ ID NO: 30425 - DNA, 2184 bp, Artificial Sequence
  Description of Artificial Sequence: Synthetic coding sequence
atgcctaagaattcaaaagtaactcagcgtgaacacagctctgaacatgtaacggaatccgtagccgacctcctggctctagaggagccggtcgactataagcagagcgtactaaacgtagctggcgaagccggagggaaacagaaggcggtcgaggaggagctggatgccgaggaccgaccagcgtggaactctaagcttcaatacatcctggcgcagattgggttttcagtgggattggggaatatttggcggttcccttacctatgtcagaagaatggaggcggagcttacctggtgccctatctcgtactcctcattattataggcataccattattttttctagagctggccgtgggacaaaggatacgccggggctcaatcggggtctggcattatatctgtccaaggctggggggcattggcttctcttcatgtatcgtgtgcctgtttgttgggctgtactacaacgtcatcatagggtggtctatcttctatttcttcaaaagctttcaatacccactgccctggagcgaatgtcccgtcgtcaggaatggttctgtggccgtggttgaggctgagtgtgaaaagtcatctgcgaccacctacttctggtatcgtgaagctctcgatatctctgatagtatctcggaatccggggggctcaattggaagatgaccttgtgcctgctggttgcttggagcatcgtcggtatggccgtggtgaagggcatccagtcaagcggcaaagtaatgtactttagcagcctgttcccttacgttgttcttgcttgttttctagtgcgtggcttactgttacgcggggccgtcgatggcattctgcatatgtttacccccaaattggataaaatgctggatccacaggtctggcgggaggccgccacacaggtgttttttgcactgggcttgggctttggcggcgtgatcgccttttcatcatacaataaacaggataacaactgccatttcgacgccgcgctggtttcttttataaacttctttacaagcgtcttggctacgttggtggtattcgccgtactgggattcaaagccaacatcatgaacgagaagtgtgtcgttgagaatgcagagaaaatacttggatatctcaacaccaacgtgctgagtcgcgatctaatccctcctcacgtcaacttttcacacctgaccactaaagactacatggagatgtataacgtgatcatgaccgtgaaggaagaccagttcagcgctctgggcctggacccttgccttctcgaggacgaattggataagtccgttcagggaaccgggcttgcctttatcgcgttcactgaggcaatgacccactttcccgcatcacctttctggtctgtgatgttttttctgatgctgataaacctgggcttaggttccatgattgggaccatggccggaattacgacacctattattgacacgtttaaagttccaaaagagatgtttaccgtggggtgctgcgttttcgcttttctggttggcctcctgtttgtccaaagatctggtaattatttcgttactatgtttgatgactatagcgccaccttacctctcaccctgatcgtaatcctcgagaacattgcagttgcttggatttacgggactaagaaatttatgcaggaattgacagagatgctcggctttcgcccttaccgcttttatttctacatgtggaagtttgtgtctcctctgtgtatggctgttctgacaaccgcctccattattcagctaggagttacaccccccgggtatagcgcttggattaaagaggaggctgccgagcgctatctatactttcccaactgggctatggccctcctgatcaccctgattgtcgttgccaccctcccgattcccgtggtgtttgtactgcgccattttcatctccttagcgatggctcaaacactttgtctgtgagctacaagaagggtcgcatgatgaaggacatctcaaatctcgaggagaatgatgagactaggttcatactgagtaaggttccctctgaggccccgagccctatgcccacacatagaagctacttaggacccggcagcacttctccgttggaaacctccggcaacccaaatggccgctatggaagtggctatctactggcaagtacacccgaatctgaactgtag

SEQ ID NO: 30426 - DNA, 2184 bp, Artificial Sequence
  Description of Artificial Sequence: Synthetic coding sequence
atgccaaagaacagtaaggtaacccagcgagagcatagcagtgagcatgtgactgagagtgtggctgacctgctggctctcgaagaacccgtggattacaaacagtctgtgctcaacgtagccggtgaggcgggcggcaagcagaaagcagtggaggaggagctcgacgcagaagatagacctgcttggaactccaagcttcagtacatcttggcccaaattggattttccgttggcctcggcaatatctggcggttcccttacctttgtcagaagaacggtggtggagcttacctagtgccctacctcgtgcttctaattatcattgggattccattatttttcctggaactggccgtcggtcagagaatccgccgcggtagcattggcgtctggcattatatttgccctcgcctggggggcatcgggttttcctcatgtatcgtctgcctctttgtcggactctattataacgttattatcgggtggtctatcttctacttcttcaagtctttccagtaccctctgccttggagcgaatgtcccgtggtgcggaacggcagcgtggcagtagtggaagctgagtgcgagaaaagcagtgcaaccacatacttctggtaccgggaagcactggacattagcgattccatctcggaatcaggagggctcaactggaagatgactctatgtctgctggtggcctggagcatagtgggtatggccgttgtgaaaggcattcaatcgtcagggaaagtgatgtatttcagcagcctgtttccttacgttgtgctggcctgtttcctcgttcgagggctgcttctgcggggtgcagtggatggaattctacatatgtttacccccaaactggacaaaatgttagatcctcaagtgtggagagaggcagcgacccaggtcttttttgcactgggcttgggattcgggggtgttatcgccttctcatcatacaataagcaggataataactgtcactttgatgccgcactcgtatccttcatcaactttttcacttcagttctggcaaccctggtagtgtttgccgtcttgggcttcaaggccaacatcatgaatgaaaaatgtgtggtggagaacgccgagaaaatcctcgggtacctgaacaccaatgtgctatccagagacttgatcccaccccatgtcaactttagccacctgactaccaaggactatatggaaatgtataatgtgatcatgacagtgaaagaagaccagttctctgcgttgggcctcgacccatgcctgctggaggacgaactggacaagagcgttcagggtacgggcctggccttcatcgcttttaccgaggctatgacccatttccccgcctctcccttttggtcagttatgttttttctgatgcttatcaatttaggcctggggtccatgatcggcacaatggcaggcattacaaccccaattattgatacatttaaagtacccaaagagatgttcacggtagggtgctgtgtctttgcctttcttgtgggcctgttattcgtacagcgtagcggtaactattttgtgaccatgtttgatgactatagcgctactctgcccctgactctcattgttattcttgagaatatagccgtggcttggatctacgggactaagaagtttatgcaggagttgaccgaaatgttaggttttaggccataccggttttatttctacatgtggaaattcgtgtcacccttatgtatggcggtgcttactacagcctccatcattcagctgggggtcacaccgccagggtactccgcctggatcaaagaggaagccgcggagcgttacttgtactttccgaactgggctatggccctgctcatcactcttatcgtcgttgctactcttccaattccggtcgtgttcgtgttacggcattttcacctactgtccgacgggagcaataccctctccgtgtcctataaaaaggggcgcatgatgaaggacatatccaatctcgaggagaacgacgagacccgctttattctgtccaaggttccgtctgaggcccctagccctatgccaactcaccgctcttatttggggcccgggagcactagccctctggaaacatcgggaaaccccaacggccggtacggaagtggctatctcctggcctccacccctgagagcgaactctag

SEQ ID NO: 30427 - DNA, 1506 bp, Artificial Sequence
  Description of Artificial Sequence: Synthetic coding sequence
atggtcaggaaacccgtcgtcagtactatttccaagggcggatatctgcaaggcaatgtgaatggacgattgcccagccttgggaacaaagaaccccccggccaggagaaggtacagcttaaacggaaggtcacacttctgagaggggtctcaataatcattggcaccataataggcgccgggatatttatcagccctaaaggggtgctacagaacaccggctctgtcggaatgagcctcaccatttggaccgtgtgcggagtgctgtccctattcggcgcattgtcttacgctgaattaggcacgaccattaaaaagagcggtggacactatacgtacattttagaggtcttcggacccctacctgctttcgtgcgggtttgggtggagttgcttatcattaggccagctgcgacagccgtgatttcactcgcattcggaaggtacattctggaaccctttttcatccagtgtgaaatacccgaactcgcaatcaagctgattaccgctgtgggaatcacagttgtgatggtgcttaacagcatgtccgtttcttggtccgcaaggattcaaatcttcctgacattttgcaaactgacggccatccttattatcatcgtgccgggcgttatgcagctcatcaagggtcagacacaaaatttcaaggatgctttttctgggcgagattcaagcattacgcggcttcccttggccttttattacggaatgtacgcctacgctggctggttctacctcaacttcgttactgaggaagtggagaaccccgagaaaacaatccccctggccatctgtatttctatggccatcgtcaccatcggatacgttctgactaacgtcgcatattttactacaattaatgctgaggagctcctcctcagcaatgctgtcgccgtcactttttccgaacggttactcggcaatttctccctcgcagtccctatttttgtggccctgtcctgtttcggaagtatgaacgggggtgtgttcgccgtctctaggttgttctacgtagcctctcgggaggggcacctgcctgagattctcagtatgattcatgtgagaaagcatactccactccctgccgtgatagtactgcacccccttacaatgattatgctgttcagcggggacctagatagtctgctgaacttcctgtcctttgcccgttggctctttataggcctcgcagtggccgggctgatctacctgcggtataaatgccccgatatgcatcgcccttttaaagtccccttgtttatccccgcgctgtttagttttacctgcctgttcatggttgccctctcgctttattccgatccattttcaacgggcatcggctttgtgatcactctgacaggtgtgcccgcctattacctgtttatcatatgggataaaaagcccaggtggtttcggattatgtccgagaagatcaccagaacccttcagatcattttggaggtggttcctgaggaggataagctgtag

SEQ ID NO: 30428 - DNA, 1413 bp, Artificial Sequence
  Description of Artificial Sequence: Synthetic coding sequence
atggaccgaggtgagaaaatccagctgaaacgcgtgtttggttactggtgggggacatccttcctgctcatcaacattattggcgcaggtattttcgtcagtccaaaaggagtcctggcctactcctgcatgaatgtcggggtgtccctgtgtgtgtgggcaggctgcgcaattctggccatgacttccacactctgctcggccgaaatctcaattagtttcccgtgtagcggagcccagtactactttctgaagcgatacttcggcagcacagttgccttcctgaacctgtggacgtctctgtttctagggagcggcgtggttgctggccaggcccttttgcttgctgagtattctattcaaccatttttcccgtcttgttctgttcccaaacttccaaagaagtgcttggccctggcaatgctgtggattgtggggatactcacttcaagaggcgtcaaggaggtcacctggttgcagatagcttccagcgtactcaaggtgtctatcttatcatttatctctctgactggcgtggtcttcttgatccgcggcaagaaagaaaatgtggagagatttcagaatgccttcgacgccgaactgccagacatcagccatttaatacaggctatcttccagggatattttgcatatagcggcggagcctgtttcactctgattgctggagagctgaaaaagcctcgtacaaccattccaaagtgcatcttcacagcacttccgctggtgaccgtggtttatctgcttgtcaatatttcctacctgacagttctgacaccccgggagatactgagcagcgacgccgttgctatcacctgggccgaccgggccttcccctctctggcatggattatgccttttgccatctctaccagtttgtttagcaatttactcatatccatattcaaaagctcccgtccaatctatttggctagtcaggagggccagcttcctctgcttttcaacacattgaatagccactcgtcacctttcacagcagtgctgctgcttgtgacattgggatctctggctatcatcctcacttctctgatcgacttgatcaactatattttcttcacagggtcactgtggtctatcctcctgatgatcggtatcctccgcaggagataccaggagcctaacttgagcattccatataaggtgtttctgtcctttcccctggcgactattgtcatcgacgtggggttggttgtgatcccgctcgtgaagtcccccaatgttcactatgtgtacgtacttctgctcgttctgtcaggcctcctgttttatattcccctgattcacttcaaaataaggctggcatggtttgagaaaatgacctgctaccttcagctgctgttcaacatctgcctaccagatgtgtccgaagagtag

SEQ ID NO: 30429 - DNA, 1302 bp, Artificial Sequence
  Description of Artificial Sequence: Synthetic coding sequence
atggatcgcggcgagaaaatccagctgaagcgcgtctttggatactggtggggtaccagtttcctgctgattaatatcatcggagcagggattttcgtcagccctaagggggttctggcttattcctgcatgaacgtgggcgtcagcctgtgcgtttgggcaggttgcgccattctggctatgacctctacgctatgcagcgccgagatcagtatcagtttcccttgctccggagcccagtactatttcctgaaaagatacttcggctctacggtggcctttttgaacctatggacctctctatttctcgggagcggcgtggttgccggccaagctctgttgctcgccgagtattccattcaacccttctttccttcctgttccgtgcctaaattgccaaaaaagtgcctggccttggctatgttgtggatcgtcggaattcttactagtcgaggtgtaaaggaggttacctggttacagatcgccagttctgtcctgaaagtgtctatactgtctttcatcagcctaacaggcgtggtgtttcttattcgggggaagaaggagaatgtggaacggttccagaacgcgttcgatgccgagctgcctgacatcagccatttgattcaggccatctttcaaggttatttcgcctattcaggggaactgaagaagccacgtaccacgattccaaagtgcattttcaccgccctcccactagtgactgtagtttatctgctggtcaacataagctatctcactgtgctgacgcccagggagatcctttctagtgatgcagtagctattacctgggcagatcgggctttcccaagtctggcttggataatgccattcgctatatcaacctctcttttttctaacttgttgatctctatcttcaagtcctccagacccatttacctggcaagccaggaagggcagttaccgctcctctttaatacactcaacagccacagcagtccgttcactgccgtcctgcttctcgtaactctgggaagcctggcaataattctcacatctctgattgacctgatcaactacatctttttcaccggaagcctctggtctatcctcttaatgatcggtattttacgtcgccgttaccaagaacccaatttgtccattccttataagtctctgatcctggtggttcaggccggggaggccggcgtacaatggcacgacctgggactgctgcaaccacttctacccggctttaagcggttttcatgcctgtccctgccctcttcttgggattatagatgtttttgccacttccattag

SEQ ID NO: 30430 - DNA, 1860 bp, Artificial Sequence
  Description of Artificial Sequence: Synthetic coding sequence
atgccttggcaagcattccgccgttttggacagaagctggtccggaggcgcacgctggagagcggcatggcggagacacgtctggccaggtgtctgtctactctggatctggtcgccttgggggttggtagtacgttgggtgcaggcgtttacgtgttggccggcgaagtagcaaaggataaggcaggtccctctattgtgatttgtttcctggtggctgcactgagttccgttctggcaggtctctgctatgcagagttcggggccagggtgccacgatcaggatctgcgtatttatattcctatgtcactgtgggcgagctgtgggcttttaccaccgggtggaacctgattttgtcctacgtaattggtactgcatccgtggcccgagcctggagttccgcttttgacaacctcatcggcaatcatatcagcaaaacactccaggggtccattgccctccatgtcccacatgtgctcgccgagtaccctgatttctttgcccttggactggttctcctactaaccgggctgctagcccttggtgcttccgaaagtgcactggtcactaaggtgtttactggcgtgaatctgctggtgctgggctttgttatgatatcaggctttgtgaaaggcgatgtgcacaattggaagctgacggaagaggattacgaactcgccatggccgagctgaacgatacatactctctgggcccacttggttcaggcggctttgtaccgttcggcttcgaggggatcttgaggggagcggctacctgcttctacgccttcgtggggtttgattgtatagctacaaccggcgaggaagcccagaaccctcagcggagcatccccatggggattgtgatctctttgtcagtatgctttctggcctactttgcggtgagtagcgccctcacgcttatgatgccctactaccaacttcaacctgaatcccctttgcccgaggccttcctatacatcgggtgggcgcctgccaggtacgtcgtggctgtcgggagcctgtgcgctctctcgacctcgctgcttgggtctatgtttccaatgcctcgcgtaatatacgccatggccgaagacggactcttgtttagggtactggcaaggatccacactggcacacgcaccccaatcatcgctactgtcgtttctggcatcattgcggcatttatggctttcttgttcaaactcaccgatctcgttgatctcatgtcaattgggacgctcctcgcttatagtcttgtctctatctgtgtactgattctcaggtaccaaccagatcaggaaacaaaaacaggagaagaggtggagctgcaagaggaggctattaccacagagtcagagaagctcaccctttggggcttattctttcccctgaactcgattccgaccccactgagcgggcagatagtttatgtgtgcagctctctgttagcagtactgctgacagcgctttgtcttgtccttgcccagtggtctgtcccactgctcagcggagacctgctgtggacagccgtagtcgtcttactgttgctgctgattattggcattatcgtggttatttggcggcaacctcaatccagtactccacttcactttaaagtgccagccctgcctctactgcccttgatgagcatcttcgttaatatttacctcatgatgcagatgacagcagggacttgggcaaggtttggcgtgtggatgttgattgggttcgctatctatttcgggtatgggatacagcattcactggaggagataaaaagcaaccagccttccaggaagagcagagcaaagacagtcgatcttgaccccggcacactatatgtgcactctgtgtag

SEQ ID NO: 30431 - DNA, 1860 bp, Artificial Sequence
  Description of Artificial Sequence: Synthetic coding sequence
atgccctggcaggcttttcgtcgatttggccaaaagctggtgagacggcggactctagagtccggcatggccgagactcgcctcgctcggtgtctgtcaaccctcgatctggtagccctgggggtggggtcaactcttggggccggagtatatgtcttagcaggtgaggtagccaaggacaaagccggcccgagtattgtcatatgctttttggtggcagccctctcaagcgtactcgctggactgtgctatgcagagttcggggcccgcgtgccccgatccggaagcgcatacctctatagctatgtgaccgtcggtgagctgtgggcctttacaaccggctggaacctgattcttagctacgtcataggcacagcctcagtcgcccgggcatggtcatcagcattcgataatctgatcggaaatcatattagcaaaaccttacagggatctatcgctttgcacgtgccccacgttttggccgaatacccagacttttttgctttgggactggttctacttttgacaggactgctggctttgggagcctcagaatcagcactggtgacgaaggtttttactggcgttaacttactcgtgctcggctttgtcatgatctcagggtttgtgaaaggcgacgtgcacaactggaagctgacagaggaggactatgagttggcgatggcagagctgaatgacacctatagtctcgggcccctgggatctggcgggtttgtccccttcggcttcgaaggaatacttcggggtgcggctacctgtttttacgcctttgtggggtttgattgcatcgccacaaccggtgaggaggcacagaatccgcagcgcagtatccctatggggattgtgattagtctgagtgtgtgtttcctggcatatttcgctgtgtcgagtgccctcacactcatgatgccatattaccagttacagccggagagtccactgccagaggcgtttctgtacataggatgggcacccgcgaggtacgttgtagccgttgggtccttatgtgcattgagcacttctctgttggggagcatgtttccaatgccccgggtcatctacgccatggccgaggatgggctgctgtttcgtgtgttggcccggattcataccggtacccggactccaattatagcaacagtcgtgtcaggcatcatcgcagctttcatggccttcctgttcaagctgacagacttagtggacctgatgtcgataggaacgctgctggcgtacagcctcgtgtctatatgtgttctgatcctgcgttatcagcctgatcaggagacgaagacaggcgaggaagtcgagctgcaggaggaagccatcacgacagagtcggaaaagttaactctgtggggccttttcttccctttgaactccattccgacccctctgtcggggcagatcgtgtatgtgtgcagctcacttttggctgtgctgctgactgcgttatgtctggtcctggcccagtggtctgtacctctgctctccggtgacctgttgtggaccgctgtcgtagttcttcttctactgcttatcataggtatcattgttgtcatctggcgtcagccacagagctcaacgcctctccactttaaagtcccggccctccctctgctgcctctgatgtctatctttgtcaatatctacctcatgatgcagatgactgccggaacgtgggcccgattcggcgtgtggatgctcattggcttcgccatctattttggatacggaatacagcattcgctggaggaaattaagagcaatcaacccagtcgaaagtccagggcaaagactgtcgacttggaccctggcaccctctacgtgcactccgtctag

SEQ ID NO: 30432 - DNA, 1572 bp, Artificial Sequence
  Description of Artificial Sequence: Synthetic coding sequence
atggcaggacacactcaacagccatcaggacgcggcaacccgcgacctgctccgagtccatcccctgtacctggcacggtaccaggagcaagtgaacgggttgcccttaaaaaggagatcgggcttttaagcgcctgcactattataatcggtaacatcatcgggtctgggatttttattagcccaaaaggcgtgctcgaacactcaggctccgttggcttggccttgttcgtctgggttttgggtggaggcgttaccgccctgggctccctctgctacgcagaactgggggttgccattcctaagtctggaggcgactacgcttatgtaacagagatctttggcgggttggccgggtttctcctgctttggagtgctgtcctgataatgtatcccacatcactggccgtaatatcaatgacattttccaattacgtcctgcagcctgttttcccaaattgcatccccccaacaaccgcaagccgtgtcttgtcaatggcctgtcttatgttattaacatgggtgaacagcagctccgtcagatgggctaccagaatccaggacatgttcactggcggtaagttgctggccctgtccctgattatcggagtcggcctcctacagatctttcaagggcactttgaggaactgcgtccctctaatgctttcgccttctggatgacgccttccgtcggtcacctcgctctcgcgttcctacagggatctttcgccttttctggctggaacttcctgaactatgtgaccgaggagatggtcgatgctcgtaagaacttgcctagggccatattcatctctatcccgctcgtgaccttcgtgtacacctttaccaatattgcctactttacggcaatgagcccccaagagctgctctcaagtaatgccgtagccgttacctttggcgagaagttattaggctatttcagttgggtgatgccagtctccgtggccttgtcaacctttgggggaataaatggttacctgttcacgtactcaagattatgcttcagcggagccagagagggacacctaccttcccttttggcaatgatccacgtccgacattgtacccctattccagcgcttctggtttgttgcggcgctactgctgttatcatgcttgtgggcgacacctatactttgattaactacgtgtcatttatcaactacctgtgttacggggtgacaattcttggactcctcctgctgcgttggcggagacccgcgctccatcggcccattaaagtgaatctgcttattccggtagcttatctggtgttttgggcattcctactggtgttttcgtttatctcggaacccatggtctgcggggtgggtgttattattattctcacgggagtgcctattttttttcttggcgtgttctggaggagcaaaccaaaatgtgtgcaccgactgactgaatccatgacccattggggacaggaattgtgcttcgtcgtgtacccacaggacgctccagaggaagaagaaaacggcccgtgccctccctctctgctacctgctaccgataagcccagtaaacctcagtag

SEQ ID NO: 30433 - DNA, 1080 bp, Artificial Sequence
  Description of Artificial Sequence: Synthetic coding sequence
atggccccaaacggcacagcctccagcttttgtcttgacagcacagcatgtaagattaccattaccgtggtgctcgctgtgcttatcctgatcaccgtcgccggcaatgtggtagtttgtctggccgtcggactcaaccgacgcctcaggaacttgactaattgtttcatagtgtcacttgcgatcacggacctgctcttgggtctgttagtgctgccattttcggcaatctatcaattgtcttgtaagtggtcctttgggaaggtgttctgcaatatttacacgtcactggatgtaatgctctgcacagcttcgatacttaacctgttcatgattagtctggatcgatactgcgccgtaatggaccccctgcggtatcccgtgctggttacaccagtacgtgtggccatttcgctggtcctgatatgggtgatctctataaccctgtctttcttatctatacacctgggttggaatagtcggaacgagacctccaagggcaaccacactacctctaaatgtaaagttcaagtgaacgaagtgtacgggctggtagacggactggtaaccttctatctgcccctgctgatcatgtgtattacatactatcgaatcttcaaagtggccagagaccaggccaaacgaatcaaccacatcagctcatggaaggccgccacaatcagagaacacaaggctaccgtcactctggccgccgttatgggtgcctttatcatctgttggtttccatattttacagcatttgtatatcgaggtctgagaggggatgacgccataaacgaggttctggaggcaatagtgttgtggctgggctacgctaactctgcgctgaatccaatcctgtatgcagcgctgaaccgcgatttcagaacagggtatcagcaattgttctgttgtcggctggccaatagaaactcccacaagactagtctcaggtcaaacgctagccagctaagccggacccaaagcagagaaccccggcaacaggaagagaaaccattaaagcttcaggtttggtctggcacagaggtaacagctcctcagggtgcaactgatagatag

SEQ ID NO: 30434 - DNA, 1296 bp, Artificial Sequence
  Description of Artificial Sequence: Synthetic coding sequence
atgagtgtcaatgtgaaccggtccgtttccgatcagttctaccgatataaaatgcctaggctgattgcgaaggttgaaggcaaggggaatggcatcaaaacagtcatcgtcaacatggttgacgtggccaaggcactgaatcggcccccaacatatccaaccaagtacttcggatgcgagcttggtgcccagactcaattcgacgtcaaaaatgatcgctatattgttaacggcagtcatgaggcaaataaactgcaggatatgctcgatggtttcattaaaaagttcgtgttgtgcccagagtgcgaaaacccggagactgacctgcacgttaaccctaagaaacagacaatcggtaacagttgtaaggcttgcggttacaggggcatgctggatacacaccataaactgtgcacatttatcctgaaaaatccgccagagaactcagatagcgggacaggcaaaaaggagaaggagaagaagaatcggaaaggaaaggataaggaaaatggcagcgtgtccagttctgagaccccgcctcctcccccacctccaaacgagataaatcctcctccccacactatggaggaagaggaggacgacgattggggagaggatacaacagaggaggcccagcgccgtcgcatggacgaaatcagcgatcatgccaaagtcctaacactctcagacgatctggagcggaccattgaggaacgggtaaacattctttttgattttgtgaagaagaagaaggaggagggcgtaatcgattccagcgataaggaaatcgtggcagaggcggaacgtctagatgttaaggccatgggtccccttgttttgacggaggtcctattcaacgaaaagataagagaacagattaaaaagtacaggagacattttctccgtttttgccataacaacaaaaaagcccaacgttaccttttacacggattggaatgcgtagtggcgatgcaccaggctcagctgatctctaagataccccatatccttaaagaaatgtacgatgccgatctgctggaggaggaagttattatcagttggagtgagaaagcctccaaaaagtacgtctctaaggagctggctaaagaaattcgcgtgaaagctgagccctttattaaatggctcaaggaggccgaggaggaatcatcagggggcgaagaggaagacgaggacgagaacattgaagtcgtttattcaaaagcggcttcggtcccaaaagtagaaactgtgaagtccgacaacaaggatgatgatatagatatcgacgcaatctag

SEQ ID NO: 30435 - DNA, 2766 bp, Artificial Sequence
  Description of Artificial Sequence: Synthetic coding sequence
atggcttggctgaggctgcagccactcacctctgctttcctacattttggtctcgttaccttcgttctcttccttaacggactgagggctgaggcaggcgggtcaggagacgtgccttctacaggacagaataatgagtcctgttcaggtagcagcgactgtaaggagggagtgatactcccaatctggtatccagaaaacccctccctcggtgataagattgctagagttatagtatactttgtagcccttatctatatgttcttgggcgtgtctatcatcgcagataggttcatggcatcaatagaagtgataaccagtcaggaaagagaggtcaccatcaaaaaaccaaacggggaaaccagtacaacaactatcagggtgtggaacgaaactgtttctaatctgactctcatggccctaggatccagcgctcccgagattctgctgagcctgatcgaagtctgcggacatggtttcatagccggcgatttaggaccctccaccatcgttgggagcgccgcctttaatatgtttatcatcatcggcatctgtgtgtacgttatccccgatggggagacccgaaagataaagcatctgagagtattcttcatcaccgccgcctggagcatttttgcctacatctggctttatatgattttagctgtgttctctcccggagtcgtgcaggtgtgggagggactgctcaccctgttttttttcccggtctgtgttcttctcgcttgggtggcggacaaaaggttattattctacaaatatatgcacaagaaatataggaccgataagcataggggaataattatcgagactgagggcgatcacccaaaagggatcgagatggatggtaaaatgatgaactcccactttctggatggcaaccttgttcccctggagggtaaagaggtagacgaatccaggagagagatgattcggatcttgaaagacctaaagcagaaacacccagagaaagatctggaccagttagtcgaaatggcgaattattacgccttgtcccaccagcagaagtcacgcgccttctatagaatccaggccactcgcatgatgacaggcgctgggaacatcctcaaaaaacacgcagccgagcaggccaagaaggcgagctccatgagcgaggtgcacaccgatgagcccgaggacttcatttctaaagtcttctttgacccttgctcctaccagtgccttgagaactgcggagccgttctgctaactgtggtgagaaaggggggcgacatgagcaagacaatgtatgtggattacaagaccgaagatggttctgcaaatgccggagcagactacgagtttaccgagggaaccgtggtcctcaaacccggggaaacccagaaggaatttagcgttggcattatcgatgacgatatcttcgaagaggatgaacactttttcgtgcggttgtcaaatgtgaggatcgaagaggaacagcctgaagaaggcatgcccccagcaatctttaatagtctccccttacccagggctgttctcgccagcccttgcgtggccacggtcacaattttagatgacgatcatgccggtatcttcactttcgagtgcgatacaattcatgtgtcggaatccataggagttatggaagtgaaagtgttgaggacaagcggcgcccgcggcactgtgatagtccccttccggaccgttgagggcactgccaaaggcggcggtgaggatttcgaggatacatatggggaactggagttcaaaaacgacgagacagttaagaccattagggtgaagatcgtcgatgaggaggagtacgagagacaagagaattttttcattgccctgggggaacccaaatggatggaaagggggatttccgacgttactgacaggaagctgaccatggaggaggaggaagcaaagcgtattgccgagatggggaagcccgtcttgggcgagcaccccaaattggaagttatcatagaggaaagttacgaatttaagaccaccgtggataaactgataaaaaaaactaatctggccctggtggtgggcacccattcatggagagaccagtttatggaggccattaccgttagtgctgccggggatgaagatgaggatgagagtggcgaggagagattgccaagctgcttcgactacgtaatgcactttttaaccgtcttctggaaggttctcttcgcttgcgtgccaccaacggagtactgccacgggtgggcttgttttgcagtgtccatactcatcatcggcatgctcacagcaataataggagatcttgcttcacacttcgggtgcaccatagggttgaaagattcggtgactgcagtggtgtttgttgcgtttggtacgtccgtgccagatacatttgccagcaaggccgccgccttacaggatgtctatgcagatgcgtcaataggcaacgtcaccgggtctaacgcagtgaatgtgtttctcggaatcggcttggcctggtccgtggcagcaatatactgggctctgcagggacaagaatttcacgtatccgcgggaaccctagctttctccgttactctgttcactatcttcgcctttgtgtgtatcagtgttcttttgtatcgtcgccgcccccatcttggaggtgaactcggaggtcctcggggatgtaagctggctacaacctggcttttcgtgtcactatggctgctgtacattctgtttgcaactctggaggcatactgctatatcaaggggttctag

SEQ ID NO: 30436 - DNA, 2778 bp, Artificial Sequence
  Description of Artificial Sequence: Synthetic coding sequence
atggcttggctgcggctacagcctcttactagcgcatttcttcactttgggttggtgacctttgtactgttccttaatggcctccgggccgaggccggcgggtcgggggatgtcccctccaccggacagaacaatgaatcatgctctgggtccagtgactgcaaggagggcgtaatcctgcctatttggtatcccgaaaatccttctctgggagacaaaatcgccagagttattgtttactttgttgcgctaatctacatgttcctcggggtctctatcattgccgatagattcatggcttcgattgaagtgattaccagccaggagagggaggttaccatcaagaagcccaacggggaaacctccacaacgacaatcagagtctggaacgaaaccgtctccaacctgacattgatggcgttgggctcctcagcccctgaaatcttactcagcctgatagaagtatgcggccatggcttcattgcaggcgatttggggccctcgactattgtggggtccgcagcgttcaatatgtttatcattatcgggatctgtgtgtacgtgattccagacggcgaaacgcggaaaattaaacacctgcgggtgttctttattacagccgcctggtcgatcttcgcctacatatggctatatatgatcctcgccgttttcagccctggtgtggtgcaagtttgggaaggcttgctcaccttgtttttcttccctgtgtgcgtgctgttagcttgggtcgcagacaagcgcctcctgttttataaatatatgcacaaaaaataccgcactgataaacatagagggatcatcatagagacagaaggcgatcatccaaaaggaatcgaaatggacggaaagatgatgaactcacactttttagatggtaatctcgttccgcttgaaggaaaggaggtggatgaatcacgccgcgagatgatccgtatcctcaaagaccttaagcaaaagcatcctgaaaaggatctcgaccagctcgtggagatggccaattactatgcgcttagtcatcagcagaagagccgtgctttctacaggatccaggccactagaatgatgaccggtgccggtaatattcttaagaaacacgctgccgagcaggccaaaaaggcttcatccatgtctgaagtccacacagatgaacctgaagatttcatctcaaaggtctttttcgacccatgttcctatcagtgcctagaaaactgtggcgccgtgctgctaaccgtggtccgaaagggcggcgacatgagcaaaacgatgtatgtcgactacaaaacggaagatggtagtgccaatgcaggagcagactacgaatttacggagggcactgttgtcttaaaacctggagaaactcagaaggagttcagtgtgggcattatcgacgacgacatttttgaggaagatgaacacttttttgtccggctgagtaatgttcgcattgaggaagagcagccagaggagggtatgccccctgcgattttcaactcgctgcccttacctagggcagtgttggcctccccttgtgtggccacagtgaccatactggacgacgaccacgcaggtatcttcacatttgaatgcgacactatacacgtgagcgagtcgatcggcgtgatggaggtgaaagttttgaggaccagcggcgcaaggggcaccgtgattgttccctttcgaacagttgagggaactgccaaaggaggcggagaggacttcgaagacacctacggagagctggaatttaaaaacgacgagacagtgaagacaattcacatcaaagtgatcgatgacgaggcatacgagaagaataagaattacttcattgaaatgatgggcccacgtatggtagatatgagtttccaaaaagcactcctcctcagcccagaccgcaagttaaccatggaggaagaggaagccaagcgcatagccgaaatggggaaaccagtgctgggagagcaccccaaactcgaagtgattatcgaggagagttatgagtttaagactacggttgataaactgatcaaaaagactaatctggcgctggtggtcgggacccattcttggcgcgaccagttcatggaagctatcacagtgtccgccgccggggacgaggatgaagatgagagtggggaggagcgccttcccagctgttttgactatgtcatgcacttcttgactgtgttctggaaagttctgttcgcgtgcgtacctcccactgagtattgccacgggtgggcctgtttcgcggtcagtattcttatcataggtatgttgaccgcaatcataggtgaccttgccagccacttcggttgtacaatcggcctgaaggattccgtaacagcggtcgtgtttgtggccttcggtacatccgttcccgatacttttgcctctaaagctgcagccttgcaggatgtgtatgccgatgccagcataggaaacgtcactggctctaatgccgtgaatgtgtttctgggcatcggtttggcctggagcgttgccgccatctattgggcgttgcagggacaggaatttcatgtatccgccgggactctagccttctccgttacactcttcacaatctttgctttcgtgtgcataagcgttctcctgtataggcgccgtcctcatctcggaggggagctcggtggaccccggggctgcaagttggctaccacatggctgtttgttagcttgtggctcctttatattctattcgctaccctggaggcgtactgctatataaaagggttctag

SEQ ID NO: 30437 - DNA, 2784 bp, Artificial Sequence
  Description of Artificial Sequence: Synthetic coding sequence
atggcgtggttaagactgcagcctctcaccagtgcctttttacatttcggtctggtgacgttcgtcctctttctgaacggactcagggccgaagcaggagggtccggggatgttccaagtaccggccaaaataatgaaagttgttcaggctccagtgactgtaaggagggggtgattctgcctatctggtatccggagaacccaagccttggcgacaagatcgccagggttatagtgtactttgtcgctttgatttatatgtttctaggcgtgtccattatcgctgatcgcttcatggccagtatcgaggtcattacgtctcaagagcgagaggtgactattaaaaagccaaatggtgagacatcaacaacaacaattcgcgtctggaacgagacagttagtaatctgacgctcatggccctcggatcctcggcccctgagatcctcctgtccctcatagaggtttgcggccatggcttcatcgctggcgatctgggcccatcaactatagttggcagtgccgcattcaatatgtttattatcatcggcatttgcgtttatgtgatccccgacggcgagaccagaaagattaagcaccttagggtgttctttatcaccgcagcctggagcatcttcgcctacatctggctgtacatgatcctggccgtgtttagtcctggcgttgtgcaggtttgggaggggttgttaactcttttcttcttcccggtttgcgtccttctcgcctgggtcgccgataagaggctcttattctataagtatatgcataagaaataccggactgacaagcatagggggatcattattgaaaccgaaggagaccacccaaagggaatcgagatggacggtaagatgatgaactcacactttctggatggtaatctggtgcctctggagggaaaagaagtggatgaaagcaggcgcgaaatgattcgaatactgaaggatctgaaacagaaacacccagagaaagatctggaccagctcgtggaaatggccaactactacgccctaagccatcagcaaaaatcccgggctttttaccggattcaggctacccgcatgatgactggcgccggcaatatcctgaagaagcacgcagccgaacaggccaaaaaagcatccagcatgagcgaagtgcatactgatgagccagaggactttatttcgaaagtattctttgatccttgtagttatcagtgtcttgagaactgcggggcggtgctgctcaccgtggtgagaaagggaggagacatgagcaagactatgtacgtcgattacaaaacagaggatggcagcgccaatgccggagcggactatgaatttacagagggcacagttgttctcaagcctggagagacccagaaagaattcagcgttggcatcatcgacgacgatatttttgaagaagatgagcatttttttgtgaggctctccaacgtgcggatcgaggaggagcagccagaagaaggaatgccgcccgcgatatttaactcattacccctgccacgggctgtactcgcctccccttgcgtggccaccgtcactattttggatgatgaccacgccggcatattcacattcgagtgtgacaccatccacgtttcagaatcaattggcgtgatggaagtcaaggtccttcggactagtggagcaaggggaaccgtcatcgttccatttaggactgtcgagggcaccgcgaagggaggtggcgaagacttcgaggacacatacggtgagctagagtttaaaaatgacgaaactgtcaagacgatcagggttaagatcgtcgatgaagaagaatacgagagacaggagaatttttttatcgcactgggcgagcccaagtggatggagcgcgggatctccgctctcctgctgagcccggatgtcaccgatcgtaagctgacaatggaggaagaagaggctaagcggatagctgagatggggaagcctgttttgggggaacacccgaagctggaagtaatcattgaagagtcctatgaatttaagactactgttgacaagctgatcaagaaaacaaacctggcactcgtagtcggtacccattcctggcgggaccagtttatggaggcaattacggtgagtgctgccggcgatgaggatgaagacgagtctggagaagaacgcctgccttcctgttttgactacgtcatgcacttcttaaccgtgttctggaaggtgctgtttgcttgcgtgccccccaccgaatactgccacggctgggcttgttttgccgtaagcattttgataataggtatgctgaccgctatcatcggcgatttggcaagccactttggctgcacgattggactgaaagatagcgtgacagcagtcgtcttcgtggccttcggcaccagcgttccagacaccttcgcctcaaaggcagccgccctccaggacgtgtacgccgacgcatctataggcaacgtaacaggatcaaacgctgtcaacgtctttctgggaatagggctggcttggagtgtagctgcgatttattgggctctgcaggggcaggagtttcatgtgtcagcaggcactcttgcttttagcgtgaccctattcacaatctttgcgttcgtgtgcatcagcgtccttctctatcgccgaagaccccacttaggtggagaacttggcggcccgcgtggttgtaagctggcaacaacctggctctttgtctccctttggctgttgtacatcctgtttgctacgttggaggcctactgctatattaagggcttttag

SEQ ID NO: 30438 - DNA, 855 bp, Artificial Sequence
  Description of Artificial Sequence: Synthetic coding sequence
atggaggaggaggaggcaaagcggatcgccgaaatgggaaaacctgtgttgggagagcatccgaagctagaggtcatcatagaagagtcttacgaattcaagaccacagtggataagttgatcaagaagacaaacttagcgctcgtagtgggaacacacagctggcgggaccagtttatggaggctataacagtctccgcggccggtgatgaggacgaggatgagtcgggtgaagagcgactccctagctgctttgattacgttatgcatttccttacagtgttctggaaagtgctgttcgcgtgcgttcctccgacagagtactgccacggttgggcgtgcttcgccgtgtccatacttatcatcggcatgctcactgctataattggggaccttgcctcccatttcggctgtactatcggcctgaaggacagtgttacggccgtggttttcgttgccttcggcacttccgtcccggatacctttgctagcaaagcggccgctctccaggatgtatacgcagatgcctctattggcaatgtcaccggcagcaatgccgtcaatgtgttcctaggcatcggcttggcttggtcagtagccgcgatttattgggctttacagggacaggaatttcatgtgagcgccgggacgcttgctttctccgtgacccttttcaccattttcgccttcgtctgcatttctgtgctgctatacaggcggaggcctcatctggggggggagctgggcggaccgcgaggctgtaaactggctacgacttggttgtttgtcagcctgtggttgctgtatatcctattcgccacactcgaggcatattgctacatcaaaggtttttag

SEQ ID NO: 30439 - DNA, 1863 bp, Artificial Sequence
  Description of Artificial Sequence: Synthetic coding sequence
atggcttggcttcgattgcagcctctgacatctgcattccttcatttcggccttgtgacctttgtgctgtttctgaacggccttagagccgaagcggggggtagcggagacgttcccagcaccgggcagaacaacgagagttgcagcggctcctccgactgcaaggagggggtgatactgcctatatggtatcctgagaacccaagtctgggggacaaaattgcccgtgttattgtgtattttgtggcactgatctacatgtttctgggcgtgagcattatcgcagatcggttcatggcctctattgaagtgatcaccagtcaggaaagagaggttactataaagaaaccaaacggggagacttctacaactacaatcagggtgtggaacgaaacagtgtctaaccttactttgatggctctcgggtcatcggccccagagatactgctgtctctgattgaggtgtgcgggcacggttttattgccggagatctcggcccatcaaccatcgtgggatccgcggcgtttaatatgtttattatcatcggcatttgcgtatatgtgatccccgatggcgagacgcgcaagattaaacacctcagggtgttctttattactgccgcctggagcatttttgcgtacatctggttgtacatgattctggcagtgttttccccgggcgtggtccaggtgtgggaaggcctgctaaccctgtttttttttcctgtttgtgtactcctggcatgggttgccgataaacgcctgttattttacaagtatatgcataagaagtaccggaccgataagcacagaggcatcattatcgaaactgagggggaccatcccaagggcattgagatggatggcaaaatgatgaattcccatttcctcgatggaaatctggtgcccctggagggaaaagaggtcgacgagagtcgcagggagatgatccgaatcttgaaggacctgaagcagaagcacccagagaaggacctggaccagctggttgagatggctaactactatgcactctctcaccagcagaaatcacgagccttttatcgtatccaggccacgagaatgatgacaggagccggcaatatcctgaagaaacatgcggcagaacaggcgaagaaagcatcgtcaatgagtgaagtgcatacagacgagccagaggacttcatctccaaggtgtttttcgatccatgtagttaccagtgtctggaaaactgcggtgccgtgcttttgaccgtagttcgaaaggggggcgacatgtccaaaaccatgtacgtagattataagactgaggatggatccgcaaacgccggggccgactacgaatttactgaaggaacggtggtgctaaagcctggcgaaacgcaaaaagagttttctgtaggtattattgacgacgatatttttgaggaggatgagcattttttcgtgcgtttgtctaacgtgaggattgaggaggagcagcctgaggaaggtatgccaccggcaatctttaactccctgcctctgccacgggcagtgctcgcctctccgtgcgtagctactgttaccatcctggatgacgaccacgccggaatttttacatttgagtgtgacacaatccacgtgagcgagagtattggtgttatggaagtaaaggtgctcaggacctccggtgcgaggggcacggttatagttccgtttcggaccgtcgagggaaccgcaaaaggggggggggaggactttgaagatacctatggcgagctcgaattcaagaatgacgaaactgtctgcgatagacaagaggccgactacggccggcgtggtggccaggaggatagccgagatgggaaagccagtatcggctag

SEQ ID NO: 30440 - DNA, 2778 bp, Artificial Sequence
  Description of Artificial Sequence: Synthetic coding sequence
atggcatggttgcgccttcagccactgactagcgctttcctgcatttcggactggtgacgtttgtgctctttttgaacggcctgcgtgccgaagcaggtggctctggcgacgttcctagtacaggccagaacaacgaatcttgctctggctcctctgactgtaaagagggagtaatcttacccatctggtaccccgaaaatccatcgctgggggacaagatcgccagggtcattgtgtattttgtcgcgcttatatacatgttcttgggagtatctattatagccgacaggttcatggcctccatagaagtgatcactagccaagagcgggaggttactatcaaaaagcccaatggtgaaacttctactactactattagagtttggaacgagaccgtcagcaatttaacactaatggccttgggatctagcgcccctgaaattctgctttcattgatcgaggtgtgtggacacggcttcattgccggtgatttaggcccctccacaatcgtggggagcgctgcatttaacatgtttatcatcattggaatttgcgtgtacgtgattcctgatggagagactcggaagatcaaacatctgagagttttttttattaccgctgcttggagcatcttcgcgtacatttggctatacatgatcttggcggtgtttagcccaggggtggtacaagtctgggaaggcttgctcacactcttcttcttccccgtgtgcgtgttacttgcttgggtggccgacaaacggctcctgttctacaagtacatgcacaaaaaatatcggaccgacaagcatcgagggatcataattgaaactgaaggggatcatccaaagggtattgagatggacgggaagatgatgaactcccattttctggatggcaatctggtgcctctggaaggcaaagaagtcgacgaatccagacgggagatgattagaattctgaaagacttgaagcagaagcacccagagaaggacctggaccagctcgttgagatggccaattattacgccctgtcacatcagcagaaatcgcgagccttttacaggattcaggccacaaggatgatgacaggggccggaaatatcctgaaaaagcacgcagcggagcaggcgaaaaaggcgtcctcaatgagtgaagtgcataccgacgagcctgaagacttcataagcaaggtcttctttgacccctgttcctatcaatgtctggaaaactgcggggctgtcctccttacagttgtgaggaaggggggagacatgtcaaagaccatgtatgtggattataagacagaagacggcagcgctaacgcaggtgcagactacgaattcaccgaaggcaccgtcgtacttaaacctggcgagacccagaaagagttctccgtgggcattatagacgatgacatatttgaggaagatgagcattttttcgttagactgagcaacgtgagaatagaggaggagcagccagaagaaggcatgcctcccgcaatctttaatagccttcctcttcctagggccgtgcttgcctccccctgcgtcgccaccgtcacaatcttagatgatgatcacgcagggatatttacttttgagtgtgatacgatccatgtaagcgagagcatcggggtgatggaggtgaaagtgctgagaacaagtggggccagaggcacagtcattgtgcccttcagaaccgttgaaggcaccgctaaagggggtggagaggatttcgaggacacctatggcgagttagaattcaagaacgatgagacggtgaagactattcacattaaagtgatagatgacgaagcttacgaaaagaacaagaattatttcatcgaaatgatgggtcccaggatggtagacatgtccttccagaaggccctattgttaagcccagacagaaaacttacgatggaggaggaggaggctaagagaatcgctgaaatggggaagcctgtgctaggggaacaccctaagcttgaagtgattatcgaagagagctatgaattcaagactacagtcgataaactcatcaaaaaaacaaatctcgccttggtcgtagggactcattcctggagggatcagttcatggaagccatcaccgtttccgcggctggtgacgaggacgaggacgagagtggtgaggagcgtctgccgagctgtttcgattacgtcatgcattttctgacagttttttggaaggttctgtttgcttgtgtaccccctacagaatactgccacgggtgggcgtgtttcgccgtgagtattctgatcataggcatgttgaccgccataattggcgatctagcctcacacttcggatgcacaatcgggcttaaggacagcgtcaccgccgtcgtgttcgtggcattcggcacaagtgtacccgacacctttgcttctaaagccgctgccctgcaggatgtgtacgcagatgcgtcaattggaaatgttaccggctctaacgctgtgaatgtgttcctaggaatcggcttagcctggtccgtggctgccatttattgggccctccagggacaggagtttcatgtttctgcaggtaccctcgctttttcggtgacactgttcacaatctttgcattcgtctgcatatctgtgcttctgtacaggcggcgtcctcacctagggggcgaacttggcggaccccgcggctgcaaactggcgactacctggctgtttgtgtccctctggctactgtacatcctgttcgctacacttgaagcttactgttacatcaagggcttttag

SEQ ID NO: 30441 - DNA, 2775 bp, Artificial Sequence
  Description of Artificial Sequence: Synthetic coding sequence
atggcatggctccgcttgcagcctctgactagcgccttcctccattttgggctcgttacgtttgtccttttcttaaatgggctgcgcgccgaggccggcgggtctggagacgttcccagcaccggccagaacaatgagagctgttccggctctagcgactgcaaggaaggcgttatcctccccatttggtaccccgaaaaccccagccttggcgataaaatcgcacgagtgatcgtgtacttcgtggccctcatctatatgtttctcggtgtcagcataatcgcggaccgtttcatggcttctattgaggtcattacctctcaggaacgagaagtaaccatcaaaaaaccaaacggcgaaacctctacgactaccatcagggtatggaacgagactgtcagcaacctgaccctgatggctttgggaagtagcgcccccgaaatactactcagcctgattgaggtctgtgggcatgggttcatcgccggcgatttgggccctagcacaatcgtgggttccgccgctttcaacatgttcatcattattggcatctgtgtctatgtaattccggacggggagaccaggaagataaagcacctgcgggtgttcttcattaccgcggcttggtccattttcgcttatatctggttgtacatgatactggcagtgttcagtccgggggtagtgcaggtctgggagggacttctcaccctttttttcttccccgtgtgcgtgctcctggcctgggtggcagacaaaagattacttttctataaatatatgcataagaaatatagaacggacaagcaccgcggcatcatcatcgagacagaaggcgaccaccctaaagggattgaaatggacggaaagatgatgaactcacattttttggatggcaacctggtccctctggaggggaaggaagtcgatgagtcacggcgcgagatgatcaggattctgaaagacctgaaacagaagcacccggaaaaggacttagatcagctggttgaaatggctaattattacgccctctctcaccaacagaagagtagggcattctaccgtattcaagctacacggatgatgaccggggccggaaatatactgaaaaagcacgctgctgagcaagcaaagaaggcatcaagcatgtccgaagtacatacggatgagcccgaggactttattagcaaggtgttttttgacccctgcagctaccagtgccttgagaactgcggcgcggtgctgcttacggtagtgcgcaaggggggcgatatgtcaaaaaccatgtacgtagattataagaccgaggacggttccgctaatgctggcgctgactacgaatttactgagggaactgtggtgctcaaacctggtgagacccagaaggagttctctgttgggatcattgacgacgacatttttgaggaagatgagcacttctttgtgcgcttgagtaatgtgcgtatcgaggaagaacagcccgaggagggcatgccacccgcaatctttaactctctgcccctacctcgggccgtattagcctcaccttgtgtggctacagtgaccatcctggacgatgatcatgctggtatattcacattcgagtgtgacactattcacgttagcgagtcaataggggtgatggaagtcaaggtcctcagaactagcggtgccaggggaactgtgatagtccccttccggactgttgaggggacggcgaagggaggtggggaagacttcgaagacacatacggggagctcgaattcaagaacgacgagaccgtaaaaacaatccgagtaaagattgtagatgaggaagagtatgaaaggcaggagaatttttttattgcactaggcgagcccaagtggatggagcgaggaatctcggccctactgctgtctcctgatcgaaaactgaccatggaggaagaggaagccaagagaatcgcagagatgggaaaaccagtgttaggcgagcatccaaaactcgaggtcatcatcgaagagagttacgagttcaaaacgacggtggacaagttgataaaaaagactaacctcgctctagtggttggaacacacagttggcgtgaccagttcatggaagcaatcacagtgtcagccgctggcgatgaggacgaggatgagagcggagaagagcggctgccaagctgctttgactacgtgatgcactttttgacagtattctggaaagtcctgttcgcctgtgtgcctccaaccgagtactgtcatggctgggcttgcttcgcagttagcatcttgatcattggcatgcttaccgccatcattggagacctggccagtcatttcggatgcacaattggcctcaaagattccgttaccgccgtcgtctttgtggcttttggcacatctgtgcccgacacctttgcaagtaaagccgcagccttgcaggacgtctacgccgacgcttccattggcaatgtgacaggctcaaacgctgtaaacgtttttctgggtattggcctggcttggagcgtcgcagctatttactgggcccttcagggccaggagttccacgtcagcgccggcacactggcctttagcgtgacactcttcacaattttcgcgtttgtgtgtatcagtgtcctcctataccgcaggcggcctcacttgggcggcgagctgggcgggccacgggggtgtaaattggccaccacatggctattcgttagcctgtggttgttgtacattctctttgccactttagaggcttattgctacataaaggggttttag

SEQ ID NO: 30442 - DNA, 3375 bp, Artificial Sequence
  Description of Artificial Sequence: Synthetic coding sequence
atgtcctcttatttttgggcacagaatgaatctaacagaccagatctgctctgcggacagcctgcagactacctcgtggaagagaaacacttcaccactctagtgtgtttcatagttgtattgggtggactattgaaaatgtgtctcaagaattgcgaggtaattgttctcacaattctgtccctctctggtttcgttataggacacatggcatacaactctgtggaggtccaccaaatcgtgtaccccctgctgcggacaagctctttctccctctattcctatttctcaccattaatcatttttatggtggccttagacgtagaattttacaccctgaagaaaatgttttggcaggtccttctgacagggctcatcagtttctctactgcttccattattattgggtacgtcgtcatcaagtttaacaaggactcatgggaccttcaatcttgtctcttattctctataacattaggtatcatcgaccccctgcggtcagtgaacagcctcaagactatcggaataagtaagatctacatcgacctcattaggggggagtctctgatcatttgttcaatagcaagcatttttttcggaaatttcaggggaaacagaattcacttttccatcttcagagacttgcatgtgggaatcgagctctcttatgacatactaggatccatcatctttgggtactggtgtgccaaaatcatccagtgtatactcgcagatgtgttcagcaatatgctgaccaacatcattttatgctttagtatggtgtatatgaccttctatattgtcgaatttctcgggatgtcaggcactctggctttagcagcagtggggctaaatctcgactcgttgacattcaagcctaagatagaactagtgattaccaagtttctccgaattttctcaagtgtttacgagcatctcatttatgcatttttcgggattgttatcggttgcggtgaattgagccactacgaatttcacacaataccctttatcttcattctgtttactacagtgaatctggtgcgcctgcttacgatcttgctggtgtcacctatcctgatgcacagcaactacgagtacaactggcgttggggcgtcgtgattacgtggagtggaatcaagggagtcttcaatctgttgtgggcacccgacgtatataacctggccgaaagaaaggtagaggtgcctcagatgttcattctctacgtccaggtgatctccctcctgaccatggggataaacagctacgtgatgacacagtctgctaggaaactggacttgtgcgtgcttagtcttcctcgccagatgatccttcagaatgctactcagcatatccaagagatcgtgcagaacaccataacgcttttcaaaaccgagaaaatactgaccaacgtgaactggacgctggttgaggataagacccgaatcgagtatatcccattttctcacgtttcccacaatgacatgaagacagagtcgactacggatgaggcactgatggaggaagccagactccatgtggcggcaatccaaatgtcttctttcgagaagcagcggaataatggcatcctggaaatcgaagctgctcgcatacttattggtgccgccaagtgttattattcaatacagggaaaattcatgagcatttatgacgtcagcacctatatgcgcaccagatcctggttaatcaaattcaaaaacgtcctgaccttcctcgagtattgtatcgagaaaatccacttcattccaccggagtcaaataccttccttacattcatcttccatatcgtcttttcggaagaatttgaatacaccgggcaaattatcaacctaatctacatttatcccatgataattcacctgtggccgatggcccgtggattaaatgtgagtgcactgataagcattaattactactttatgtttctttatgtcttggagagcaccctgaaaatcattattctgaaaaggaaatacttccaacagtgctggaacactctggagttttttattctggttataggtataatcgacatattttgcgtatatttcgtcaaattacgccccgataatttggctctgatccagctgactgttattatgggatacctgagaattatcagattcctcccgcttttcaagattatagtgccaatacttatcaggattgccgatgtccagatcaaaaaaagactaagcctgatgtacagcatcacaaaagggtatattaaaagccaggaagacgccaagctgcttatcaagcagatcgctgtgtgtgagagcatttatcagaagctctgcgaaatcttagagaccaataagcaggatgctgtgaaagagctagttctgatggaacatgaagggcgggacgtggtcattgccctgaagacaaaacaagctatcagaaatgtgattgccaaagcccttaagaacctcacatttttatgcagtcgaggtatcatagacaagcacgaagttattgagattaataaggtactgctgaaaaagctaaaagcccttaacaatttcccaaaagctattcctcccccaacacccgacatttacctgcataatattatctggctcgagggaaaggacgtacttatcgacttcttcaaggagcgcgcaaaattggcctgttttgatagtggggacacaatctgcaaaggaggtgagatgccacagggaatttatctgattataagtgggatggccatccttcatagcctcagccccacgtttggaatcgaaagcaatcagaggtgcgaccggggatctagagacatgttcactgagttctgcacgactggagatatcatcggcgaactctcgtgcctgctcaaaagggaaatagaatataccgtgatttgcgagacgtcccttcaggcttgttttatcagcctcgaggacctctacgagggctttgacgcattctggccttctctagagtataagatttggctaaaactggcactcagtacagcctatcagtactttgagtcatccctgattgatgaggacttaaggttccagaattgtgtcatgttcaatcaagcttacgtggagaccctttcctcttacagcgatatgataattgacaatatgaccatgaaattcgtcattattgtttacgggtctgtcattgataccaaaacggaagagccttactttgccccttgcatcattccgactacttgtgaacaggttcaaggtacaagcgacctgtcgaagctgctgatcatacaggcgagtgagcttacacaaaggaattccaatactaacgtcatggcatccgtgaatacggtttttgagcagccagggaagaatatcaacggaaggcagaaaatgtcttag

SEQ ID NO: 30443 - DNA, 1353 bp, Artificial Sequence
  Description of Artificial Sequence: Synthetic coding sequence
atggtggctctggacgtcgagttttacaccctcaagaaaatgttctggcaagtgttgctgacagggttgattagcttctctacagcttctatcattattggatatgtggttatcaaattcaacaaggattcttgggatttgcagtcgtgcctgctattctcaatcaccctgggaatcatcgatccacttaggtccgtcaactcccttaaaactatcggcattagtaagatttacattgatctgatccgcggggaatccctaatcatctgttccatagcctcaatcttctttggcaatttccggggaaatagaatccacttttctatctttcgcgatctccacgtgggtattgaactgagttacgacatactaggttccattattttcggctattggtgtgccaaaataatccagtgcattttggcagatgtgttctccaatatgcttactaatatcattctctgtttcagcatggtgtatatgacattttatattgttgaatttctgggcatgtctgggactctcgccctggccgccgtgggtctgaacctagacagtctgacatttaagcccaagatcgaactcgttatcaccaagttcttgaggattttctccagcgtgtacgagcatctcatttacgcttttttcggcatcgtcattggatgtggtgaactgagccactacgagttccacacaatcccttttatctttatactgtttacgactgtgaatctggttagattgctgactattttgctggtgtctcctatacttatgcacagcaattatgagtataactggcgctggggcgtcgtcattacttggtcaggtatcaagggcgtctttaaccttctgtgggcacctgacgtctacaatctcgccgaaaggaaagttgaggtgccacagatgtttattctgtacgtgcaggttatttctctgctgacgatgggaattaattcttacgtaatgacccagtccgcacgcaagttggatctgtgcgttttgagtttgccgcgccagatgatcctgcaaaacgccacccagcacatccaagagattgtccagaacactatcacattgttcaaaaccgagaagatcttgacaaacgtaaactggactctggtcgaagataaaactcgcatcgaatatatcccttttagtcatgttagccacaatgatatgaagaccgaaagcactaccgacgaggccctgatggaggaagcacgtctgcacgtcgctgccatccagatgtcatctttcgagaagcaacgtaataacggaattctcgaaatagaggccgccaggatcctgattggtgctgcaaagtgttactactccatccagggcaagtag

SEQ ID NO: 30444 - DNA, 1548 bp, Artificial Sequence
  Description of Artificial Sequence: Synthetic coding sequence
atgcacacgacggagtccaagaatgagcaccttgaggatgaaaatttccaaacttctactacccctcagtctctcatagatcctaataacactgcacaagaggaaacaaagaccgtcctcagcgacactgaggaaatcaaaccacagactaagaaggagacgtacatctcatgccccctgaggggggtcctgaacgtcataattactaatggcgtgatactctttgtgatctggtgtatgacttggtccattctgggctccgaggccttgcctggcggtaacctcttcgggctgtttatcatattttatagtgccatcatcggcggtaaaatcctgcagttgatccggatcccactcgtgccacccctccccccacttctcggaatgctcctggcagggttcaccattcggaatgtaccttttatcaatgagcatgtgcacgtcccgaatacttggtcctccattctgcggtccatcgctttaacgattattttgatcagggcagggctgggcctcgaccctcaagctcttcgccacctaaaggtggtgtgttttcgactggccgtgggaccctgcttaatggaggccagcgcggcagcagttttttcacattttataatgaagtttccttggcagtgggcttttctcctggggttcgtgctgggggcagtatcacccgccgtggtggtgccatatatgatggtattacaggaaaatggttacggcgtcgaagaaggcattccaactcttctgatggcggctagtagcatggacgacatcctcgccattaccggatttaacacgtgcctgtcgatcgtctttagctccgggggcatcctaaacaatgctatcgcaagcatccgcaatgtgtgcatatcccttctcgccggaattgtattagggtttttcgtgcgttattttccctccgaagatcagaaaaagctgaccctgaagagggggtttctggtgttgaccatgtgcgtctcagccgtgcttgggtctcaacgtattggtctccatggatccgggggcctgtgcactctggtgctcagcttcatcgctgggaccaagtggagccaagaaaagatgaaggtacagaaaattattaccacggtctgggacattttccaacccttactttttggactggtgggtgcggaagtgagtgtgagctccctcgagtctaacatcgtgggcatctctgtagcaaccctgtccttggctctgtgtgtgcgtattctgaccacttacctcctgatgtgttttgccggattttctttcaaagagaaaatcttcatcgcgttggcctggatgccgaaagccaccgtccaggctgtcctcgggccactcgccctggagactgcacgagtctccgccccacacctggaaccatatgctaaagatgtcatgacagtggcgttccttgccattctgatcaccgctccgaatggtgctctcttgatgggcatacttggcccaaaaatgctgacccgccactatgacccctccaagataaaactgcagctatctacacttgaacaccactag

SEQ ID NO: 30445 - DNA, 1428 bp, Artificial Sequence
  Description of Artificial Sequence: Synthetic coding sequence
atgcacacaaccgagagcaagaacgagcacctggaagacgaaaactttcaaactagcactactccacagtctttaatagaccccaacaacacagctcaggaagaaaccaagactgttctgagtgatacagaagagataaagccacagactaaaaaggagacttatatcagctgtccgttgcgaggagtgcttaacgtgatcataactaatggcgtaatcctgttcgttatttggtgcatgacgtggtctattttgggatcagaagcactgccaggcggtaacctctttggattgttcattatcttctactccgccatcattggcggcaaaatcttgcagcttattcggatccccctggtgccacctctgcctcctctcctgggcatgctgctggcggggttcactattcgtaatgtaccgtttatcaatgaacacgttcacgtgcccaatacatggtcatcgattcttcggtccatcgccctcaccattatccttatccgcgctgggttgggactagacccccaggctctgcgccacttgaaagttgtgtgtttccgtttggccgttgggccttgcctgatggaggccagcgccgcagctgttttctcacactttatcatgaagttcccttggcagtgggccttcttgctgggtttcgttctgggggccgtcagccccgcagtggtggtgccctatatgatggtcttgcaggagaacggttacggggttgaggaaggtatccccactctgctaatggcagcctcatcaatggacgacatcttggccataactgggttcaatacatgcctgagcattgtcttttcaagcggggggattttgaacaatgccatcgcttccatccgaaatgtgtgcatttctctactggcaggcattgttctcgggttcttcgtgcgctactttccgagtgaggatcagaaaaagctgacattgaaacgcggctttcttgtattaacaatgtgcgtatccgccgttctgggctctcagcgcatcggactgcacggatcgggtgggctgtgcaccttagtgcttagctttatcgcaggtacgaaatggagtcaggaaaaaatgaaagtgcagaaaattattactacagtgtgggatattttccaaccacttctcttcggcctagttggggcggaagtttcagtatctagtctcgagtccaacattgtagggatcagcgtggccaccctctccttggcactttgcgtgaggatcttgactacatacttgctaatgtgcttcgccggatttagctttaaagagaagatttttattgcgttggcttggatgcccaaggctaccgtccagatcaatcaagccattctcttactttttctccttcgcgaggaatggaccaattgcaaggttgccaagaaatgcgagtacaccaaggagagacagtag

SEQ ID NO: 30446 - DNA, 663 bp, Artificial Sequence
  Description of Artificial Sequence: Synthetic coding sequence
atgcacaccactgagagcaaaaatgaacacctggaagatgagaacttccagactagcacaacccctcagtcactgatagaccctaacaataccgcccaggaggagaccaagacagttctcagtgacaccgaagaaatcaagccacagactaagaaagagacgtatatttcctgccccttacggggcgtcctgaacgtcattatcacaaacggggtaattctgttcgtgatctggtgtatgacctggtccatcttggggagcgaagctctgcctgggggcaatctgtttggcctcttcatcatcttttacagtgcaattatcggcggtaagattttgcagctcatacgcattcccctcgtgcccccattgcctccattgctgggaatgctattagcaggatttacgatccggaatgttccctttattaatgagcacgtccacgtgccaaacacctggtcaagcatcttaaggtctatcgctctgacgatcatcctcattcgggcgggcctgggtctcgacccccaggctcttcggcacctgaaggtggtttgcttcaggcttgcagtggggccctgtctgatggaggcctccgccgccgccgtcttttcccatttcattatgaaatttccttggcagtgggcttttcttcttggattgttctag

SEQ ID NO: 30447 - DNA, 153 bp, Artificial Sequence
  Description of Artificial Sequence: Synthetic coding sequence
atgcacaccactgaaagcaagaacgagcacctcgaagatgaaaactttcagacaagtacaacgccgcagtctctgatcgaccccaataacaccgcgcaagaagagacaaagactgtcctgagcgataccgaggagatcaaacctcagacatag

SEQ ID NO: 30448 - DNA, 1365 bp, Artificial Sequence
  Description of Artificial Sequence: Synthetic coding sequence
atgggagacgaagacaagcgaataacgtacgaggatagcgagcccagtactggtatgaattacacaccatccatgcatcaggaagctcaggaggaaactgtgatgaagctcaaggggatagacgctaacgagcctacagagggctccatcttactgaaatcttctgagaagaaactccaggaaactccaaccgaagcaaatcatgtgcaacgcctaaggcagatgctcgcctgccccccccatgggttgctggatagagtgatcacgaatgtgaccataatcgttttgttatgggcggtagtatggtctatcacaggttcagagtgcctgcccgggggtaacctgttcgggatcatcatactattttactgtgctatcattgggggcaaactgttgggtttgattaagctcccaactctccctccgctgcctagcctgcttgggatgctgctggccggcttcttaataaggaatattcccgtgataaatgacaacgtacaaattaagcacaaatggtcgtcatctttgcgtagcatagcccttagcattatcctcgtccgagccgggctgggcttagactctaaagccctgaaaaaactaaaaggcgtgtgcgtccgattaagcatgggtccatgcatcgtggaagcatgcacgtctgcgctcctcgcacactacctgctcggcctcccatggcagtggggctttattctcggatttgtccttggcgccgtttcccctgctgttgtagtgccaagcatgctgctgctccagggagggggttatggagttgaaaagggcgtccctacactgctgatggcggccggatcgttcgacgatatactggccatcactgggttcaatacatgcctgggaatcgcattcagcactggaagcaccgtgtttaacgtcctgaggggcgtcctggaggtggtgattggagtggccaccggctctgtcctgggattctttattcagtactttccctcgcgggatcaggacaagcttgtctgcaaacgaactttcttggtccttggcttgagcgtgctggcagtcttctctagcgttcatttcggtttccctggaagcggcggtctctgcaccctggtgatggcttttctcgcagggatggggtggaccagtgagaaggctgaggtggagaagatcatcgctgtagcgtgggatatctttcagccactgttgtttggactcatcggcgccgaagtcagcatcgcctccctcagacccgaaacagttggtagcgctgacagtatcactggcaacttcgggaccgagaggccgaagctcttgggaccaccatccacacagctcagatttcattttttccatattcagctgtctacttag

SEQ ID NO: 30449 - DNA, 1614 bp, Artificial Sequence
  Description of Artificial Sequence: Synthetic coding sequence
atgggggatgaggataaacggatcacttacgaggatagcgagccttcaaccggtatgaattacactccctcaatgcatcaggaggcccaggaagagaccgttatgaagctaaaaggtattgatgctaacgaaccaacggaaggcagcattctgttaaagtcatctgaaaagaagctgcaggaaaccccaactgaggcaaatcacgtgcaaagactgcgtcagatgctcgcttgcccgccccacggtttgctggatagggtcattaccaatgtgacaataatcgtcctcctttgggcggtcgtgtggtctatcaccggctcggagtgccttcccggagggaatctgttcggcattattatcctcttttactgcgcaataatcggcgggaaattgctaggtctgatcaaactaccaactctccctccacttccttccttactgggaatgctgttggccggcttcctgatccgaaatattccagtcattaatgacaacgtgcagattaagcataaatggtcttcaagccttcggagcatcgcactctcaatcatactcgttcgagccggactgggattggactccaaagctttaaagaagctaaaaggtgtttgtgtgcgactctcgatgggcccatgtattgtggaggcatgcacatctgctctccttgcccactacctcttgggactgccttggcagtgggggttcatcctgggttttgtcctcggagccgtgagccctgcagttgtggtgccttccatgctgctgctacaaggaggcggatacggtgtggaaaagggggtaccaactctcttaatggccgcaggcagtttcgatgacatcctggccatcaccgggttcaacacgtgcctgggcatcgcatttagcacaggctctacagtcttcaacgtgcttcgcggagtattggaggtggtaatcggcgtggcaaccggctccgtgcttggattttttatccagtactttccgagccgagatcaggataagctggtgtgtaagcggacattcctcgttcttgggctttcagtccttgccgttttttcatctgtacactttggcttccccggctccgggggcctgtgcaccctcgtcatggcctttctggccggaatgggctggacgtctgagaaggctgaggtggaaaagatcattgccgtggcatgggacatatttcagccactcttgttcgggctgatcggcgctgaggttagcatcgcctccttgcgcccggagaccgtggggctttgcgtggctacagtcggaatcgctgtgctaattcgtatcctgactacgtttttaatggtctgcttcgcaggtttcaacttaaaggagaagattttcataagcttcgcctggttgccgaaagcgaccgtacaggcggcgattggcagcgttgccttagacaccgcccgctcccacggagagaagcagttagaagattatggcatggacgtactcactgtggcctttctgtctatccttatcacagccccaatagggtctctcctcataggcctgctaggtcccaggctgcttcaaaaggtggagcaccaaaataaagatgaagaagttcagggcgagactagtgttcaggtgtag

SEQ ID NO: 30450 - DNA, 1614 bp, Artificial Sequence
  Description of Artificial Sequence: Synthetic coding sequence
atgggcgatgaagacaaacgcattacctatgaggattctgaaccctccactgggatgaattatacaccctctatgcaccaggaggcccaggaggaaactgtcatgaagctgaagggaattgacgcaaatgaaccaactgagggcagcatcctgctgaaatcctctgaaaagaagctgcaggagacaccaacagaggcaaatcacgtccaaaggctgcggcaaatgctcgcgtgcccaccacacggacttctggacagagtcatcacaaatgtgacaataattgttctcctgtgggctgtcgtttggtctattacaggctctgaatgtctgccaggtggaaatttattcggtattatcatccttttctattgcgccatcataggagggaagctgcttggccttattaaactacccacgctcccgccgttgccaagcctgctgggaatgctccttgccgggttcctgattcgaaatattcctgtaattaacgataatgtccaaatcaaacataagtggtcatctagtttgcgatcaatcgctttgtcaatcattctcgtgagagctgggctgggcctggactccaaagcgctgaagaagttgaaaggcgtatgtgttcggctgtctatgggaccctgtattgtggaagcttgtacctcagctctgctcgcccattacctccttgggctgccatggcagtgggggtttatcctaggctttgtcttaggggccgtgtcgccggccgtggtcgtcccgtctatgctcctgcttcagggaggcggatacggtgtggagaagggcgtgccaactctcctgatggctgccggatccttcgacgacatcttggctataacaggatttaacacatgcttaggaattgctttcagcaccggaagtacagtgttcaatgtgctgcgcggagtgctggaagtggtgattggtgtggctaccggttcggtcctcggtttctttattcagtactttccgtccagagaccaggacaagctggtttgcaaacggacattcttggtcctgggactatccgttctcgctgtgttctcctccgtccactttggcttcccaggcagtgggggactctgcacccttgtcatggccttcctggctggtatgggctggacctctgagaaggcagaggtggagaaaataatcgcagtagcatgggacatcttccagccgctgcttttcggcttgataggtgctgaggttagcatcgcgtctctgaggcccgagaccgtggggctgtgtgtagctaccgtgggcatagccgtgctgattcgcatattgactacattcctgatggtgtgcttcgccggctttaacctgaaggaaaagatcttcatttccttcgcatggctacccaaggcaacagtccaggcagcaatcggtagtgtcgcacttgacacagcgcggtcccatggggagaagcagctggaggattacggcatggacgtcctgactgtcgctttcctgagcatcctgatcaccgcccccattggaagcttactcatcggcttgctcggccctcggcttctgcagaaggttgagcaccagaataaagatgaagaggtccaaggggagacatctgtgcaggtatag

SEQ ID NO: 30451 - DNA, 1254 bp, Artificial Sequence
  Description of Artificial Sequence: Synthetic coding sequence
atgggtgatgaggataagagaattacgtacgaagactccgaaccatctactgggatgaactacaccccgagtatgcaccaggaggcccaggaggagactgtgatgaagctgaaaggcatcgatgcgaatgagccgacagagggatccattctgttgaaaagctctgagaaaaaactgcaggaaactcccacagaggctaatcatgtgcaaaggttgaggcaaatgctagcctgtcctccgcacggtctgttagatcgggtgattacaaacgggatgctgctggccggattcctaattcgcaacatccctgtcattaatgacaacgtacagattaagcacaagtggtctagctcccttcggtctattgccctaagtattattctggtcagggcggggctcgggctcgacagcaaagccctcaaaaagctgaaaggggtgtgtgttcgcttgtctatggggccctgtattgtagaagcgtgcacctccgcactgcttgctcattatttgctaggcctgccatggcaatggggattcatactgggattcgtactcggggctgtatctcctgccgtcgtcgttcccagtatgttgctgcttcagggtggtggttatggggtcgaaaaaggcgtcccgactctgcttatggccgccggtagtttcgatgatatcctggccatcaccggcttcaacacatgtctgggtatcgctttttccactggatccaccgtttttaacgtactgcgcggcgtgctcgaagtggtcatcggggtggctaccgggtctgtcttgggcttcttcatccagtactttcctagtcgtgaccaggacaagctcgtgtgtaagcggacctttctggtactgggcctgagtgtcttagcggttttctcttcagtgcacttcgggtttccgggcagtgggggattgtgcaccttggtgatggcctttttagccggtatgggttggactagcgaaaaggccgaagtggagaaaatcattgccgtggcctgggatatcttccagcccctcctattcgggttaatcggagccgaggttagcatcgcgtccttgcggccagagactgtcggatgcaatcgtatttgtgggttcgggcatagtaaggtcacttggcgcgaaactatacgaagattatggaacggctgcgttgattcagggatatttgtgcacccacatcactcccccaactggaagtccgcgtattggtttaccggcccccaggccagcgccgagagttag

SEQ ID NO: 30452 - DNA, 1443 bp, Artificial Sequence
  Description of Artificial Sequence: Synthetic coding sequence
atgggggacgaagacaaaaggatcacatacgaggattcggagccttccaccgggatgaactacactccctctatgcaccaggaggcccaagaagagaccgtaatgaaactgaaaggaattgacgccaacgaaccgactgagggtagcatcctgctgaagtccagtgagaaaaagttgcaggagacgcccactgaggctaatcacgtgcagagactccgccaaatgctcgcttgccctccccatggcctgcttgatcgagtgatcactaacggcatgctgctcgcagggttcctgataagaaatattccagtaattaacgacaacgtgcagataaagcacaaatggagttccagtctcagatcaatcgccttgagtataatccttgtgcgtgcgggactggggctggattcaaaagctcttaaaaagctgaagggagtttgcgtcaggttgagtatgggaccttgcattgtggaagcctgtacaagcgctctgttggcccactacctcttaggacttccttggcagtggggatttatcctggggtttgtgttaggagccgtatcccctgcagtcgtggtgcccagtatgctcctgttgcaagggggcggctacggagtcgagaaaggtgtgccaactctcctcatggccgccggctccttcgatgatatccttgccatcactggctttaacacgtgccttggtatagcatttagtactgggtcaacagtgttcaatgtactgcgcggggtactggaggtggtgatcggagtggccacagggtctgtgctgggatttttcattcagtacttccccagtcgggaccaggacaagcttgtctgtaagaggacgtttttggtcctgggcctgtccgtactagccgttttttcttccgtgcacttcggatttcccggttccggtggcctgtgtaccctagtcatggcctttctcgctggcatggggtggacatccgaaaaagcagaagtggaaaaaatcattgccgtggcctgggatatatttcagcctttacttttcggccttatcggcgctgaggtgagcattgcctctcttcgacctgagacagttggcctgtgtgttgctacagtggggatcgctgtcctgatcaggatcctgacgacttttctcatggtttgcttcgccggatttaacctgaaggagaagatctttatctcctttgcctggctgcctaaggccacggtgcaggcagcaatcgggtccgttgccctggatactgcccggtcacacggcgagaagcagctggaggactatggaatggatgttttaacagtcgcattcttatctatcttgataaccgcacccattgggtctctcctcatcggtctgctgggccctcggctgctgcagaaggttgagcaccaaaacaaggacgaagaggtgcagggcgaaaccagcgttcaggtgtag

SEQ ID NO: 30453 - DNA, 432 bp, Artificial Sequence
  Description of Artificial Sequence: Synthetic coding sequence
atgggcgatgaagacaagcggattacatacgaggacagcgagccttccacgggaatgaattacaccccatccatgcatcaggaggcccaggaagaaacagtgatgaaacttaaaggaattgatgcgaatgagccaacagaagggagcatactgcttaagtcatccgagaaaaagctgcaggaaacacctactgaggcaaaccatgtgcagaggttgagacagatgctcgcctgcccaccgcatgggttgctcgatcgggtcatcaccaacgttactatcatagtactcctgtgggccgtcgtttggagcataaccggctctgaatgtttgcctggtggaaatctgttcgggataataattcttttctattgcgccattattggcggtaagctcttgggcctcatcaagctgcccacactgccgccactgtag

SEQ ID NO: 30454 - DNA, 2064 bp, Artificial Sequence
  Description of Artificial Sequence: Synthetic coding sequence
atggacgaaggaaccgggctgcagccaggcgccggcgagcagctggaggctcctgcaaccgccgaggcagtgcaggaacgctgcgagccagaaacgctgcggagcaagagcttgcctgtcttgtctagcgccagttgcagaccttcgttgtcccctacaagcggcgacgccaatcctgcctttgggtgcgtagactcttcagggcaccaagaactgaagcagggaccaaatccgttggctccctcaccctcggcccccagcacttctgccggtttgggggactgcaaccacagggtagacctatccaaaacctttagtgtgtctagcgcgctcgcaatgctgcaggaacgccggtgtctgtatgtggtgcttacagacagcagatgttttcttgtatgcatgtgtttcctcacattcatccaagcactgatggtgagcggatatctctctagcgtgattactacaatcgagcgccggtatagcctgaagtcgtcagaaagcggcctccttgtgagttgttttgacattggaaacttggtggtcgtggtgttcgtgagttacttcggaggacgcgggagaaggcccctgtggcttgcagtcggcggactcctgattgcttttggcgctgccttatttgctctaccccactttatctcacctccttatcagattcaggaactaaatgcttctgcgcccaacgacgggctgtgccagggcggcaatagtacagccacccttgagcctccggcctgccccaaagactccggcggaaacaatcactgggtgtatgtggccctttttatctgtgctcaaattctgatcggcatgggctctacgccaatttacaccctgggacccacctatctggacgataacgtgaaaaaagagaattccagcttatatctcgcaataatgtacgttatgggtgccttgggacctgccgtggggtatctgctggggggcctgctcatcggattctacgtggacccccgaaacccagttcatctggaccagaatgatcctaggtttataggtaattggtggagcggcttccttctttgcgccatagcgatgttcctggtaatctttcctatgttcacctttccgaaaaagctgcctcctaggcataaaaagaaaaagaaaaagaaattcagcgtggatgcagtgtcagacgatgatgtacttaaggagaagagcaataactcggagcaagctgacaagaaggtctcttcaatgggtttcggaaaggacgtgcgcgatttgccaagggccgcagtgcgcatcctcagcaacatgacttttcttttcgtgtccctgagctacaccgccgaatctgccatcgtaaccgctttcatcaccttcatacccaagttcattgaaagccaattcggcattccggccagcaacgctagcatatacaccggggtaattatcgtcccctcagccggggtaggaatcgtcctgggaggatacatcatcaaaaaattgaagctgggcgcgcgcgagtcagctaagcttgctatgatatgctccggcgtctcactgctgtgtttctctacgctgtttatcgtcggctgtgagtccataaacctgggagggatcaacatcccctacaccacaggcccctctctcactatgcctcatcggaatcttacaggtagttgtaatgttaactgcggttgcaagatccacgaatatgaaccagtttgcgggtccgacggaattacatacttcaacccttgtctggcaggctgcgtgaattctggtaatctgtccaccggcatcaggaattacactgaatgtacatgcgtgcagagcagacaggtgattacgcccccaactgtgggccaaaggagccagctgagggtggtgatcgttaaaacttacctgaacgagaatgggtatgctgtttccggcaagtgcaagaggacatgcaacacattaatcccgttcctcgtgttcttgttcatcgtcaccttcatcacggcctgcgctcagccgtccgccattatagtgaccttgagcatccattcatattctaatttgttgtggagctcacactag

SEQ ID NO: 30455 - DNA, 2013 bp, Artificial Sequence
  Description of Artificial Sequence: Synthetic coding sequence
atgggcgaaaccgaaaagcgaatcgagactcataggatacgttgcctgagtaaacttaaaatgttcttactggccattacctgcgcatttgttagcaaaaccctgtccggatcgtacatgaactccatgttgacccagatcgaaaggcagttcaatattccgacctccctcgttgggttcatcaacggcagcttcgagataggcaacctgctgctgatcatttttgtttcttactttggtaccaagctgcaccgtccaatcatgatcggaatcggttgcgtggtgatggggctgggatgcttccttaagtcccttccacactttttaatgaaccagtacgagtatgaatctacagtgtcggtctcagggaacctgtcgtccaacagttttctgtgcatggagaacggtacacaaatcctgcgccccacccaggatccatccgaatgcaccaaggaggtgaagagtctgatgtgggtctacgtgctggtcggcaatattgtgcggggtatgggcgagacaccgattctgcctttggggatttcttatatcgaagatttcgccaaatttgagaacagccccctgtacataggcctagtcgagacgggcgctatcataggtccactcatcgggcttctcctggcgtctttctgtgccaatgtctacgtagatacaggttttgttaacaccgacgatttgattatcacaccaacagatactcgttgggtaggcgcatggtggtttggatttctgatctgcgcgggtgtgaatgtcttgacagctatcccttttttttttctgcctaatacactgccaaaagaggggttagagaccaatgccgatataattaaaaacgaaaacgaggataagcagaaagaagaggtcaagaaggagaaatacggcattaccaaggatttcctgcccttcatgaaaagcctgagctgtaaccccatctatatgctattcatcctggtgtctgttatacagttcaacgcattcgtgaacatgattagtttcatgcctaaatacctcgagcaacagtacggcatttcctcatcagatgctatcttcctgatgggcatttataatctcccacctatatgcatcggctatataatcgggggtctgataatgaagaagttcaaaatcacagtaaagcaggccgcccacatcggatgttggttaagcttgctggaatacctgctctacttcctatcgtttctcatgacctgcgagaactcctctgtggtggggattaatacctcttatgaaggaattccacaggatctgtacgtcgaaaatgatatattcgccgattgtaacgtcgattgtaactgtccaagcaaaatctgggatcctgtctgcggaaataatgggctttcttatctgtccgcgtgcctggctggatgcgagacctccattggtacaggaataaacatggtgttccagaactgttcctgtatccagactagtggtaattcctccgctgtactgggtttgtgcgacaagggccccgactgctccctgatgctgcagtattttctgattctctccgcaatgtcgtctttcatttatagcctcgccgccatccccggatatatggtattgctgcgctgcatgaagtctgaggaaaaatccctgggggtgggactgcatactttttgtacacgtgtctttgcgggcatccccgcacccatatactttggcgctctgatggattccacgtgtctccattggggaacgctcaaatgcggagaaagtggcgcctgccgcatttacgacagtaccacttttaggtatatctacctcggtttgcccgcggcattaaggggctcatctttcgtgcctgccttgatcatcttgattctgttgagaaagtgccaccttcctggagagaacgcttcttccggaactgagttaatcgaaacaaaggtcaagggaaaggagaatgaatgcaaggatatctatcaaaaaagtacagtgttaaaagacgatgaactgaagactaaactgtag

SEQ ID NO: 30456 - DNA, 1740 bp, Artificial Sequence
  Description of Artificial Sequence: Synthetic coding sequence
atgttcttaacgaaaaattgtaagcaagagcaggaacgcgtggaatctgccaaaatgtttctgttggcaatcacatgtgcgtttgtgagtaagaccctgtccggctcgtacatgaatagtatgctgacccagatcgagcggcagttcaacattcccacgtctcttgttggctttattaatggaagtttcgaaataggcaacttactccttatcatatttgtttcatattttggcaccaagctacataggcctattatgatcggaatcggttgcgtcgtgatgggattgggctgtttcctcaaatctctgccccattttttaatgaaccagtacgaatacgagagcactgtctcagtgagtggaaacctgtcaagtaattccttcttgtgcatggagaatggaactcagatcctgcggcctacccaggaccctagtgaatgcacaaaggaggttaaaagtcttatgtgggtgtacgtactggtagggaatatagtgaggggaatgggggagacgcctatcctcccgttagggatctcttatatagaggacttcgccaagttcgagaactcaccactatacatcggccttgtcgagaccggcgcaataatcggccctctgataggcctcctgctcgccagtttttgtgctaatgtgtacgtagataccggttttgtcaacaccgacgacttaatcatcacccccaccgatacccgctgggtgggagcttggtggttcggcttcctcatctgtgccggagtcaatgtcctgaccgctatccccttcttcttcttacctaacaccttgcccaaggagggcctggaaactaatgccgatatcatcaaaaatgagaacgaggataagcagaaggaagaggtcaagaaggagaagtatggtattaccaaagacttcttacccttcatgaagtcgctctcttgtaatcctatatatatgctctttatcctagttagtgtgatccagttcaatgcgtttgtcaatatgatctcatttatgccaaagtatctcgaacagcaatatgggatcagttccagcgacgccatcttcctgatggggatatacaacctgccacctatatgcataggctatatcatcgggggactgattatgaaaaagttcaagattacagtaaagcaggctgctcacatcggttgctggctgtcccttttagagtatctcctttatttcctctccttcctaatgacctgcgaaaacagctctgtcgttggaatcaacacctcctacgaaggcatacctcaggacctgtacgtcgagaacgatatatttgccgactgtaacgtggattgtaattgcccctccaaaatttgggacccggtgtgtggcaataatggtctgagctacctgagtgcctgtctggccggttgcgaaacctccatcggcacagggattaacatggtgtttcaaaactgcagctgcatccagacctcaggaaacagtagcgccgtgctcggcctttgtgataaaggtccagattgcagtttaatgttgcagtacttcctgatattgtccgccatgtcgtcattcatatacagtctggccgctatcccaggatacatggtgcttctcaggtgcatgaagtccgaggagaaatccctcggcgtgggactgcatactttctgcacacgtgtatttggcaagaactcttacttctttccccatccgattcgcactatcttacttctgcttttcttcattaccctctag

SEQ ID NO: 30457 - DNA, 42 bp, Artificial Sequence
  Description of Artificial Sequence: Synthetic coding sequence
atgggagaaaccgaaaaaagaatcgaaacacatagaatttag

SEQ ID NO: 30458 - DNA, 156 bp, Artificial Sequence
  Description of Artificial Sequence: Synthetic coding sequence
atgggagaaactgaaaagcggatcgaaacacacaggatcaggtgcttaagtaaactcaagatgttcctactcgccatcacttgcgccttcgtcagcaagactcttagcggctcttacatgaattccatgctcacccaaattgagcgacaattttag

SEQ ID NO: 30459 - DNA, 300 bp, Artificial Sequence
  Description of Artificial Sequence: Synthetic coding sequence
atgggcgaaaccgagaaacggattgagactcacagaataaggtgccttagcaaactcaaaatgttcctgctggccataacctgtgcttttgtcagcaagaccctcagtggtagttacatgaattcgatgctgactcagattgagcggcagtttaacatccccacatcacttgtgggattcatcaatggctctttcgagataggcaacttgcttctcattatattcgtaagctattttggcacgaagttacaccgcccaataatgattggcattggctgtgtggttatgggtctgggttag

SEQ ID NO: 30460 - DNA, 444 bp, Artificial Sequence
  Description of Artificial Sequence: Synthetic coding sequence
atgggtgagacggagaaaaggatcgagacccaccggatccgctgcctatctaaactgaaaatgttcctgctcgctattacatgcgctttcgtgtcgaagaccctttccggttcatatatgaacagtatgctgacgcagattgaaagacaatttaatatccccacatctctggtcgggttcattaacggttcctttgaaataggaaacctcttactgattatctttgtcagctattttggcaccaaattacaccggcccatcatgatcggaatcgggtgtgttgtgatggggctaggatgttttctcaagtcgctacctcattttctgatgaatcagtatgagtacgagagcacagtgagcgtttctggcaatctgtccagcaacagcttcttatgcatggagaacgggactcaaatcctccgccccacccaggacccgtcatag

SEQ ID NO: 30461 - DNA, 9 bp, Artificial Sequence
  Description of Artificial Sequence: Synthetic coding sequence
atggggtag

SEQ ID NO: 30462 - DNA, 267 bp, Artificial Sequence
  Description of Artificial Sequence: Synthetic coding sequence
atgggagagaccgagaaacggatcgagactcaccgcataagatgcctatccaaactcaaaatgttccttctcgctattacttgcgcatttgtgtcgaaaaccctttctggcagttatatgaacagcatgctaactcagattgaacgccaatttaatatcccaacctctttagtggggtttataaacggtagctttgaaatcggaaatctgttgctaataatcttcgtctcttatttcggaactaaacttcaccgaccaataatgtag

SEQ ID NO: 30463 - DNA, 276 bp, Artificial Sequence
  Description of Artificial Sequence: Synthetic coding sequence
atgggagaaactgagaagcgcatagagacacataggatacgatgcctaagcaaactgaagatgtttttgctggcaatcacatgcgctttcgttagcaagacattgagcgggtcatacatgaattccatgctaacacaaattgaacggcagtttaacatccccacatctctggtaggattcatcaatgggtcatttgaaattgggaatttgctgctgatcatttttgtatcctacttcggcacgaagctgcatcgaccaatcatgatcggaatttag

SEQ ID NO: 30464 - DNA, 2013 bp, Artificial Sequence
  Description of Artificial Sequence: Synthetic coding sequence
atgggggaaacagaaaagaggattgaaacccaccggataagatgcctgagtaaactaaaaatgttcttgcttgccatcacctgtgccttcgtgagtaagacgctgagtggaagctatatgaatagtatgttgacacaaattgagagacagtttaacattccaacatctctcgtgggcttcattaacggctcattcgagataggaaatttacttctgatcatctttgtttcctacttcggaacaaaactccatagacctattatgattggaattggctgcgtggtgatgggcttgggctgttttctcaaatccttgcctcactttctgatgaatcagtacgagtatgaatccacagtatccgtgagcggcaacctatccagcaattcatttctttgtatggagaacggtacgcagatcctacgccctacccaggacccaagtgagtgtacaaaagaggttaagtcacttatgtgggtgtatgtgctggtgggtaatatcgtgcgcggcatgggagaaacaccgatcctgcctctgggaatctcctacatagaagacttcgcgaagtttgaaaacagccctctctacattggcttagtagagactggcgcgataatcggaccattaataggtctgctgctggcttccttttgcgcaaacgtttacgtggacacgggcttcgtgaacacggatgacctgatcattacgcctacggacacccgctgggtgggcgcctggtggtttggatttctcatctgcgccggggtaaatgtgctaacagctataccattcttctttctccctaacactctacctaaggagggccttgagaccaatgccgacatcattaagaacgagaatgaggataagcagaaggaggaagttaaaaaagagaagtatggcatcaccaaagattttctgccctttatgaagtctctctcatgtaacccaatatatatgctgttcatactcgtgagcgtcatccagttcaatgcctttgttaacatgataagttttatgcccaagtacctcgagcagcaatatggcatctcttcgtctgatgcgatctttctcatggggatttacaatctcccacccatctgcatcggttatatcattggcgggcttatcatgaagaaatttaagattactgtgaagcaggccgcccatataggatgttggttatcccttctcgaatatttgctctacttcctgagttttttgatgacctgcgaaaactcatcagtggtcgggattaacacctcctatgaaggaattccacaggacttatacgtggagaacgacatttttgccgactgcaatgtggactgtaactgtccaagcaaaatttgggaccccgtttgcggcaataacggcctctcatatcttagcgcatgcctagccggatgcgaaacctcaattggcactgggattaacatggtttttcagaactgctcgtgcattcagacgagtggcaacagtagcgctgtgcttggactgtgtgataaaggtcccgattgctctttgatgctgcagtacttcttgatcctctccgccatgtcaagttttatttacagtttagccgctatcccagggtatatggtgctgctccgatgcatgaaaagcgaagagaagtcacttggagtaggtctgcacactttttgcaccagagttttcgcaggcattcctgctcctatctatttcggggcactgatggattctacgtgcctccactgggggacgttgaaatgtggggagtcgggcgcctgcagaatatatgacagtacaaccttccggtacatctatttgggcctcccagctgcgcttagaggaagcagtttcgtgcccgctcttattattctgatcctgctgcgtaagtgtcatcttcccggggagaacgccagtagtggaacagaactaatcgagaccaaggtgaaaggcaaggagaacgagtgcaaagacatctaccaaaagtcgactgtgctgaaagacgatgaacttaagacgaagctctag

SEQ ID NO: 30465 - DNA, 414 bp, Artificial Sequence
  Description of Artificial Sequence: Synthetic coding sequence
atgggtgagaccgaaaaacgaattgagacacaccgaattcggtgcttgtccaaactgaaaatgttcctgcttgctattacatgtgcttttgtatccaagacactcagcgggtcgtacatgaactctatgctcactcagatcgagagacagtttaatatcccaacatctctagtgggtttcattaatgggagtttcgagattggtaacttgctattgatcattttcgtgagttatttcggaaccaaattacaccgaccgataatgattgggattggatgtgttgtcatgggcctggggtgttttctcaagtctctgccacatttcctcatgaatcagtatgagtatgagagcaccgtgtctgtctccggtaacctttcctcaaacagttttctgtgcatggaaaacggtacgtag

SEQ ID NO: 30466 - DNA, 1617 bp, Artificial Sequence
  Description of Artificial Sequence: Synthetic coding sequence
atggagaacggcacacagatactcagacccacccaggaccccagcgaatgcacaaaagaggtcaagagcttaatgtgggtatatgtgctggttggcaacattgtacggggaatgggcgagactccaatcctcccccttggaataagctatatagaggatttcgctaaattcgagaatagcccgctgtatatcggtctggtcgaaaccggcgctattatcggtccattaataggcctccttctagcctcgttttgtgcaaacgtgtacgtggatactggtttcgttaataccgatgacttgattatcacccccaccgacacaaggtgggtgggggcttggtggtttgggtttttaatctgcgccggcgtgaatgtattaacagcaatcccttttttctttctccctaacaccctgccaaaagagggcctggagaccaatgctgacattattaagaatgagaatgaggataagcaaaaggaagaagttaaaaaagaaaagtacggaattactaaggattttctgccattcatgaaaagcttatcttgtaaccccatttatatgttatttattctggtttcagtgattcaattcaacgccttcgttaacatgatctcttttatgcctaagtacctcgagcagcaatatggtatttcaagttctgatgctatttttctgatgggtatttataacttaccacctatctgtatcggctacattatcggcggccttataatgaaaaaatttaagatcacggtcaagcaagccgcacatattgggtgctggctgtctctgctggagtacctcttgtatttcctgtccttcttgatgacgtgcgagaactcctcagtagttggtatcaataccagctacgaaggtatccctcaagatctctacgtggaaaatgacatttttgctgattgcaacgtggactgcaactgtccttccaaaatttgggaccccgtctgtgggaataatggcctgagctatctcagcgcctgtttagcagggtgtgaaactagtattgggacaggcataaatatggtttttcagaactgtagctgtatccagacgagcggaaactcttcggcagtgctgggcctatgcgataaggggcccgattgctcgctcatgctgcagtactttctcattctctctgcgatgagcagctttatctactcccttgcagccattcccggctacatggtactgttgaggtgtatgaaaagcgaggagaagtcgttgggcgttggactgcataccttttgcactagggtgtttgccggaattccagcacctatctacttcggcgctctcatggactctacttgtctgcattggggtacactcaagtgtggcgagagtggtgcctgcagaatctacgatagtaccacctttaggtacatttacttgggactaccagctgccctgagaggtagctctttcgtgcccgccttgatcatcctgatcctgcttcggaagtgtcatctgcctggtgagaatgcctcctcgggaactgagctgatcgagactaaagtcaagggtaaagaaaatgagtgtaaggacatttatcagaaaagcaccgtgctgaaagatgatgaactcaagactaaactgtag

SEQ ID NO: 30467 - DNA, 1617 bp, Artificial Sequence
  Description of Artificial Sequence: Synthetic coding sequence
atggagaatggcacccaaatacttaggccaacccaggatccaagcgaatgtaccaaagaggtgaagtctctgatgtgggtatatgtgttggtcggaaacatcgtgagaggaatgggtgagacaccaattctgcctctcggaatatcctacatcgaagatttcgccaaattcgaaaacagccccctgtacattggattggtcgagacgggggccatcattggaccattgatcgggcttcttctagcatccttctgcgcgaatgtgtacgtggataccggctttgtcaacacggacgacctcataataacgcccactgacacacgatgggtcggggcctggtggttcggcttcttaatctgcgctggggtgaacgtcttaaccgccatccctttcttttttttaccaaatacgctgccaaaagaaggattagaaacaaatgcagatatcatcaaaaacgagaacgaagataagcagaaggaagaggtaaaaaaggagaaatatggaattactaaagatttcctccccttcatgaagagcctgtcttgcaaccccatctatatgctcttcatcctggttagcgttatccaattcaatgcgtttgtgaatatgatctccttcatgcccaaatacttagagcagcagtatggaatcagctcaagtgacgctatcttcctgatgggcatctacaatttacctccaatttgtattggctatataatcggcggcctaataatgaagaaattcaagatcacagtgaagcaggcagcgcacatcggctgctggctcagtctgttggagtatttgttgtattttctttcgtttctgatgacctgcgagaactcttccgtggtgggtattaataccagctatgaaggaatcccccaagatctttacgttgagaatgatattttcgccgattgcaatgtggattgtaattgtccctctaagatctgggaccccgtgtgcggcaataacggtctgagttacctgagcgcttgcctagccggatgtgagaccagcattggaaccgggatcaacatggtctttcagaactgctcatgcattcagaccagcgggaacagcagtgccgtgcttgggctgtgcgataagggtccggattgctcccttatgcttcagtatttcctgattctgtccgcaatgtctagcttcatatacagtctggccgcgattcctggttatatggtgctgctgcgatgcatgaaatccgaagaaaagagcctgggcgtcggcctgcacaccttctgcacacgcgtgttcgcaggcattccagcccccatttattttggcgccctgatggactccacatgtcttcattggggtacactgaaatgtggggagagtggggcatgccgaatctacgattccacaacattcaggtacatctatcttggcctgcccgcggccttgcgcgggagttccttcgttcccgctctgataattttgattctgctccgtaagtgtcatcttccaggggagaacgcttccagtggtacagagttgatcgagactaaggtgaaaggcaaggaaaatgagtgcaaggatatatatcagaagagcaccgtcttgaaggatgacgagctcaaaacaaaactgtag

SEQ ID NO: 30468 - DNA, 1704 bp, Artificial Sequence
  Description of Artificial Sequence: Synthetic coding sequence
atggggctgctccccaaactgggagccagtcagggctccgataccagcacatctagagccgggcggtgcgcacgcagtgtattcggaaatattaaagtcttcgtcctctgtcaggggctcttgcaattgtgtcaactgctttattctgcctacttcaaatcaagtctaaccaccattgagaaaaggtttggattgtcgtcctcatcttctggccttatctcctctctgaacgagattagtaacgctattttgattatctttgtgtcttatttcggttctcgggtccaccgtccaagactcattggcattggaggtctgtttctcgccgccggtgctttcattcttaccttgccccacttcctgtctgaaccataccagtatacccttgcaagtaccgccatcctttttgcaatctcagtatttggccctgcatttggttacctcttgggctcagtgatgctgcaaattttcgttgattatggaagggttaatacagccgccgtcaacctggtgcccggggatccccgctggatcggggcttggtggctcggtctgttgatcagtagtgccctgctcgtgctgaccagctttccgttcttcttttttcctagggccatgcccatcggagccaagcgcgctccagcaactgccgacgaagcgaggaagctggaggaggctaagtctaggggttcccttgtggatttcatcaagcgctttccatgcattttcttgcggttgctcatgaactcactgttcgttctggtggtactggctcagtgtaccttttcctctgtaattgccggactgagcaccttcttgaataagttcttggagaagcaatatgggacttctgccgcttacgctaatttcctcatcggcgcagttaatctgcctgcagcagcattgggcatgttgttcggcggaatccttatgaagcgttttgttttctctttacaggcaatacctcgcatcgcaaccaccatcattactattagcatgatcctatgcgtcccgcttttttttatgggatgttctactccaacagtggccgaagtgtatcccccctcgacgagcagctcgatccatccacagtcccctgcatgtaggcgggattgctcttgccccgatagcatattccacccagtctgcggtgacaacggcatcgagtacctgagtccgtgtcatgctgggtgcagcaatatcaacatgtcatccgctactagtaaacagctgatttacttaaattgctcatgcgtcaccggcggatcagcctccgctaagaccgggtcttgtcccgtcccatgcgcacactttcttctgccagcaatctttctgatttcattcgtgagcctcattgcctgtatctcacacaatcctctgtatatgatggtcctgagagtcgttaaccaggaagagaagtcttttgccataggcgtgcagttcctcctgatgagattattggcatggctgcccagtccggcattgtatggtctaacgattgatcactcctgcattcggtggaattctctgtgcctgggcagaaggggggcctgcgcttactacgataacgacgccctacgggaccgctatttaggactgcagatgggctataaggccctgggaatgctcctgctgtgtttcatttcttggcgtgtgaaaaaaaataaagaatacaacgtgcaaaaggctgcagggttgatatag

SEQ ID NO: 30469 - DNA, 2130 bp, Artificial Sequence
  Description of Artificial Sequence: Synthetic coding sequence
atggggccgcgaataggccctgcaggcgaagtcccacaggttcccgacaaagagacgaaggcgacaatgggaactgagaatacacctggcgggaaggcttcccctgatcctcaggatgtgcgcccctcagtttttcataacatcaagctatttgtcttgtgtcactctctgcttcaacttgcccaactgatgatttcaggatacctgaagtccagcatctccacagttgagaagaggtttgggctgtcctcccagacctctggactcctggctagctttaatgaagtggggaacacggctctgattgtgtttgtgtcctatttcggcagtagagtccacaggccccgcatgattggttatggagccatactggtggctctagcgggcctcttaatgactctaccccacttcatctcagagccctaccgatatgacaatacctcaccagaggacatgccccaggatttcaaggctagcttgtgtctcccgactactagtgcccccgcgtcagcgccctctaatggtaattgctccagctacacagaaactcaacacttatccgtggtgggcataatgttcgtggcacagaccctgcttggcgtggggggagttcccatccagcccttcgggatcagctacatcgatgactttgcccacaactcaaattctcctctgtaccttggtatattgttcgcggtcaccatgatgggccctggcctggcattcggtctgggctcattaatgctgcgcctgtatgtagatatcaatcagatgcctgaaggcgggatttcgctgaccattaaggatccacggtgggttggcgcctggtggctgggattccttattgcagccggggcggttgcccttgcagcgatcccttacttcttctttccgaaggaaatgccaaaggagaagagagaactgcaatttagacggaaagtgctggccgtgactgactcacctgctcgtaaaggaaaagattcgccttccaagcagtcacccggggagagcacaaagaaacaagatggcctcgtgcagatagctcccaacctgaccgttattcagtttatcaaggtgttcccacgcgtacttctgcaaacactccgtcatccaatctttcttctggtggtgctcagccaggtttgcttatctagcatggccgcaggaatggccattttcttgcccaagtttcttgagagacagttctcaattacagcaagctatgcaaacctgctaatcggttgtctcagcttcccttctgtgattgtgggaatagttgttgggggcgtcttggtgaagcggctgcacctaggccccgtcggatgcggggccctgtgtctcctcgggatgctgctatgcctttttttttctttgcccttgttcttcatcggatgtagctcacaccagatagcggggattactcaccaaacttctgcacatcccggattggaactgtctcccagctgcatggaggcatgcagttgtcctttggatggattcaacccagtctgcgatccctcaacaagggtagagtacattaccccttgtcacgctggttgtagttcctgggtggtgcaagatgcactggataacagtcaggtcttctatacgaactgctcttgcgtggtcgagggcaacccagtgctggcaggctcatgtgattctacgtgcagccacctggtcgtcccttttctcctcttggtctcgctgggaagtgccctggcctgtctgactcataccccttcctttatgctcatcctgcgaggggtaaaaaaggaggataaaactctcgccgtgggaatccaatttatgttcttgcggattctggcctggatgcccagcccagtaattcacggatctgcgattgacactacctgtgtgcactgggcattatcatgcggaagaagagcggtctgcagatactataacaacgacttgctgcgaaacaggtttatcgggttgcagttctttttcaaaacaggtagcgtgatctgctttgctctagtgcttgctgtgcttcgccagcaggacaaagaagccaggacaaaagagtctcgttctagtccagccgttgagcagcagctgttagtgtctggtccaggcaagaagcctgaggacagcagggtctag

SEQ ID NO: 30470 - DNA, 1449 bp, Artificial Sequence
  Description of Artificial Sequence: Synthetic coding sequence
atgatcggctatggcgccatcctggttgccctcgctgggctgttgatgacattgcctcatttcatcagcgagccgtataggtatgacaacacttcccccggggggattagccttactatcaaggaccctagatgggtgggcgcatggtggctcggttttctgatcgcggccggcgctgtagccttagcagccattccatacttctttttccctaaagagatgcctaaagagaagcgcgaattgcagttcaggcgcaaagtcttggcagtgaccgattccccggctcggaagggaaaggatagtccttcaaaacaatctcctggcgaatcgaccaagaaacaggacggtttagttcagatcgcgcctaacctcacggtaatccagtttattaaagtttttcctagggtcttgcttcagacattgcgtcatcctatattcttactcgtggtgttatcacaggtttgcctgtcgtcaatggcagccgggatggccatctttctgccaaagttcttggagcggcagttttctattacggccagttatgcaaatctgctgatcgggtgcttgtcgtttccttcagttattgtgggcattgtcgttggaggggtgctcgttaaaagactgcatttgggacctgtgggatgcggagcgctctgcctgctgggcatgcttctgtgcctatttttctccctgccacttttcttcattggctgctcatcacatcagatagcaggcatcactcatcagaccagtgcgcacccgggcttagaattgtcgccctcctgcatggaggcatgcagttgcccacttgacgggttcaatccagtttgcgatcccagtacgagggtggagtacattaccccttgtcacgctggctgcagtagttgggtggtgcaggatgcgcttgataactcccaggtgttctataccaattgttcatgtgtcgtcgaaggcaacccagtgttggcaggttcctgcgactcaacctgttcacacctggtggtgccatttcttctattagttagtttagggagtgccctggcctgcctcacccacacaccgtcatttatgcttatactccgcggcgtgaaaaaagaggacaagaccctggcagtgggcattcagtttatgtttctcagaattctggcgtggatgccctctcccgtgattcatggcagcgccattgacactacctgcgttcattgggccctgtcttgcgggaggcgcgccgtatgtaggtactacaataatgacctcctcagaaatcgcttcattgggctgcagttcttttttaagaccgggtcagtcatatgctttgccctcgttctagctgtattacgccagcaggataaagaggcccgcaccaaagagagtagaagctcgccagccgtggaacaacagctcctcgttagcggacctgggaagaaaccggaggatagcagggtgtag

SEQ ID NO: 30471 - DNA, 2064 bp, Artificial Sequence
  Description of Artificial Sequence: Synthetic coding sequence
atggggactgagaacaccccgggtggcaaggcctcacccgatccacaggatgtccggcctagtgtttttcacaacattaagctattcgtactatgccatagtctgcttcagctggctcagcttatgatttccggatatttaaagtcctcaatttcaacagtcgagaagcgatttggactttccagccagacaagcggactgctggcctcttttaacgaggtgggcaacacagcgctgatcgtcttcgtgtcttactttggcagtcgcgttcatcggcctcggatgatcggatatggtgcaatcctggtcgctcttgccggcctgctgatgacactgccccactttatcagtgaaccataccgatacgataatacaagcccggaagacatgcctcaggactttaaagcctcactgtgcctgcccactacctcagctcctgcgtctgcaccatccaacggtaattgtagtagctacaccgagacccagcatctgtccgtggtggggattatgttcgtcgcccaaacgctgttgggggtgggcggagtgcccatccaaccctttggaatcagctacattgatgacttcgctcacaactctaactctccactgtatcttgggatactctttgctgtcaccatgatgggtccaggccttgcgttcgggctcggatcactaatgttacggttatacgtggatataaaccagatgcctgaaggtggtatttcccttaccattaaggatccaaggtgggtgggagcctggtggctcgggttcctgattgccgctggcgctgttgccctcgctgccatcccctacttcttctttccgaaagagatgcctaaggaaaaaagagagctccagtttaggaggaaagtcctggctgtcaccgatagccctgcacggaagggcaaggactcaccaagcaaacaaagtccaggggagtccactaagaagcaagacggtctggtgcagatcgcccctaatcttaccgtcattcaatttataaaggtctttcctagggtgctgctccagacgctgcgtcatcctatattcctcctggtcgtgctgagtcaggtctgcctcagctccatggctgcaggtatggccatatttctgccaaagtttctcgagcgccagttctccatcactgcaagctacgccaatctcctgattggttgcctctcttttcccagcgtcattgtggggattgtagtgggaggcgtactggtgaagagattgcatctgggtcccgtcggatgtggggccctgtgcttgttgggaatgctgttgtgtctgtttttttctttacctctgttcttcatagggtgtagctcccaccagatcgcaggcattacccatcagacaagtgcacaccccggtctggagttatctcctagctgtatggaagcctgtagctgtccactggatggcttcaacccagtatgtgatccgagcacgagagtcgaatacataacaccctgtcacgcaggatgttcttcatgggtggttcaggacgcactcgacaatagtcaggtgttctacactaattgctcttgcgtggttgaaggcaatccggtgctggcaggctcctgcgactccacatgtagccacctggtagttccattcttactgcttgtttctttaggatccgcactggcttgtcttactcataccccatcgtttatgctcatattgcggggagtcaagaaagaggacaagacgttggcagtcggaattcaattcatgtttctgaggatcctggcatggatgccttcccctgtgatccacgggagtgctattgataccacctgcgtccattgggctctgagctgcggcaggagagccgtctgcagatactacaataatgacttgctccgtaatagatttatagggctccagtttttctttaagacagggtctgtgatctgttttgccctcgtgcttgccgtgttacgccagcaagacaaggaggcccgaaccaaagagtctcgctctagtcctgctgtggagcagcagctgctcgtatccgggccagggaaaaagcccgaagactccagggtttag

SEQ ID NO: 30472 - DNA, 1449 bp, Artificial Sequence
  Description of Artificial Sequence: Synthetic coding sequence
atgatcggatacggtgcaatcctcgtggccctcgccgggcttcttatgactctccctcacttcatctccgagccttaccgctatgataatactagtcccgggggcatttcactgactatcaaagaccccaggtgggttggtgcctggtggctgggatttctgatcgcagctggggcagtcgctctagccgccatcccatattttttcttccccaaagaaatgccaaaggaaaaacgtgaactgcaatttaggaggaaagtcctggctgtgactgatagcccagctcggaaaggcaaggactccccaagcaagcaaagcccaggcgagtcaacgaaaaaacaagatgggctcgtccagatcgctcctaacctcacggtgatccaatttatcaaagttttcccaagggtgctgctgcaaactctgaggcaccccatttttttactcgtggtcctctcacaagtttgcttgtcctcaatggctgccgggatggcaatctttcttccaaaattcctggagcgtcagttttcaataactgccagctatgcgaatctgctaatcgggtgcctaagttttccgtccgtgatagttggcatcgttgtcgggggggtgctcgtcaagagactccacctgggacctgtgggttgtggcgccttatgcctcctgggaatgttgctttgcttattcttcagcctgcctctcttcttcattggttgctccagccaccagatagctggcattacgcaccagacctcggcccaccctgggctggaactctctccctcctgtatggaagcatgtagttgtccgttggacggcttcaatccggtgtgcgatcctagcacccgcgtcgaatacatcaccccctgccacgcaggctgcagttcctgggtggtccaggatgccctcgacaactcccaagttttttatacaaactgtagctgtgtggttgagggcaacccggtgcttgccgggagttgtgactcaacatgctcccacctcgtcgtccccttcttattgctggtatccctgggttctgcgctggcatgcttaacgcacactcccagctttatgctcatcctgagaggtgtgaagaaggaagacaaaacgctggcggtgggcatccaatttatgtttctgcgcatcttggcctggatgccatcccccgtaatccacggtagtgctatcgatacaacttgtgtgcactgggccctgagctgtggtcggagagctgtgtgcagatactataacaacgacctcctccgcaataggttcataggactgcaatttttctttaagaccggctccgtgatttgcttcgctctggtgctagctgtgttgcgccaacaggacaaggaggcacgcactaaggaatccagatcaagccccgccgtggagcagcagctcctcgtgtcaggccctggcaaaaaacctgaagacagtcgggtgtag

SEQ ID NO: 30473 - DNA, 1698 bp, Artificial Sequence
  Description of Artificial Sequence: Synthetic coding sequence
atgggacctagaattgaggatatgccgcaagactttaaagcgtcactgtgcctgcctacaacatccgctcccgcttccgcacccagcaacgggaactgtagtagttataccgaaacacagcatctgagcgttgtcggcataatgttcgtggcccagacgcttctgggggtaggcggcgtgcctatacagccttttggcatctcttacattgatgattttgcccataacagtaattcccctctttacctgggaattctgttcgcggtcactatgatggggccaggcctagcatttggtctcgggtctctgatgttaaggctttatgttgatattaatcagatgcccgaagggggaatcagcctgactattaaggacccgcggtgggtgggggcctggtggctgggttttcttatagctgcaggtgccgtggccttggctgcaataccctatttcttctttccaaaagagatgcctaaggaaaagcgcgagcttcagttcagaaggaaggtcctggccgtcactgattccccggctagaaagggcaaggattctcctagcaaacagagccccggcgagtccaccaagaagcaggacggtcttgtgcagattgctcctaatctcaccgtaattcagttcatcaaggtgttcccacgcgtactgctgcagacattacgacaccccatattcttgctggtcgtgctgtcacaggtgtgtctgtcctccatggccgccggaatggcaatattcctgcccaaattcctggaacgacagttctcaataacagcctcatacgccaaccttctcatcggatgtctgagttttccttctgtcatcgtcgggatcgttgtggggggcgtactggtgaagaggttgcatctcggaccggtgggatgcggagctctttgtctcctggggatgttgctctgcctttttttctctttgcccctgttcttcattggctgttcatcccaccagatcgccggaatcacccaccagactagcgcacaccccggcctggagctctcgccctcctgcatggaggcgtgttcctgccccttagacggattcaacccggtctgcgacccatccactagggtggagtacatcacaccatgtcacgcaggatgcagctcctgggtcgtccaggatgccctcgacaattcccaggtgttttatacaaactgttcttgcgtggtggaaggcaatccagtgcttgccggaagttgtgatagcacgtgctcccacctggtagttccctttctcctattagtgagcttgggctctgctcttgcttgtctgacccatacgccaagctttatgctcatccttagaggcgtgaaaaaagaagacaagacattagcggttgggatccagttcatgtttttgcgcattttggcctggatgcctagccccgttatacacggttccgcaatcgatacaacctgcgtccactgggctttaagctgcggcaggcgcgctgtctgtagatactataacaatgatctactccgaaatcggttcatcggcctgcagtttttttttaaaaccggcagcgtgatttgttttgcgttggtgctggccgtattacgacagcaggataaggaagcgcgcacaaaggaaagtagatcaagccccgctgtggagcagcagctgcttgtatctggccctggtaagaaacctgaggactcccgggtgtag

SEQ ID NO: 30474 - DNA, 135 bp, Artificial Sequence
  Description of Artificial Sequence: Synthetic coding sequence
atgggtaccgaaaacacccccggaggcaaggcttctcctgatcctcaggatgtaagaccctccgtgttccacaacatcaaactgttcgtgctgtgccattctctcttgcagctggcacagctgatgatcagttag

SEQ ID NO: 30475 - DNA, 453 bp, Artificial Sequence
  Description of Artificial Sequence: Synthetic coding sequence
atgggtaccgagaacacaccagggggcaaagcttctcctgaccctcaagacgtgagacccagtgtgttccataacattaaactgtttgtcctctgtcacagtttgctgcagttggctcagctgatgatctccggatacttgaagagtagcatctcgacggtggagaaacgatttgggctgtcctctcagacatccggtttgctcgcgagcttcaatgaagtgggaaacactgctctcatcgtttttgtgtcctacttcggatctagggtgcatcggcctcgcatgatagggtacggcgcaattttggttgcactggccggactcctgatgacgttgccccacttcatctctgagccgtaccgctatgataacacgtcaccagaggacatgccacaggactttaaggctagtctgtgtctgcctaccacttctgctcccgcgtccgccccgtag

SEQ ID NO: 30476 - DNA, 135 bp, Artificial Sequence
  Description of Artificial Sequence: Synthetic coding sequence
atgggaacagaaaatacgccggggggcaaagcttccccggaccctcaggatgtcaggccatccgtgtttcataacataaaactgtttgtgctgtgtcacagtctgctacaactcgctcagctgatgatctcatag

SEQ ID NO: 30477 - DNA, 264 bp, Artificial Sequence
  Description of Artificial Sequence: Synthetic coding sequence
atgggtactgagaatacccccgggggtaaagcttcaccagacccccaagatgtgaggcccagcgtattccacaacatcaaattgtttgtactgtgccatagcttactgcagttggcacagctgatgatttcgggctatctaaagtctagcatcagcacggtggaaaagagatttggtctgtcaagtcagacgtcagggctgcttgcttctttcaacgaggtcggcaatacagcccttattgtgttcgtttcatatttcggatag

SEQ ID NO: 30478 - DNA, 1782 bp, Artificial Sequence
  Description of Artificial Sequence: Synthetic coding sequence
atgatcgggtacggcgccatcctcgtggctctggccggcctactgatgaccctcccccattttatcagtgaaccctaccgttatgacaataccagccccgaggacatgcctcaggactttaaagcttccttatgtctcccgaccactagtgcccccgcctccgctccaagcaacggcaattgttcaagctacaccgagacacagcacttgtctgtggtaggcattatgttcgtcgcccagaccctcctaggcgtgggaggcgtgcctattcaacccttcgggatttcatatatcgacgattttgcgcacaattccaactcccctctgtatctcggcatcttgttcgcggtcaccatgatgggccctgggctggccttcggtctcggtagcctgatgctgcgattgtacgtggacatcaaccagatgcctgaaggaggaatttctctcacaattaaagacccccgttgggttggggcctggtggcttggcttccttatagccgcaggcgctgtggccttggcagccatcccatacttcttctttcctaaggaaatgccgaaagagaaacgagagctacagtttcgccggaaggtactcgccgtgaccgactcacctgcccgcaaagggaaggactccccctctaaacagagccctggcgagagtaccaaaaagcaggatggcttggttcagatcgcccccaatttgacagtcattcaatttatcaaagtgtttcctagagtcctgctccagaccctccggcatcccattttcttgctagtagtcctgagtcaggtgtgtcttagtagcatggccgccggaatggcaatatttttacctaaatttctggagcggcagtttagtatcacagcatcttacgccaacttgctgatcggctgcttgtcattcccatccgtgatagtggggatcgtggtgggcggagtgctagtgaaaagactgcatctcgggccagtcggttgtggcgcgctgtgtctcttaggaatgttgctgtgcctctttttctcattgcccctgttctttattggttgtagttctcatcagatcgcgggcatcacccatcagacctccgcccatccaggtttggagctttcccccagctgcatggaagcctgcagttgcccacttgacggattcaatcccgtgtgcgatcctagtaccagggtggagtacatcactccttgtcacgctggatgttcaagttgggtagtccaggatgccttggataactcccaagttttctatactaactgtagctgcgtggtggaggggaaccctgtgttggctggctcctgtgacagtacatgcagccacctggtggttcccttcctcctgctagtgtccctggggagtgccctggcgtgcctcacccacaccccatccttcatgctgatcctgaggggggtaaagaaagaagataagactctggcagtaggcatccaattcatgttcctacgcatactggcttggatgccatccccagtaattcacggcagcgcaatcgacacaacatgcgtgcactgggccttgtcctgcgggcggcgggcggtgtgtagatactacaataacgacctgttacggaatcgcttcattggactgcagtttttcttcaagactggcagtgttatctgttttgcgctggtgctggctgtgctgaggcagcaggacaaggaggcacggactaaggaaagtcgaagttctccagccgtggagcaacaactgttggtaagtggccccggcaagaaacccgaagactctagggtgtag

SEQ ID NO: 30479 - DNA, 135 bp, Artificial Sequence
  Description of Artificial Sequence: Synthetic coding sequence
atgggaactgagaacaccccaggaggcaaagccagtccggacccgcaggatgttcgtccatcagtctttcataacataaagctgttcgtcttatgtcattccctcctgcagcttgctcagctgatgatctcttag

SEQ ID NO: 30480 - DNA, 384 bp, Artificial Sequence
  Description of Artificial Sequence: Synthetic coding sequence
atgggcactgagaacacccctggcggtaaggcatcccctgatccacaagacgtgaggccatctgtcttccacaatataaaattgttcgtcctgtgtcattccctacttcaactcgctcaattgatgattagtgggtatctgaagtcaagtatttccacagtagaaaagagattcggtctttcctcccagacatcgggcctgttggcctcattcaatgaggttggaaatacggccctcattgtttttgtgtcttatttcgggagccgcgttcacagaccacggatgattggctacggcgctatcctggtggctctcgctggactgctgatgacacttccccattttataagcgaaccataccgatatgacaacacaagcccatag

SEQ ID NO: 30481 - DNA, 2175 bp, Artificial Sequence
  Description of Artificial Sequence: Synthetic coding sequence
atgaaatctgcaaagggaattgagaacctcgcctttgttccctcctcccccgacatacttcgtagactgagtgccagcccatctcagatagaggtatcagctctctcatcggacccccaacgagaaaatagtcagcctcaggagctgcagaagcctcaggaacctcaaaagagcccagaaccgtcactcccatccgcaccacccaacgtgtcagaggagaaactaaggtctctctccctgagcgaatttgaagagggctcatacggatggcgcaacttccacccacagtgtctacagaggtgcaatactccgggcgggtttctactgcactactgtctgctcgccgtgacccaaggaatcgtggtcaatggattggttaacatatctatttctaccgtagaaaaaaggtacgagatgaagagttcccttacaggactgatctctagctcctatgatatttccttctgtctgctctcactcttcgtgagtttctttggagagcgagggcacaaacctaggtggttagctttcgcagccttcatgatcggactgggcgccctggtgttctcgttacctcagttcttttccggcgagtataaacttggtagcctgttcgaagacacctgtgtgaccacaaggaacagtacaagctgtacttccagtacctcctccctgagtaactacctttacgtgttcatcttaggccagctgctgttgggggccggcgggacacctctctatacactgggtacggctttcttagacgattctgtgccaacccacaaaagctcattgtatattgggaccggctacgctatgtccatccttggccccgccattggctacgtgctcggcgggcagctcctgaccatatacatcgatgtcgccatgggggaatcgaccgacgtgaccgaggacgatccacgatggctgggggcctggtggattggattcctgctcagttggattttcgcgtggtcccttataatccctttttcatgttttcccaaacacctgccaggaactgcagagatccaagctggaaagacatcacaagcccatcagtccaacagcaacgcagacgttaaatttggcaaatctattaaagacttccctgccgctcttaaaaatctcatgaagaacgcagtttttatgtgtttagtgctgtccacttcaagtgaggccctgatcacaacagggtttgccaccttcttacccaaattcattgaaaaccaattcggtttgactagcagcttcgcagccacactcggaggagccgtgctcatccccggggctgcactgggccagatcctgggcggatttctagtgagcaaattccggatgacctgcaaaaataccatgaagttcgctctttttacgtcgggcgtagcactgaccctgtccttcgtttttatgtatgccaagtgcgagaatgagccattcgctggcgtgtcagagtcctacaatggaactggagaacttgggaacctgatcgcaccttgcaatgccaactgtaactgcagcagatcctattactatccagtgtgtggggacggagtccaatatttctccccatgtttcgccggatgctcaaaccccgtcgcgcatcgtaaaccgaaggtatattacaattgttcttgcatcgagagaaagaccgagatcacatcgaccgcggagacatttggcttcgaagctaaggctggaaaatgcgagacccattgcgcaaagctgccgatattcctgtgcatattttttattgtcatcattttcacttttatggctggcacccctattactgtgtccatactccggtgcgtgaatcacagacagcgcagccttgctctcgggattcaattcatggtactcagactgttaggaaccataccaggaccaattatctttggcttcaccattgattccacttgcatcctctgggacatcaacgactgcggaattaagggggcatgctggatctatgacaatattaaaatggctcatatgctggtggcaatctcagtgacatgtaaggtcataactatgttctttaacggattcgccattttcctctataagcccccgccgtcagccacagatgtgtccttccataaagaaaacgctgtggtaaccaacgtattggctgagcaagacctgaacaaaatcgtaaaagagggttag

SEQ ID NO: 30482 - DNA, 2547 bp, Artificial Sequence
  Description of Artificial Sequence: Synthetic coding sequence
atggatgaggggacaggccttcagcctggcgctggagagcagcttgaggcccccgcgacagctgaggcagtacaggaacgctgtgaacccgaaacactcaggtcgaagtcccttcccgtgctctcaagcgcaagctgccgcccctcactaagccccacgagcggcgacgcaaatcccgcgtttgggtgcgtcgactcctctggacaccaggaattgaaacagggaccaaaccccctggccccctccccgagtgccccatccacttccgcaggtctgggagactgtaatcatcgagtcgatttgagtaaaaccttctccgtctcgtcagccttggctatgcttcaagaacgccgttgcttgtacgtggttctcacggactccagatgtttcttagtttgcatgtgtttccttacttttattcaggcactgatggtaagtggttatctatcaagcgtgataacgaccatcgaaagaagatactcgctgaaatccagtgagtcaggcttgcttgtttcgtgttttgacataggtaatctcgtcgtcgttgtgtttgtttcgtactttggagggcgagggagacgccctctctggctggccgtcgggggccttctgatcgcctttggtgctgctctctttgccctcccgcattttatttccccaccctatcagatacaagagcttaacgcctcagctccgaatgacggactctgtcaggggggtaattccacagccactcttgagccccccgcctgccctaaggactctggtgggaacaatcattgggtgtatgtggccctgttcatctgcgcccaaatcctgatcgggatgggaagcacccccatttacactttgggccccacttatctggacgacaacgtgaaaaaggagaactccagcctctatctggctattatgtatgttatgggggctctcggcccagccgtagggtatctgctgggtggtctcctgataggattctatgtggacccgaggaatcccgtgcacttggaccagaacgaccctcgatttatcggaaactggtggtcagggttcctcctttgcgccatcgccatgtttctagtgattttccccatgtttaccttcccaaagaaactgccaccccggcataagaaaaaaaagaagaaaaaattctcagtcgacgctgtctcagatgacgacgtcttgaaggaaaagtccaataactctgagcaggccgacaagaaggtttcatcaatgggctttggtaaggacgttcgcgacctgcctagggccgcggtccggatcctgagcaacatgactttcctctttgtatccctgagttacacagccgaaagtgccatcgtcactgctttcattactttcattcccaagtttattgagtcacagtttgggatccccgccagcaatgcttccatttataccggcgtgatcatcgtgccctccgccggtgtgggcatcgtgttgggagggtatattatcaagaagcttaagctgggggctcgggagtccgcaaagctggccatgatctgcagtggggttagcttgctgtgcttcagtacccttttcattgttgggtgcgaatcaattaacctgggtggaattaacatcccgtacaccactggtcctagcctgacgatgccccaccgcaacctcactgggagctgtaatgtcaactgcgggtgtaagatccacgaatacgagcctgtctgtggttctgatggtatcacttattttaacccttgtctagccggttgcgtaaattcaggaaatttaagtaccggtatacggaattacaccgagtgtacctgcgtgcagtcccggcaggtgataactccaccaactgttgggcagcggtctcagcttagggttgtaatcgtgaagacatatctcaatgagaatggttatgcagtgtccgggaaatgtaagcgcacatgcaacacactgattcctttcttagtctttctgtttatcgtcaccttcattactgcctgtgcccagccctccgcaattattgttactctgcgctctgttgaggacgaagaaagaccttttgctctgggcatgcagttcgtgctcttaaggactctcgcctacatcccaacgccgatctatttcggagccgtcatcgacacgacgtgtatgctgtggcagcaggagtgcggagtccagggctcttgttgggaatataacgttacaagctttcgatttgtatacttcggtctggcagctggcctgaagttcgtgggattcatttttatttttcttgcctggtacagcattaagtacaaagaagacggtctgcagcggaggagacagcgggaattccctctgtctaccgtctctgaacgcgtggggcaccctgacaatgcccgcacacggtcgtgtccggctttctctacacagggggaatttcacgaagaaacaggcttgcaaaaaggcatacaatgtgccgcccagacctaccctggcccctttcccgaagctatctcatcttccgcagaccctgggctggaagagtctcccgcagcgctggagcctccatcctag

SEQ ID NO: 30483 - DNA, 2382 bp, Artificial Sequence
  Description of Artificial Sequence: Synthetic coding sequence
atggatgaggggaccggtctgcagccaggagcaggggaacaacttgaggcccccgcaaccgcggaagcagtccaggagcggtgcgagccagaaacactgaggtccaaaagcctgcccgtcctgtcctccgcaagctgccgtcccagcctgtccccaacaagtggggatgcaaatccggctttcgggtgtgtggatagttcaggccatcaggaactcaagcaggggcctaaccccctggccccttccccatcagctccaagcacctcggctggcctaggggactgtaatcaccgagtggatttgtctaaaactttcagcgtgtcttctgctctagcaatgctccaggaacgacggtgtctttacgttgttctcactgactctcgctgttttctggtgtgtatgtgcttcctgacattcattcaggcactgatggtctcgggctacctaagtagcgtaataaccacgattgagcgacgctacagcctcaagagttccgaaagtgggctgttagtgagctgtttcgatatcggaaaccttgtggtcgttgtcttcgtgtcttatttcgggggaaggggacggagacctttgtggctcgccgttggaggcctgctgatcgcctttggagccgctctctttgcactgcctcacttcatctcaccaccctaccaaatacaggaactcaacgctagcgctccaaatgacgggttgtgtcagggagggaattcaactgctacccttgaaccccctgcttgcccaaaggactccggcggaaacaatcattgggtgtatgtcgcgctcttcatttgcgctcagattttgattggaatgggatcaacaccaatttacaccctgggaccgacgtatcttgacgacaacgtgaagaaagagaatagttcgctgtacttggcaatcatgtacgtgatgggcgctctagggcccgccgtgggttatctgttgggcggcctgctcataggcttctatgtggaccccaggaacccagtccatctggaccaaaatgaccccagattcatcggaaactggtggagtggattcctgttgtgtgcaatcgcaatgttcctggtgatttttccaatgtttacctttcccaaaaaactgccgccccgacataagaagaagaagaagaaaaaattctccgtggatgccgtctccgatgacgacgtgttgaaggaaaagtcaaataacagtgagcaggcagataagaaagtgtcaagcatggggtttgggaaggacgtacggggggttatcatcgtgccctcagctggcgtgggcattgtccttggcggctacattatcaagaagctcaaactgggggcccgcgagtctgctaaactagcgatgatttgtagcggagtttcgctgttgtgctttagcacgctattcatcgtcggctgtgaatcaatcaacctgggcggaatcaacataccatatactacaggcccaagcctcacaatgccgcaccggaatctgactggatcctgcaacgtaaactgtggatgcaaaatccatgagtatgaacctgtctgcggaagtgacgggataacgtactttaacccttgcctggccggttgtgtgaatagtggaaatctctccaccggcatccggaattacaccgagtgtacctgtgttcagtcccgacaggttattactccgccgaccgttggtcaacggagtcagctgagggttgtgatcgtgaagacgtatctgaacgagaatggttatgccgtgtccggtaagtgtaaacggacttgcaacacactgatccctttcctggtgtttttgttcattgttaccttcattacggcttgtgctcagcctagtgccattatcgtgacgctccgctctgtcgaagacgaggagagacctttcgcactagggatgcaatttgtattgctgagaactctggcgtacatccctactccaatctatttcggagctgtgattgacacgacatgtatgctctggcagcaggagtgtggagtgcagggaagctgctgggagtataacgtgacgtcattccgtttcgtgtactttggcctggccgccggtttaaagtttgtaggattcatatttatctttctggcctggtacagcataaagtataaagaagacggcctccagagacgacgccagcgtgagttcccactgagtactgtgtctgaacgtgttgggcaccccgacaatgctaggactagaagctgccccgccttctcgacacagggagaattccatgaggagaccggcctgcaaaaaggaatccagtgtgccgcccagacgtatcccggtccatttcctgaagctatttcaagctcggccgatcctgggctggaagagagccccgccgctttggagcctccaagttag

SEQ ID NO: 30484 - DNA, 606 bp, Artificial Sequence
  Description of Artificial Sequence: Synthetic coding sequence
atgttcccagagcagcagaaagaggagtttgtatcagtgtgggtgcgggatccaagaattcagaaagaggatttctggcacagctacatcgactacgagatttgtatccatactaatagcatgtgctttacaatgaaaacctcctgcgtcagacgacgatacagagaattcgtctggctgcgccagcggctacagtccaacgcgctgctcgttcagctgcccgagttaccatccaagaatctgttttttaatatgaacaatcggcagcacgtcgaccagagacggcagggcctggaggattttctgcggaaggttctgcagaacgcgctgctcctgtccgacagcagcctgcatctctttctgcagtcacacctcaacagcgaggacatcgaggcgtgtgtgagcggccagaccaagtactctgtcgaagaggccattcataagttcgcgctgatgaacaggaggttccctgaagaggatgaagagggcaaaaaagagaatgacatagattatgacagcgagagttccagtagcggcctgggccacagcagcgacgacagcagctcccatggatgtaaagtgaataccgctccccaggagagctag

SEQ ID NO: 30485 - DNA, 606 bp, Artificial Sequence
  Description of Artificial Sequence: Synthetic coding sequence
atgttccctgaacaacagaaagaagagtttgtcagtgtgtgggtgcgcgatcccagaatccagaaggaggatttctggcactcgtatattgattacgaaatttgcatccacacaaacagcatgtgttttaccatgaaaaccagctgcgtgagaagaaggtatcgggagtttgtctggctccggcagcgattgcagtcaaacgctcttctggttcaactgcctgaactcccttctaaaaatctgttctttaatatgaataaccggcaacatgtagaccagagaagacaaggcttggaagactttctgcggaaagtcctgcagaatgcccttctcctgagcgacagctcactgcatctgttcttgcagagccatctcaactccgaggacattgaggcctgcgtcagtggacagacaaagtacagcgtggaggaggcaatccataaattcgcgctgatgaacaggcgctttcctgaggaggacgaagaggggaaaaaggagaacgatatcgactacgacagcgaatcctcctcctccggcctcgggcactccagcgatgattcttctagtcacggttgcaaggtaaacacagccccacaagagagctag

SEQ ID NO: 30486 - DNA, 684 bp, Artificial Sequence
  Description of Artificial Sequence: Synthetic coding sequence
atgattctcatggaagggatcggatgtatgcgacattctagcctgacacgacaacccaaactgccatatcgcagcctggcgtccgctcgcggtgggcttcaagaattcgtctccgtgtgggtgcgggatcccagaatccaaaaggaagatttttggcacagctacattgactacgaaatatgtattcatactaactccatgtgcttcacaatgaagacaagttgtgtgcgcagacggtacagggaatttgtctggctgcgacagagattgcaatcaaatgcattgttggtccagttaccggagctgccgagcaagaacctgtttttcaatatgaataataggcagcacgttgatcagcgaaggcaggggttggaagacttcttacggaaagttttacagaatgccctactgctatccgatagttccctccatttatttcttcagtcccacctcaactctgaggatattgaggcctgcgtatccggtcagactaaatactccgtggaggaggcgatccataagttcgctctgatgaataggcggtttcctgaggaagacgaggagggcaaaaaggagaatgatatcgattatgactcggagtcctccagcagcgggctgggccattctagcgacgactcctccagtcacggctgcaaagtgaacacagccccacaagagtcgtag

SEQ ID NO: 30487 - DNA, 354 bp, Artificial Sequence
  Description of Artificial Sequence: Synthetic coding sequence
atgaacaatcgccagcacgttgatcaacggagacagggcctcgaagatttcttgcggaaagtgctgcagaacgctctgctgctgagcgactccagcttgcacctcttccttcagagtcatcttaatagcgaagacattgaagcttgtgttagcggtcagacaaagtactccgtcgaggaggccattcataaattcgcgcttatgaacaggagattcccggaggaggatgaggagggaaagaaggagaacgatatagactatgattcagagagttcatcaagcggcctcgggcattcatcagacgatagctccagccacggctgtaaagtaaacacagctccgcaggaatcttag

SEQ ID NO: 30488 - DNA, 2841 bp, Artificial Sequence
  Description of Artificial Sequence: Synthetic coding sequence
atggtcccatgggtccgtacaatgggacaaaagctgaaacagaggctgcgccttgacgtaggaagagaaatatgccggcaatatcctctgttttgcttccttctcctctgtttgtccgctgccagcttgctactaaatcggtatatacacattttgatgatattttggtccttcgttgccggtgtcgttaccttctactgcagtctgggccctgactctctgctcccaaacattttcttcacaattaaatacaagcccaagcagctgggactgcaagagctatttccgcagggtcacagttgtgccgtgtgtggcaaggtgaaatgtaaacgacataggccaagcctgctgctcgagaattaccagccatggctggatctgaaaatttcctctaaggtggacgcttcactgagtgaggtccttgagttggtgcttgagaactttgtgtacccctggtaccgggatgttacagatgacgagtctttcgttgacgagcttcgcataacgctgcggttcttcgcgagcgtactgattcgcagaatacacaaggtagacatcccttccatcatcactaagaaactgctgaaagctgcaatgaaacatatcgaagttatcgtaaaggccagacaaaaggtgaagaatactgaatttcttcagcaggccgcacttgaagagtacggacctgaactgcatgtggcactgagaagtcggcgggatgaactgcattatttaaggaagttgaccgaactgctcttcccctacattttgccccccaaagctacggattgcaggtccctcacactccttatcagagagatcctgagcgggagtgtgttcctcccctcactcgatttccttgccgacccagatacagttaatcacctactgattattttcattgacgactctccacctgaaaaggccaccgagcctgcctcccccctggttcctttcctgcagaagtttgctgagccacgcaataagaagccctccgtgctgaagctggagcttaagcagatacgggagcagcaagacctcctgtttagatttatgaattttcttaaacaagaaggcgccgttcatgtgctgcaattttgccttactgtggaggagtttaatgacaggatcttgcgccctgagctgagtaacgacgagatgctgtccttgcacgaggagcttcaaaagatttataaaacgtactgtttagacgaatcaatcgacaagattcggtttgacccatttatcgtggaagagatacagagaatcgcagaggggccttacattgacgttgtcaagctccagacaatgagatgtcttttcgaagcttatgagcacgtgctgtcattacttgaaaacgtgtttactcctatgttctgccacagcgatgaatatttcagacagctactaaggggggctgaatccccaaccagaaacagcaaactgaacagaggctccctgagtttagatgattttagaaatacccagaaacgtggcgagtcctttggtataagccggatcggctctaaaattaagggggtcttcaagagtaccacaatggagggggcaatgctgcctaattacggagtcgcagagggggaggatgacttcattgaagagggcatagttgtcatggaggatgattcacccgtcgaagctgtgtccactcccaacacccctaggaatttggctgcttggaagatctccatcccatatgtcgacttctttgaagacccttccagcgaacgaaaagagaagaaagaaaggatcccagttttctgcatcgatgttgaaaggaatgaccgaagagcggttggccacgagcctgagcactggagcgtctatcggcgttatctcgagttctatgtgctcgagagcaagctgacggaattccatggtgcatttcccgatgcccagctgccttctaagcggatcatcgggcccaagaactacgagtttctgaagtcaaaaagggaggaattccaagagtatctgcaaaagctgcttcagcatcccgagctaagcaattcccagttactggctgatttcttgagcccaaacggcggggagacccaattcctagataagattcttccagacgtcaatctagggaaaattatcaagtcggtgccaggaaaattgatgaaggagaaaggtcaacatctggaaccgttcataatgaatttcataaactcatgcgaatcccctaagcctaaaccttcaaggcctgaactgacaatactgtccccaacttccgagaataataagaagctgtttaacgacctgttcaagaataatgcaaatagagcggagaataccgagagaaagcagaaccaaaattacttcatggaggtaatgacagttgagggtgtctacgactacctgatgtatgtggggcgggtggtgttccaggtgcccgactggctgcatcacctgctaatggggacccggatactgttcaaaaacacactcgaaatgtacactgattattacctgcagtgtaagctggaacagctgttccaagagcatcggctggtgagccttattacactcctgcgcgacgcaattttttgtgagaacaccgaacccagaagccttcaggacaagcagaagggcgcgaagcagacatttgaggagatgatgaactacatccccgacctgctggtcaagtgcataggcgaagaaaccaagtacgagtcaattcggttgctgttcgacggccttcaacaacccgtgctgaacaaacagctgacttatgtgttactggatatcgtgatccaggaactgttcccagaactgaataaggtgcagaaggaagtcaccagtgtgacttcatggatgtag

SEQ ID NO: 30489 - DNA, 2682 bp, Artificial Sequence
  Description of Artificial Sequence: Synthetic coding sequence
atggtcccctgggtgcggactatgggacagaagctgaaacagcgacttcgattggacgtgggtcgggaaatctgccgacagtaccctctgttttgctttctactgctgtgcctatcggcagcttcccttttactaaatcggtacattcatatcctcatgatcttttggtcattcgtggcgggcgtcgtgacattttattgcagcctgggtccggactccctcctgcccaatattttttttacgattaagtacaagcctaaacagctgggcctgcaagaattgttcccacagggacactcatgtgcagtttgtggcaaggttaaatgtaagcgacacagaccatctctgctgttggagaactatcagccttggctggacttgaaaattagtagtaaggtggatgcatcactctcagaagttgacatcccatctattatcacaaagaagttgctgaaggctgcaatgaagcatatagaggtcatcgtaaaagcccgtcagaaggtgaagaacactgaattccttcagcaggctgctttagaggaatacgggccagagctacacgtggccttgagatctagaagagacgaactgcattacttaaggaaattaactgaactactgttcccgtacattctccctccaaaagccaccgattgcaggtcattaacactcctgatccgggagatccttagtggatcggtgttcctgccctctctagactttctggcagatccagatacggtcaaccacctcctcatcatctttatcgacgattctccacccgaaaaggctaccgagcctgcctctccactagttccttttctccaaaagttcgccgagccaaggaacaaaaagccgtcggtcctcaagctggagctgaaacagattcgggagcagcaggaccttctgttcaggttcatgaactttctcaagcaggagggcgccgttcatgttttgcagttttgcctgacagtcgaagaattcaacgatagaattttacgacccgagctctctaacgatgaaatgttgtcactacacgaggaactccagaagatctataaaacatactgcctcgatgagtcaattgataagataaggtttgatccattcatcgtagaagaaatccaacggatagctgagggcccttatattgatgtcgtaaaactgcagactatgagatgcttgttcgaggcatatgaacacgtgctctccctgttagaaaatgtgttcacaccgatgttctgccacagcgacgaatactttagacaattgttgaggggcgcagaatctcccacccgcaacagcaagctcaaccgcaatacgcagaagcgaggcgagagctttgggatttcaagaatcggatccaagatcaaaggcgtgtttaaatccactaccatggaaggagccatgctacccaattatggcgtggccgagggcgaagatgatttcattgaagagggcattgtggtgatggaagacgacagcccagtggaagccgtctctacacctaacacgcctagaaatctggctgcctggaagatctccatcccctatgtagacttctttgaggatccttcttcagagcgtaaagagaagaaggaaaggatccctgtgttctgtatcgatgtcgaacgcaatgatcgacgcgctgtaggtcatgagccggaacactggtctgtttaccggcgttatcttgaattttacgtactcgaaagcaagttaacagaatttcatggtgccttcccggacgcccagcttccatctaaaaggataatcgggccaaaaaactatgagttcctgaaaagtaagcgagaagaatttcaggaatacctgcagaagctcttgcagcatcccgagctgagcaatagtcagctactggccgacttcttatcacccaacggcggggaaacacagtttctcgataagattctcccggacgtgaatctcggcaagatcataaagagcgttcccggcaaactcatgaaggaaaaaggacaacacctggaaccatttattatgaattttattaacagctgcgagtcccctaaaccaaaaccgagccgacccgaactaactatcctgtccccaaccagtgaaaacaacaaaaagttgttcaacgaccttttcaaaaacaacgctaacagggcagagaacaccgagcgcaaacagaaccagaattactttatggaggtgatgacagtggaaggagtgtatgactaccttatgtacgtgggtcgggtggtgttccaggtccctgattggctgcaccacctccttatgggaacacgtatactgttcaaaaatactctggagatgtacactgactattatctgcaatgtaagctcgagcaactgtttcaggagcataggttagtttctctgattactctccttagagacgccatcttctgtgagaacaccgagcctaggagcctacaggataagcaaaaaggcgctaaacagaccttcgaagaaatgatgaactatatcccagacctcctcgtgaaatgcattggggaggagaccaaatacgagagcattcgattgctgtttgacgggctccagcaaccagtcctcaataagcagttgacatatgtcctgctggacattgttatacaggagctctttcccgaactgaataaagtgcagaaggaggtaacaagtgtgacttcatggatgtag

SEQ ID NO: 30490 - DNA, 2814 bp, Artificial Sequence
  Description of Artificial Sequence: Synthetic coding sequence
atggtgccctgggtgcgaaccatggggcagaaattgaagcaaagactaagactggatgtggggcgtgagatctgcaggcaataccccctgttctgctttctgctcctctgcctgtcagcagcctcattacttctgaatcgctacatccatatcctcatgatattttggtcttttgtcgccggggtcgtgaccttctactgctctctcggtcccgacagcctgctgcccaacattttcttcacaatcaagtacaagcctaaacagctgggactgcaggaactgttcccacaggggcactcatgcgcagtatgtggcaaggtcaagtgcaagagacaccggcccagtctcctcttagagaattatcaaccttggctggatctcaagatcagtagtaaagtggacgccagcttgagcgaggtgcttgagctggtgctggaaaactttgtatacccctggtatagggatgtaaccgacgatgagagcttcgtggacgaactacggatcacactgagatttttcgcgagcgtgcttatacgccggatccataaagttgacatcccgagcatcattaccaagaaactgctaaaagccgccatgaagcatattgaggtgattgtgaaggcccgacagaaggtgaaaaatacagagttcctccagcaggccgccctcgaggaatatggcccagagctgcacgtcgcccttcgcagtaggagggacgagctccactaccttaggaaactaacagagctcctttttccctatattctgcctcccaaggctacggattgtcggtctctgacactgctgatccgcgaaatcctcagcggcagcgtcttcctgccatccttggatttcctggccgatcctgacactgtgaaccatttgttgatcatctttatcgatgattccccgcccgagaaggctacggaaccggcaagtcccctcgtgcccttcttacagaaattcgcggagccccggaataagaagccatcagtgctgaagctcgagctgaagcagatccgcgagcagcaagacctgttgtttagatttatgaacttccttaaacaggagggagctgtgcacgtgttgcagttttgcctaacagtcgaggaatttaacgatcgtatcctcaggccagagctgagcaatgacgagatgttgtcactgcacgaagaactgcagaagatttacaagacttattgtctggacgagtctatcgacaaaatccggttcgacccgtttatcgttgaggagattcaaaggattgcagaaggcccctatatcgatgtggttaagctccagaccatgaggtgcctctttgaggcttacgagcatgtcctgtccctgctggagaatgtgttcactcctatgttttgtcattctgatgagtatttccgacagttactgcgcggggccgagagccctacacggaattccaaacttaatcgaaacactcagaagaggggtgaatccttcggtatttctaggatcggatccaaaatcaagggagtgttcaagagcactactatggagggagcgatgctccctaattatggggtcgcagagggcgaggacgactttatcgaagagggcattgtggtcatggaagatgacagtccagtcgaggcagtgagcactccaaatactccccgaaatctggctgcctggaagatctctattccttacgtagatttcttcgaggatccctcaagcgagcggaaggagaaaaaggaaaggattccggttttctgtattgacgtggaacgtaatgatagacgcgccgtcggccacgaaccagaacactggagtgtctataggagatatctcgagttctatgtgttagagtccaaactcaccgaatttcatggcgcgttcccagacgcccagctaccttcaaagaggatcatcgggcccaaaaattatgagtttctgaagagcaaacgcgaggagtttcaggagtatcttcagaagctgctgcagcaccctgagctctcgaactctcagctcctcgcagattttctcagtcctaatggaggtgagactcagtttttagataagattctaccggatgtgaatctaggaaaaattattaagtcggtgcccggaaagcttatgaaagaaaagggacaacacctggaaccctttattatgaacttcattaactcatgtgaatcgcccaaaccaaaaccttctaggcccgagctgacaatattaagtcccacgtccgagaacaacaaaaaattgttcaatgatctgtttaagaacaatgctaacagagccgagaataccgaaagaaaacaaaatcagaactacttcatggaggtgatgaccgtagagggcgtctacgactacttaatgtacgtaggaagggttgtgtttcaagtgccagattggttacaccacctgttgatgggtactcggatcctgttcaaaaatacacttgaaatgtacaccgactactacctgcagtgcaagttggagcagttgtttcaggagcatcgtctggtctcactgatcaccctgctgagagacgccatcttctgcgaaaataccgagccacggtccctgcaggataaacaaaagggagctaagcagacattcgaggaaatgatgaactatatcccggacctcctggttaaatgtattggagaagagacaaaatatgagagtatacgcctactattcgacggtttacagcagccagtcctgaacaaacaactgacttatgtgctgcttgacatcgtcatccaggagttatttcccgagttgaacaaggtccagaaagaggtgacaagcgtgactagttggatgtag

SEQ ID NO: 30491 - DNA, 1047 bp, Artificial Sequence
  Description of Artificial Sequence: Synthetic coding sequence
atggaagacgactctcccgtggaggcagtgtcaaccccaaacactccgaggaatctggccgcatggaagatttccattccatatgtggacttcttcgaggaccccagctctgaacggaaagagaaaaaggagcggatccctgtgttttgtatcgatgtcgaacgcaatgatcgtagggcagtcgggcatgagcctgaacactggtccgtgtatcgacgatacctggagttttacgttctggagtctaagcttaccgaattccatggagctttcccagatgcacagcttccgtcgaagcggatcattggtcccaaaaactacgagttcctaaaatcaaagagagaagaattccaagagtacctgcaaaagttgcttcagcaccctgagctgtccaattcccagttactggctgattttctcagtccaaacggtggagagacgcagtttctggataaaatcctgcctgatgtgaacttggggaaaattatcaagtccgtgcctggtaagctgatgaaagagaagggtcagcacctcgaacccttcataatgaacttcatcaacagctgtgagagtccgaagccaaaaccctctcgcccagagctcaccatcctgtcccctactagcgagaacaacaagaaactgttcaatgacctcttcaaaaataacgctaacagggccgagaacaccgagagaaagcagaaccagaactatttcatggaagtgatgacagtggagggggtctacgactaccttatgtacgtcgatgctattttctgtgagaatacggaaccgcgctcccttcaggacaagcagaagggcgcaaagcagacgttcgaagagatgatgaactacatcccagacttgctggttaaatgcatcggagaagagacaaagtatgaatccataagacttctgttcgatggcctccagcaacccgtgcttaataaacagctgacttatgtgctgctggacattgtcatccaagagctgttccctgaacttaataaggtccagaaggaagtcacttcagtgacatcttggatgtag

SEQ ID NO: 30492 - DNA, 2685 bp, Artificial Sequence
  Description of Artificial Sequence: Synthetic coding sequence
atgatattctggagcttcgttgctggagttgttaccttttattgcagcctcggccccgatagcctgctgcccaatattttcttcaccattaagtacaagccaaagcaactcggcctccaggaacttttcccccaggggcactcatgcgcggtgtgcggtaaggtcaaatgcaaaaggcaccggccctcattactgcttgaaaattatcagccttggctggacttgaaaattagcagcaaagtcgatgcgtctcttagtgaggtgcttgagttagtgctagaaaacttcgtctatccgtggtatcgtgacgtgacggacgacgagagcttcgtggacgaactcagaatcacactgcgattcttcgcctcagtcctgatcaggcgcatccacaaggtggacataccatccattatcaccaagaaactactgaaggccgcgatgaagcacatagaggtcatcgtgaaggcaaggcagaaggtgaaaaacaccgaatttctgcagcaggcggccctcgaggagtacggtcccgagctccatgtcgccctgaggagcaggcgggacgagttgcattatcttcgaaagctgacagaacttcttttcccatatattctgccccccaaggccaccgattgtcggtccctgaccctactaattcgggaaattttgagcggcagcgtctttctgccaagtctggattttttagctgacccggacacggtgaatcatttgctaattatattcattgatgactcaccgccagagaaagccaccgagcctgcttcgcccttagtgcctttcctccagaaattcgccgaaccgcggaacaaaaaaccctcagttctgaagctggagctcaagcagatccgtgagcagcaggaccttctttttcggtttatgaactttctgaagcaagagggtgccgtgcatgttctgcagttctgcctcaccgtggaggagttcaatgataggattctgaggccggagctgtcaaacgatgagatgctgtctctgcacgaagaacttcagaagatctacaaaacgtattgcctagatgaaagcatcgacaaaatccggtttgatccgtttatcgtagaagagatacagcgcattgctgagggcccatatatcgatgtcgtcaagctgcagacaatgagatgtctattcgaggcttatgaacacgttctgagcctcttagagaatgtttttaccccaatgttctgtcatagtgacgaatatttcaggcaactccttcgaggagctgagagccctaccagaaactccaagctaaaccgaggctcactttctctggatgattttcgaaacacccaaaagcggggcgaatcattcggcatttctagaatcgggagtaagatcaagggcgtgttcaagtctaccaccatggagggagccatgctgccaaattacggcgtcgctgagggggaggatgattttatagaggaagggattgtggtgatggaggatgacagtccagtggaagctgttagtacccctaatactccccgcaatctggcagcctggaagatctcgataccttacgtggatttctttgaagatccatcatccgaacgcaaggagaagaaagaaaggattcccgtgttttgtattgacgtggaacggaatgataggcgggccgtgggacatgaaccagaacattggagcgtgtatagaaggtatttagagttctacgtcctggagagcaagctcacggagtttcatggcgctttccccgacgcgcagctccctagtaagaggatcatcggccccaagaactatgagttcctgaagagcaagcgtgaggagttccaggagtatctgcagaagctccttcagcacccggaactctctaactcccagctactagcggatttcttgtctcccaatggcggggagacgcagttcctcgataagatcttacccgacgtaaacctgggcaagatcatcaagtctgtgcccggaaaactaatgaaggagaaaggacaacatcttgaacccttcatcatgaacttcatcaatagttgtgaaagcccgaaacctaagccctctcgtcccgaactgacaattctctcccctacttctgagaacaacaaaaagctctttaacgacctgttcaaaaacaatgccaatagagccgaaaatacagaaaggaagcagaatcaaaactactttatggaggtgatgactgtcgaaggtgtgtatgactacctgatgtatgttggccgggtcgtcttccaggtgcctgattggttgcaccacttattgatgggcactagaatactattcaaaaatactctggagatgtataccgactactacctgcaatgcaagctagagcaactgtttcaggagcacaggctggtctcattgatcaccctcttgagggacgctatcttctgtgagaacaccgaacctcgatccctccaggacaagcagaaaggcgccaaacaaacttttgaggagatgatgaattacattcctgatctgctggtgaaatgtatcggcgaagaaactaaatacgaaagcattcgtcttctgttcgatggtttacagcaacccgtgctgaacaagcagttgacctacgttctgctggatatagtgatccaggaactgtttccagagttgaataaggtccagaaagaagtgacttctgtgacgagttggatgtag

SEQ ID NO: 30493 - DNA, 1035 bp, Artificial Sequence
  Description of Artificial Sequence: Synthetic coding sequence
atggccaccccctacgtccctgttcctatgcccattggcaattctgccagcagtttcactactaatcgcaatcaacggtccagcagcttcggctctgtgtccacctcctcaaatagcagcaaaggtcaactagaggactcaaatatggggaactttaaacagactagtgttccagatcaaatggataatacttcctcggtatgcagttctccattaattagaacaaaattcaccggaactgccagcagcatagaatatagtacgcggccccgggacactgaggaacagaacccagaaaccgtgaattgggaagatagaccctccactcctaccattctcggctacgaggtgatggaagagagagcaaaattcactgtttataagatcctggtgaagaagacacctgaggaaagttgggtagtctttcgtaggtacaccgatttctccaggctgaatgacaagctgaaggagatgtttccggggttccggttagctcttcctccaaagcggtggttcaaagataattacaacgcagacttcctggaggataggcaattaggcctacaggcctttctgcagaatctggttgcccataaagacatcgcaaattgcctagctgtcagggagttcctctgtctggatgatcctccaggacccttcgactcactggaagagagccgagccttctgcgagacgcttgaggaaaccaactatcgcctgcagaaggagctcctggagaaacaaaaagaaatggagagcctgaaaaagctcctgtcagagaaacaattgcatatcgatacattagaaaaccggattagaaccttgtccctggaaccggaggaaagcctcgatgtttcggagaccgagggcgaacaaatcttgaaggttgagtcctccgctttagaggtcgaccaggacgtcctggatgaagagtccagagcagataataagccatgcttatctttttcagagccggagaatgccgtttccgaaattgaggtcgcagaggtagcctacgatgcagaggaagactag

SEQ ID NO: 30494 - DNA, 948 bp, Artificial Sequence
  Description of Artificial Sequence: Synthetic coding sequence
atggcaaccccgtacgtgcctgtacccatgcctataggtaacagcgcatcttcattcaccactaacaggaatcagcggtcttctagtttcggctcggtgtctacaagttcaaatagcagtaaagggcagctggaggattccaacatggggaacttcaaacagacaagcgtgccggatcagatggataacacatcaagtgtgtgttcctcccctctcattaggactaaattcaccggcaccgctagcagcatcgagtattccacccgcccccgagatactgaggaacaaaaccccgaaacagttaactgggaagatcggcccagtacaccaactattctgggttatgaggtgatggaagaacgagcgaagttcactctcaaggagatgttcccgggctttaggcttgccctcccacctaaacgctggtttaaggataattataatgcagattttttggaggatcggcagttgggactccaggccttcctgcagaatcttgtggcccataaagacattgcaaattgcctcgcagttagagaatttctctgtctcgatgatcccccaggccctttcgattctctggaggagtcccgagccttctgtgagacacttgaggagacgaactatagacttcaaaaagaactcttagagaagcagaaagaaatggagagcctgaaaaaacttttgtctgagaagcagctgcatatcgatacgttagagaaccgtattcgaaccctctcccttgagccagaagagtccctcgacgtgagtgagactgagggtgaacaaatcctgaaagtggagagcagcgctcttgaggtcgaccaggacgtcctggatgaagaatcacgtgccgacaataaaccatgtctttcgtttagcgaacccgagaacgccgtgagcgagatagaagtcgcagaagtcgcatacgacgcggaggaggactag

SEQ ID NO: 30495 - DNA, 1035 bp, Artificial Sequence
  Description of Artificial Sequence: Synthetic coding sequence
atggccaccccctatgtgcccgtgcccatgccgattggcaactcggcgtcttctttcacgactaataggaaccagcgctcttcctcctttgggagtgtgtcaacaagcagtaatagctctaaagggcaattagaggacagcaacatggggaattttaagcagacttccgttccggaccagatggataatacatcttccgtgtgctccagtccacttatccgcaccaaatttacaggaacggcctcatcgattgagtactcaacacggccgcgggataccgaagagcagaatcccgagaccgtgaactgggaggataggccttccacacccacaattctgggctacgaagtcatggaagagcgcgcgaaattcactgtgtataaaattttagtcaagaagacgccagaggagagttgggtggtgtttcgtaggtacacagatttctctagattgaacgataagctgaaggagatgtttcctggcttccggttagccctcccacctaagcgttggttcaaggataattataacgctgacttccttgaagatcgccagctcggcctacaggcctttctgcagaacctagtggcccacaaggatattgccaactgtctggcagttagggagtttctctgcctggatgatccccccgggccttttgattcgctggaggagtcaagagccttctgcgaaacactggaggagacaaactatcgactccagaaagagcttctggagaagcagaaagagatggaatctttgaagaagctcctttctgaaaaacagctgcacatcgatacattggaaaacaggataaggaccctgtctctcgagccagaggaatccttagacgtttcggaaaccgagggggaacagatcctgaaggtggaaagctccgctctcgaagttgatcaggatgttctggatgaggaaagcagagcagataacaaaccctgcttgagcttcagtgaaccggaaaatgccgtcagtgagattgaggtggccgaagttgcttatgacgctgaggaagactag

SEQ ID NO: 30496 - DNA, 255 bp, Artificial Sequence
  Description of Artificial Sequence: Synthetic coding sequence
atggcgaccccctacgtgcccgtgcccatgccaatcggaaatagcgccagcagctttactaccaacagaaaccaaagatcgtcaagcttcggctctgtatctacctcatccaatagctctaaggggcagctggaagacagtaacatgggcaacttcaaacagacaagcgtgcctgatcaaatggacaatactagctcagtttgttcgtcccctctcattcgcacaaagtttaccgggacagcaagtagcatttag

SEQ ID NO: 30497 - DNA, 279 bp, Artificial Sequence
  Description of Artificial Sequence: Synthetic coding sequence
atggccaccccctacgttcctgtcccgatgcctatcggtaatagcgcaagctcatttacaacaaatcggaatcagaggtcttcatcttttgggtccgtgtccacatcctcgaactccagcaagggccagctggaggacagcaacatgggcaactttaagcagaccagcgtgcccgaccagatggacaacaccagttctgtgtgtagctcaccattgattaggacgaagtttacagggacagcttcttctattgagtattctacaagaccaagagattag

SEQ ID NO: 30498 - DNA, 111 bp, Artificial Sequence
  Description of Artificial Sequence: Synthetic coding sequence
atggctactccttacgtcccagttcccatgcccatcgggaacagcgcaagttccttcaccaccaaccggaatcaacgatcgtcttcatttggatccgtttctactagttag

SEQ ID NO: 30499 - DNA, 612 bp, Artificial Sequence
  Description of Artificial Sequence: Synthetic coding sequence
atggcaacaccttacgttccagttccaatgccaattggcaactctgcttcatcattcactacgaatcgaaaccagcgttcctcctcgtttggctccgtgtctacctcttctaatagctctaaaggacaactcgaagatagtaatatgggaaatttcaaacagacgagcgtgcctgaccagatggacaatactagcagcgtttgctcctcaccactgatcaggaccaagtttacaggcacagccagctccattgagtattctaccagacctagagacactgaagaacagaatcctgagaccgttaattgggaagataggccgagcaccccaaccatcttagggtatgaggtgatggaggaacgggccaagttcaccgtgtacaaaattctggtaaagaagacccctgaagagagctgggtggtgtttcgtcgatacacagacttctcccggcttaatgacaagcttaaggagatgttcccgggcttccgactcgcgctcccacctaaaagatggttcaaggacaactataatgcggactttctcgaggaccggcagcttggcctgcaggcctttctgcagaatttagtggcccacaaagacattgcaaattag

SEQ ID NO: 30500 - DNA, 1887 bp, Artificial Sequence
  Description of Artificial Sequence: Synthetic coding sequence
atggctctaagggccagggcactctatgacttcaggtcggagaacccaggcgagatatcactgagggaacacgaggtgttgtcgctgtgtagcgagcaagacatcgagggctggctggaaggagtcaattcccgtggagatcggggcctctttcctgcctcctacgtgcaggtcattcgcgcccctgaacctgggcctgcgggcgatggaggaccaggagcccctgcacgatacgccaatgttccccctggcggcttcgaacccctgccagtggctccaccagcctcttttaaaccacccccagacgcctttcaggccttgctgcaaccccaacaggcgcccccgccatccactttccaacctcccggagccggatttccttacggaggaggcgccctacagcccagtcctcagcagttatatggtgggtatcaggctagccagggcagtgacgacgactgggacgatgagtgggatgactcaagtaccgtggctgacgagcccggggcactaggctccggcgcctatcccgatttggatggctcatcttctgctggggttggagccgctggacgatatcgcctgtcgacacgctctgatctaagcctgggcagccggggtggcagcgtaccgcctcagcaccacccgtcgggtcccaaaagtagtgccacagtgtctcgtaaccttaacaggttttctacattcgtaaagtctggtggtgaggcatttgtgctgggcgaagcaagtggctttgtcaaagacggggataagttgtgtgtcgtgctgggcccttatgggcctgaatggcaggaaaacccgtaccctttccagtgtaccatcgacgacccaaccaaacaaacaaaattcaaggggatgaagtcatacatttcttacaaactcgtgcccacgcacacccaggtacctgtgcaccgtaggtataagcattttgactggttatacgccaggctcgccgagaaatttcctgtgatttcggtgccacatcttcccgagaagcaagccaccggacgatttgaggaagactttattagcaaaagacgcaaaggcctgatttggtggatgaatcacatggcttcacacccagtgctcgcccagtgcgatgtgttccagcactttctgacgtgcccttcatctactgatgaaaaggcctggaagcagggcaaacggaaggccgagaaggacgagatggtaggtgccaacttttttctgaccctctccacccccccagcagccgctctggatttgcaggaggtagagtccaagatcgacggctttaaatgttttacgaagaaaatggacgacagcgccttacaattaaaccacacggctaatgagttcgctcggaaacaggttactggctttaaaaaggagtatcagaaagtgggccaatctttccgcggactatctcaggcatttgagctcgatcagcaggctttctccgtgggcctcaaccaagctattgcttttacaggagacgcctatgacgcaatcggcgaactgtttgctgagcagcctagacaggatctggaccccgtaatggacctccttgccctctatcaaggtcatctggccaacttccccgacatcattcatgtgcagaaaggcaaagcctggcccctcgagcaggtgatctggtcagtgctatgtcgactgaaaggagctacgttgacggctgtgccgctgtgggtctcagagtcctactctaccggagaagaggcatctagggatgtggatgcgtgggtgttctcactggagtgtaaactcgactgctcaactggttccttcctgctcgagtatttggccctgggaaatgagtactccttttctaaggtccagcgagtgccgttgatgacggtattgagcttctag

SEQ ID NO: 30501 - DNA, 1776 bp, Artificial Sequence
  Description of Artificial Sequence: Synthetic coding sequence
atggccctgagagcccgcgctctctatgacttcaggtccgaaaaccctggcgaaatctctctgagagaacacgaggtgctgtcgttgtgttctgagcaggatatcgaaggctggcttgagggcgtcaactcgagaggggatcgaggactatttcccgcttcctacgttcaagtgattcgcgcaccagagcccgggcccgcaggtgacgggggacccggggcccccgcgcggtacgcgaacgttcctcctggtggatttgaaccactgcccgtagccccccctgcgagttttaagcctccgccggacgcatttcaggcccttctgcaaccacagcaggcccctcctccatccacatttcagccacctggcgctggattcccttacggaggaggcgccctacagccctcccctcaacagctctacggaggctatcaggccagccaggggtcagacgacgactgggatgacgagtgggacgactccagtacagttgctgacgaacccggagccctcggcagcggcgcctatcctgacttagatggatctagtagcgcaggggtcggtgccgccgggcgttaccggctgtcgacacgttcagacctgagcctgggatcccggggcggctccgtgccgccacagcaccatccatctggacctaaaagtagcgcaacagtgtctcgaaatctcaacaggttcagcaccttcgttaaaagcgggggagaggccttcgtcctcggcgaagctagtggctttgtaaaggacggcgataaattgtgtgtagtcctagggccctacggacccgagtggcaggagaacccctacccatttcaatgcaccatagacgatccaacaaagcagacaaaattcaaaggcatgaaaagttacattagctacaagctggtgcctactcatacacaggtcccagttcatcgaagatataagcacttcgattggctgtacgcccgattggccgagaagtttccagtaattagtgtaccgcatctgcctgagaagcaagctaccggcagatttgaagaggattttatctctaaaagaagaaagggactgatctggtggatgaaccacatggcaagccatccggttttagctcagtgtgatgtctttcagcacttcctgacatgtccaagttccaccgacgaaaaagcatggaagcaggggaaacgcaaagccgaaaaggacgagatggtcggtgcaaatttcttccttacactgtctacgccgccagcagcggccttagatctgcaggaagtggagtctaagatcgacggctttaaatgttttaccaaaaagatggatgattccgcactccaactgaaccacaccgctaacgagtttgcccggaagcaggtgacggggttcaaaaaggagtatcagaaagtgggacaaagttttcgaggcttgagccaagccttcgagctggatcagcaagccttcagcgtcggtctgaaccaggcaattgcctttacaggcgatgcctatgacgcgatcggtgaactgttcgcagagcagcctaggcaggacctcgatcccgtcatggaccttctggcgctgtatcagggtcatctggccaacttcccagacatcattcatgttcaaaaaggcaaagcatggccccttgagcaggtcatctggtctgtactgtgtcgactgaaaggagccacactcaccgcagtgccactgtgggtgagtgaatcttactctaccggggaagaggctagccgcgacgttgatgcgtgggtttttagcctggaatag

SEQ ID NO: 30502 - DNA, 1875 bp, Artificial Sequence
  Description of Artificial Sequence: Synthetic coding sequence
atggctttaagagcacgggctttgtacgactttcgaagtgagaacccaggcgagatatccctgcgggagcacgaggttctctcactttgttcagaacaggatattgaggggtggctcgagggtgtcaactcacgcggagaccgaggactgtttccagccagttacgtgcaagtgatcagggctcctgagcctggcccagccggagatggcggcccgggtgctcctgcgaggtacgcgaacgtgcctccggggggattcgagccgctgcctgttgcccccccagcctctttcaaacctcctccagacgcctttcaggcattattgcagcctcaacaggcgccccctcccagcaccttccagccacccggggctggcttcccctatgggggaggtgctctacagccttccccgcagcagctctatgggggataccaggcttctcaaggctcagacgacgattgggacgatgaatgggatgattccagtactgtcgcggatgaaccgggagccctggggtctggtgcatatcccgatctcgacgggagctcctccgccggcgtgggtgccgctggacggtaccgactgtctacacggagcgaccttagcctgggatcccggggcggcagcgtgcctccccagcatcacccctctggcccaaaatcttctgcaacagtatccaggaacctaaacagattttccacattcgtgaaaagcggaggtgaagccttcgtgcttggagaagcgtccggattcgtgaaagatggtgataagttgtgcgtggttctcgggccttatggccctgagtggcaggaaaatccttatccttttcagtgtaccatagacgacccaacaaaacagactaagttcaaagggatgaaatcatatatcagttacaagctagtgccaactcatactcaggtgcccgtgcaccggaggtataagcactttgactggctgtacgctcgtctggccgagaagttccctgtgattagcgtcccccatctccccgagaaacaggcaacaggtaggtttgaagaggattttatttcaaagagaagaaaggggctgatttggtggatgaaccatatggcctctcatcctgttctggcccagtgcgatgtttttcagcatttcctgacctgtccttcatcaactgacgaaaaagcctggaagcaaggaaagagaaaagccgagaaagacgagatggttggcgccaatttctttctgacgctgtcgacaccgccggccgcagcgctggacttgcaggaagtcgagagcaagatcgacggatttaagtgctttactaagaagatggacgatagcgccctgcagttgaatcatactgctaatgagtttgcccgcaagcaggtaaccggatttaagaaagaatatcagaaagtcggccagtcttttcgtggtttgtcacaggcctttgagctggatcagcaggcatttagcgtgggacttaatcaggccatcgctttcacgggagatgcatacgacgccattggagaactctttgccgaacagcccagacaagatctggaccccgtaatggacctccttgctctttatcaaggtcatttagcaaatttccctgatatcatccatgtgcagaaaggagccttgaccaaggttaaagagagtagaaggcacgtcgaggaggggaaaatggaggtgcagaaggccgatggcatccaagacaggtgtaacaccatttccttcgccacactcgccgagatccaccacttccaccaaatccgggtgcgagacttcaaatcgcagatgcagcacttcctgcagcagcagattatcttctttcagaaggtcacacagaagctggaagaagcgcttcacaagtatgattccgtttag

SEQ ID NO: 30503 - DNA, 2979 bp, Artificial Sequence
  Description of Artificial Sequence: Synthetic coding sequence
atgaagacagaaacagtgccacccttccaggaaacgccagccggctcatcgtgtcacttaaataacctactctcctcacgtaaactcatggccgtgggggtgcttttagggtggttattggtcatccaccttctagtgaacgtatggctgttgtgtttactatcagccttgcttgtggtgctgggaggctggctgggatcttcactggctggcgtggcttcagggcgtctccacctggagcgcttcatacctctcgccacttgtcccccttgtccagaggctgagaggcagctggaacgtgagataaacaggacaatccagatgatcattagggattttgttctgtcatggtacaggtctgtgagtcaggaacctgcctttgaggaagaaatggaagccgccatgaagggattagtgcaggaactgaggaggcgaatgagcgtgatggatagccacgccgtcgcccagtccgtccttacactgtgcggctgccacttgcagagctatatccaggctaaagaggccaccgctgggaagaacgggcccgtagagccctcacatctgtgggaggcttactgtagggctaccgcccctcaccctgctgtgcacagcccgtcagctgaggtgacctacaccaggggagtggtcaatttgctgttgcagggtttggtcccaaaaccacacttggagacacggacaggacggcacgtggtagttgaacttataacctgtaatgtgatacttccactgatcagccgtctgagtgatcccgactggattcacttggttctcgtaggtatcttctcaaaggcccgagatccggccccttgcccagcctccgcacctgagcagccatctgttcccacttctctccccctcatcgcagaggtagaacaattgccagaaggccgggcttctcctgtcgccgcgcctgtgttcctctcctattccgaaccagaaggtagcgccggtccttcgccagaggtggaggaaggccatgaagccgttgagggagacctaggagggatgtgcgaagaacgaaaggtggggaacaacagcagtcatttcttgcaaccaaacgtgcgaggaccactgtttctttgcgaagatagcgaactggaatctcccctatcagagctgggcaaagagaccattatgcttatgacacccggatccttcctcagcgatcgtattcaagacgccctgtgtgcgctggagtctagtcaagcgctagaaccaaaagatggcgaggcaagtgagggcgctgaagcggaggaaggccctggcactgaaacagagacagggctgcctgtgtccactttgaattcttgtcccgagatccatattgataccgccgataaagagattgagcaaggggacgtcactgcttctgtgactgctctgctagaaggccccgagaaaacatgtccaagccgccctagttgcctggagaaggacctcactaacgatgtgagctctcttgatcccaccctgcctcccgttttgctgtccagcagtccgcctgggcccttgtcttccgccactttcagtttcgagccacttagcagtcctgatggcccagtgatcatccagaacctgcgaatcacaggcaccattacagcgagagaacattccggcactggtttccacccgtacactttgtacactgtgaagtatgagactgctcttgacggggagaattcctccggactgcagcagctcgcatatcacacagtgaatagaagatatcgagagttcctgaaccttcagactagactggaggagaagcctgacctacggaagttcattaaaaatgtgaagggaccaaaaaagctgttccctgacttgccactgggcaacatggatagcgaccgggttgaagctcggaagagcttgctggagtcttttttgaagcaattgtgcgcaattccagaaatcgcaaacagtgaggaagtacaggagttcctggcacttaacactgacgcaagaatcgcattcgtgaaaaagcccttcatggtgtctcggatcgataaaatggtagtcagcgctatcgtagataccttaaagaccgccttcccccggtccgagccacagagtccgacagaggagctaagtgaggctgaaacggaatcgaaaccgcagactgagggcaaaaaggctagtaagtctcgcctccgcttttctagtagcaagatttcccctgcactctcagtgaccgaagcacaggataaaattctgtactgcttacaggagggaaacgttgagagtgagactctaagtatgtctgccatggaatcgtttatagaaaagcagacaaagttgttggaaatgcagccaacaaaagccccagagaaggatcccgagcagccaccaaagggcagagtggacagctgtgtaagtgatgcggccgttccagcgcaggatccaagtaatagcgatcccgggacggaaaccgaactcgctgataccgcgttagacctgcttctgctcctgctgaccgagcagtggaaatggctgtgcaccgagaatatgcagaaattccttcggctaatatttggcaccctcgttcaacgttggctggaggtccaagtggccaatttgacttccccacagcggtgggtgcaatatctactgctgctgcaggagtcaatttggccagggggggtgctgcctaagttccctagaccagtgaggacacaggagcagaagcttgccgcagagaagcaagccctgcagtcacttatgggagtgctgcccgaccttgtggtggaaatcctcggggtcaacaagtgccgtttgagctggggtctggtcctggagtcactccaacagccactgattaacagacacctcatctattgcctgggggatatcattttagaatttctggaccttagcgcctccgtggaggagtctgctgcaactacctcagcctctgatactcccggtaactccaaacgcatgggggtgagtagctag

SEQ ID NO: 30504 - DNA, 1308 bp, Artificial Sequence
  Description of Artificial Sequence: Synthetic coding sequence
atgtatgaaactgcactggatggagagaacagtagtggattgcagcaattagcttaccatacagtcaatcgcaggtaccgagagtttcttaacctccagactcggctcgaagagaagcccgacctgaggaagtttatcaagaatgtgaagggccccaaaaaactatttcccgatctccccctggggaacatggattccgaccgggtggaggcccgtaagtctctcctggagagtttcctgaagcaactctgcgctatacctgagatcgcaaattctgaggaggtacaggagtttctggccctcaataccgacgccagaattgcctttgttaagaagccattcatggtgtcgcgaattgacaagatggtagtcagcgccatcgtcgacaccctcaaaaccgcttttcctcgctctgaacctcagagcccaacggaagagctgagcgaggcagaaactgagtcaaagcctcagaccgagggcaagaaagcctctaagagccgtctgcggtttagcagctcaaagatttcaccagctcttagcgtgactgaggcacaggacaagattttgtattgtctccaggagggaaacgtggaatcagagactctgagtatgagcgcaatggaaagcttcatcgaaaaacagacaaagctgctggaaatgcagcctacaaaggcacctgagaaggatccggagcagcctcccaaaggccgggttgactcatgcgtgtccgacgcggccgtccccgcccaggacccatccaactcagatcccggcacggagaccgagctggctgacacagccttagacctgctactgctgttgctgacggagcagtggaaatggctctgtaccgagaacatgcaaaaattcctgagactgattttcgggacactggtgcagaggtggcttgaagtgcaggtggccaacctgactagccctcagcggtgggtgcagtacctgctactcctccaagagtcaatctggcctgggggagtcctcccgaaattcccaaggccggtgcgaactcaggagcagaagttagcagctgagaagcaggccctccagagcctgatgggggtgctaccggacttggtggtggagattctgggtgtgaacaagtgtcgtctatcatgggggctggtgctcgagtctctacagcagccgctgatcaatcgtcatttgatttattgtctgggagacatcatcttagaatttctggatctaagtgcaagcgtggaggagtctgccgccactactagtgcgtccgataccccaggaaatagcaagcgcatgggcgtgtctagttag

SEQ ID NO: 30505 - DNA, 699 bp, Artificial Sequence
  Description of Artificial Sequence: Synthetic coding sequence
atgtctgccatggaatctttcatcgagaagcagacaaaactgctggaaatgcaaccgaccaaagccccagaaaaagacccagagcaaccccccaagggacgggtggattcctgcgtgagcgatgcggctgtgcccgctcaggacccctctaatagcgaccctgggacggagaccgaactcgccgacacggcattggacctcctgctgctgttgctaaccgagcagtggaaatggctgtgcaccgagaatatgcagaaatttctccggctaattttcggcaccctcgttcagcgctggctggaggttcaggttgcgaacttgacatcacctcagcgttgggtccagtacctcctgttgctccaggagagcatttggccaggtggggtactgcctaagtttcccaggcctgtgcggacgcaggaacagaaactggctgctgaaaaacaggcccttcagtcactgatgggagttctgcccgacctggtcgtggaaattctgggcgtgaataagtgcagactgtcatggggtctggtcttggaatccctgcagcagccgctcataaacaggcacttgatttattgcttaggagacatcatcttggagttcctggacttatcagcctcggtcgaggaaagcgcggccactaccagcgcctctgacacaccaggaaactctaagagaatgggagtatcctcatag

SEQ ID NO: 30506 - DNA, 582 bp, Artificial Sequence
  Description of Artificial Sequence: Synthetic coding sequence
atgctggaagtacatatcccttccgtcgggcccgaagcagagggtccacgtcaatcacctgagaaaagtcacatggtcttccgcgtggaggtgctgtgttctgggcgccggcatacagttcctagaaggtattcagagttccatgccttgcacaagaggataaaaaagctttataaagttccagattttccatctaagcgcctacccaattggcgtacgagggggcttgagcagcggcgacaaggcctggaggcatatattcaggggatcctgtaccttaaccaggaagttcctaaggagttactagagttcctacggttacgccactttcccaccgaccccaaggccagcaattgggggaccctccgcgagtttttgccaggagattcatcttcacagcagcaccaaaggccggtattgagctttcacgttgatccgtacgtgtgtaatccgtcacccgaaagtctgcctaacgtagtggttaatggggtccttcaagggttgtacagttttagcatcagcccggacaaggcccagcccaaggccgcttgtcatcccgcacccctgccacctatgccctag

SEQ ID NO: 30507 - DNA, 525 bp, Artificial Sequence
  Description of Artificial Sequence: Synthetic coding sequence
atgctggaggtgcatatacccagtgttgggccggaagccgagggaccccggcaaagtccggagaaaagccatatgattaaaaaactctacaaagtgcctgactttcctagcaaacgtcttcccaactggaggacccggggccttgaacagagacgccagggcttggaagcctacattcagggtatcctgtatcttaatcaggaggtgccaaaggaactcctagagttcctaagactgagacacttccccacagacccaaaggcgagcaattgggggacgctgagggaatttctcccaggggacagttcaagccaacagcaccaacgccctgtcctaagctttcacgtggacccgtacgtctgcaatccatcgcccggggaggaggtcccccggtacggtgccacaggcctgggctgcggcctctgcatttctcgtttactgggtccttccgacagcatatcttttctcctgcccacgtcaggtgccaccacatcatgctcctgccccctggagcctgctctgtag

SEQ ID NO: 30508 - DNA, 510 bp, Artificial Sequence
  Description of Artificial Sequence: Synthetic coding sequence
atggaagtttatatcccttcgttccggtacgaggagtctgatctggagcgtggctacacagtgtttaaaattgaagtactaatgaacgggagaaagcattttgtagaaaaacgctatagtgagtttcacgctctgcataagaagttgaaaaagtgcattaagacaccagagattccgagtaagcatgtaaggaactgggtgccgaaagtgctagagcagagaaggcagggattagagacatacttacaggctgttatcctagaaaacgaggagttaccgaaactgtttctggacttcctgaatgtgcgacatctgccatctctgcccaaggctgaatcctgcggctccttcgatgagaccgagtccgaggagtctagtaagctttcacaccaacccgtgttgctgttccttagggacccctatgtacttcccgcagccagtgacttcccaaacgtggtgatagagggagtgcttcacggtatcttctaccctcacctgcagccccggtag

SEQ ID NO: 30509 - DNA, 480 bp, Artificial Sequence
  Description of Artificial Sequence: Synthetic coding sequence
atggaagtttatatccccagctttcgttacgaagagagcgatttggagagagggtataccgtgtttaagatcgaagtcttgatgaacgggaggaaacattttgtcgagaagcgctactcagagtttcacgccttacacaagaagctcaagaaatgcatcaagacacctgagatcccctcaaaacatgtccgtaattgggtgcctaaggtcctcgaacaacggcgacaaggcctggagacatacctccaggccgttattttagaaaatgaggagctgccgaagctgttcctggattttctcaacgtcagacaccttcccagcctcccgaaagctgagagctgcggctcttttgatgagactgagtccgaagaatctagtaaactctctcatcagccagtcctactctttttaagggatccttatgtgttaccagctgcatcaggcaatcagacctgccaccttctcacagccctttactag

SEQ ID NO: 30510 - DNA, 480 bp, Artificial Sequence
  Description of Artificial Sequence: Synthetic coding sequence
atggaagtgtacatcccaagctttcgatacgaggagtcagaccttgaaagagggtataccgttttcaaaattgaagtcctgatgaatgggaggaagcattttgtagaaaagagatactccgaatttcacgccctacacaagaaactgaagaaatgtatcaaaacaccagagattccctccaagcatgtcagaaactgggtgcccaaagtgctcgaacagcgacggcagggactagagacatacctgcaggccgtgattttggagaacgaagagctgcctaagctctttctagacttcctgaatgtgcggcacctgccctcccttcccaaggccgagagctgcgggagttttgacgagacagaatccgaggagtcgagtaagctgtcacaccagccggttctgctgttccttcgggacccttacgtgcttcccgccgcgagtgggaaccagacctgtcatctgttgactgccctgtactag

SEQ ID NO: 30511 - DNA, 1086 bp, Artificial Sequence
  Description of Artificial Sequence: Synthetic coding sequence
atgcgcaatttaaatattaaagatgtctctaagctgaaggatgaaatcattctcatcgagaaggaaagaactgacctgcagctgcacatggctagaacagattggtggtgcgagaatctgggtatgtggaaggcttccatcacgtcaggggaggtcaccgaagaaaacggagaacagctgccctgctatttcgttatggtctcccttcaggaggtgggcggagtggagaccaaaaactggacggttccaaggcgcctttcagaatttcagaacctgcatagaaagctttcagagtgcgtaccctcactgaaaaaggtgcagttaccatctctgagtaagctcccgttcaagtctattgatcagaagttcatggagaaaagtaagaatcaactgaataagttcctgcagaatctgctgagtgacgaaagactgtgtcagtctgaggcgctgtatgccttcttgtccccctctcccgactacctcaaagtgattgatgtccaaggtaagaagaacagcttttcgctgtcatcattcctggaacgactgccccgcgactttttcagccatcaggaggaggagacggaggaggacagtgatctcagcgactacggtgatgacgtggatggtcgtaaggacgcccttgccgagccctgcttcatgctcataggcgagattttcgagttgcgtggaatgttcaaatgggtacggcgcactctaattgctctggtccaggtgacatttgggcggacaattaacaagcaaattagagataccgtttcatggatttttagcgaacaaatgctggtgtattatatcaacatttttcgtgacgcattctggcccaacgggaaactcgctccccccacaaccattaggtcaaaggaacagtcacaggaaacaaagcagcgggcgcagcaaaaattactggaaaacattcccgacatgttgcaatcgctggtagggcaacagaacgccaggcacggtattatcaagatttttaacgccttacaggagacaagggcaaataagcatttattgtatggtacttccacaaacaccctgttgtccccacgcgatcatgattag

SEQ ID NO: 30512 - DNA, 2523 bp, Artificial Sequence
  Description of Artificial Sequence: Synthetic coding sequence
atggacaaagccctgaaagaagtattcgactactcttatcgcgactacatcctgagctggtatgggaacttgtcacgagacgaaggacagctgtaccacttactcctggaagatttctgggagatcgctaggcagctgcaccatcgtctgtctcacgtcgatgtagtgaaggtcgtatgtaacgatgtggtccggacacttctcactcacttctgtgacctcaaggcagctaacgcccggcatgaggaacagccccggccatttgtgctgcacgcctgccttcggaattccgatgatgaagtccggtttctgcagacatgcagccgggtcctcgtgttttgcctcctaccttcaaaggatgtgcagtctcttagcttgcgaatcatgcttgccgagattctcaccacaaaggtgctcaaaccagtcgttgagctgctgtccaatccagactacatcaaccagatgttacttgcccaacttgcctaccgggagcagatgaatgagcatcacaagcgagcctacacttacgccccatcttacgaggacttcattaaactaatcaattcgaattctgacgtcgagtttctgaaacagctgcggtatcaaatcgttgtcgagatcatccaagccactaccatctctagctttccgcagttgaaacgacataaggggaaggaaactgctgccatgaaagcagatcttctacgcgctagaaacatgaaaaggtacatcaaccagcttactgtagccaagaagcagtgtgaaaagcggatccgaattctcggcggtccggcttacgaccagcaggaggacggtgcccttgacgaaggggagggaccacagtcccagaaaatcctccaattcgaggatatcctggccaacaccttttacagggagcatttcgggatgtatatggaaagaatggacaagcgggctctcatatcattctgggaatccgtggagcaccttaagaatgccaacaagaacgagatcccgcagttagtgggtgagatatatcagaactttttcgtcgaatccaaggagatttccgtggagaagtctctctataaagagatccaacagtgcctggtcggcaataaggggatcgaagtgttttataagattcaggaagacgtgtacgaaaccctcaaggatcgatactacccgtctttcatagtgtctgacctgtatgaaaaactcttgattaaggaggaggaaaaacatgcttcacagatgatatcgaataaggatgagatgggcccgcgcgatgaagccggagaagaggcagtggatgacgggaccaatcaaatcaatgaacaggctagttttgccgtgaacaaacttcgcgagttgaacgagaaattggaatataagaggcaggccctcaatagcattcaaaatgctcccaagcctgacaaaaagatcgtgtcaaaactgaaagacgagattatactgatcgagaaggagcgcacagacttacagctccatatggcaagaaccgactggtggtgcgaaaacctgggaatgtggaaggctagcattacctccggggaggtgaccgaggaaaacggggaacagcttccctgctatttcgtcatggtgtctctgcaggaggtgggcggcgtggaaactaagaattggactgtgccacgcagactctcagaattccagaatctgcatcggaagcttagcgaatgcgtgccgagcctcaaaaaggtgcaactcccctcactgagtaagctgccgttcaaaagcatcgatcagaagttcatggagaaatctaagaatcagttgaataagttcttgcagaacctcctgtccgatgagcgcctctgtcagtcggaagccctgtatgctttcttgtcccctagtcccgattaccttaaagtgatcgatgtgcaaggtaagaaaaacagcttctcactgtcaagctttctcgaaagacttccccgggattttttctctcaccaggaagaggaaaccgaggaggacagtgacctctccgactatggggacgatgttgacggtcggaaagacgccctggcagagccttgcttcatgctcattggcgagatcttcgagctgcggggcatgtttaaatgggtgaggagaacactgattgccctagtccaagtgacttttggtaggaccatcaataagcagatccgcgacacagtgtcttggatattctctgagcagatgctcgtgtactatatcaacatctttcgcgacgctttttggcctaatggcaagttagccccaccaacaacaatacgatccaaggaacagtctcaagagaccaagcaaagagctcagcaaaagcttctagagaatatacccgacatgctgcagtccctagtcggacagcaaaacgccagacacggcattatcaagatattcaatgctttgcaagaaacaagagctaacaagcatctgctttacgcgcttatggaactgctacttatcgagttgtgccccgagctgcgagtacacctggaccagctcaaggccggacaggtttag

SEQ ID NO: 30513 - DNA, 2523 bp, Artificial Sequence
  Description of Artificial Sequence: Synthetic coding sequence
atggacaaagccctgaaggaggtcttcgactactcttacagagactacatattgagttggtatggaaatctatcaagagacgaggggcagttgtaccatctgcttctagaagatttttgggagatcgccagacagctgcatcataggttaagccacgtcgacgtcgtgaaggtggtgtgcaatgatgtcgtgcggacactgctcacccacttttgcgatctgaaggcagcaaacgcaaggcacgaagaacagccccggccttttgttcttcatgcctgccttcgaaattcggacgatgaagtgcgattcttgcagacctgtagtcgggtactggttttctgcctcctcccaagcaaagatgtgcagtctctgagcctaaggatcatgctcgctgaaattctgacaacaaaggtgctcaagccggtggtggagctccttagtaacccagactacatcaaccagatgttgctggcccagttggcttacagggaacaaatgaatgaacatcacaagcgggcctacacatacgcaccatcctacgaggatttcattaaactaatcaatagcaatagcgatgtggaatttctcaaacagctgcggtatcagattgtggttgaaataattcaagctactactatttcatcattcccccagctgaaaagacataagggaaaagaaacagccgctatgaaggcggatcttctgcgggcgcggaatatgaaaagatatattaatcaactgacagttgccaaaaagcagtgtgagaaacgcatccgcatcctgggagggccggcctacgaccagcaggaagacggcgccttagatgagggggaaggtccacagtcccagaagattttgcaattcgaagacattctcgccaacactttttatcgggagcacttcggtatgtatatggagaggatggacaagcgcgcactgatctcattctgggagtcagttgagcaccttaaaaacgcgaataaaaacgaaattccacagcttgtcggggaaatataccagaacttttttgttgaaagcaaggagatttccgtcgaaaagagcctttacaaggagattcagcaatgcttagttggaaacaaaggaattgaggtgttttataaaattcaagaggacgtttatgagactttaaaggacaggtactatccaagcttcatagtcagcgacctgtacgagaaactgttaattaaggaggaggaaaaacatgctagtcaaatgatctcaaacaaagatgagatgggaccacgcgacgaggccggggaggaagctgtagacgatgggacgaatcagattaatgagcaggcctccttcgcggtcaacaaattgcgagagctgaacgagaagcttgagtataagcggcaagccctgaacagcatccagaatgctccaaagccggacaaaaagattgtcagcaaactgaaggacgaaattattttaattgaaaaagagaggactgatctacagttgcacatggctcgcacagactggtggtgtgaaaacttgggtatgtggaaagcctctattacatccggggaggttactgaagagaatggggaacagctgccctgctacttcgttatggtgtctttgcaggaagttggaggcgtagagaccaaaaattggacagtccctcgacggctgagcgagtttcaaaatctccacaggaaactgtccgagtgtgtgccctcactcaaaaaggtgcagctcccaagcttgtcaaagctccccttcaaatccattgaccagaagtttatggagaaaagcaaaaatcagttgaataaattcctgcaaaacctactgagcgatgagagactgtgccagagtgaagccttgtacgcttttttgtccccttcccctgattacctgaaagtgatcgatgtgcaagggaagaagaatagcttcagcttgagttcttttctcgaacgcctgccacgcgactttttttcccatcaggaagaagagacagaagaggactcggacctgagtgactacggagacgacgtagatgggcgtaaagatgctctggccgagccatgctttatgctgattggagagatcttcgagctgcgaggcatgtttaagtgggtgagacggacgctgattgcactagtccaggtcacattcggacggacaatcaataagcagattcgcgataccgtcagctggatattcagtgaacaaatgctggtctactacatcaacatattcagggatgccttctggccaaacggcaagctggctcctcccaccacaatccgtagcaaggaacagtcacaggagacaaaacagagagctcagcagaaattattggaaaacattcccgatatgctgcagtctttggtgggtcagcagaacgctcgccacggaataattaaaattttcaatgccctgcaggaaactcgcgccaacaaacatttgctctacgccctgatggagctgctcctgatcgagctgtgccctgaattgcgcgttcatctggatcagctgaaagctgggcaggtctag

SEQ ID NO: 30514 - DNA, 1356 bp, Artificial Sequence
  Description of Artificial Sequence: Synthetic coding sequence
atggaaggagaaagaagggccagccaggccccttcttccggccttcccgcgggcggcgcaaacggggagagtccaggcgggggtgcgcctttcccagggagctctggttcctcagcactactgcaggcggaggtgttagacctcgatgaagacgaagatgatctcgaagtttttagcaaggatgccagcctgatggacatgaacagtttctcccccatgatgccaactagccccctcagcatgatcaatcagataaaatttgaggatgagcccgatctgaaagacctcttcatcactgtagatgaacccgaatctcacgtgacaaccatcgaaactttcataacttaccgcataataacgaagacaagccggggtgagtttgactcaagcgaattcgaagtgcggcggcgctaccaagacttcctatggctcaagggtaagctagaggaggctcatcccacactgattatcccgccactacctgagaaattcatagttaagggcatggtggagcggttcaatgatgacttcatcgagacacgccgtaaagcactgcataagttcctgaaccggatagccgaccatcccacccttaccttcaatgaggactttaagatttttctgaccgcccaagcctgggaattaagtagccacaagaaacagggtcctgggttgctttctaggatggggcaaaccgtcagagcggtcgcctcaagtatgcgaggtgtgaagaatagacccgaggagtttatggaaatgaacaactttattgagctgttttcccaaaaaattaacctgatcgacaagatatctcaaagaatctacaaagaggagcgtgagtactttgacgaaatgaaggaatacggccccatccatatcctatggtcagctagcgaagaagatctggtggacacgctgaaggacgtcgcctcttgcatcgaccgatgttgtaaggccactgaaaaaagaatgagcggacttagcgaggccctgctcccagtcgtgcacgaatacgtcctgtactctgagatgctcatgggcgtgatgaaacgccgggaccaaattcaagcagagttagattcaaaggtcgaagtgctcacatacaaaaaggccgatacggacctcttaccagaggagataggcaaacttgaagataaagttgagtgcgccaataatgccctcaaggctgactgggaacgctggaaacaaaacatgcaaaacgacattaaactggcttttactgacatggctgaagagaacatccattactatgagcagtgtttggcaacctgggaatctttcctgacctctcagactaacctgcatctcgaggaagcatccgaggataagccatag

SEQ ID NO: 30515 - DNA, 1011 bp, Artificial Sequence
  Description of Artificial Sequence: Synthetic coding sequence
atggatatgaacagtttttcccccatgatgcctacctctcccctgagtatgatcaatcaaatcaagtttgaggacgaacctgatctgaaagatctctttattactgtcgacgagcccgaatcccatgtgactactatcgagactttcatcacctatcgtatcatcaccaaaaccagccgtggggaatttgattcatctgaattcgaggttcgtaggcgctaccaggatttcctctggctgaagggaaagctggaggaggcccaccctacgttgattatccccccgcttccggagaagttcatagtgaaggggatggtggagcggtttaacgatgactttatagagacacgtaggaaggccttgcataagttcctgaatcgaattgctgatcaccccacactaacctttaatgaagattttaagatattccttaccgcgcaagcctgggagctgtcttcacacaagaagcaggggccgggtcttctgtcaagaatgggccagaccgtgcgcgccgtagcgagtagtatgcggggtgtgaagaacagacctgaggagtttatggaaatgaacaattttatagaactctttagtcaaaaaatcaacctgattgacaaaatctcacagagaatctacaaagaggaacgtgagtatttcgacgagatgaaggaatatgggccaattcacattttatggtcagccagcgaggaggatctcgttgacacattgaaagatgtggctagctgcatcgaccgctgttgtaaggcaaccgagaaaaggatgtctggcctgagtgaggccctgctgcccgtggtccacgaatatgttctttactctgagatgcttatgggggtgatgaaaagacgagaccaaatccaagcggagctggactccaaggtggaagtacttacctataaaaaagccgatacagatctgtgcctggctacgtgggagtcctttctaacgtctcaaactaatctgcacctcgaagaggcctccgaggacaagccatag

SEQ ID NO: 30516 - DNA, 1191 bp, Artificial Sequence
  Description of Artificial Sequence: Synthetic coding sequence
atggaaggcgaacgccgggcctcccaggccccttcatcagggttgcccgctgggggggccaacggcgagagcccaggtggcggagcaccatttcctggatccagtggaagcagcgcgctgctgcaggccgaagttctggatctggatgaggacgaagacgacctggaggtgttcagtaaggatgcttccctgatggatatgaattcttttagtccgatgatgcccacatcacctctgagcatgattaaccagatcaagtttgaggacgaacctgacctgaaagacctcttcatcacggtcgacgagcctgagtcccatgtcactacaattgagactttcatcacatatagaattatcaccaagacgagcaggggcgagttcgacagcagcgaatttgaagtgagacgccgctatcaggactttttgtggttgaaaggcaaactggaggaggcccatccaacactgatcattcctgaactttccagccacaaaaagcagggccctgggttgctgtcccgcatgggacaaactgtaagagcagtggctagctccatgagaggcgtcaagaacagaccagaagaattcatggagatgaacaactttatcgagttgttcagccagaaaatcaatcttattgacaaaatttctcagcggatttataaggaagagcgcgagtactttgacgagatgaaggaatatgggcccattcatatcctctggtcggcgagcgaagaggacctagtagatactctaaaggacgttgcttcttgtatcgacaggtgctgcaaagccaccgagaaaaggatgtctggcctgtctgaagctctcctgcctgtggtgcatgaatatgtgctgtacagcgagatgctcatgggagtcatgaagcggcgagatcaaatccaggctgagcttgactcaaaagtggaggtgctcacgtacaagaaggccgacaccgacctgctgcccgaggagatagggaaactggaggacaaagtggagtgtgccaataatgccctgaaggctgactgggagcgttggaaacagaatatgcagaatgatatcaagctcgctttcacagatatggctgaagaaaacatccactactacgagcagtgtctagctacgtgggagtctttccttacctctcagacaaacctgcacctggaggaggcatccgaagacaaaccctag

SEQ ID NO: 30517 - DNA, 1509 bp, Artificial Sequence
  Description of Artificial Sequence: Synthetic coding sequence
atggacctgattcctaacttagccgtggagacatggcttttactagctgtgtcactggtgctgttgtatctctatggcacacgaacacatggcctgtttaagcggttggggatccctggacctaccccgctccctctccttggcaacgttctaagttatagacagggcctgtggaaatttgataccgagtgctataagaagtatgggaaaatgtgggggacatacgagggccaattgccagtcctggcaatcaccgatcccgacgtcataaggaccgttctggtgaaagagtgctatagtgtgtttacgaatcgcagatcccttggcccagtgggattcatgaagagcgccatctctctcgccgaagacgaagaatggaagcgcatccgctccctgcttagtcccacgtttacctcagggaagctaaaagagatgttcccaattattgcccagtatggagacgtgttggtaaggaatctccgcagagaggcggaaaaggggaagccagtcaccctcaaagatatttttggagcctacagcatggatgtgattaccggaacttcgttcggcgtgaacattgactccttgaacaatccacaagatcccttcgtcgagtccaccaaaaagtttttgaaattcggatttttagacccattgtttttgagtatcattctgtttccattcctgacaccagtcttcgaagctttaaatgtgtccctgtttccgaaggacaccattaatttcctatcaaagtcagtcaaccggatgaaaaaaagcagactgaatgacaagcagaagcacagactggatttccttcagctgatgatagatagccagaactccaaggagaccgagtcgcacaaggccttatccgatctggagctggctgctcagtccatcattttcatttttgccggctacgagactacatcctccgtgctgagcttcaccctgtatgagttggctacacacccagatgtgcagcagaagcttcagaaggagattgatgccgttctcccgaacaaggccccacccacctacgacgccgtggtgcagatggaatatctggatatggttgtcaatgaaacactgaggctgttccccgtagccattaggcttgagaggacatgtaagaaagacgtggaaattaatggagtgttcatccctaaaggatcaatggtggttattcctacatacgctttacaccacgatcccaaatactggacggagcctgaagagttccgccctgagcggttttcgaagaaaaaagactcaatagacccctatatctacacaccatttggcacaggtccccgaaactgtattgggatgcggtttgcccttatgaatatgaagctggccctgatcagggttctacaaaacttcagctttaagccatgcaaggaaacccagatcccattgaagttagatacacaggggctactccagcccgaaaagccgattgtgttgaaggtggactcacgggacggtaccttgtccggcgaatag

SEQ ID NO: 30518 - DNA, 129 bp, Artificial Sequence
  Description of Artificial Sequence: Synthetic coding sequence
atgcagatgccgcagggaaatcctcttctgctctcacacacactccaggagctcctggcacgagataccgtacaagtggagttgattccagaaaagaagggtctgtttcttaaacatgtcgagtactag

SEQ ID NO: 30519 - DNA, 531 bp, Artificial Sequence
  Description of Artificial Sequence: Synthetic coding sequence
atgcagatgcctcagggcaatcccctcctgctgtcacatacccttcaagaattgctggcacgcgataccgtccaggtggagctgatacctgagaaaaaggggctcttcctgaaacacgtcgagtatgaggtgtctagccaacggttcaagagctccgtatataggaggtataacgattttgtggttttccaggaaatgctcttgcataaattcccatacagaatggttcctgccctgccccccaaaaggatgcttggggcagacagggagttcattgaggctcgcagaagggccctgaagcggtttgtgaatctagtcgcacgtcacccactgttttcagaggacgtggtgctgaaacttttcctatccttttccggaagcgacgtgcagaacaaactcaaagaaagcgcacaatgcgtcggtgatgagttcctcaattgcaaacttgcaactcgcgccaaagacttcttgccggctgacatccaagcccagtttgctatctcacgggagctcattcgcaacatctattag

SEQ ID NO: 30520 - DNA, 600 bp, Artificial Sequence
  Description of Artificial Sequence: Synthetic coding sequence
atgcaccgaggcacacaggagggagctatggcgagcaggctgctgcacaggctgaggcatgcccttgctggcgacggaccaggcgaggctgccgcaagtcccgaggctgagcagttcccggagtcctctgagttggaggatgatgatgccgaaggactgtccagccgcctttctgggaccctgagcttcacttccgcagaggatgatgaagacgacgaggatgaggacgatgaagaagctggacctgaccagctgcccctgggcgatgggacttctggggaggatgcggagcggagtccgccaccagacggccagtggggcagtcagttactggcaaggcagctgcaagatttttggaagaagtctaggaacacgcttgcacctcagagacttctgtttgaagtaacttccgcgaacgttgtgaaggacccaccctctaagtacgtgctttatacccttgctgttatcggccctggtcctccagactgccagccagcccagatctccaggcgctacagtgatttcgaaagactccatcggaatctgcagcgccagttccgaggacctatggctgcaatcagttttccgcagagccactag

SEQ ID NO: 30521 - DNA, 453 bp, Artificial Sequence
  Description of Artificial Sequence: Synthetic coding sequence
atggctagtaggttgctgcaccggctacgccatgctctggccggtgatggcccgggcgaggccgcagccagccccgaggcagaacagttccccgaaagtagcgaactagaagatgacgacgctgagggcctcagctccagactctccggcaccctgtcctttacctctgccgaggacgatgaagatgacgaggacgaggatgatgaggaggctggccccgaccaactgcccttgggtgatgggacctctggcgaagatgcagagcgaagcccacctcctgacggacaatgggggtctcagttacttgcaagacagctgcaggacttttggaaaaagagcaggaatacacttgctccgcaaaggctcttattcgaagtaacgtccgctaatgttgtgaaggaccccccaagtaagtatgtcacccctacactctcatctacaccgtctccctag

SEQ ID NO: 30522 - DNA, 477 bp, Artificial Sequence
  Description of Artificial Sequence: Synthetic coding sequence
atgcacagaggcacgcaggagggcgccatggcgtcacgcctcctgcacaggcttagacatgccctggcaggagacgggcccggcgaggccgcagcgagtccagaagctgaacagttcccagagtcatcagaattagaggacgacgacgcggaagggctgagctccaggctctctggaacactctctttcacctcagcagaggacgatgaggacgatgaggatgaggatgacgaggaagcgggaccagaccagctcccactgggcgacggcacctctggggaggacgccgagaggtcaccaccgccagacggacagtggggatcccagttgctggcccgccagctgcaggatttttggaaaaaaagtcggaacacacttgctccccagcgcctgctcttcgaagttacctcggctaatgtggttaaagatccccccagcaaatacgtaaccaatctgtcctcgacacccagcccttag

SEQ ID NO: 30523 - DNA, 1122 bp, Artificial Sequence
  Description of Artificial Sequence: Synthetic coding sequence
atgcaccggggtacccaagagggagccatggccagcagactgttgcaccggctccggcatgcactggcaggcgatggcccaggtgaagccgccgccagtcctgaggccgaacagtttccggagagctcagagctggaagacgacgacgccgaagggctgtcctcccgcttgtccggcactctctcgtttacctcagcagaggatgacgaagacgacgaagatgaggatgacgaggaggccggcccagatcaactgccactcggagacggcacctccggcgaggatgctgagcggtctcccccccccgacggacagtggggttcccagttgctggccagacagctgcaagacttttggaaaaagagcagaaacactcttgcccctcagcgattgctgtttgaagtgacctccgctaacgttgtgaaggaccccccttctaagtatgtgctgtacacactagccgtgatcggccccggccctcctgactgtcagcccgcccaaatttcacggagatactcagacttcgagagactgcaccggaatcttcaacgacaatttcggggccccatggccgcaatttcctttccacgtaagagattaaggcgtaactttactgccgagacgatcgcgaggcggagtagggcattcgagcagttcctcggtcatcttcaagccgtgccagaactccgacacgcacccgacctgcaggatttttttgtgctccccgagctgaggagggcacaatcgttgacatgcaccggcctttaccgggaagccctcgccctgtgggctaatgcctggcagctccaggctcagcttggcacaccctctggccccgatcgacctctcctgaccctggccgggctggccgtctgccatcaagagctggaggatcctggagaggcaagggcatgctgcgagaaggcgctgcagctgttgggagataagagccttcatccactcttggccccatttctggaggctcatgtgcgccttagttggaggttggggttggataagcggcagtccgaagcccgtctgcaggcactgcaggaagccggcctgacgcctactcctccacccagcttgaaagaactcctgataaaagaagtgctggattag

SEQ ID NO: 30524 - DNA, 294 bp, Artificial Sequence
  Description of Artificial Sequence: Synthetic coding sequence
atggacaagcagagctccgctggcggagtgaagcggtctgtaccgtgtgactcgaatgaggctaacgaaatgatgccagaaactagcagcggatattcagatccccagcctgcacctaagaagctgaagacatcagagtctagtacaatcctggtggtgaggtataggcgcaactttaaacggacaagccctgaagagttagtcaacgatcacgcccgaaagaatagaattaatccattacagatggaagaggaggaatttatggagattatggtggaaatccccgcaaagtag

SEQ ID NO: 30525 - DNA, 3771 bp, Artificial Sequence
  Description of Artificial Sequence: Synthetic coding sequence
atggaccggccactctctagctccgccgaagcagaagaagagctggaatggcaagtggcctcgaggaggcggaaagcctgggcaaagtgcagatccagctggcaggcctctgaaacagaagacctgtccaccgaggctactacacaggatgaggaagaagacgaggaggaagacctgcccggagcccagttgcccgccgcagggggcaggggaaatgtgcctaacgaaaaaatagccatttggttgaaggactgtaggacaccactgggtgcaagccttgacgaacagtccagctccacactcaaaggagtcctggttcgcaacggcgggtcctttgaagacgacctttcacttggggcagaagccaatcatctgcatgagagcgacgcacagattgaaaactgcaataatatcctggctaaagagcggagattacagttccaccagaaagggaggagtatgaatagcacaggcagcgggaagtccagtggcactgtatcctcagtgtctgaacttcttgagctttacgaagaggacccagaggaaattctgtacaatctggggttcggaagggacgaaccagatattgcctccaagatcccttcaagattctttaatagctcctcttttgcgaaaggtatagacatcaaggtgttcctgagcgctcagatgcagaggatggaagttgaaaaccccaactatgctctcacctctcggtttcgccaaatagaagtcctcaccactgtagcaaatgccttctcctccctgtactcccaagtaagcggcacacccctgcaacggataggtagtatgtcaagcgtaacctccaacaaagagaccgaccccccccccccactgactcggagcaatacagcaaatcggctgatgaaaaccctgtcgaagttaaatctgtgtgtcgacaagacagagaaaggtgaaagcagctcaccatcaccatccgcggaaaaaggtaaaattctgaacgtgtcggttatagaagagagcgggaacaagaacgaccagaagtcacaaaaaattatgaagaagaaagagtcttccagcatgttggctacagttaaagaagaagttagtgggtccagtgccgctgtgacagagaacgcggacagcgatagaattagcgacgaggctaacagcaattttaaccaagggaccgagaatgaacagtccaaagagacccagagccacgaaagtaagctgggcgaggagtccggaattgtagaaagcaagctggacagtgacttcaacatcagctctcactcagaactggagaatagttccgaactcaaatccgttcacatcagcacacctgagaaagagccctgcgcacccctcaccattccctccataagaaatattatgactcagcagaaggactccttcgaaatggaggaagtgcaaagcacggaaggagaggccccacacgtgcctgccacttaccaattaggactcacgaaatccaaaagggatcaccttttaagaactgctagtcagcatagtgactccagcggctttgcggaagattccactgactgtctgagcctaaatcaccttcaggtgcaggaatctctgcaggcaatgggatcctcagctgacagttgtgactccgaaaccacagtgacaagtttgggggaggatctggccacccctacagcccaggatcaaccgtactttaatgaatcagaggaggaatccctggtacctttacaaaaagggcttgagaaagccgcagcggtcgctgataagcgcaagtccggtagtcaggatttccctcagtgcaataccatagaaaataccggaaccaaacagtccacctgttctcctggtgaccacattattgaaataacagaagtggaagaggacctgtttcctgctgaaacagtcgaattacttcgcgaggcgagcgcagaatccgatgttgggaagtccagtgagtccgaatttacccagtacacaactcatcatattctgaaatccctggccagtattgaagctaaatgttccgacatgtcttctgagaacactactggtcccccatcgtccatggaccgggttaacacagccctccagcgagcgcagatgaaagtgtgttcactgtcaaaccaaagaatgggccgaagcctgctgaaatcaaaagatttgctgaaacagaggtatctattcgccaaagccgggtatcccttgcggcggtctcagagtctgccgacaactcttttgtcacccgtgcgggtggtgtccagcgtaaatgtaagactaagccccgggaaagagacccggtgctcccccccgtctttcacctataagtacacaccggaggaggaacaggaactcgaaaaacgagtgatggaacacgatgggcagagcctggtgaagtcaactatttttatctcccctagttctgtgaaaaaagaagaggcccctcaaagcgaagcccctagggtcgaggagtgccatcacgggcgcactcctacttgcagccgtctagcgcccccgcctatgtcacagtctacttgcagccttcatagcatccattccgaatggcaggagagacccctatgcgagcatacaaggacattgtctacccactctgtgcctaacatatcgggcgcaacctgcagcgcatttgcatcccctttcgggtgcccatactcccacaggcacgcgacctacccctacagagtttgttctgtgaatcctccaagcgccatcgagatgcaactcaggagggtattgcacgatattcggaatagtttgcagaaccttagccagtacccaatgatgcgtgggcctgaccccgcggccgctccatactctacccagaaaagtagcgtcctcccactgtacgaaaacaccttccaagaactgcaggtgatgcgcagatccctgaacctgtttcgaactcagatgatggacctggaactggccatgctgcgtcagcagacaatggtataccaccacatgactgaagaagagcgcttcgaagtggatcagttacagggcctgcggaattcagtgcggatggaactgcaggaccttgagctccaactagaagaacgacttttgggcctggaagagcagctgcgagctgtccgaatgccttccccatttcgctcatctgcccttatgggaatgtgtggcagcaggtctgctgataatctgagttgtccatcgcccctcaatgttatggagcctgtgacagaactcatgcaagagcagtcttaccttaagtccgaactggggttgggactaggcgaaatgggttttgagatcccgcctggcgaaagcagcgagagcgtcttctcccaggccactagtgagtctagttccgtctgttcaggacccagtcacgcaaatcgcaggaccggggtgcccagtacggcctctgtgggcaaaagcaagacacctctggtggcccggaaaaaagtttttcgggccagcgtcgctctgacacccaccgcacccagccgaactggttcggtccagaccccaccagaccttgagagttcagaagaagtggacgctgcagaaggcgcgccagaagtcgtgggcccaaagtcggaagttgaggagggccacggtaaattgccctccatgcccgctgcagaagagatgcataaaaacgtcgagcaggacgagcttcagcaggtgatccgggaggtgggaatggatcctatctcatgcgtaatccttgaactgtcaatgatctgtactggcggaggcgttatctgtgccctggaggacacctgctgctag

SEQ ID NO: 30526 - DNA, 3255 bp, Artificial Sequence
  Description of Artificial Sequence: Synthetic coding sequence
atgaatagcaccggcagcgggaagagctccggcaccgtgtctagtgtgtccgagcttcttgaactgtatgaagaggacccagaggaaatcctctataatctaggtttcggcagagatgaaccggatatcgcttcaaagatcccctctcgcttcttcaatagtagcagctttgcaaaagggatcgacatcaaggtattccttagcgcacaaatgcagagaatggaagtcgagaatcccaactacgctctgacatcccggttccgccagatcgaagtgctgacaactgttgccaatgccttttcctcactatacagccaggtgtcgggcacgcccctgcaaagaatcgggagcatgtccagcgttactagcaacaaggagactgacccacctccccccttgacccgctccaatacagctaatagactgatgaagacattgtcaaagcttaacctgtgtgtggataagaccgagaagggagaaagtagttctccctctccttcggccgagaaaggtaaaatccttaatgtctcagtgatcgaggaaagcggcaacaaaaacgaccagaagtcccagaagatcatgaaaaagaaagagtcaagttccatgctggcaacagtcaaggaagaggtaagtgggtccagtgctgcagtcaccgagaacgcggactccgaccggatcagtgatgaagcaaactccaacttcaatcagggcaccgaaaatgaacaatcaaaagagacccagagccatgagtctaaactgggagaggaaagcggcatcgttgagagtaagttagatagcgacttcaatatttcttcccatagtgaactggaaaatagctctgaactgaaatctgtgcacattagcacacccgagaaggagccatgcgctccactcacaattcccagcataagaaacattatgacccagcagaaagatagctttgaaatggaggaggtacagtcaaccgagggcgaagctccgcatgtaccagctacttaccagctcggactgactaaatctaaaagggaccacctcctgcgaactgcctctcagcacagtgattccagcggtttcgcagaggatagtacagattgcctcagtctgaatcatctacaagtgcaagaatcactgcaggccatgggatcctctgccgacagttgcgacagcgagacaacagtgacctctctgggagaggatctggccacccctacggcacaggatcaaccctattttaatgagtctgaagaggaatcgctagttcccttgcagaaaggactcgaaaaagctgccgcagtagccgacaagcgtaaatctgggtcacaggacttcccgcagtgcaacacaattgagaacaccggaactaaacagtcaacttgttccccaggagaccacatcattgaaatcacggaagtcgaggaggacttgttccccgccgaaactgtggagttgcttcgcgaagcgtccgccgaaagcgacgtgggaaaatcctccgaatctgaatttacccagtatacgacccaccacattcttaaatccttggcaagtattgaggccaaatgctctgatatgagctcggagaacactactggcccccccagtagtatggacagagtaaatacggccttgcagcgggcccagatgaaggtctgttctctgagcaatcaaaggatgggaaggtctctgctcaagtccaaggatttgctcaagcaacggtatctttttgccaaagctgggtacccactcaggcggagccagtccctgcctaccaccctcctttccccagtgagagtggtgtcaagtgtcaatgttagactcagcccaggaaaggaaacccgatgtagccctcctagcttcacctacaaatatacccccgaggaagaacaagagctggaaaagcgcgtgatggaacacgacgggcagtccctggtgaaaagcacaattttcatctcaccatcctccgtcaaaaaggaggaagcccctcagagcgaagccccgcgggtggaggagtgccaccacgggcgcactccgacctgctcccgattggcccctccccctatgagccaaagtacttgttcactgcattctatacattctgaatggcaggagaggcctctctgcgagcacacacgcacgcttagtacgcacagcgtccccaatatcagtggtgccacctgctcagctttcgcaagcccttttggatgtccatatagccacaggcacgcaacatatccataccgggtatgcagcgtcaatcctccgtcagctattgagatgcagttaaggcgtgtgctgcatgatatccgcaactctttgcagaacctctcccaataccccatgatgcgcggtccagatcccgccgccgctccatacagtactcaaaagtcctctgtgctgcctttatacgagaatactttccaggaactgcaggtcatgaggcggtcactgaatctttttcgcactcaaatgatggatcttgaattggctatgctgagacaacagacgatggtatatcatcacatgactgaagaagagaggtttgaggtggaccagctgcagggcttgcgcaatagtgttagaatggagctgcaggatctagaacttcagctggaggagaggttgctgggtctcgaggagcagttacgcgccgtgaggatgccttcgcctttcagaagcagcgcgctgatggtcaccgaactgatgcaggaacagagctacttaaaatcggaattgggattaggtctgggagaaatgggttttgagattcctcccggcgaatcttcagaaagtgtgttttcccaagccactagcgaaagtagttcagtctgctcaggaccgagccatgctaatcgtcgcaccggcgtgccttctaccgcttccgttggaaagtcaaaaacacccttggtggcccgtaaaaaagtctttcgcgcgagcgtcgctcttacccctacagcccctagtagaacgggctccgtccaaacccccccagatctggagtccagtgaggaagtggatgccgccgaaggtgctcctgaggtcgtgggccccaagtcagaggtggaggagggacatggaaagttaccgtctatgccggcggcagaggaaatgcacaagaatgtggaacaagatgagctgcagcaagtgatccgggaaattaaagagagtattgtgggtgagatccgtcgcgagatcgtgagcggactgctagccgcagtgtcctcatcaaaagcaagcaatagtaagcaggattatcactag

SEQ ID NO: 30527 - DNA, 3780 bp, Artificial Sequence
  Description of Artificial Sequence: Synthetic coding sequence
atggacagaccactgtctagttcagctgaagccgaagaagagctcgagtggcaggtggcttcacgtcgcagaaaggcctgggccaagtgccgcagtagctggcaggcgagcgagaccgaagacctgagcaccgaggcaaccacccaagatgaggaagaagacgaggaggaagatctgcccggggcacagctccctgcagcgggaggtcgtggaaatgtgcccaatgaaaaaatagccatttggcttaaggactgtcgcactcccctgggagctagcttagatgagcagagcagctcgaccttgaagggcgtgctcgtccgcaacggaggtagtttcgaggacgatttgtcactgggagctgaggccaatcaccttcacgagtccgacgcccaaatcgaaaattgtaacaatattttggctaaagagcgtaggctgcagtttcatcaaaagggtcgatcaatgaactcgacaggatccggcaaaagctctggcaccgtttcgtctgtgagcgaactgctggagctctatgaagaggacccggaggagatcctgtataacctgggcttcggccgggacgaacccgacatcgcctcaaaaattccctctcgattctttaactccagttcattcgccaaagggattgatatcaaagtgttcttaagtgcacagatgcagcgaatggaagttgagaacccaaattatgccctgacttcacggttccggcagattgaagtgctgacaacagtcgccaacgcattctcctcactgtatagtcaggtgtccggcacccctttgcagcgaatcggatccatgtcctccgtgacctccaataaggagactgatcctccccctccactcacaagatccaatactgctaacaggctgatgaagacactgagcaagctcaacctgtgcgtggataagacagagaagggggagagcagttctccatcaccctccgcagagaagggaaagatacttaacgtctctgtgatcgaagagagtggaaacaagaatgaccaaaaatcccagaagattatgaagaaaaaagaaagctctagcatgctggcaactgttaaggaggaggtgtctgggagtagcgcagctgtaaccgaaaacgctgactccgaccgaatttctgatgaagctaactccaatttcaatcaaggtactgaaaatgagcaaagcaaggaaacacagtcccacgagtccaagctcggggaggagagcgggattgtggaatcgaagctcgattcagattttaacatcagttcccatagtgaacttgagaattcatccgaactgaagagcgtccatatctccacacccgaaaaagaaccctgtgctccgttaacaattccctctattcgcaatattatgacgcaacagaaagacagttttgagatggaggaggtgcaaagcactgagggcgaggccccacacgtcccagcaacataccagttaggtttaacgaagagcaagcgcgatcatttgctgcggacggcatcacagcactctgattcaagtggattcgctgaagattccacggattgtctctcactcaaccacctacaggttcaggaatcactccaggccatgggctccagcgccgactcctgcgattccgagaccacagtcaccagtctgggtgaagacttggcaacccccacagcccaagaccagccatactttaatgagtcggaggaggagtctctggtgcctttgcaaaaagggctggaaaaggcagcagccgtggccgataagagaaagtcaggatctcaggactttccacaatgcaacacgatagaaaatacaggaacgaagcaaagcacctgttcaccaggagaccacatcatcgaaatcacggaagtcgaggaggatctgttcccagcagaaacggtagaactactccgggaagctagcgccgagtcggacgtcggaaagtcctctgaaagcgagttcacccagtacactacccaccacatcttaaaatctcttgcttcaatagaagcgaagtgtagcgatatgtcttctgaaaatacaactggccccccatcgagcatggaccgcgtcaatacagccctgcagagagctcaaatgaaggtgtgctccctctccaaccagcgtatggggaggagcttattgaaatctaaagatctccttaaacagcgatacttgttcgcaaaagccggttaccctctgcgcaggtcgcaatccctgcccaccacactcctgtcccctgttagggtggtgtcctctgtgaacgtgcggttgagccctgggaaggaaaccagatgcagcccacccagcttcacctataagtacacccccgaggaggagcaggagctcgagaaacgtgtcatggagcatgatgggcaatccttagtgaagagcaccatttttattagtccatcctcagtgaaaaaagaagaggccccccagtccgaggcgccccgggtggaagagtgtcaccacggaagaactcctacgtgtagccggctggcacccccccctatgtcccagagcacatgtagcctacatagcatccactcagaatggcaggagagacccctgtgcgagcacacaagaacgttaagcacacattctgtgccaaatatttcgggcgccacttgctccgccttcgccagcccgtttggatgtccgtatagccaccggcatgccacctatccctaccgagtgtgttcagttaatcccccctcggccatagagatgcaattaagaagggtgcttcatgatatcaggaactcattgcagaatctgtcccaataccctatgatgagaggccctgacccagcggcggccccctattccactcaaaagagtagcgttctccccctttatgagaatacctttcaggaactccaagtgatgcgccggtccttgaatcttttccgcacccaaatgatggatctggaactggccatgctccgccagcagaccatggtataccaccatatgactgaagaagagaggtttgaagtggaccaactgcagggactcagaaattctgtgagaatggagctgcaggacttagaactccagctggaagaaagactccttgggcttgaagagcagctgagagccgtgcggatgccttccccttttagatcttctgcattgatgggaatgtgcggcagtcgatcagctgacaatttgagttgcccatccccactgaacgttatggaaccagtgaccgaactaatgcaggaacagagctacttgaagtcagagctcgggctgggcctcggcgaaatgggatttgagattccacctggtgagtctagcgaaagcgttttctcccaagccacctcagaatcatcatctgtgtgtagcggacctagtcatgccaatagacgcacaggggtgccttccactgcatcagttggcaagagtaagactcccctcgttgccaggaaaaaagtgtttcgagctagcgttgcactgacacctaccgctccatcgcggactgggtccgtgcagactcctccagacttggagagctccgaagaagtggacgcggctgagggcgcccccgaagtggttgggcccaaatctgaggttgaagagggccatggtaaactgccaagtatgcccgctgcggaggaaatgcacaaaaacgtggaacaggacgagcttcagcaggtgattagggaaatcaaagagagcatcgtgggtgaaattaggcgcgaaatcgtttcgggactcttagccgccgtttctagcagcaaagcatcgaatagcaaacaggactaccactag

SEQ ID NO: 30528 - DNA, 519 bp, Artificial Sequence
  Description of Artificial Sequence: Synthetic coding sequence
atgcctgtcggtgcgggcctccccacatcgttgacttccccaccctcgaccgaagcaccaaaatcttcactgctccggaaacagacccagccccctaaaaaacagtcctcccccgctgtgcacttgcgctgcacaatggatcctgtaatgatgacagtgtcgccaccccccgcgcaccgccaccgaaggagaggcagtcctaccagatgcgcccattgtcctgtggcatgggccccagataccgacgacgagaaaccccatcaatatcccgccatatgctcgtaccattgggacgtgcctgaagattgggagggatttcagcatacgcagggaacttgggttccgtggtcccaggatgcaccagaatctccaccccaaaccatccgcttccagccaggtcgccagagcgagacaccgtctaagaaaaagaagaagaaaaagaaaaagcggaacattggcgctccactgaaacgatatctgacagtgactagccagcttagtgtgacttcattgctgtag

SEQ ID NO: 30529 - DNA, 930 bp, Artificial Sequence
  Description of Artificial Sequence: Synthetic coding sequence
atggctatggtggaacgcccacgtccagagtgggccagctaccataactgtaactcaaatagctgccaggaccttggcaatagtgttcttctgctgctgggattaatcatatgtattaacatcagtattaacatcgttacattgctgtggagtagattccgaggagtcctttatcaggtattccatgatacgatctgcgaaaaggaggctcccaagagttctctcttaaggaaacagacacagccgcctaaaaaacaatcttcccctgctgttcatttgagatgtaccatggatcctgtgatgatgactgtctccccaccaccggcccataggcataggagacgggggtctcccacccgttgtgcccattgtccggtcgcttgggctcccgacaccgacgatgagaagccccatcagtacccagctatatgttcctatcattgggacgtccctgaagactgggaagggttccagcatacacaggggacctgggtgccctggtctcaggatgcaccagaatctccgccacagaccattaggtttcagcctaccgtggaagagcgaccccttaaaaccggaatctggtctgaactcgggctgcgtgcctacgtgtaccctgtgaacccccctccgcccagtccggaggccccgagccacaaaaatggtggggaaggtgcagtacccgaggccgaagcggcccagtatcagccggtacccgcaccaacccttggaccagctgtgatccccgaattctcacggcatagaagttctggacgaatcgtctacgatgctcgagacatgaggcgtagactccgggaactgaccagggaggtcgaagccctatccgggtgctatccgctggcatcgggatcgagtactgccgaggagacctccaaaaactgggtctacagaagcttgactggacgatag

SEQ ID NO: 30530 - DNA, 987 bp, Artificial Sequence
  Description of Artificial Sequence: Synthetic coding sequence
atggccagtcggtgctctgagccatacccagaagtctctaggattcccaccgttcgcggttgcaatggcagtctgtcaggggctctctcctgttgtgaagatagcgcaagaggttccggcccccccaaggctcctacggtagccgaaggaccgtcaagttgtctgcgccgcaatgtgatctcagagcgggagcgacgaaaacgtatgtcactgagctgtgagaggctgagagccctgctgcctcaattcgacggccggcgggaggacatggcgtcggtgctggaaatgtcggtgcagtttctgagactggctagcgcactgggacccagccaagagcagcacgcaattctggcttcttcaaaggaaatgtggcactctctccaggaagatgtgctgcagttaaccctgagtagtcagatccaagccggagtgccagaccctgggaccggagcttccagcggcacgcgaaccccagatgtgaaggcttttctggagagcccgtggtctctggaccccgcctccgcatctccagagcctgtgccccacatactggcttcttcccgccaatgggatccagcctcatgcacgtctctgggaaccgataagtgtgaagctctactgggtctatgtcaggtaaggggtggcctccctccctttagcgagccgagcagtctggttccttggcccccagggcgcagcctgcccaaggctgtgagaccacccctgagctggccgcccttctcccaacagcagactctcccagtaatgtctggagaggccctgggttggttgggccaggccgggccgcttgccatgggggccgctccgcttggagaacccgctaaggaggatcccatgttggcccaagaggccggatccgcactgggatcggatgtggacgatgggacatccttcctgctcaccgcagggccttcgtcatggccgggcgaatgggggcccgggtttcgggccggacccccagcctag

SEQ ID NO: 30531 - DNA, 1164 bp, Artificial Sequence
  Description of Artificial Sequence: Synthetic coding sequence
atggcttcccgatgtagcgaaccgtatccagaagtgtcacgcattccgactgtccgcggatgtaacggctcactgtccggggctctgtcttgctgcgaagacagcgcccgaggaagtggccctcccaaggcaccgaccgtcgccgaaggcccctcctcgtgccttcgtagaaacgtgatttcagaacgagagcgcagaaaacgcatgtcattaagttgtgagcggttgcgggctctgttgcctcagtttgatgggaggcgcgaagacatggcctctgtgcttgaaatgtccgtccaattcctgaggcttgcctcagctttgggaccctcacaagagcagcacgccatcctggcaagcagtaaagagatgtggcacagtctgcaagaggacgttctgcagctgaccctgtctagccagattcaggcaggcgttccagacccgggcacaggggccagttcaggtacacgaactcctgacgtcaaggcattcctggaaagtccatggtctctggatcccgcctctgcctcgcctgagcctgtcccacatatactggcgtcttctcgtcagtgggaccctgcaagctgcacaagtttaggtactgataaatgcgaggcacttctcggtctgtgccaggtcaggggcgggctcccccctttcagcgaaccatcttccctcgtcccatggccaccaggacgcagtctgcccaaagctgtcagaccgccattatcttggccacccttttcccagcagcagacactgcctgttatgtccggcgaagcactgggatggctgggccaggcaggccctcttgcaatgggggccgcccctttgggggagccagctaaagaagacccgatgctcgctcaggaggccggctccgctctaggcagtgatgttgacgatggcacctcattccttctcacagcagggcccagttcgtggccaggttctcttgagggccgcggaggaagcggcccagcttgggccccagctgaatccagccccctcgatgtgggagagcctggatttctgggggaccccgaattggggtctcaagaactgcaagatagccctctcgaaccctggggtttggacgtggattgcgccggactggcactgaaggatgaggtcgagtccatttttccggacttctttgcctgttag

SEQ ID NO: 30532 - DNA, 684 bp, Artificial Sequence
  Description of Artificial Sequence: Synthetic coding sequence
atgagctacttcaggaccccccaaacacacccgggcccacttccaagtggacagggaggcgctgcaagtccaggactttctctcggtctgtgctcccccgtggagcctgttgtggtggcttcaggtggcactggccctctcagtcagaaagcagagcaggtagctccggcagctcaggcctggggtcctgccctagccatgcctcaggcacgcggctgtccaggtggaacttcttgggaaacactgcgtaaagagtatagcaggaactgccataagtttccacatgtacggcagctggagtctctgggatgggacaatgggtattcacgcagccgagccccagacctgggcggaccttcccgcccccgccccctgatgctgtgcggcttgtcacctagagttctacccgtgccctccgaggcggtgggaaaggaggcgagctcacagccagatatatgcattttgacactcgccatgatgatagccgggatccctacagtgccggtgcctggtgtcagggaggaggaccttatttgggccgctcaggccttcatgatggcacatcccgagccggagggggccgttgaaggggcgcgttgggagcaagcacatgcccatacagccagcggaaagatgcctttggtgaggagcaagcgcgggcagccccccggatcctgtctgtag

SEQ ID NO: 30533 - DNA, 765 bp, Artificial Sequence
  Description of Artificial Sequence: Synthetic coding sequence
atgcccatcaagcctgtgggatggatttgcggtcaagtcctcaaaaatttttccggccgcatcgaaggaatacaaaaggccattatggatctggttgacgaattcaaggatgagtttcccactatccttaggctgtcccaatccaaccagaagcgggaaccagcccagaaaacgtcaaagattcgaatggctattgccctggcaaagattaaccgtgcaacgctcattagggggttgaactctatcagccggtcaagcaagtctgtagctaaactgcttcatccccaactggcctgtcgcctgcttgagttgagagacatctcaggtcgcctactccgcgaggtcaacgcccccagacagcccctctataatatccaggtgaggaaaggctcattgtttgagattatctcgtttccagccaagactgcattgactagtattatctacgccagctacgctgcactgatctacctggcggtttgtgtgaatgccgtgcttaagaaagtgaagaacatttttcaagaagaagagtcgatccgccagaaccgcgaagagtcagaaaactgtaggaaagcctttagcgagcccgtcctctccgaacctatgtttgctgagggggagatcaaggcaaagccataccggagcttgccagagaagcctgacatctccgattatccaaaacttctggccaataagcaatcgaataacattcaggtgctccatagcgtgtttgaccaatcagcagagatgaatgagcaaatttag

SEQ ID NO: 30534 - DNA, 765 bp, Artificial Sequence
  Description of Artificial Sequence: Synthetic coding sequence
atgcctataaaaccagtaggatggatttgtggacaggtgctaaaaaacttcagtggaaggatcgagggcatacagaaagccatcatggatctggtggatgaattcaaagacgagttccccactatcctcagactgagtcaatctaatcagaagagggagcccgcgcagaagacctcaaagataaggatggcgattgctctggctaaaataaatcgggcgaccctgatcaggggcctgaactcgatctcccgctcttctaagtccgtagccaagctgctgcacccccaactggcttgccggcttctcgagctgagggacatttccggcagactactgcgagaagtgaacgcaccccgtcagcccctgtacaacatccaggtgaggaaaggatcactgtttgagattatctctttccctgccaagaccgccctcacctcaattatctacgcatcttatgccgctcttatctatctcgccgtctgcgtaaacgctgtgctgaaaaaagtgaagaatatcttccaggaggaagagtccatccgtcaaaatcgagaagaatccgagaactgccggaaagctttttccgagccagtcctgtccgaacccatgttcgccgaaggcgagatcaaggccaaaccttaccggtcactccccgaaaagcctgacatttcggactatccaaagttactggcaaacaaacagtccaacaacattcaagttctgcatagcgtcttcgatcagagcgcggagatgaacgaacaaatttag

SEQ ID NO: 30535 - DNA, 408 bp, Artificial Sequence
  Description of Artificial Sequence: Synthetic coding sequence
atgccaataaagcccgtgggctggatatgtggtcaggtgctgaagaatttctccgggcgtatcgaaggcattcaaaaggccattatggatctggtggatgagttcaaggacgagttccccaccatcctacgcctgtcacaatccaatcagaagagagagccagctcaaaagacaagtaagattcggatggccatcgctctggctaaaatcaatagggcaactctgataagggggctaaattccatttcccggtcttctaagtcagtggcaaagctgctccacccccagctggcttgtcgcctgttggagttgcgggatatttctggccgtctgcttagagaggtgaatgcccctagacagccactgtacaacatccaggagaagaagatggggctgcaactatcatag

SEQ ID NO: 30536 - DNA, 1272 bp, Artificial Sequence
  Description of Artificial Sequence: Synthetic coding sequence
atgaaacccaacttctcactgcggctcaggatcttcaacctgaattgctggggaatcccctacttgtccaaacaccgggcagataggatgcggcgtttgggcgatttccttaaccaagagagtttcgatctagccctccttgaggaagtttggtccgaacaggacttccagtacctgagacagaagctttctcccacctacccagccgcccaccactttcgatccggaatcatcggctccgggctctgtgtgtttagcaaacaccccatccaggagctcactcagcatatctatacactcaatggctacccgtacatgattcaccacggggactggttctctggtaaggccgtcggactgcttgtcctccacctgagtggcatggttctcaacgcttatgtaacccacctgcatgctgaatataacaggcagaaagacatatatctcgcccaccgtgtggcacaagcatgggagctggcccagttcatccatcacacttccaaaaaagctgatgtggtcttgctttgcggcgatctgaatatgcatccagaggatttgggctgctgtctgctgaaggagtggacaggacttcacgatgcttatctcgagacgcgcgattttaaaggtagcgaggaaggcaacaccatggtgcccaagaattgttacgtatctcagcaggaactgaagccttttcccttcggcgtgaggatcgactacgtgttgtacaaggcagtctccgggttttacatcagttgcaaatcattcgagaccactacaggcttcgacccgcaccgggggactcccttgtctgatcacgaagccctgatggcaacactgttcgtacggcattctcccccacagcagaatcctagttctacgcacggtcctgccgagagaagcccgctgatgtgtgtgctcaaggaggcatggaccgagctcgggttgggcatggctcaagcccgctggtgggccaccttcgccagttacgtgattggtttgggactacttttgcttgctcttttatgcgtgctcgctgcgggcggtggagccggcgaggctgcaattctgctgtggacaccgtctgtgggcttggtcttgtgggccggcgcgttttacctgttccatgtgcaggaagtaaatggactctatagggctcaagccgaactgcagcacgtgctgggaagagccagggaggcgcaggatcttggaccagagccgcagcctgccttattgctgggccaacaggagggagaccggactaaggaacagtag

SEQ ID NO: 30537 - DNA, 846 bp, Artificial Sequence
  Description of Artificial Sequence: Synthetic coding sequence
atgcccgtacagttgactaccgccctgagggtggtaggcacatccctgtttgccctcgccgtactcggggggatcctggctgcttatgtcaccgggtatcagttcattcacaccgagaagcactatctgagctttggcctttacggagcaatcctgggactgcatctcttaatccagtcactcttcgcctttctcgagcataggagaatgagaagggctgggcaggccctgaagctgcccagtccccgtagaggcagtgtggcgctgtgtattgccgcatatcaggaggaccccgattatctgagaaagtgcctgcgctcagcccagcggattagcttccccgatttgaaagtcgtaatggtggtggacggaaaccggcaggaagatgcctatatgctagacattttccatgaagtgttgggtggaaccgagcaggcaggtttttttgtgtggagatcaaactttcacgaggccggagaaggcgaaacagaagccagcctgcaagaagggatggatcgggttagggatgttgtgcgggccagtacctttagctgcattatgcagaaatggggaggtaaacgcgaggtgatgtatactgcattcaaggcactgggcgacagcgtggattacatccaggtctgcgatagcgacaccgtgctggatccagcatgtacaattgagatgctgagagtcctagaagaggacccacaagtaggcggcgtcgggggtgatgttcagccccccggaaagggcatggcagtggaggatgaccaggtacaagcagcacaagtgcgcgcaaccgaggcttggtcagtgcatcaaaggcacgtgtcgagagagcaatag

SEQ ID NO: 30538 - DNA, 2175 bp, Artificial Sequence
  Description of Artificial Sequence: Synthetic coding sequence
atggccggacgcaagcatttctggcagccccggtggtgtccgcgctggctggagcctccattgctgacgggtgctcgcgagtcatgcggggtgcagcatcgcgatgggatctctaggccttggggtcctgtcaaagcctcaatccaagaatgtatcctaccagattctccactgtatcataacaaggtccagtttacccctaccggaggcctgggactgaatttggccttgaatccatttgaatactatatattcttctttgccctcagtctcattacacagaaaccgctgcctgtgtctctccacgtgcggacaagcgactgtgcttacttcattctggtcgatcgatacctctcatggtttttacccaccgaggggtctgtgcctccgcctctgagctcctcgcccggaggaacttcgccctctcctccccccagaacccccgccatacctttcgcaagttacggcctccatcacacctcactgctaaaaaggcacatcagccatcaaactagtgtgaacgctgacccagctagccacgaaatatggaggtctgagacattattgcaggtctttgtcgagatgtggcttcaccactactccctggaaatgtatcagaaaatgcagtctccacatgccaaagagtcctttacaccaactgaagaacacgttctggtcgttcggctgctgctcaagcatctccatgcttttgctaactcactgaagcccgaacaggcatccccgtccgcccacagccacgcgacctcaccactggaggaattcaagcgcgctgccgtaccccggtttgtccagcagaaactctatctgttcttacagcactgcttcggccactggccactggatgcctcgttcagggccgtcctcgaaatgtggctgtcttacctgcagccttggaggtacgctccagataagcaggccccggggtccgattcccagcctcggtgcgtttccgagaagtgggccccattcgtgcaggagaacttgctgatgtacacaaaacttttcgtcggattcctgaaccgcgccctccgtacggatctagtttctcccaagcatgcgctgatggttttcagggtggcgaaagtgttcgcccaaccgaatctcgccgaaatgatccagaagggcgaacagttattccttgagccagagctggtgattccgcaccggcagcatcggcttttcaccgctcccaccttcactggctccttcctgtctccatggcccccagcggtgacagacgcttcatttaaggtaaagagccacgtgtattccctggaagggcaagattgtaaatacacgcctatgtttgggcctgaggctaggaccctcgtgttacggcttgcccagctcatcacccaggccaagcacaccgctaagagcatatctgaccagtgtgctgaatctcctgccggccattccttcctgtcctggctcggcttttctagtatggacaccaatggaagctatactgctaacgatctggatgaaatgggccaggattctgttagaaaaacggacgaatacctggaaaaagccctggaatatctgcgacagattttcaggttgagtgaagcccaactccggcagttcactctggccctgggcactacccaagatgagaacggtaagaagcagctgccagactgcatcgttggggaagacggtctgatccttaccccattaggccggtatcaaattatcaatggtcttagacggtttgagatcgaataccagggcgaccctgaattgcagccaatccggtcctacgagattgcatccttggtcaggaccctgttccggctgagctcagccatcaaccatagattcgcaggtcagatggccgcattgtgttctcgtgacgactttctcggctcattctgcaggtaccacctgacagagcctggtcttgcttcccgacaccttcttagtcccgttggaagaaggcaagtggcgggtcatacaagaggcccccggctgagcctgcggttccttgggtcgtaccgcactctcgtatcccttttgctcgcctttttcgtggcgtctctgttctgcgtggggcccttaccctgcactctgctgttaaccctcggctacgtgctgtacgccagtgccatgacactgctgaccgagcgcgggaaactgcaccagccctag

SEQ ID NO: 30539 - DNA, 2514 bp, Artificial Sequence
  Description of Artificial Sequence: Synthetic coding sequence
atgactacttttggcgctgtggccgagtggagactgccttctttgaggcgcgccactctttggatcccgcagtggttcgcgaagaaagccatctttaactcaccactggaagccgcaatggctttcccgcatctgcaacagccttcctttctccttgcctccttgaaggcagatagcataaacaagcccttcgcccaacagtgccaggatcttgtcaaagtgattgaggacttccccgccaaagagctgcacaccatattcccgtggctggtcgagtcgatttttggctcactcgacggagtactggtcggctggaatctacgttgcttacagggccgggtcaacccggtcgaatatagcatcgtgatggaattcttggacccggggggtcctatgatgaaactggtctacaagctccaggctgaggactacaaattcgatttcccagtgagctacttgcctgggccagtgaaggcctccattcaggagtgtatactaccagattccccactgtatcataacaaggttcagtttaccccgaccggaggtctgggactaaatctagctctgaacccttttgagtactacatattctttttcgcactgagcctgattactcagaagccactccccgtgagtctacacgtaaggacttctgactgtgcatatttcatcctggtcgaccggtatctgagttggtttttacctacagaaggaagcgtccccccccccctatcctcttccccaggcggcacctccccctcccctccaccaaggacgcctgcgatccctttcgcttcgtatgggctccaccacactagcctgttgaagaggcacataagccaccagactagcgtcaatgccgatccagcatctcacgaaatatggaggtctgaaacattattacaggtgttcgtcgagatgtggctccatcactacagcctggaaatgtaccagaagatgcaatcaccccacgctaaggaatcctttacgccgacagaggagcacgtcctggtggtgcggttgctgctgaaacatttgcacgcttttgctaacagcctgaaacctgaacaggcatccccctccgcgcactcacacgccacctcacccctcgaggaatttaagagggccgcagtgccacgcttcgtgcagcaaaagctctatcttttcctgcaacactgctttggccattggccactggatgcgtccttccgcgctgtgttggagatgtggctgagttatctgcaaccctggaggtatgcccccgacaagcaagctcccggatcagactcccagcccagatgcgtgtcagagaaatgggcccccttcgtgcaggagaacttgctgatgtatacaaagctgttcgtgggcttcctgaaccgcgccttgcggacagatcttgttagccctaagcacgctctcatggtgtttagggttgccaaggtgtttgcccaacctaatctcgccgagatgatccaaaagggcgaacagctgttcttggaacctgagcttgtgataccacaccggcaacatagactgttcaccgctccgacctttactggaagctttctttcaccctggcctcctgccgtcacagatgccagtttcaaggtgaaatcgcacgtgtactctctcgagggacaggattgtaagtacaccccaatgtttggccctgaggctcgcacactcgtgctgagactggcacaacttatcactcaggcaaaacataccgccaagtcgatttcggaccaatgcgctgagtcacctgcaggccacagcttcctgtcttggcttggatttagttccatggacacaaatgggagttacaccgcgaatgacctcgatgaaatgggtcaagactccgtgcgcaaaactgatgaatacctcgaaaaggcgctggagtatttgaggcagatatttcggctgtccgaggcacaactgaggcagtttacccttgccctcggtacgacccaggacgagaacgggaaaaagcaactgccggactgtatcgtgggcgaggacgggctgattttgacacccctgggtagatatcagattatcaatggtctgagaaggtttgaaattgaataccagggggaccccgagctccagcccatcaggagctatgagattgccagcttggtgcgcaccttgtttcggttgagtagtgccattaaccacagattcgcgggacagatggccgcattgtgcagcagggatgacttcctggggtccttctgtaggtatcaccttaccgaaccagggctcgcttctaggcatctactgtctccagtggggaggcgccaggtcgcaggtcataccagaggaccaaggctgagcctgagattcctgggctcttatcggaccctcgtctccctgctgctcgcattcttcgttgccagcctgttttgtgtcggaccactgccatgtaccctcctcttgactctggggtacgtgctgtatgcatcggctatgacgttgttaaccgaaagaggcaaattacaccaaccctag

SEQ ID NO: 30540 - DNA, 2601 bp, Artificial Sequence
  Description of Artificial Sequence: Synthetic coding sequence
atgacaacttttggtgctgtagcagaatggaggttacctagcctgcgacgcgccacactttggatccctcagtggtttgctaagaaagccatattcaacagccccctcgaagccgctatggcattcccacatctgcagcagcctagttttctcctggcatcccttaaggccgactccatcaataagccatttgcacaacagtgtcaggacctggtaaaagttatcgaggacttcccagccaaagaacttcacacaatttttccatggctggtagagtcgatcttcggctctctggacggagtgctcgttgggtggaacttaagatgccttcagggaagggttaatccagtggagtatagtatcgtcatggaatttctcgatcccggcggacccatgatgaagctagtttataaactccaagctgaggattacaagtttgactttcctgtgagctacttgccgggccctgttaaggcgtccattcaagaatgcatcctccccgactctcctctttaccacaataaggtgcaatttacccctacgggtggtctgggcctcaacctggctttgaatccctttgagtattatatcttcttcttcgcactttcactgatcactcagaaacccctgcccgtcagtctccacgttcgtacatctgattgtgcctacttcatacttgtggataggtacttgtcctggttcctgccaacagaggggagcgtgccaccgcctctcagttctagccctggaggcacgagtccatcgccccctccacggactcctgctatcccctttgccagctacgggctccaccatacgtctctgttgaagcgccacataagccatcaaacctcagtgaacgcggatcctgcctctcatgagatttggagatctgaaactctcctgcaggttttcgtggagatgtggctgcaccactacagtctggagatgtaccagaaaatgcagtctccccacgctaagctcgaggtcctccactatcgcctgtccgtgtcttcagcactgtactcccccgcccaacccagcctgcaggccctgcacgcttatcaggagagtttcacaccaaccgaggagcacgtgttagttgtgagactgctgttgaaacacttacacgccttcgcgaactctctgaaaccagaacaagcctctccctctgcacacagccatgccacaagtccactagaagagtttaagagggccgcggtgccacggttcgtgcagcagaagctctatctattcctgcaacattgtttcggtcactggccattagatgcctcattcagagccgtactggaaatgtggctgtcctacttgcagccctggagatacgctccagacaaacaagcacctggctctgactcacagccaaggtgtgtgtctgagaaatgggcccccttcgtgcaggagaaccttcttatgtacacaaagctttttgtgggattcttgaatagagcactgcgcacagacctcgtgtctccgaagcatgccctcatggtgtttagggtggccaaagtttttgcccaaccaaatcttgctgaaatgatacagaaaggcgaacagctgttcctggaaccagaactggtcatcccccatcgccagcaccgtctcttcacggctcccacgttcaccgggtcgttcttgtctccctggcctcccgctgtgactgatgcttccttcaaagtgaagagccatgtatattctctcgagggacaggactgcaaatacacccccatgttcgggcccgaagcccgcactttagttctcaggctggcacagcttatcacacaggctaaacatacagcaaagagcatttccgaccagtgcgcagaatcacctgccgggcacagttttttatcgtggctgggcttttccagcatggatactaacggcagctacaccgcaaacgatttagacgagatgggccaggattcagttaggaagaccgacgagtacctcgagaaggctctcgagtacctgagacagatcttccgattgtctgaggctcagctgcgccagtttaccctcgcgctgggaaccacacaggacgagaatggcaagaagcaattaccagattgtatcgtgggggaagacggattgattctgaccccactggggcggtatcagattatcaatgggctgcggcgctttgagatcgagtaccagggggacccagagctccaacccattcgctcgtacgagatcgcctccctcgttagaaccctttttcgactttccagcgccatcaaccacaggtttgcaggacagatggcagccctgtgcagccgtgacgacttcctcggctcattttgccgataccacctcacggagccgggtctggcctctcgacacttgttaagccctgttggacgaaggcaggttgcgggccacacgcgtggacctcgccttagccttaggtttctgggtagctataggacgctggtctcactcttgctagcattctttgtagctagtcttttttgcgtcggacctctgccttgtactctcctattgaccctgggttatgtgctctacgcttctgcgatgacactgctcacagaacgcggaaaattgcaccaaccatag

SEQ ID NO: 30541 - DNA, 1509 bp, Artificial Sequence
  Description of Artificial Sequence: Synthetic coding sequence
atgcagaccccaccacccacccggtcaggaggccagaagctgtgttcacggttcttactgaagtgcgggtttatcacgatcccctggcgttgcataaagaaatgctctcctctgatgccaagggctgccgtcccacgcttcgtccagcagaagctgtatctttttctccagcactgcttcggccattggcccctagacgcctctttcagagccgtgctcgaaatgtggttgagctacctccagccctggcgttatgcccccgataagcaggcacccggctcagacagccagcccagatgtgtgagtgaaaagtgggccccatttgttcaggagaacctgctgatgtatacaaagctgtttgtcggcttcctcaaccgcgccttgagaacagacctggtgtcgcctaagcacgccctcatggtatttagagtagccaaagtgtttgctcagcctaatctggccgaaatgattcagaagggcgaacaactatttctagagcctgagctggtgataccacatagacagcatcggctctttactgcacctactttcactgggtcattcctgagtccctggccacccgcagttacagacgcttcattcaaagttaagagccacgtgtactcattggaagggcaggactgtaagtatacacctatgtttggaccagaggcccgtacccttgtcctgcgtctggcgcagctgattacccaggccaagcacacggcgaagtccatttctgatcagtgtgcagaatctcccgctggccattccttcctaagttggctcggctttagctcaatggacaccaatggatcctacactgctaatgacctggacgagatgggacaggactcagtgcgaaaaaccgatgagtatctggaaaaggccctggaataccttagacagatttttcgactttcagaggcccagttgcgccaattcactttggcactaggcactacccaggatgagaacggcaagaagcaactgcctgattgcattgtgggagaagacggactaattctgacacccctgggtagataccagatcatcaacggcctgcgcagattcgaaatcgagtaccagggagaccccgaactgcagcccattcgcagttacgagatcgcttcactggtgaggaccctgtttcgcctcagtagcgccataaatcaccggttcgcaggacaaatggccgcattgtgctcgcgggacgatttcctgggcagcttctgccgctatcacctaactgaaccaggccttgcttcaagacaccttctttcccccgtgggccgaaggcaggtcgcaggacatacacgtggacctagactctcacttagattcctgggaagctatagaaccctcgtgagcctgctgttggcattcttcgtcgcttcgctgttctgtgtgggcccactgccttgtactctgttgctgactttgggttacgtgctgtatgccagcgcaatgacccttttgacagagcgtggaaaattgcatcagccctag

SEQ ID NO: 30542 - DNA, 2295 bp, Artificial Sequence
  Description of Artificial Sequence: Synthetic coding sequence
atgacaacattcggcgcagtagcggaatggcgactgccttctttgagacgggcaacactgtggatacctcaatggtttgccaaaaaagcaatatttaattcacccctggaagccgcaatggcgtttccccatttgcaacaaccaagttttctgctggcctcactgaaggccgactcaatcaataaaccattcgcccagcagtgccaggacctcgtgaaagtcatcgaagacttcccggccaaggggcccgtgaaggctagtatacaggagtgcatattaccggacagccctctgtatcacaacaaggttcaatttacccctacaggcggcctcggcttgaacctcgctctgaatccttttgaatactacatcttctttttcgccttatcccttattacacagaagcccctcccggtcagccttcatgtacggacctctgactgtgcatattttatcctggtcgatcgctacctatcttggttcttacccacagaaggctcagtcccacctccattatcctcttcccccgggggcacgtccccatctccgcctcccaggacccccgcgattcctttcgcaagctacggcctgcaccacacatcattgttgaagaggcacatctctcaccagacctctgtcaatgctgaccccgcctctcacgagatctggaggtccgaaaccctactgcaggtcttcgtggaaatgtggctgcatcattatagcctggagatgtatcagaagatgcaatccccacatgccaaagaatctttcaccccaacagaggaacatgtgctcgtggtaagattgctgctgaaacacttgcacgcgtttgcaaacagcctgaagccagaacaggcaagcccttccgcacactcgcacgccaccagcccgctggaggaattcaagcgtgctgccgtgccccgcttcgtccaacagaaactctacctattcttgcagcattgcttcggacattggcccctcgacgcctccttcagagctgtgctggagatgtggttgagttaccttcagccctggcgctacgctccagataaacaggctcctggcagcgactcacagccacgttgtgtcagcgagaaatgggctccatttgtccaagagaatcttctgatgtacacaaagctgtttgtcggcttcctgaatcgcgctctcagaaccgatctggtgtcccccaaacacgctctgatggtgtttagggtagcgaaggttttcgctcagcctaatctcgccgagatgattcagaagggggaacagctgttcttggagcccgaactggtgattccccacaggcagcatcggcttttcaccgcacccacatttaccgggagctttttgagtccctggccgccagccgtgactgacgcctccttcaaagtaaaatcccatgtgtatagtctcgaagggcaggactgcaaatacacccccatgtttggcccagaagccaggacactggtgctgcggctggcacaactgataactcaggccaagcataccgccaagtcaataagcgatcagtgcgccgagagtcctgcgggacactcttttttatcctggctgggattttcttctatggacactaatggtagctacaccgccaacgatctggacgagatgggccaggacagcgtgcggaaaactgatgagtatttggaaaaggccctggagtacctgcgacagatctttcgtcttagcgaggcacagctcagacagttcactctggccttgggcaccactcaggatgagaatggcaagaagcagctgccggactgcatagtgggtgaggacggacttatactgacccccctgggcaggtaccagatcattaacggactgagacggttcgaaatcgagtatcaaggcgatcccgagctgcagccaatacggagctatgaaattgcttcactggtgcgtacattgttccgcctctcttccgcgatcaatcaccggtttgccggtcaaatggcggctctttgtagccgcgatgatttcctgggatcattctgcaggtatcatctgacggagccaggccttgccagcaggcacctcctcagccctgtgggccgccgccaagtcgccgggcatacccgggggccacggctgtcgcttaggtttctgggcagctatcggacactggtttcccttctgctggctttttttgtagcctccctgttttgcgtcggccccctaccctgcacactcctcctgacgcttggctacgtactctacgcctccgccatgacgctcctgacagaaaggggcaagctgcaccagccgtag

SEQ ID NO: 30543 - DNA, 1593 bp, Artificial Sequence
  Description of Artificial Sequence: Synthetic coding sequence
atgtggttgcaccactattccctggaaatgtatcagaagatgcagtctccccacgcgaaagaatccttcactcctaccgaggagcacgtgctggtggtccgcctgcttctcaagcatttgcatgctttcgccaactccctgaagcctgagcaggcttccccctccgcccattcacatgcgacatcaccgctggaggagttcaagcgtgctgccgtaccaagatttgtgcagcaaaaactctacctttttctgcagcactgttttggccactggcccctggatgccagcttccgggcagtactggagatgtggctgtcttacctgcaaccgtggcgctacgcacctgacaagcaggctcccggttcagactctcagcctaggtgcgtctccgagaagtgggcgccgtttgtccaggaaaacctgctgatgtataccaagctgttcgtgggctttctgaatcgggcgctgcgcaccgatctggtttctcccaaacacgctttgatggtgttccgcgtggcaaaagtttttgcacagccaaacctggccgaaatgattcaaaaaggggagcaactgtttctcgaaccggaactagtgattccacatcgccaacatcgtttgttcactgcacctacttttacgggaagttttctgagcccctggccgcctgccgtaacggatgcctcttttaaggtgaaatctcacgtgtattcgcttgagggtcaggattgcaaatacaccccaatgttcggcccagaggctagaaccttggtgctacgactagcccagctcattacgcaggcgaagcatacagcaaaatccatcagcgaccaatgcgcagagtccccggccggtcattcctttctctcctggttggggttcagcagcatggacaccaatgggtcctataccgcgaatgacctagacgagatggggcaggacagcgtacgaaaaaccgacgagtatttggaaaaggctctggagtacttaaggcagattttccgcttgagcgaagcccagcttcgacagttcactctggcactaggcaccacccaagacgagaatggaaaaaaacaactgcctgattgtatcgtcggcgaagatggcctgatccttaccccactgggacggtaccaaatcatcaacggcttgcgccggtttgaaattgagtaccagggagaccccgagctgcagccaatccggagctatgagatcgcatctctggtgcgcacccttttcagactgagctctgccataaatcacagatttgccggccaaatggcggctctctgctctagggacgactttctaggatcattttgccgctatcatcttacggagcccgggctcgcatccagacatctgctgagccctgtgggccgtaggcaagtggccggacacaccaggggcccacggctatcactgcggtttttgggaagctacaggacgttagtgtccctactgttggcctttttcgtcgccagcctgttctgcgtgggtccccttccttgcactctgctcctcacactgggctacgtgctgtacgcaagcgccatgactctcctcaccgagcgaggaaagctgcaccagccctag

SEQ ID NO: 30544 - DNA, 1824 bp, Artificial Sequence
  Description of Artificial Sequence: Synthetic coding sequence
atgcagactccccctcctactagatcgggtggtcagaaactgtgtagcaggttcctcctgaaatgcggattcatcacgattccttggcgttgtattaagaagtgtagtccacttatgccatcctggcggttttgcaccactgattccgtctcccctgctccatctacggccccccccaatcccgcttctagaccctcgactccaacgaaatccctgggcaatcgcggatccgacgcaagaggtttttattgggccgaattctcatccggttgcgtgcaggatgaagaacaagaatcctttactccaactgaagagcatgttctggtggttcgtctgctacttaaacatctgcatgcctttgcgaacagtctgaagcccgaacaggcttctccttccgcccattcccatgctactagccccctggaggagtttaaacgggccgcagtcccacggttcgtccagcagaaactgtacctatttctgcagcactgttttggccattggcctctggatgcatcctttcgggctgtcctggaaatgtggttaagctacctgcagccgtggcggtacgcccctgataagcaggcacctggcagtgactctcaacctcgttgcgtgagcgaaaagtgggctccgttcgtgcaggaaaaccttttaatgtacaccaagctgttcgtgggttttctgaacagagctcttagaactgatctcgttagtccaaagcacgcactgatggtattcagagtggcgaaggtattcgcgcagcccaatctcgccgagatgattcaaaagggtgagcaactgttcttggaacctgaactggttattccacacaggcagcaccgtctgtttaccgcccccactttcacaggtagctttctgtccccctggccccctgctgtgactgatgctagtttcaaagtgaagtctcacgtctacagcctcgagggtcaggattgcaagtatacgccgatgttcgggccagaagctcgaacacttgtgctgcgtctggctcaattgatcacacaggccaagcacacagccaagagcattagtgatcaatgcgcagagtcacccgccggccactccttcctttcctggctaggtttcagttctatggacaccaacgggtcttacacagctaacgaccttgatgagatggggcaggactcggtgcgcaagacagatgagtaccttgagaaggccttggagtacttgagacaaatttttcgactgagtgaagcccagctccggcagtttacattagcattagggacaacacaggacgagaacggaaagaagcagctgcctgactgcattgtcggagaggacggtctgattctgacgccgctggggcggtaccagattataaacggattaagacgcttcgagatagagtatcagggggatcctgagcttcagcccataaggtcttacgaaatagcctccctcgttaggaccctgttccgactgtctagtgccataaaccatagattcgccggccagatggctgcgctctgttcgcgagatgacttcctcggttcattttgcaggtaccacctaacagagccaggtctcgcaagtaggcacctgttatctcccgtgggacggcggcaggttgcgggacacacccgtgggccccggctgagcctgcgatttctgggttcctatcgaaccctggtgagcctgttacttgctttctttgtggctagcctgttttgtgttgggccactcccctgcactctgcttctcactctaggctacgtcttatatgcctcggctatgaccttgttgaccgaacgcggaaagctgcaccaaccatag

SEQ ID NO: 30545 - DNA, 1848 bp, Artificial Sequence
  Description of Artificial Sequence: Synthetic coding sequence
atgactaccttcggcgcggtggctgagtggcgactgccaagtctccgccgtgcgaccctgtggatcccccagtggtttgctaagaaagccatcttcaactctccacttgaggctgcgatggcattcccccatctccagcagcccagcttcctgctcgcttctcttaaagcggattccatcaacaaacccttcgctcaacagtgccaggatttggtcaaggtaatcgaggacttcccagctaaagtatttgtggagatgtggctgcaccattattcactggaaatgtatcagaaaatgcagtctccacatgcaaaagaatcatttacacccaccgaggagcacgttctcgtggtgaggttgcttctgaagcacctgcacgctttcgctaatagtcttaagccagagcaggcatccccatctgcgcacagtcacgcaacgagcccgctcgaagaattcaagagggcagcagtgccccggtttgtgcagcagaaactgtacctctttctgcagcactgttttggtcactggcctctggatgcgagcttcagagccgttctcgagatgtggttatcatatctgcagccatggaggtacgctcctgacaagcaggcaccaggcagtgactcccagccaagatgcgtgagcgagaagtgggcaccatttgtccaggagaacctgctgatgtatacaaaactttttgtgggcttcctcaaccgggcgctcaggacagacttagtctctcctaaacacgcgctgatggtcttccgcgtagcaaaggtttttgctcagccgaatctggccgagatgattcagaaaggagagcagctgtttttagagcccgaactcgtgatcccccacagacagcatagactgtttaccgcacctaccttcaccggaagtttcctgtcgccctggccacctgccgtcacagacgcctccttcaaggtgaagtctcatgtttattccctggaaggacaagattgcaaatatacgccaatgttcggcccagaagctcggaccttagtccttagactggctcagctgataacccaggctaaacacacagccaagagcatctcggatcagtgcgccgaaagccccgccggacatagttttctctcatggctcggtttctcctcgatggatacgaacgggagctacaccgcaaacgaccttgatgaaatgggccaagattccgtacgcaaaaccgatgagtacctcgaaaaggccctggagtatctgcggcagatcttccgcctctcggaagcccagcttcggcagttcaccctggctcttggtacgacgcaggacgaaaatggcaagaaacaattgccagattgtatagtcggtgaagacggccttattttgacgcctttggggagatatcagattattaatggacttcgccgctttgagatcgagtaccagggagatccggagctacagcctatcagaagctatgagatcgctagcttagtacggacattgtttagactgagttccgcaatcaatcacagattcgcagggcagatggccgctctgtgcagccgggacgactttctgggctccttttgtcgctaccatctcaccgaacctgggctcgcctcgcgtcatctgctctcacccgtcggcaggcggcaggtggccggccacacccggggccctcggttaagcctgcgctttctgggatcttatcgaaccctggtgtctctcctcctcgcttttttcgtggcgagtctattctgcgtaggccctctcccctgtaccctactgctcaccctaggttatgttctgtatgccagtgccatgacccttcttacagagagagggaaattgcaccagccatag

SEQ ID NO: 30546 - DNA, 609 bp, Artificial Sequence
  Description of Artificial Sequence: Synthetic coding sequence
atcctggaagtctatagcacgaaggctaagaattacgtcaatggtcattgcaccaagtatgagccttggcaactcattgcatggtccgtggtatggacactccttatcgtatggggctatgaattcgtcttccagcctgaatcactgtggtcccggttcaaaaaaaagtgttttaaactgactagaaaaatgccaattattggccgtaaaatccaggacaagctgaataaaactaaggacgacatttccaagaatatgagctttctcaaggtggataaggagtatgttaaggccctgccctctcaggggcttagcagttccgctgtcttagagaagctgaaagaatatagcagcatggatgccttttggcaggagggccgcgcctccggcacagtgtactcgggcgaagagaaactgacagagctcctggtgaaagcctatggggatttcgcatggtctaatcccttgcacccggatatttttcccggactgcggaaaatagaagccgagattgtgcggattgcttgcagtttgttcaatggaggtccagatagctgcgggtgtgaagctctctttttgttctgtttttccaatatgctcgcgccgtag

SEQ ID NO: 30547 - DNA, 1707 bp, Artificial Sequence
  Description of Artificial Sequence: Synthetic coding sequence
atgcccagtaccgacctgctcatgcttaaggcctttgaaccctacctggaaattctggaagtctactcaaccaaggccaagaattacgtgaacggccattgtacgaaatacgagccgtggcagctcatagcgtggagtgttgtgtggacactgcttattgtttgggggtatgagtttgtatttcagcccgaaagcttgtggtcccgtttcaagaaaaagtgtttcaaattgactaggaagatgcctattatcggccggaagatccaggacaagttaaacaaaacaaaagacgatatttcaaagaacatgtcctttctgaaggtcgacaaagagtatgtgaaggcactccctagccagggccttagttcatccgccgtgctggagaaactgaaagagtattcctcgatggatgccttttggcaggaaggccgcgcatcgggcacggtttacagcggagaggaaaagttaaccgagctgctggtgaaagcatatggtgatttcgcgtggtccaatccacttcaccctgacatcttcccaggcctccgcaagatcgaagctgagatcgttagaatcgcgtgctctctttttaatgggggccccgacagctgtggctgtgtgacaagtggagggaccgagagcatactgatggcatgtaaggcctaccgtgacctggcatttgaaaaggggattaaaacacccgagattgtcgctccccagagtgcacacgctgctttcaataaggctgcatcttatttcggtatgaagatagtgagagtgccattgaccaaaatgatggaagtcgatgtacgcgccatgcggcgcgccatcagtcgcaatactgccatgttggtgtgtagtacaccacaatttccccatggcgttatagatcccgtgccagaggtggctaagctcgcagtgaaatataaaatcccactccatgtggacgcctgtctgggcggtttcttgattgtctttatggagaaggccggctatcctctggagcacccatttgacttcagagtgaaaggagttacctcaatctcagcagacactcataagtacgggtatgctccgaaaggcagcagtctggtgctctacagtgacaagaagtacagaaactaccagttcttcgttgacaccgactggcagggcggaatatacgcttctccaaccatcgcgggttctaggcctgggggtatcagtgcagcctgttgggccgctcttatgcatttcggcgagaatggctatgtggaagccacaaagcagataatcaaaactgcacggttcctaaaatcggagcttgagaacatcaagggcatattcgtttttgggaacccacagctgagtgtcattgcccttggttcccgggactttgatatctatagattaagtaatctgatgactgcaaaaggctggaatctcaatcagctgcaatttcctccttccatccatttctgtattaccttactgcacgcacgcaagcgagtagcaatccaatttctgaaagatatccgggagtccgtgactcaaataatgaagaatccaaaggccaagacgactgggatgggagccatctacggaatggcccagactacagttgataggaacatggtggctgaactgtcctccgtgtttctcgattctctgtactctaccgatacagtcacccagggctcacaaatgaatggcagccctaagccccattag

SEQ ID NO: 30548 - DNA, 408 bp, Artificial Sequence
  Description of Artificial Sequence: Synthetic coding sequence
tgaatccaggacaagctcaacaagacgaaggacgacataagcaaaaacatgagtttcttgaaggtcgacaaggagtacgtgaaggcgctgccctcccagggactgtcctcaagtgccgtcctggagaagctcaaggaatattcaagcatggacgcattttggcaggaaggcagagcctccggaaccgtgtactcgggcgaagagaaactgacagagttactagtgaaagcctacggcgactttgcttggtcgaaccctcttcatcctgacattttcccgggtcttagaaagatcgaagcggaaatcgtgcgaattgcctgttcgctctttaacgggggtccagactcatgcggttgtgtgagcatctgtaaaggtcaccctatcgcattgttttttcgcctaaagtag

SEQ ID NO: 30549 - DNA, 1638 bp, Artificial Sequence
  Description of Artificial Sequence: Synthetic coding sequence
atggaaaccgaactgtgtgctgcccaccttccgacagaatcagacgcacccaaccactaccaggcagtgtgcagagctcttttcgcagaaactatggaactgcacactttcctcaccaaaatcaagagcgctaaggagaatctgaaaaagatccaggaaatggagaagagcgacgagtcctcaactgacttagaagagctgaagaatgcagattgggcacgcttctgggtgcaggtgatgcgagaccttcgcaacggggtgaagttaaaaaaggtccaggagcggcaatataatcctctacctatcgagtaccaattgacgccatatgagatgctgatggacgatattcggtgcaaaagatatacattgaggaaggtaatggtgaatggagacattcccccaaggctaaaaaagagcgcccatgagatcatattggacttcatccgatcccgacctcctctgaaccccgtgagcgcaagaaaactgaagcccaccccaccaaggcctcgcagcctccacgagcgaattctggaggaaatcaaggcagaacgcaagcttagacccgtgagtcccgaggaaattcgcagaagtaggctcgatgtgacaaccccagagagcactaagaacttagttgagtcctccatggtaaacggcggcttgacaagccagacgaaagaaaacggcctctccacatcccagcaagtgcccgctcagcgcaaaaaattgctgcgggcgcccacactggctgagttggattctagtgagtcggaagaggagactcttcataagagtacctcaagttcatctgtgtcaccatcttttccggaggaaccagtcctggaggctgtgagcaccagaaaaaaaccgcccaagtttctcccaatctctagcacgccacaaccagaacgccggcagccaccacaacggaggcacagcatcgaaaaggaaaccccgacaaacgtacgccaatttttacctccctcccggcagtcaagccgctcactcgaggaattttgctaccctgtggagtgcctcgccctgacagtggaagaggtcatgcacatcaggcaggtgctggtgaaagccgagttagagaagtatcagcagtacaaagacatatacacggccctcaagaaagggaagctctgcttctgctgccgcactagacgattttcattcttcacgtggagctatacatgccagttttgtaaaaggcccgtctgcagtcagtgttgcaaaaagatgcggctcccgtcaaaaccctacagcacattacccatcttctccctggggccaagcgctctgcagcgaggcgagtcaagtatgcgatcagaaaaaccctctacagcgcatcacagacctctaaggagcattgcaagattctcatccaaatctaagtcaatggataaaagcgacgaagaacttcaatttccgaaggagctgatggaggactggtcaaccatggaggtgtgcgtagactgcaagaagtttatcagcgagatcatcagctcctccaggcgcagcttagttcttgctaacaaacgagctaggttaaagaggaagactcagtctttttatatgtccagcccggggccatctgagtattgcccgtccgaacgtacgattagcgaaatctag

SEQ ID NO: 30550 - DNA, 1377 bp, Artificial Sequence
  Description of Artificial Sequence: Synthetic coding sequence
atggctaacacagtagaagctgatggtagtaatgacgagggatatgaagccgctgaggaagggttgggcgatgaagacgaaaagcgcaaaattagtgccattcgttcgtaccgcgacgtgatgaagctgtgcgccgctcatctgccgacagaatctgacgctcccaatcactaccaggccgtgtgccgcgccctgttcgccgaaaccatggaacttcacaccttcttaaccaagattaagtctgcgaaggagaacctgaaaaagattcaggagatggaaaagagcgatgagtcctctaccgacctggaagaactgaagaatgcagattgggcaaggttctgggtccaggtgatgcgggatctccggaacggtgtcaagctaaagaaggtgcaggaacgccaatataatccattgcctatcgagtaccagctgaccccctacgagatgctgatggacgatatacggtgtaaacgttataccctccgcaaggtaatggttaatggggacattcccccccggctaaaaaagagtgctcacgagatcatcctcgacttcattcgctcaagaccacctctgaaccctgtctccgctcgtaagctaaagccaaccccacctagacctaggagcctccacgaacgtatacttgaggagatcaaggcagagcggaaactcaggcctgtctcacccgaagagatcaggagatcccggctcgatgtgaccacccccgaatccaccaaaaatctcgtggaatccagcatggtcaacggcggactgacttcacaaaccaaggagaacggactcagtacttcgcagcaggtacccgcccaacgcaagaagctgttgcgggcaccaacactggctgagctcgacagcagcgaatcagaggaggagaccctgcataaatctactagttcctcttcagtttctccctcattccctgaggaacctgttctggaggcagtgtcaaccagaaaaaagccccccaagttcctgcccatttctagcactcctcagccggagcgaagacagcccccccagcggcggcacagtatagaaaaggaaacacccacaaatgtgcgacagtttctacctccttcacgccagtctagcaggtcactggaggagttctgctacccggtcgagtgtttggctctgacagttgaagaggttatgcacatcaggcaggtcctcgttaaggccgagctcgaaaaatatcagcagtacaaggacatatatacggcacttaagaaagggaagctgtgcttttgttgccgcactcgacgttttagcttctttacttggagctatacatgccagttttgtaaatccgactgcttatttaatggcaccgctcactgtcaattctatcttggatag

SEQ ID NO: 30551 - DNA, 2271 bp, Artificial Sequence
  Description of Artificial Sequence: Synthetic coding sequence
atggcccaggcagctggcccggcgggcggaggggaaccacgcaccgaagccgtcggaggcgagggacctagggagccaggcgccgccggaggcgctgccgggggttccagagacgcgctgagtctcgaggagattttaaggttgtacaatcagcctattaacgaggaacaggcttgggccgtatgttatcagtgttgcggctcccttcgcgccgctgctcgccggcgacagccccggcaccgagtgaggtcagcagcgcagattcgcgtgtggcgagatggagctgtcaccctggctccggcggccgacgatgccggcgagcccccgccagtggcagggaagctggggtactcccagtgtatggagactgaggtgattgagagcttgggcataatcatttacaaagcgttggattacggccttaaagagaatgaagagcgcgaactgtccccacccctggagcaactgattgatcacatggcaaatactgtcgaggcggacggcagcaatgacgaaggctatgaagcagccgaggagggcctgggtgacgaagatgaaaagaggaaaatcagcgcaatacggagctaccgtgacgtgatgaagctatgcgcggcacacttgcctaccgagagcgacgctcccaaccactaccaggctgtctgcagagctctgttcgctgaaaccatggagctccataccttcctgacaaagatcaagagcgcgaaggaaaacctgaagaaaattcaggagatggaaaagagtgatgagagttctaccgatcttgaagaactcaagaatgccgattgggcccggttttgggtgcaggtaatgcgtgaccttcgaaacggtgtcaaattaaaaaaggtccaggaaagacagtataatcctctgccaattgagtaccaactgaccccgtacgagatgctgatggacgacatcagatgcaaacggtatacactcagaaaggtaatggtgaatggggacatacccccgcggctgaagaagagtgctcacgagattatcctagacttcattcgatccaggcctcccctgaatccagtgtctgctaggaaacttaaaccaacgccacccagacctaggtccctgcatgaacggattttggaggagataaaagcggagcgtaagctgagaccagtgagtcctgaagaaattcgtcgttcccggttagcaatgcggccattgagcatgtcatatagctttgatctaagcgatgtcaccaccccagagtcaactaaaaatttggtagagagctcaatggtgaatggtgggctcacctctcagactaaagaaaacggactctcgactagccagcaggtccctgcgcagcgcaagaagctattgagagctccaactttggctgagctggactccagcgaatctgaggaggaaacacttcataaaagcacctcgagttcaagtgtatctccatcattccctgaagaacctgtgcttgaagcggtcagtaccaggaagaagccccctaaattcctgccgatatcctctacccctcaaccagagcggagacagccaccacagaggcgccacagcattgagaaggagacaccgaccaacgtgcggcagtttttacccccttcccggcaatcctctagatcactggaggaattctgttacccagtagagtgcttagcccttactgtcgaggaagtcatgcacatccgccaggtgctggtgaaagcagaactggaaaaatatcagcagtataaagacatatacaccgcattaaaaaaaggtaagttgtgcttttgttgccgcacccgccggttcagctttttcacgtggtcttacacgtgtcagttctgtaagaggccagtgtgctctcagtgttgcaagaagatgcggctacccagcaagccctactctacgttacccatcttctcactgggaccttcagctctccaacgcggcgagtcctctatgagaagcgagaagccctctactgcccatcacaggcccctcagatccatagcaaggttctccagtaaaagtaaaagcatggataagagtgacgaagagttacagtttcctaaggagcttatggaggactggtctacaatggaggtctgcgtcgactgtaagaagttcatttcagaaatcattagctcttctcgtcgctctctcgtgctcgcaaataaaagggccagactgaaaaggaaaacacagtctttttacatgagcagcccgggtccttctgaatactgtccttctgaaaggacaatctccgagatctag

SEQ ID NO: 30552 - DNA, 2229 bp, Artificial Sequence
  Description of Artificial Sequence: Synthetic coding sequence
atggcccaggccgccgggccagcgggaggcggggagccccggacagaggcggtgggcggcgaaggaccaagggagccgggagcggccggaggggctgctggagggtctcgggacgccctttccctcgaagaaattctgcgtctgtacaatcagcccataaatgaagaacaggcgtgggcggtatgttaccaatgttgcggctcgctgcgcgccgctgcgcggagacggcaacctcgacacagagtgaggtctgctgcccagatcagggtgtggagagacggggcagtgacattagccccagctgcagatgatgccggcgagccaccaccagttgccgggaaactgggctatagccagtgcatggagactgaggttatagaatctctcggaatcatcatctacaaagccttagattacggacttaaggaaaacgaggaaagagaacttagccctcccctcgagcagctaatcgatcatatggcaaatacggttgaggccgatggatccaacgacgaaggctacgaagccgctgaagagggcctaggcgacgaagacgagaagaggaagatctccgctatccgctcctatagagatgtcatgaagttgtgcgccgcccacttacctacagagtcagatgcccccaaccactaccaggcagtgtgccgggccctctttgcagaaaccatggaactgcacacatttttgaccaaaataaagtccgctaaagaaaacctgaaaaagatacaggaaatggagaagagcgacgaatcatcgacggatttggaggaacttaagaacgccgactgggctagattttgggtccaagtcatgagggatctgcgtaatggggttaaactgaagaaggtccaggaacgccaatataaccctcttccaatagaatatcagctgacgccgtacgagatgcttatggacgatatccggtgcaaaagatacaccctaaggaaggttatggttaatggcgatatccccccaaggttaaagaaatctgctcacgagattatactggactttattcggtcaaggccaccccttaacccggtgagcgcgaggaaactcaaaccaacccccccccgacctaggtcgctccatgaacgcattcttgaagagatcaaggcggagaggaagcttcggcctgtgtctcccgaggaaattcggcgtagccgactagacgtgacaactcccgaatcgaccaagaaccttgtggaatcttccatggtaaatggcggactcacgtcccagacgaaggagaacggactttctacaagccaacaggtcccggcccagcgaaaaaaactgttacgggcaccaactctcgctgaactggacagcagcgagagcgaggaagagacactccataaaagtactagctcctcttctgtgagtccctctttcccagaggagcccgttctcgaagctgtttcaacacggaagaaaccgcccaaatttcttcccatctctagcacccctcagccagagcggagacagccccctcagagacgtcactcgattgagaaggagacccctaccaatgtccggcagttccttccgccatctaggcagtcatctcggagcctggaagagttctgttaccccgtagagtgtctcgcacttaccgtcgaggaggtcatgcatatccgccaggtgctcgtcaaggccgaactcgaaaaataccagcagtataaggatatttatactgcactgaaaaaaggcaagctatgtttttgttgccgcactagaagatttagctttttcacgtggagttacacctgtcagttctgtaagcgaccagtgtgctcacagtgttgcaaaaagatgcgtctgcccagtaaaccttattccaccctgcctatattttcacttggtccgagcgccctccagcgcggagagtcgagtatgaggtccgagaaacccagcacagctcaccaccgacccctgaggagtattgctaggttcagcagcaaatccaaatcaatggacaaaagtgatgaagagcttcagtttcccaaggagttaatggaggattggtctaccatggaagtctgcgtggactgtaagaagttcattagcgagataattagcagttcccgtaggtccctggtgctggctaacaaaagagctcgactaaaaagaaagacccagtccttctacatgagctccccaggtccaagcgagtactgtcccagcgagcggacaatttcagagatttag

SEQ ID NO: 30553 - DNA, 1869 bp, Artificial Sequence
  Description of Artificial Sequence: Synthetic coding sequence
atggagactgaggtgatcgagagtctgggcatcatcatatataaggccctcgactacggtctcaaagagaatgaagagcgagaactttccccccccttggaacaattaatcgaccacatggctaacacggtcgaggccgacgggtcaaacgacgagggttacgaggccgcagaagaaggcctcggagacgaagatgaaaagcgaaagatatctgcaatcaggtcttatcgagacgtcatgaaactgtgcgccgcgcacctgcctaccgagtccgatgctcccaatcactaccaagcagtttgtcgtgctttgttcgcggagactatggagctgcatacatttttgaccaaaattaaatcagccaaggaaaatcttaaaaagatccaggagatggaaaagtccgacgagtcctcaaccgatctagaggaactcaagaatgctgactgggcacgcttctgggttcaggtgatgagagacttgaggaatggcgtgaagctgaaaaaagtccaggagcgacagtacaacccactgccaatcgaataccagctgacaccttatgaaatgctcatggatgatatacgttgtaagcggtataccctgagaaaggtcatggtaaacggcgacattcctccacgcctgaaaaaaagcgctcacgagatcattttggacttcatcagaagcaggccccccttgaatcccgtgtccgcgagaaaattaaagcccacaccaccaagacctaggtctctgcatgagcgcattctggaggagatcaaggccgagagaaaactgcgccctgtgtccccggaggagatacgccgatcacgcctggacgtcacgacacccgaaagcactaaaaacttggtggagtcatccatggtcaacggaggtctgacctcccagactaaagaaaacgggctgagcaccagtcaacaggtgccagctcaaaggaagaaactgctcagggctccaactctggctgaactagacagctctgagagcgaggaagagactttacacaagtccacaagctcatcctcagtttccccctctttcccggaagaaccagtactggaggccgtgagcacacgcaagaaaccgccaaagtttttgcccattagcagcacccctcagcccgaacggaggcagcctccgcaaaggcgacatagcatagagaaagagacaccgaccaatgtgcgccagttcttgcctccctctcgtcagtcttcgagatcactcgaagagttctgctaccctgtggagtgtctggcactgactgttgaggaagtgatgcatattcgtcaagtgctcgtgaaagccgaactggagaagtaccagcaatataaagacatttatactgccttaaagaagggtaagctgtgtttctgttgtcgaacccggcgattctcattctttacttggtcttacacatgccagttttgcaaaaggcctgtctgtagccaatgctgcaaaaaaatgcggctgccatcgaagccttatagcaccctccctatttttagcctgggtcccagcgcactgcaacggggggagtcaagcatgagatccgagaaaccttctactgcccaccatcggcccctacggagcatagcaaggttctcgagtaaatctaaatctatggacaaaagcgatgaggaactgcagtttcccaaagagctcatggaagattggtccacaatggaagtgtgcgtggattgcaaaaaatttatcagcgagatcatttccagttcgaggagatcccttgtgcttgcaaataagcgcgcgcgcctcaaaagaaagacccagtctttttatatgagtagcccaggtccttctgaatattgcccaagtgagcgcactatctcggagatctag

SEQ ID NO: 30554 - DNA, 624 bp, Artificial Sequence
  Description of Artificial Sequence: Synthetic coding sequence
atggcattacttttcgctcgctcactgagattatgtcggtggggcgccaaacgtctgggagtggccagcactgaagcccagcgcggggtgtccttcaagctcgaggagaaaacggcccattcatcccttgctctctttcgcgatgatatgggagttaagtacggcctcgtcggactggagcctacgaaggttgcacttaatgtagagaggttccgggaatgggccgtggtgctggcggataccgcagtaactagtggccggcactattgggaggtgacagtcaaacgttcacaacaattccgcattggcgtggccgatgtggatatgtccagggacagttgcatcggagtagatgaccgatcgtgggtgtttacctatgcacagagaaagtggtacacgatgctggctaatgaaaaggcaccagttgagggtatcggccaaccagaaaaggtaggactcctgttggagtatgaggctcagaaattatcgctagtggacgtgtcccaggtatcagtggtgcataccctgcagacagatttccgggggccagtggtccctgccttcgcgctttgggacggcgagctgctcacccactctggactcgaggtgccagaggggctgtag

SEQ ID NO: 30555 - DNA, 390 bp, Artificial Sequence
  Description of Artificial Sequence: Synthetic coding sequence
atgtggagcgcctccggctcaggcaggcattactgggaagtgaccgttaaacgctcgcagcagtttcgaataggagtggccgacgttgacatgtcccgtgattcatgtatcggggtcgatgatcggtcctgggtattcacttatgcgcagcgcaaatggtacactatgctcgcgaacgagaaggcgcctgttgaaggcatcggccagcctgagaaggtaggactgctgctcgaatacgaagcgcagaaactctctctcgtcgatgtttcacaggtgagcgtcgtccacactctacagacagacttccgaggacccgtagtgcctgccttcgcactctgggacggagaactgctgacacacagtggcctggaggtgcctgagggattgtag

SEQ ID NO: 30556 - DNA, 1257 bp, Artificial Sequence
  Description of Artificial Sequence: Synthetic coding sequence
atgagaactaaggctgccggatgcgccgaaaggcgtcccttacagccgcggaccgaagccgccgctgctccggcagggcgggccatgccctcggagtacacatatgtaaaattgaggtccgattgctcgcggccttctctgcagtggtacacacgggctcagagtaaaatgcgccgacctagcctgctcttgaaagatatcttaaaatgtacccttttggtgttcggcgtttggatactgtatattcttaaactgaattacaccacagaagagtgcgatatgaagaaaatgcattatgttgacccagatcatgtcaagcgcgcccagaagtatgcccagcaggtactccaaaaggagtgtcgcccaaagttcgccaagacatccatggctctgttgtttgaacatcggtattccgtggacctcttgccatttgtccagaaggctcctaaggattctgaggccgagtccaagtacgaccctccattcgggttccgaaaattcagctccaaggtgcagacgttactcgagcttttacctgagcacgacctgcccgaacaccttaaggctaaaacatgtaggcgctgcgtggtgattggcagtggcggcatcctgcacggccttgaactgggccatacattgaaccagttcgacgtcgtgatccgtttgaactcagccccggtcgaagggtactcggagcacgtgggtaataagactactatcaggatgacctacccagaaggcgctccgctgagcgatttggagtattattccaatgatctgtttgtcgcagtgcttttcaagagcgttgatttcaattggctccaggctatggttaaaaaggaaaccctccccttctgggtgagattgtttttttggaagcaggtagccgagaaaataccactgcaacctaagcacttcagaattctcaatcctgttattatcaaagaaacagcattcgatatcctccaatattctgagccacagagcaggttttggggaagggataagaatgttccaacaataggagtgattgccgtggtgttagccactcacctgtgcgacgaagtgtcccttgccggtttcggttacgatctgaatcagccccgtaccccactgcattatttcgacagtcagtgcatggcagccatgaattttcagaccatgcacaatgtgactacggagacgaagttcctcctcaagctggtgaaagaaggagtggtcaaggacctcagcggaggaatcgacagagaattttag

SEQ ID NO: 30557 - DNA, 372 bp, Artificial Sequence
  Description of Artificial Sequence: Synthetic coding sequence
atgtacgagattgcagccccaaacgtggcctttatgaccctgcgctcaatgtgtaacactagtaaaatggtgacgtgcgcgaaaatttttttctacttccttgtgtttttcagcctttctcaaaatgtgcccactatcggggttatcgctgtggtcctcgctacccacttgtgtgatgaagtgtccctggctggtttcggttatgatctcaatcagccaagaacccctctccactattttgattcccaatgtatggccgccatgaattttcagactatgcataatgtgacaaccgagaccaaatttctgctaaagctggtcaaggaaggtgttgtgaaagacctgagcggtggtattgatcgggagttctag

SEQ ID NO: 30558 - DNA, 1173 bp, Artificial Sequence
  Description of Artificial Sequence: Synthetic coding sequence
atgccatcggagtacacatacgtcaagttgaggtcagattgtagccgaccaagcttgcaatggtacacaagggcccagagcaagatgagaaggccttctttacttctgaaggacattcttaaatgcactttgctggtctttggagtgtggatactctacatactcaaattgaactacactacggaagagtgcgacatgaagaaaatgcactatgtggatccggatcacgtcaaacgggcccaaaagtacgcccagcaggtactgcagaaggagtgtcgacctaaatttgccaagacctccatggctctcttgttcgagcaccggtactcagtggacctgctgccttttgtccagaaggcccctaaggactccgaggcggaatctaagtacgacccacccttcgggttcaggaaattcagctcgaaggtccaaacactgctggaactacttcccgaacatgacttgcccgagcacttgaaagcgaagacctgcagacgctgcgtggtcattggttcaggcggcatcctccacggattagagttaggccatacattaaaccaattcgatgtggtgatccgcctgaacagcgctcctgttgaggggtacagcgagcatgtgggaaataaaacaaccattcgtatgacatacccagaaggagctccgctgtcagacctggagtactattccaacgaccttttcgttgcggtgctgttcaagtctgtggatttcaactggctgcaggcgatggtaaaaaaggagactttgcccttttgggttagactgttcttttggaaacaggtggcggaaaagataccgcttcagccaaagcatttcaggatcctaaatcccgtgatcataaaggagactgccttcgacatccttcagtacagcgagccccagtcaaggttttggggcagggataaaaatgtgccgactattggggttatagcagtggtgttggccacacacctctgcgacgaggtttccctcgctgggtttggatacgacctgaaccagccacgcacccccctgcactactttgactctcaatgcatggctgccatgaatttccagacgatgcacaatgtgacaactgaaactaaatttctgctaaaacttgtgaaggaaggggtcgtcaaagacctctcaggcggaattgacagggaattttag

SEQ ID NO: 30559 - DNA, 1188 bp, Artificial Sequence
  Description of Artificial Sequence: Synthetic coding sequence
atggccagcgtccctatgccctcagagtatacctacgttaagttgagatctgattgctcccggccttcgcttcagtggtatacccgggcacaaagcaaaatgcgtaggccatccctgctgctcaaggatatactgaaatgtacgcttttggtttttggggtatggattctttatatcttgaagctaaattacacaactgaagagtgtgacatgaagaaaatgcattatgtggatcctgatcacgtgaaacgggcacagaaatatgctcagcaggtgttacagaaggagtgccgccccaaattcgctaaaaccagtatggcccttctcttcgagcacagatacagcgtggacctgctgccatttgtacagaaagcccccaaggattccgaggcagaatcgaaatacgacccgcccttcggcttccgaaaattttcgtccaaggtccagacattgctggagctgctcccggagcacgacctgccagaacatctgaaggccaaaacttgccggaggtgtgtggtcatcgggagcggaggaatcctccatggcctggagctgggccacaccctgaaccagttcgatgtggtgatacgcctcaactcagcccctgtggaaggatattctgagcacgtggggaacaagacaactattaggatgacttaccccgaaggagcccctctgagtgacctggagtactattccaacgacttatttgtggccgtgctgtttaaatctgtggactttaactggctgcaggccatggtgaaaaaggagaccctgcccttctgggtcagactgtttttttggaagcaggttgccgagaagatccctctgcagccaaaacattttcgcattcttaacccagtgatcattaaagaaacagccttcgatatcctgcagtactccgaacctcagagccgattctggggccgcgataaaaacgtgcccacaataggggtaatagccgtggtgctagcgacccacctgtgtgatgaggtatcactcgctggtttcggttatgatcttaaccagccacgcacaccgctgcactatttcgattcccagtgcatggcagccatgaactttcagaccatgcacaacgtcacaactgaaaccaaattcttactcaaattggtgaaagaaggcgtagtgaaggacctcagtgggggtatcgatcgggagttttag

SEQ ID NO: 30560 - DNA, 420 bp, Artificial Sequence
  Description of Artificial Sequence: Synthetic coding sequence
atgccctctgagtatacgtacgttaagttgcggtcagattgtagtcgaccaagtctgcaatggtacactagggctcagtcgaagatgagaaggccctctctgctgcttaaagatatcctgaagtgcactcttttagtgttcggggtgtggatactctatatccttaagcttaattacactacagaggagtgcgacatgaaaaaaatgcactatgtcgatccggaccacgtgaagcgagcccaaaaatacgcccagcaggtgttacagaaagagtgtagacccaaattcgccaaaacatccatggcccttttatttgagcatagatattccgtggacctactgcccttcgtccaaaaggctcctaaggattcggaggcagaatcaaaatatgacccacccttcggcttccgcaagttttag

SEQ ID NO: 30561 - DNA, 663 bp, Artificial Sequence
  Description of Artificial Sequence: Synthetic coding sequence
atgcggacaaaagcggctggttgtgctgaacgtcgcccactccagccccgtaccgaggccgcagccgcaccagctggacgggccatgcccagcgagtatacttatgttaagttgagatccgactgcagcagaccttccctgcagtggtataccagggcccagtcaaaaatgcgacggccttcgctcctgctcaaggacatcctgaaatgcacactgctggtctttggcgtctggatcttgtacatactgaaactgaactacaccactgaagaatgtgatatgaagaagatgcattatgtcgatcctgaccacgtcaagacactttccccatgtggttggcattgcgtacaactgataatggctaggtggactcagccactgctccaccgactgctgagcgattctgctgatctgcatagagcatttaagggatcgagagctctgcccgcagaggcattcagcgaaccgcgacatcaacatctccagaccgaatcattcctctcactggtcttgttgccggcctttcaggccttcctgggatatctgagagcgccggagggcgcagccctggcactccggcactttctgttgtcttgtgaactgtgggcctcttccggaggaggacgcgagcagctcaagcagatgccagtgcagctgacctag

SEQ ID NO: 30562 - DNA, 1803 bp, Artificial Sequence
  Description of Artificial Sequence: Synthetic coding sequence
atgcgcagctgtctgtggcgatgtcggcacctgtcccagggggtgcaatggagccttttgctcgcagtgctcgtgtttttccttttcgcccttccgtctttcattaaggaaccccagacaaagcctagcagacatcagcggacagaaaacataaaggagagaagtctacaatcacttgctaagcctaaatcccaggccccaacccgcgcccgccgcacgacaatctacgcggaaccagttccagagaacaacgccctgaacacccagactcagcctaaggcgcacaccaccggggatcgcggcaaagaggctaatcaagccccccctgaggaacaggataaagtgccccacacagcacagagggccgcatggaagtcgccagagaaagagaagaccatggtgaacaccttgtcaccacggggccaggacgccggtatggcttcaggcaggacggaagcccagagctggaaatctcaggatacgaagacaacacaaggcaacggcggtcagaccaggaagctcactgccagccgcacagtcagcgagaaacatcaaggcaaggccgccaccaccgccaaaacccttatacccaaatctcagcatcggatgctcgcgcctaccggcgctgtctcaacacgaacgaggcagaagggggtaactactgccgtgatccctcctaaagaaaaaaaacctcaagctactccaccccccgcaccatttcaatccccaactactcagaggaatcaacgtcttaaggcagcaaactttaaatcagaacccagatgggatttcgaggaaaagtactccttcgaaatcggcggccttcaaaccacgtgtccagacagtgttaaaataaaagccagtaagtcattatggctacaaaagttattcctgccaaatctgaccctctttcttgattctcggcatttcaatcagagcgaatgggaccggctcgagcactttgccccacctttcgggttcatggagctgaattattctttagtgcagaaagtggtgactagatttccacctgttcctcagcaacagctgctcctggcctccctcccagcaggttcattgcgatgcattacctgcgccgtcgtggggaacggaggcatcttaaataactcacacatgggtcaggagatcgacagtcatgattatgtctttagattgtccggagctcttataaaagggtacgaacaagatgtcggcactaggacatcattctatggcttcaccgcgttttccctcacccaatccctgctcatactgggaaaccgggggtttaagaacgtgcctctgggaaaagacgtgagatacttgcactttctagaaggcacacgcgactatgaatggctggaggctctgctaatgaaccagaccgtcatgagtaaaaacctgttttggtttcgtcataggccacaggaagcttttagggaggccctacatatggatcgctacctgttactgcaccccgacttcttaagatacatgaagaatcgctttttgagaagtaaaactctggacggagcccactggaggatctatagaccaaccacgggcgctctcctactgctcaccgcactgcaactgtgtgaccaggtaagtgcttacggcttcatcaccgaaggccatgaacggttctccgaccactattacgatacctcgtggaagaggctcattttctacattaaccacgacttcaagctagagagggaggtgtggaagaggctccatgacgagggaatcattagactgtaccaacgcccagggccaggcacagccaaggcaaaaaattag

SEQ ID NO: 30563 - DNA, 1416 bp, Artificial Sequence
  Description of Artificial Sequence: Synthetic coding sequence
atgcggagttgtctgtggagatgtagacatcttagccagggagtgcagtggtctctcctgttggccgtgcttgtgttttttctttttgcactgccaagcttcatcaaggagcctcagaccaagccgagccggcaccaaaggacagaaaatatcaaagagagaagtttacagagtttagccaagccaaaaagccaggccccgacccgagcccgccgcactaccatttacgcagagcccgtccctgaaaacaatgcccttaatactcagacccagccaaaggcacacactactggggatcgagggaaagaggctaaccaggcgcccccagaagagcaggataaagtcccccatacagcacagcgcgccgcatggaaatcaccagagaaagaaaagactatggtgaacacactctcccctcgagggcaggacgccggcatggcctccggtcgtactgaggcacagagttggaagtcacaggacactaaaacaacgcaaggaaacggagggcagacgcgaaaactgactgcctctcggactgtgtctgaaaaacatcaaggcaaggctgccaccactgcaaaaaccctcattcccaaatctcagcaccggatgttggcgcctacaggggcagtctccaccaggacacggcaaaaaggcgtgacaacagccgtgattccgcctaaggagaagaagccacaagctactcccccaccagcacccttccagtcccctacgactcaacgcaaccagaggctgaaggctgccaacttcaaatctgagccccggtgggacttcgaggagaagtactcgttcgaaattgggggacttcagaccacctgtcccgacagtgtgaaaattaaggcttccaagagcctctggcttcaaaaacttttcctccctaacctcacactgtttctggactcgagacatttcaatcaatcggagtgggatagactggaacattttgcacccccattcggcttcatggaactgaactattcactggtgcaaaaagtcgttacccggttccctcctgtcccccagcaacaattgctcctggcgagcctcccggcaggatcactgagatgcattacttgtgcggtggttggcaacggcggcatcctaaataacagccatatgggccaggagattgactcccatgactatgtattccgtctatctggcgctcttatcaaagggtacgagcaggacgtgggcacccgcactagtttttacggattcaccgctttctctctcacccagtcactgctcattctgggtaaccggggatttaaaaatgtccctctgggaaaggctcagacccctgggtctttctcaggatcccccgcgcacggccaggttccagtggctgctccaagactgtctcccattcacgaagaacaggtcagcgaagtgtag

SEQ ID NO: 30564 - DNA, 2238 bp, Artificial Sequence
  Description of Artificial Sequence: Synthetic coding sequence
atgggagtcccctttttttcttctttacgttgcatggtggatcttggaccttgctgggccgggggcctcaccgccgagatgaagctgctgttagccttggccgggctgctagctatcctggccactcctcagcccagcgagggcgccgcccccgcggtactgggggaggtggatacctcattagtactatctagcatggaagaggccaaacagttggttgacaaggcatataaggaaaggcgggagtccattaaacagagactacgcagcggctccgcctctcctatggagctgctgtcttactttaaacaacctgtcgctgccacacgcacagcggtaagggcggcagattatctccatgtggccctcgacctgcttgagaggaagttaaggtcgttgtggcggaggccgttcaacgttacagatgtgctcacccctgcccagctgaatgtgctcagcaaatcttctggttgcgcgtaccaggacgttggagtgacctgccccgagcaggataagtaccgcaccatcaccggaatgtgcaacaacaggcggtctcctacactgggggccagcaatcgggctttcgttcgctggcttccggcggagtatgaggatgggttctccctgccttacggttggacacctggcgtgaaacggaatgggttcccggtggccttagcccgggccgttagcaacgagattgtacggtttcccactgaccaattgacaccggaccaggagagatccttaatgtttatgcagtgggggcaacttttagatcatgatttggatttcacgcctgagcccgctgcgagggctagcttcgttacgggggttaattgtgagactagctgtgtccagcagccaccgtgcttccccctaaaaattccacctaacgatcctcgcattaagaatcaggctgattgcattcctttctttagatcgtgccccgcttgcccaggcagtaacataaccataaggaatcagatcaatgccctaactagtttcgtggatgcctctatggtgtatggaagtgaggaaccgctagctaggaatcttcggaacatgtccaatcagttgggattgctcgcagtaaatcagaggttccaggataatggaagggccctcctaccgttcgacaacctgcacgatgatccctgcctgctgacaaacagatctgctcgcatcccatgcttccttgccggagatacccggtcttccgagatgccagaactgacttcaatgcataccctgttgttaagagagcataacagattggccacagaactcaaaagcttgaatccaagatgggatggggagcgcctgtatcaggaggctcggaagatcgtaggcgcaatggtacagattatcacttatcgcgactacctcccactggtcctcggccccaccgcgatgaggaagtacctgcccacttacaggtcctataatgatagcgtggatcctagaatcgcgaatgtgttcaccaacgcctttcgatacggccacaccttgatccagccgttcatgttcaggcttgataatagataccaacccatggagccaaaccctagggtgcctcttagccgagtgtttttcgcctcctggcgcgttgtactggagggtggaatcgacccgatcctgaggggactgatggccactcctgccaaacttaatcggcagaatcagattgctgtcgatgagattcgggagcgcctcttcgagcaagttatgaggattggactagacttacctgccttgaacatgcagaggtctcgagatcacggcctgccggggtataacgcctggcggagattttgtggactgccacagccagagacggtaggccagcttggtaccgtgcttcgaaacctgaagctagccaggaaactcatggaacagtatgggacccctaacaacatcgatatctggatgggcggtgtttccgagccgttgaaaaggaagggacgtgtcggaccgctgctcgcatgtatcatcggaacccagttccgaaaacttcgcgatggggatcggttttggtgggaaaacgagggtgtttttagcatgcagcagcgacaggcccttgcccaaataagcctgccccgcatcatctgcgataataccggcatcacaacagtgtctaagaataacatattcatgagtaatagttatcctcgggactttgtaaactgtagcactttgccggccctgaacctggcctcgtggcgcgaggcatcctag

SEQ ID NO: 30565 - DNA, 918 bp, Artificial Sequence
  Description of Artificial Sequence: Synthetic coding sequence
atggcatgtatcctcaaaagaaaaagcgtgattgccgtatcgttcattgcggcttttctttttctgttggtcgtgagactagtaaacgaggtgaatttccctcttttgctgaactgctttgggcagcctgggactaagtggatcccgtttagttacacataccgacgcccgttgcggactcactatggttacatcaacgtcaaaacccaggagccattacagctcgattgcgatctttgtgccatagttagcaacagtggtcaaatggttgggcagaaggtgggcaatgagatcgacagaagcagttgtatttggcgaatgaacaacgcccccacgaaagggtacgaagaggatgttggaagaatgaccatgatcagggtcgtgtcccacacctcggtgccactgttacttaaaaatcccgactactttttcaaagaagctaatactaccatttacgtgatttggggccccttccgcaatatgcgaaaggacgggaatgggattgtatacaatatgcttaagaaaaccgtgggtatctacccaaatgcccagatctacgtgacaactgagaaacggatgtcctattgcgacggcgtctttaagaaggaaaccggcaaggatcgggtacagtccggcagctacctcagcactggttggttcacttttctcctcgctatggacgcatgttacgggatccacgtgtatggtatgatcaatgacacatactgcaagaccgagggatatcggaaggtcccctaccattattatgaacaaggacgggatgaatgtgacgagtattttctgcatgaacatgccccatacggcggtcacagatttattactgagaaaaaggttttcgctaagtgggcgaagaagcacaggatcatcttcacccaccctaactggactctttcatag

SEQ ID NO: 30566 - DNA, 915 bp, Artificial Sequence
  Description of Artificial Sequence: Synthetic coding sequence
gtttgtatccgtaagaggaagtcagtgatcgccgtgtcctttattgctgcattcctgtttcttctcgtagtgagattagtgaatgaggtgaattttcccctgttactgaactgcttcggacagcctggcacaaaatggattccttttagttatacttacagacggcccctgagaacccattacggatacattaatgttaagactcaggaacccttacagcttgactgcgacttatgtgccatagtgagcaactctgggcagatggtcggtcagaaggtcggcaacgagatcgaccgctccagttgcatctggagaatgaataatgcccctaccaaaggttatgaggaggacgttggccgcatgaccatgatcagagtggtgagtcacacctcagtcccactccttctaaaaaaccctgactactttttcaaggaagctaatacaaccatatatgtgatttggggtccatttcgcaacatgcggaaagatggaaacggcatagtctacaatatgttgaagaaaaccgttggcatttatccaaacgcacagatctatgttacaactgagaagagaatgtcctactgcgatggcgtgtttaagaaggagactggtaaggaccgggttcaatctgggtcatacctgtccacaggctggttcacattcctgctggccatggatgcctgctacggaatccacgtctatggaatgatcaatgacacctactgcaaaaccgaaggataccggaaagtgccgtatcactactatgagcagggcagagatgagtgcgacgagtattttctgcacgagcatgcgccctatggtggccaccgcttcattaccgaaaagaaggtgttcgcgaagtgggctaagaaacaccggatcatatttacccaccccaactggaccctatcttag

SEQ ID NO: 30567 - DNA, 633 bp, Artificial Sequence
  Description of Artificial Sequence: Synthetic coding sequence
atggcgtgtattttgaaagttaccacatggatagccgtatccttcattgcggccttcttatttctcctggtcgtgaggctagtgaatgaagtgaacttccctcttcttttgaactgcttcgggcagcccggtaccaagtggatcccgtttagttacacataccgacgaccgctgcgaactcactacgggtacatcaacgtcaagacccaagaaccactgcagctggattgcgatctatgcgctatcgtgtctaattcaggccaaatggtggggcagaaggtaggaaacgaaattgataggtcctcgtgtatatggcggatgaataatgcgccgacgaaaggctacgaggaagatgttggccgaatgacaatgatcagggtggtctcccacacgagtgtgcccttgctcctcaaaaacccagattatttcttcaaggaggctaacacaaccatctacgtgatctggggcccattcaggaacatgagaaaggacggcaatggcattgtttacaacatgctgaagaagacagtcgggatataccctaacgctcagatctacgttacaaccgaaaaacgcatgagctactgcgacggggtgttcaagaaggagaccggaaaagattcgactgaatag

SEQ ID NO: 30568 - DNA, 612 bp, Artificial Sequence
  Description of Artificial Sequence: Synthetic coding sequence
ttcagtatcttccaaccactgcagctggattgcgatctgtgcgctattgtgagcaatagtggccagatggttggccaaaaagttggaaatgagattgatcggagctcttgcatttggagaatgaacaacgcaccgactaagggttacgaagaggacgttggccgaatgaccatgattcgggtcgtctcccatacatccgttcctctgctactgaaaaacccagactatttctttaaagaagctaatacgaccatctacgttatatggggacccttcaggaatatgaggaaggatggtaacggcattgtctacaatatgctgaaaaagaccgtgggaatttaccctaatgcccaaatttacgtaactacggaaaagaggatgagttattgcgacggcgttttcaagaaggagactggcaaagacaggactgagggatataggaaagttccttatcattattacgagcaaggcagggacgagtgcgacgaatacttcctccatgaacacgccccttatggtggtcatcgctttatcactgagaagaaggtgttcgcaaaatgggctaagaagcacagaatcatctttacacacccaaactggaccctgtcctag

SEQ ID NO: 30569 - DNA, 909 bp, Artificial Sequence
  Description of Artificial Sequence: Synthetic coding sequence
atgaaggcaccgggccgcctggtgctcataattttgtgctccgtcgtctttagtgccgtttatatactcttatgttgctgggccgggttgccactgtgcttagccacatgtctagaccaccacttcccaaccggcagtagaccgaccgtgcccggcccccttcattttagcgggtattcttccgtgccggatggaaaacccttagtaagagaaccatgcaggagttgcgcagttgtctcttcatccggacagatgctcggctcaggcttaggagccgagatagactcggccgagtgcgtgttcaggatgaatcaggccccgacagtgggatttgaagccgacgtgggacagaggtctacattgagagttgtgagtcacacgtccgtacccctgttactacgaaattattcccactactttcagaaggctcgagatacactctatatggtctggggccagggccggcacatggaccgtgtgctcggtggtcgcacatatcgcaccctgttacaactaaccagaatgtatcccggcttgcaagtttatacatttacagaaagaatgatggcttactgcgatcagatatttcaggacgagacaggaaagaatcgccgacaatcaggtagttttctgagcacaggatggtttacaatgatccttgccttggagttgtgcgaagagatcgttgtttacggaatggtaagtgattcttactgtagagagaagagtcatcccagcgttccctatcattactttgagaaaggcaggctcgacgaatgtcagatgtatcttgcccacgaacaggctccccgatcagcccaccggttcattacagaaaaagctgtcttctctcggtgggccaaaaaacggcctatcgtttttgcacacccaagttggcgcactgagtag

SEQ ID NO: 30570 - DNA, 657 bp, Artificial Sequence
  Description of Artificial Sequence: Synthetic coding sequence
atgctgggatccggactaggcgcagagattgattccgctgagtgcgtcttccggatgaaccaggcacctacagtggggtttgaagctgacgtcggccaacgctccaccctcagagtggtgagccacaccagtgtgccactccttttacggaattacagccactacttccaaaaggcccgcgacacactctatatggtgtggggacagggcaggcacatggatcgtgtgctcggcggacggacttaccgcactctgctgcagctgacgcggatgtatcccggcctgcaggtctacacatttacggagcggatgatggcttattgtgatcagatatttcaagatgaaaccggaaagaatcggagacagtctggcagctttctcagtacagggtggtttaccatgattctggccctggaattgtgcgaggagattgtcgtgtacgggatggtttctgacagctactgccgggaaaaaagccatccgagtgttccgtatcactatttcgagaaaggtagactggacgagtgccagatgtacctcgctcatgaacaagccccccgaagtgcccacaggtttatcacggagaaagcggtctttagccgctgggcaaaaaagagaccgatagtttttgcgcatccttcttggagaacagaatag

SEQ ID NO: 30571 - DNA, 606 bp, Artificial Sequence
  Description of Artificial Sequence: Synthetic coding sequence
atgctgggctctggacttggtgctgaaattgacagtgctgagtgtgtgtttaggatgaaccaagcccccaccgtcggcttcgaagccgacgtgggtcagagatccacactcagggtggtatcccacacctcagtcccactcttgctcaggaactactcacattatttccagaaggcgcgcgacacgctgtatatggtgtggggacaggggaggcacatggatcgagtcctcggaggtcggacgtacagaactcttctgcagctcaccagaatgtacccggggctgcaggtatataccttcactgagcgcatgatggcttactgcgaccagatcttccaggatgagaccggcaagaaccgtcgacagtcaggtagctttctcagtacaggctggttcacgatgatccttgctttggagctgtgcgaagagatagtagtctacgggatggtctcggatagttactgtcgcgagaagtcccatccaagtgtgccctatcactactttgaaaagggccggctggacgagtgccaaatgtatctcgcccatgaacaagcacccaggtccgcccaccgatttattaccgagaaggcagtgtttagcagatag

SEQ ID NO: 30572 - DNA, 657 bp, Artificial Sequence
  Description of Artificial Sequence: Synthetic coding sequence
atgctgggtagcggcctaggtgcagagatcgactctgccgagtgcgtgttccgtatgaatcaagctccaacagtcggcttcgaagccgatgtgggacaaaggtcgaccctgagagtggtgagccatacatctgtgcctcttctgcttaggaactattctcattactttcaaaaggcgcgtgacacgctgtacatggtgtggggacagggccgacacatggatagagtcttgggcggccgaacctatagaacactgctgcagctcaccaggatgtaccccggcttacaggtgtatacctttacagagaggatgatggcctactgtgatcagatattccaggacgaaacaggtaagaacagacggcagtcaggctctttcctgtctaccggctggttcacaatgatccttgcacttgaactctgtgaggaaatcgtggtttacggtatggtgtccgactcctactgcagggagaagtcacacccctcagtgccttatcattattttgaaaaaggacgcctggacgagtgccagatgtaccttgctcacgagcaagctcctcggtcagcccatagattcataacggaaaaggctgtgtttagcaggtgggccaagaagaggcctatcgtattcgcacatccctcctggagaaccgagtag

SEQ ID NO: 30573 - DNA, 1002 bp, Artificial Sequence
  Description of Artificial Sequence: Synthetic coding sequence
atggcttgctcccgaccgccatcccagtgtgagcccacatctctgccaccaggacctcctgcaggccggaggcatcttcctctgagcagacggaggcgcgaaatgtcaagtaataaagaacagagatccgccgtttttgtcatcctctttgctctcatcaccattttgattttgtattccagcaacagcgcaaacgaagtcttccactacggaagcttgcgaggtagatccagaagacctgtaaacttgaagaagtggagcattacagacggctacgttccaatcctgggaaacaagaccctgcctagtaggtgtcaccagtgcgttatcgtgtctagctcttcccatcttcttggaactaagttaggaccagaaattgaacgtgcggaatgtaccatccggatgaacgatgctcccaccacaggctacagcgctgacgtgggcaacaaaactacatatcgcgtggtggctcactctagtgtctttagagtgctgcgtaggccgcaggagttcgtgaacaggacaccagagaccgttttcattttttggggtccgccatcaaagatgcagaagccccagggcagtcttgttagggtcatccaaagggccggtctggtctttcctaacatggaagcttacgccgtgtcgccaggccgcatgcgccaatttgacgatctgtttaggggagagaccggcaaagatcgtgagaaatcacacagttggctttcgactggctggttcacaatggtgatcgctgttgagctgtgtgatcacgtgcacgtgtatggcatggtgcctccaaactattgctcacaacggcccagactgcagaggatgccatatcactattatgagccgaagggccctgacgagtgtgtgacctatatccaaaacgaacactccaggaaggggaaccatcaccgctttataacagaaaagcgtgtctttagctcttgggcacagttgtatggaatcacgttttctcaccccagctggacctag

SEQ ID NO: 30574 - DNA, 900 bp, Artificial Sequence
  Description of Artificial Sequence: Synthetic coding sequence
atgagtagtaataaagagcaaaggtcggctgtatttgtgattctgtttgccctgatcacgatattaatcctttacagctctaacagtgcaaatgaggtgttccattatggaagcttgagaggacgctctcgacgacccgtaaacctgaaaaaatggtccattaccgacggctacgtccccatcttaggcaacaagactctgccttcccggtgtcaccagtgcgtaattgtcagctcatcaagtcatctgctgggtactaaactcgggcccgagattgagagggcagagtgtacaattcggatgaatgacgcccccaccaccggttactccgcagacgtcggcaacaagacaacatatagggtcgtggcccactcctcagtgtttagagtcttacggcggccccaggagtttgtgaacaggacccctgaaacagtctttatattctggggacccccatctaaaatgcagaaaccccagggctccctcgtacgcgtgatacagcgggctgggttagtgttccctaatatggaagcctacgccgtgtcacctggcagaatgcggcagttcgacgacctgtttcggggcgaaactggcaaggaccgtgagaaaagccactcatggctctctaccgggtggtttaccatggtgatcgccgtggaactctgtgaccatgtgcatgtttacggcatggtgccccccaattactgcagtcagcgccctcgactccagcgcatgccctaccactattatgagcccaaggggcctgacgaatgtgttacatacatccagaacgaacattcccgcaaggggaaccatcacagatttatcacagagaagcgggtcttcagctcctgggcacagttgtatggcattacattctcccacccaagctggacatag

SEQ ID NO: 30575 - DNA, 1125 bp, Artificial Sequence
  Description of Artificial Sequence: Synthetic coding sequence
atggcctgtagcaggccaccctctcagtgtgaacccacatctctgccgcctgggcctccagcagggcgaagacatctgcccctgtctcggaggcgcagagaaatgagctctaacaaagagcagagatcggccgtattcgtgatattatttgctctcataacaattctcattctttacagctccaatagtgccaacgaggtcttccattacggcagccttcgaggtaggtcccgtcgaccggtgaacttaaaaaagtggagcatcaccgatggctacgtgcctattctcggcaataagaccttgccgagcaggtgccatcagtgcgtcatcgtgtcaagcagctcccacctgctcggcacgaaactcggcccagaaattgaacgcgccgaatgcaccattcgaatgaacgacgcccccactactggatactcggccgacgtgggcaacaagactacctacagggtcgtggcccatagctctgtatttagagtattacggcgcccccaggaattcgtgaatcggacccctgaaaccgtttttattttttggggcccaccatcaaagatgcaaaaacctcaaggttcactggtgcgggttatccagcgtgctggcctcgtcttcccaaatatggaagcttatgctgtgagcccaggacgcatgcggcaattcgacgatctgttccggggcgaaacagggaaagatcgggagaagagccactcttggctgagcactggctggttcacgatggtaattgctgtggagctgtgcgatcacgtgcacgtgtacgggatggtcccacctaattattgcagtggacccgcaagcagtgcgtgtccaaccacaaccacttcaccacggggaaggaccaacgtgtcacctacctctcgaatgagcacagtagccagggccactactaccgcctcctcacctagaaagggctccagtcacagaggaccgtcatgcatggctagccccagcccaactccacctggaccccggccaccttccttgtgggatctgcgcagggtgcgcggcgaagcagcttctgcacagccattgggacaggggccatccagcggtcagtcgcgtttggctggagtgagtcctagtcagtcgggaccatag

SEQ ID NO: 30576 - DNA, 900 bp, Artificial Sequence
  Description of Artificial Sequence: Synthetic coding sequence
atgagcagtaataaagagcaacgatcagccgtattcgtcattctgtttgccctgatcactatcttaatcctctactccagtaattcagccaatgaagtgttccattatggcagcctgcgcgggaggtcacggcgcccggtcaatctgaaaaagtggtcgattacagacggatatgtgcccattttgggcaacaagacactgcctagtcgctgtcaccagtgcgttattgtttccagttcctcgcatctgcttggaacaaaactaggacctgaaatcgagcgagcagagtgtaccattcggatgaatgacgctcccaccactggatacagtgctgatgtggggaataagacgacatacagggtcgtggcccacagcagcgtgtttagggtcttacggcggccccaggaattcgtaaatcggactcctgaaaccgtgttcattttttggggcccacccagcaagatgcagaagccacagggttcattggttagagttatccagagggccgggttagtttttccgaatatggaagcttatgcagtctctcctgggcgaatgagacagttcgatgaccttttcaggggcgaaactggtaaggaccgggagaaatctcattcatggttatccaccgggtggttcacgatggtgatcgccgtggaactgtgtgatcatgtgcacgtgtacggtatggtaccacctaactactgcagccagcgcccaagacttcagcgcatgccctaccattactacgagccaaaagggcccgacgagtgcgtcacctatatccagaacgagcactcgcgcaagggaaatcaccacagatttataaccgagaagcgcgtgttctcttcatgggcccagctgtacgggattacattctctcatcccagttggacctag

SEQ ID NO: 30577 - DNA, 1002 bp, Artificial Sequence
  Description of Artificial Sequence: Synthetic coding sequence
atggcgtgctcacgacctcctagtcagtgcgagcctacctctctgcccccaggcccaccagccggccgtagacacttacctctcagtcgtaggcggcgtgagatgtcaagcaacaaggaacaacgctccgctgtttttgtgatactgtttgccttaatcacgattctcatactttactcaagcaactcagccaacgaagtgttccactacggctcactcaggggtcgctccaggaggcccgtaaacctgaaaaagtggagtatcaccgatggttacgtcccaatcctgggtaacaagacgctgccctcaagatgtcaccagtgtgttatcgttagtagttcatctcatctgctcggaaccaaattaggccccgagatagagagagctgaatgtacaatcaggatgaatgatgccccaactactggatattcagctgatgtggggaataagacaacgtaccgcgtcgtcgcccatagtagtgttttccgcgtcctgcggcgccctcaggagtttgtcaaccgcaccccagagacggttttcatattttggggccctccctcaaaaatgcagaagccacagggaagtctggtgagggtcatccagagagctggcctcgtgttccccaacatggaggcatacgctgtcagccccggccgtatgcgtcaatttgatgacttattcagaggcgagaccggaaaggatcgcgaaaagtcacattcgtggctctcaaccggttggtttacaatggtgattgcagtcgagctgtgtgaccacgtacatgtgtatgggatggtaccacccaattattgctcccaaaggccacggctccaaaggatgccttaccattactacgagccgaaggggccagacgaatgtgtgacatacattcagaacgaacattctcgtaaagggaatcatcaccgatttatcacagagaaaagggtcttcagcagctgggctcaactttacggaattaccttcagtcacccatcttggacttag

SEQ ID NO: 30578 - DNA, 603 bp, Artificial Sequence
  Description of Artificial Sequence: Synthetic coding sequence
atgagctcaaataaggaacagaggtccgcagtattcgtaattctgtttgcgttgattacaatcttgattctgtatagcagcaactctgctaacgaggtgtttcactatggttccctccgtgggcgatcaaggcgccctgttaatctgaaaaagtggtcaattaccgatggttatgtgcccatcttgggcaataaaacactgccaagtcggtgtcaccagtgcgtaatcgtgtccagcagttctcatctgcttggtactaaactggggccagagatcgagagggccgagtgcactattcgtatgaacgacgccccgactactgggtattccgcagatgtgggtaacaagactacttaccgcgtggttgcacattcttccgtgtttcgcgtactgagacgcccccaagagtttgtcaacagaacccctgagacggtgtttattttctggggtccgcccagtaagatgcagaaaccgcagggatcactcgtacgtgtcattcagcgtgccgggcttgtgttccccaacatggaagcatacgcggtgtctccaggcaggatgcgacaatttgatgatctttttcgaggcgagactggtaaggactag

SEQ ID NO: 30579 - DNA, 402 bp, Artificial Sequence
  Description of Artificial Sequence: Synthetic coding sequence
atgagaagttcaatcacagcaccatgcggagctgtcgccgcagatctgagcaccagccggagcggcgcgtcactgacagctatgtccccatttagtgctacacgggagaagtctcactcctggctgtctaccgggtggtttacaatggtgatcgcagtcgagctgtgtgaccacgtccacgtctatgggatggtgcccccaaactattgttcccaaagaccgaggttgcagcgaatgccatatcattactacgaacccaagggcccggacgagtgcgtgacttatatccagaacgagcattccagaaaaggtaaccatcaccgcttcattaccgagaagagggtgttcagcagctgggctcagctgtatggaataacatttagtcacccctcttggacgtag

SEQ ID NO: 30580 - DNA, 1590 bp, Artificial Sequence
  Description of Artificial Sequence: Synthetic coding sequence
atgaaaccccacctaaagcagtggcgtcagcggatgctgtttggcattttcgcttggggtctgctgttcttactcatattcatatatttcaccgacagcaacccggcggagccagtgccatcaagtcttagcttcttggaaactcggcggttgctacccgtccagggaaagcagagggcaattatgggcgcagcccatgaacccagcccaccaggggggcttgacgccagacaagcattgccaagagcccatccagccggatctttccatgccggccctggcgacctgcagaagtgggcccagtcacaagatgggttcgagcacaaggagttctttagctctcaggtgggacggaaaagccagtctgccttctaccccgaggacgatgactacttttttgccgctggacagccagggtggcattcccacacccagggtaccctcggcttccccagtccaggcgaacccggcccccgtgagggcgcgtttcccgcagcgcaggtgcagcgcagacgcgtgaagaaacgtcatagacggcaaagaagaagccatgtgctagaagaaggagatgacggggatagactctattcaagtatgtctagagccttcctgtaccgtctgtggaagggcaacgtatcttctaaaatgctgaatccgcgcctgcaaaaagctatgaaggattacttgacagccaataagcacggagttaggtttaggggcaagcgagaggcgggcttgtcacgcgcccagttgctgtgccagcttcgaagcagagccagggtacggaccctggacggtacagaagcacccttcagcgcccttggctggcggagattggtgcccgccgtgccattgagtcaattgcaccccagagggctacgtagctgcgcagtcgttatgagcgctggcgccatccttaatagttctctgggagaagagatcgattctcacgatgccgtcctgagattcaactcagcgccaacaagagggtacgaaaaggacgtcgggaacaagaccaccatccgcattatcaatagtcagatcctgaccaatccttcgcatcactttattgacagtagcctgtataaggatgtgatactggtggcttgggatcctgccccgtattcagcgaacttaaatttatggtacaaaaagcccgactataatttattcaccccctacattcagcatcgacagaggaacccgaatcagcccttttacattcttcatcctaagtttatctggcagttgtgggacatcatccaagagaatacaaaagaaaagattcaaccgaaccctccatcatccggttttatcggaattttaatcatgatgagcatgtgtcgagaagtacacgtttatgagtacatcccatcagtgaggcaaactgaactgtgtcactaccatgaattgtattatgacgcagcgtgcactctcggggcttaccacccattactgtacgaaaagctcctggtgcagcggcttaatatgggcacgcaaggggacctccaccggaaaggaaaagttgtgctgcccggattccaggctgttcattgccccgccccctcgccagtgatcccgcactcctag

SEQ ID NO: 30581 - DNA, 288 bp, Artificial Sequence
  Description of Artificial Sequence: Synthetic coding sequence
tgatctgggttcattggaatcttaatcatgatgtctatgtgccgcgaagtccacgtgtacgaatacattccatccgtgcggcagaccgagttatgtcattaccacgagctttactacgacgccgcctgtactctgggcgcctaccatccgctgttgtacgagaagttacttgtgcagcgtttgaacatgggcacccagggcgatctccacaggaagggtaaagtggtcctccctggctttcaggccgtacattgtcctgccccttcccctgtgataccccactcttag

SEQ ID NO: 30582 - DNA, 1401 bp, Artificial Sequence
  Description of Artificial Sequence: Synthetic coding sequence
atgaaaccacacttaaagcagtggaggcaaaggatgctcttcggaatcttcgcctggggactgctgttcttactgatctttatctactttaccgattcaaatcccgccgaacccgttccatcctccttatccttcctagaaactcggaggttattgcccgtgcaggggaagcagagagcgattatgggagctgcccacgaaccgtctccccccggagggctggacgctcgacaggcgctgccaagggcccaccccgctgggtctttccacgcaggcccaggtgacttgcaaaagtgggcacagtctcaagacggctttgagcacaaggagtttttttctagtcaagtcggaaggaaaagccagtcagccttttatcctgaggatgacgactatttcttcgccgcgggacagcccggctggcattctcacacacaaggaaccttaggcttcccctctccaggagagcctggcccaagggagggggcgtttcccgccgcccaggtgcagaggcggagggttaagaagaggcaccggagacagcgacggtcccatgtcctggaagaaggagacgacggagataggctctactcttcaatgtctcgcgcattcctgtatcgcctgtggaaaggtaacgtgtcctccaagatgctaaaccccaggttacagaaagcgatgaaggattatctgaccgctaacaaacatggcgttcggtttagaggcaagcgggaggctggactttcacgtgctcagctgctttgtcagctccgttcccgcgccagggtgcgcaccctggatggaacagaggccccgttcagcgctcttggttggaggcgactcgttcccgccgtccccctgtcccagttacacccccggggccttcgcagctgcgccgtggtgatgtccgcaggagcaatcctgaactcttctcttggcgaggagatcgattcacacgacgctgtgcttcggttcaactcagcaccaacacgtggctatgagaaagacgtgggcaacaagactaccataaggattattaattctcagattctcacgaatccttctcatcacttcattgactccagcctgtacaaggatgtgattctagtagcctgggatccggctccttactccgcaaacctgaatctgtggtataagaaacccgattacaacctatttactccctatatacagcacagacagcgcaacccgaatcaacctttctatatcctccacccaaagttcatctggcagctctgggacataatacaagaaaatacgaaggaaaagatccaacccaatccaccctcttcagggttcattgggtcgttcgtgaagatcggccacattagggcatgctccgagcccaggtctagagattgcaccccagcatggacaacagaatag

SEQ ID NO: 30583 - DNA, 1590 bp, Artificial Sequence
  Description of Artificial Sequence: Synthetic coding sequence
atgaagccccacctgaaacagtggagacaacgcatgctattcggaatttttgcttggggcttactgtttctgctgatcttcatatatttcactgacagtaatccagccgaaccggtgccatcttctttgtcttttctcgagactagacggcttctgcctgtccaagggaaacagcgggcaataatgggagccgcccatgaaccgtcccctccaggaggcttggacgcccggcaagccttgccaagggctcaccccgccggttctttccacgcgggtccgggggacctgcagaaatgggcacagagtcaggacggatttgaacacaaggagtttttttcttcacaagtggggcgaaagtcccagtccgctttctacccagaagatgatgactatttctttgccgccgggcagccaggttggcatagtcatacacagggaacattaggcttcccttccccaggtgaacctgggccccgggagggcgccttccctgcagcgcaggtgcagaggcgacgcgttaagaagaggcacagacgccagcggcgctcccatgttctggaagagggcgacgacggagaccggttatattcatccatgtccagggccttcctatatcgcctgtggaagggcaatgtgtcctctaaaatgctaaacccaagactgcagaaagcaatgaaagactatttgactgctaacaagcacggcgttcgctttcggggcaagagggaagctggcttgtctcgcgcccagctgctctgccagctccgatcgagggccagagtgcgaacactggatggcaccgaagccccctttagcgccctcggatggaggaggttggtgccagctgtccccctatctcagctgcatccccgcggtcttagatcctgtgctgtagtcatgtctgcgggagcgatcttaaactcctcattgggcgaggaaattgacagccacgacgcagtccttcggtttaatagcgcccccaccagggggtatgagaaggatgtggggaacaaaacaacaattcgcattatcaactcccagattctgacaaacccatcccatcacttcatcgatagctctctttacaaggacgtgatcctcgttgcatgggaccctgccccttacagtgccaatctcaacctgtggtacaagaaacctgattataatctgttcacaccctacatccaacacaggcagcgtaaccccaatcaacccttctatatccttcacccgaaatttatttggcaactgtgggatatcatacaggagaatactaaggagaagatccagccgaatccaccctcctctggatttattggtatcctaattatgatgtccatgtgcagagaagtgcacgtgtacgaatacatccccagcgtgcgccagacagaactgtgccactaccatgaactgtattacgatgcagcctgcacactgggtgcctaccacccactgctgtacgagaagctgcttgttcaacgactcaacatggggacccaaggcgacctgcaccggaaaggcaaagtcgtcctgcctggcttccaggcggtccactgccccgcgccgtcgcccgtgatcccccatagttag

SEQ ID NO: 30584 - DNA, 108 bp, Artificial Sequence
  Description of Artificial Sequence: Synthetic coding sequence
atgaagccccatctaaagcagtggagacagcggatgctgtttgggattttcgcatgggggctcctcttcctgttaatctttatctatttcacagatagtaatccatag

SEQ ID NO: 30585 - DNA, 1071 bp, Artificial Sequence
  Description of Artificial Sequence: Synthetic coding sequence
atgagtccttgtggccgggcaaggaggcaaaccagtcgaggggcaatggctgttctcgcctggaaattcccacggacccgcctcccaatgggcgccagtgcactttgcgttgttgtgctgtgttggctgtatatctttccagtctatcgcctgcctaacgagaaggagatagtacagggtgtgctgcagcagggcactgcctggcggaggaatcagacagctgcacgggcgttcaggaaacagatggaagactgttgcgaccccgctcacctgtttgccatgaccaaaatgaactctcctatgggaaaaagcatgtggtatgacggtgaatttctgtatagttttactatcgacaatagcacttactcactatttccacaggccactccttttcaacttccccttaaaaaatgtgccgttgtcgggaatggaggcatactcaagaagagcggctgcgggcggcagatcgatgaggccaacttcgttatgcgatgtaacctgccgccactcagcagcgagtatactaaggacgtgggatctaaaagtcaactggtgacggctaacccgagtatcatcagacagaggtttcaaaatctcttatggagtcggaaaacctttgtggataatatgaaaatatataatcactcctatatctatatgccagccttctccatgaaaacgggcacagaaccaagcctgcgcgtttactatactctttctgacgtgggcgctaatcaaaccgtgctattcgctaaccccaattttcttcgatctatcggaaagttctggaagtcgaggggcatccacgccaaaagactgagcacgggcttatttcttgtatccgccgccctagggctctgtgaagaggtggccatctacgggttttggccctttagcgtcaatatgcacgagcaacctattagtcaccactattacgataatgtgctgcccttttcaggatttcatgccatgccagaggagttcttgcagctttggtatctgcacaagattggcgccctgaggatgcagttagatccctgcgaggatacatccctgcagcctaccagctag

SEQ ID NO: 30586 - DNA, 642 bp, Artificial Sequence
  Description of Artificial Sequence: Synthetic coding sequence
atgacaggcagtttttatactcactcccccctcaccatccaactgacactgtcatcgcatcggtgcaatcttcctccgctgagtagtgagtacacgaaggatgtgggatccaagagccagttggtgacggcaaacccgtccatcattcgacagcgctttcagaatctactgtggtcacggaagacattcgtcgataacatgaagatatacaatcactcatacatctacatgcctgctttttctatgaagacaggcacagaacccagcctgagagtatactatacactgtcggatgtgggagcaaatcagacagtcctgtttgcaaacccaaatttccttagaagtataggcaaattttggaaatctagaggtattcatgcaaaaaggctctctacaggactgttcctggtgagtgctgctcttgggttatgcgaggaggttgccatctacgggttctggccatttagcgtgaatatgcacgaacagcctataagccatcactattatgataatgtcctgcccttcagcggtttccacgccatgcccgaggagttcttacagctgtggtatctgcacaaaatcggagcactgcgtatgcagctcgacccctgcgaggatacctccctgcagcccacttcatag

SEQ ID NO: 30587 - DNA, 1128 bp, Artificial Sequence
  Description of Artificial Sequence: Synthetic coding sequence
atgcagcttcagttcaggtcctggatgctggcggccctgactttactggttgttttcctcatcttcgccgacatctctgagatcgaggaagagattggaaattctggagggcgcggcacaattcgtagtgcagtgaattcactgcacagcaagagcaacagggctgaagtcgtaattaatggcagcagtagtcctgctgtcgttgatcgttcaaatgagtccatcaagcacaacattcagcccgcgtccagcaagtggcggcataatcagacactaagcttaaggatcaggaagcaaattctcaagtttttggacgccgagaaagatatatctgtactgaaagggacattgaagcccggcgatattatccactacatctttgacagggatagcacaatgaacgtctctcaaaatctctatgaattacttccccgcacctcgcctctcaagaacaaacactttggaacttgcgccattgtgggcaactctggcgtgctcttgaacagcggctgtggtcaagagatcgacgcacactcattcgtcatccgctgcaatctggcaccggttcaggagtacgctagagatgttggacttaaaaccgatctggttaccatgaacccgagtgttattcagcgcgctttcgaggaccttgtcaacgctacttggcgagagaagcttttgcagaggttgcacagtctgaacgggtccatactctggatacccgccttcatggcccgcggtggtaaggagagggtcgaatgggtcaatgaactgattctcaagcaccatgtaaacgtaaggacggcctaccctagccttcggctgcttcacgccgtgcgcggatactggctgacgaacaaggtccatatcaaaagacctactacggggctgctgatgtataccttagccacccggttttgtaaacagatttatctttacggcttctggccatttcctctcgatcagaatcagaatccggtgaagtatcactactacgactcactcaagtatggttacacctcccaggcatcccctcacacgatgcctctggagttcaaggcgctgaagtcccttcacgaacagggggcattgaagctgacggtgggccagtgcgatggtgccacctag

SEQ ID NO: 30588 - DNA, 1065 bp, Artificial Sequence
  Description of Artificial Sequence: Synthetic coding sequence
atgcagctgcagttcagaagctggatgctcgcagccctcactctgctggtagtgttccttatatttgccgacattagtgaaatcgaggaggagatcggagccgaggttgtgattaatggatcgagtagccccgcagtggtggacagaagcaatgaaagtatcaagcataatatccagcccgcctccagtaagtggcggcacaaccagaccctgtcactcagaattcgcaaacagatcttaaaattcctggacgccgagaaggatatatctgtgttgaagggcacgctgaagccaggtgatataatccattacatattcgaccgggacagcacgatgaacgtgtcacaaaatctttacgagctgttacccaggacgtctccactaaagaacaagcactttggaacatgtgccatcgtaggtaattcaggggtcctcttgaattccgggtgcgggcaggaaatcgacgcccactctttcgtgatccgctgtaatctagcacccgtccaggagtacgcacgtgatgtggggctgaagactgacctggtgaccatgaacccatccgtgattcagcgagcctttgaagatctggtgaacgcaacatggagggaaaaactgttgcagaggctccacagcttaaatggtagtatcttgtggatccccgcttttatggctcgcgggggcaaagagagggttgagtgggtgaacgagctgatcctcaaacaccacgtcaatgtcagaaccgcatacccgagtttgagacttcttcatgctgtgcggggttactggttgacgaataaagtccatatcaagcgcccaacaacggggcttctgatgtataccctggcgaccaggttttgtaagcaaatttacttatatggtttctggccatttccattggatcagaaccaaaacccagtgaagtaccactactatgacagccttaagtacggctatacctctcaggcctctcctcacactatgcccctggagttcaaagcattaaaatcactgcacgagcagggcgcattgaaactgactgtgggtcagtgcgatggggcgacttag

SEQ ID NO: 30589 - DNA, 1143 bp, Artificial Sequence
  Description of Artificial Sequence: Synthetic coding sequence
atgagaaattgcaaaatggccagagtggcgagtgtgctgggccttgtgatgctcagtgttgctcttctgatactctctctgatctcgtatgtttcactcaagaaagagaacattttcacaaccccgaaatatgcctccccaggggcacccaggatgtacatgttccatgccggattcagatcacagttcgctttaaagttccttgacccctcctttgtaccaataactaattctttgacacaggagctgcaggaaaagccttctaaatggaaattcaaccggactgcattcttgcaccagagacaggaaattctccagcacgtagacgtcatcaaaaattttagccttactaaaaactctgtccgaattgggcagctgatgcactacgattactcatctcataagtacgtgttctccattagtaacaatttccgtagtctgcttcctgatgtctctccaattatgaacaaacactataacatctgcgccgtggtggggaactccggaatcctgacaggctcccagtgtggacaggagattgataagagcgattttgtgttccggtgcaattttgcccccactgaagccttccagcgcgacgtaggtcgtaagacaaacctgactacatttaacccttctatcctggagaaatattataataacttgttaaccattcaagatcggaataacttctttctgagcttgaaaaagctggatggagctatcttgtggattccagccttttttttccacacctcggccacggttacgagaaccctggtggatttcttcgttgaacaccgaggccagctgaaggtgcagctggcttggccagggaacataatgcagcacgtgaataggtactggaaaaataagcacttgtccccgaagcgcctgtccacaggcattctgatgtacacactggcatcagccatttgtgaggaaatccatctgtatggattttggccctttgggtttgaccctaacacccgcgaggaccttccctaccattattatgacaaaaagggaactaaattcaccactaaatggcaggaaagtcaccagttgcctgcagagttccaactcctgtatagaatgcacggggagggacttactaaactgactttgtcccattgtgcgtag

SEQ ID NO: 30590 - DNA, 1464 bp, Artificial Sequence
  Description of Artificial Sequence: Synthetic coding sequence
gctggtggaaggggccggacagcgctgcgtgccccctcaccccggagaagggccgctcctcctagcagctgctctgctccgggtcctgcgagaccctgtctccggggtcccgccgccctacggggatcctgccagcctcagcccccagcgcccgtggcttccccacaccctagacctggccccccgccccctccgcacgcaagagcccatacacacacacatactcatactcatactcacactcatatttacacccccgcctcatgttggcccctgaacggaccaatcagtcctgtcagcctgaaccccgcccagccaggaatgcggaactgtaagatggcaagggtggcgagtgttctcgggcttgttatgctcagcgtggcactgttgatcctttcacttattagttacgtgagtctaaagaaagagaatattttcacgacaccaaaatatgcctccccaggcgcgcctaggatgtacatgtttcatgccggttttagatcccagttcgccctcaagtttcttgacccgtccttcgtgcctattactaattctctgactcaggagttgcaggagaagccaagtaagtggaaatttaaccggacagcctttcttcaccaaagacaagaaattctgcagcatgtcgacgtgataaagaacttcagcctgaccaagaattctgtaaggattggtcagttaatgcattacgactactcatctcacaaatacgttttctctatttccaacaactttagatcgcttttgcctgacgtaagccctattatgaacaaacactacaatatttgtgccgtggttggcaactcaggaattttgacaggatctcagtgcggccaggagattgataagtctgattttgtcttcaggtgtaactttgcaccaacagaggcatttcagcgcgatgtgggacggaaaaccaacctcacgacctttaatcccagcatcctggaaaaatattataacaacctccttacaatacaggataggaataacttctttctgagcctgaagaaattggacggggccatcttgtggatcccagcttttttctttcacacttccgccacggttaccagaactctggtagatttcttcgttgagcatcgaggtcagctgaaggtgcagctggcgtggcctgggaatattatgcagcacgtgaataggtactggaagaataaacacctaagcccaaaacggctttcgaccggaatcttgatgtataccttagcttctgccatttgtgaggagatccacctctacggcttttggccttttggattcgacccaaatactcgagaagatcttccctatcattattatgacaaaaaaggcaccaagttcactacaaagtggcaggagagtcatcaacttcccgcggagttccagctgctataccggatgcatggcgagggtttaacaaaactgacactgagccactgtgcctag

SEQ ID NO: 30591 - DNA, 405 bp, Artificial Sequence
  Description of Artificial Sequence: Synthetic coding sequence
atgaggatgcttctgcacctgtctctcctcgcactgggggctgcatacgtttacgccatacctacagagattcccaccagtgcgctcgtgaaggagacattagcccttctgtcaactcaccgtaccctgctgattgccaatgagactttaaggatacccgtgcccgtccacaaaaatcaccagttatgcacggaggaaatttttcaaggtattgggactctcgaatcacagactgtccagggcggaacggttgagcggctttttaagaatcttagtctcattaaaaaatatattgacggtcagaaaaagaaatgtggtgaagagcgcaggagagtgaaccaattcttagactacctgcaggaatttctgggtgtaatgaatacggaatggataatcgaatcatag

SEQ ID NO: 30592 - DNA, 507 bp, Artificial Sequence
  Description of Artificial Sequence: Synthetic coding sequence
atgcggtctatccgtaagcgatggactatctgcacaatttccctcctgctcatcttttacaagacaaaggagattgctcgcacagaagagcaccaagagacacagctaattggggacggagaactcagtctgtcacggagcctagtgaatagttccgacaaaatcatacgtaaagcgggaagcagtattttccagcacaacgtcgaagggtggaagatcaattcctccctagtgctcgaaatccgtaaaaatattctaagattcttggatgctgaaagagacgtctctgtggtgaagtctagtttcaagccaggggacgttatacattacgtgttagacagacgacgcacactgaatatctcacatgacctgcacagcctgctgccagaggtttcgcccatgaagaatcgccgtttcaaaacctgtgccgtggttgggaactcaggaatccttctggactctgagtgcggaaaggagatcgactcacataattttgtgataagatag

SEQ ID NO: 30593 - DNA, 1131 bp, Artificial Sequence
  Description of Artificial Sequence: Synthetic coding sequence
atgcggtatgccgatccttccgctaaccgagacctgctgggaagtcgtaccttgctcttcatctttatctgtgctttcgccctcgttactctactgcagcaaatcctgtatggcagaaattatataaaacgctatttcgagttctacgaaggtccattcgagtataatagcacacgctgcctggagctgcggcacgaaattctggaagtgaaggtcttgtctatggtgaagcagtccgagttgtttgaccggtggaaaagcctgcagatgtgcaagtgggccatgaatatcagcgaggctaaccaattcaaaagcaccctgtctagatgctgtaatgcccccgccttcttattcacaactcagaagaacacccctctggggacaaaactgaagtatgaggtggatacgtctgggatctatcacatcaaccaggagatcttcaggatgtttcccaaagatatgccctattaccggtctcagttcaaaaagtgtgccgtggtgggtaatggaggtatcttaaaaaacagccgatgcgggcgcgaaataaattccgccgactttgtgtttagatgcaaccttccaccaataagcgagaagtacacaatggatgtaggggtgaagacagacgtagtgactgttaacccttccattataacggagcgattccacaagctcgagaagtggcgtcgcccattttatagggtcttacaagtctacgaaaacgcgtccgtcctgctgcccgctttttataacactaggaatacggatgtcagcatccgggtgaaatacgttttagacgacttcgagtctcctcaggccgtctattacttccacccacaatacctagtgaatgtatcaagatactggttgagcttgggcgtcagagccaaaaggatatccaccggactgatactggttactgcggcgttggagctgtgcgaggaggtacatctgttcggtttctgggcgtttcctatgaacccctctggtctctacattactcaccactattacgacaatgtgaagccacgacctggtttccacgccatgccaagcgagatttttaatttcctgcacctgcacagcaggggcattctgagggtccacacaggcacatgttcctgttgctag

SEQ ID NO: 30594 - DNA, 1038 bp, Artificial Sequence
  Description of Artificial Sequence: Synthetic coding sequence
atgcggtatgccgacccctcagccaaccgagacctgctcggctctcgaaccctgttgtttatttttatctgcgcattcgccttagtgaccctgctgcagcagatactgtacgggcggaactacatcaaaagggttaaacaaagcgaattgttcgacaggtggaagtctttgcagatgtgtaagtgggccatgaatatcagtgaggccaaccagtttaaatcgaccctctcacgatgctgtaacgcccctgcattcttatttactacccagaagaacacccccttgggtaccaagctgaagtacgaagtcgatacatcgggtatataccacatcaatcaggagatatttaggatgtttcctaaggatatgccttactaccgctctcaattcaaaaaatgcgctgtagtcggcaacgggggtattctgaaaaactctcggtgtggccgggagatcaattctgccgatttcgtgttccgttgtaacttgccgccgattagtgagaaatatacaatggacgtgggggttaagacagatgttgtcacagtgaacccatccattatcacagaacgattccataagttggaaaagtggcggcgccctttctacagagtgcttcaagtgtatgagaatgcctcagtgttgctgccggccttttacaacactaggaacacagatgtctctatccgggtcaagtatgttctggatgattttgagagtccacaagccgtgtattacttccatccccagtatctggtgaatgtgtcccggtattggctgagtctcggggtacgggccaaaagaatctcaaccgggttgatcttggtgacagccgcattggagctgtgtgaagaggtgcacctcttcggcttctgggcctttcccatgaacccgagcggtctatacattactcatcattactacgataatgtgaagccccggcccggcttccatgccatgccctccgaaatctttaacttccttcacttgcactctcgcggcatcctgcgggtgcacaccggtacctgcagttgctgttag

SEQ ID NO: 30595 - DNA, 1239 bp, Artificial Sequence
  Description of Artificial Sequence: Synthetic coding sequence
atgcgctatgcggatccatcagcaaacagggacctgctaggatcacgcaccttgctgttcatttttatatgcgcttttgcgttggtcactctcctccagcagatactgtacggacgaaactatataaagagagggctgcagtttggatggcaatccggggaccagctgactaactggactggtctctttaacgtcacggacgaccctgcagttcaatccggcagtgatagttcaagccggtacttcgaattttatgaaggacctttcgagtacaattcaacgcgctgtctggagttgcgacacgaaatcttagaggtcaaggtgctctctatggtgaagcagtctgagctgttcgaccggtggaagtccctgcagatgtgcaaatgggccatgaacatctcagaagctaatcagtttaaatcgactttgtctcgctgttgtaacgcgccagcatttctgttcacaactcagaaaaacactccgctgggtactaagctgaaatacgaggttgacacttctggcatttatcacatcaatcaggagatttttagaatgttcccgaaggacatgccatactaccgcagccagtttaagaagtgtgctgtggtcggaaacggggggattttgaaaaattccaggtgtggccgcgaaattaattcagccgatttcgtgttccgatgcaacctaccccccatttcagagaaatacactatggacgtgggagtgaagacggatgtggtaacagtgaacccatctatcatcactgagcggtttcataaactcgaaaagtggcggcggccattctacagagtacttcaggtgtacgagaatgccagtgtgctcctcccagccttctacaatactcgcaatactgatgtgagtattcgagttaagtatgtgctcgacgatttcgaatccccgcaagccgtttattatttccatcctcagtacctggtcaacgtttcccggtactggctgagcctgggagttcgcgctaaaagaatcagtaccggcctgatcttggtgaccgcggccctcgaactgtgcgaggaggtgcacttattcggcttttgggcctttcctatgaatccatcagggctgtacatcacccaccattattatgataacgtgaagccaaggcctggattccacgccatgccaagtgagatcttcaactttctccatcttcactctagaggtattctgcgcgtccacactggaacttgttcctgctgctag

SEQ ID NO: 30596 - DNA, 1197 bp, Artificial Sequence
  Description of Artificial Sequence: Synthetic coding sequence
atgcgtcccggtggtgctctcttagctttgctggctagtctattgcttttactgctgctgagactgctgtggtgtcctgccgacgcacctggcagagcgcgaattttggttgaggagtctcgcgaagcaacacacgggacacctgcggcccttcgcaccctgaggagccctgctacagccgtgcccagggccaccaatagtacctacctcaacgagaaatctctccagctgacagaaaaatgtaagaacctccaatatggaattgaatccttttccaacaagaccaagggatattctgagaatgactacctccagatcatcacggatatccaatcctgcccctggaagaggcaggcggaggagtatgccaacttcagagccaaactggctagctgttgtgacgccgtgcagaactttgtggtgtctcaaaacaacacgcccgtggggacgaacatgtcctatgaagtagaatccaagaaggagatcccaataaaaaaaaacatattccatatgttcccagtttcccagcccttcgtagattatccttacaatcagtgtgccgtcgtggggaatggaggtatactgaataaatcactttgtgggaccgaaatcgacaaatcagatttcgtttttcggtgcaatctgccccccaccacaggcgacgtatctaaggatgtaggtagtaagactaatttggtgaccataaaccctagcatcattacattaaaatacgggaatctaaaggaaaaaaaagctttattcctggaagacatagctacatatggcgatgccttcttcctgctaccagctttctcattccgagccaacactggtacctcttttaaggtgtattacactctggaggaatccaaagctagacagaaggttctgtttttccacccaaagtatctaaaggaccttgcgctcttttggcgcactaagggcgtcacagcgtatagactgagcactggactcatgatcaccagcgtggcggttgaactttgtaagaatgtcaagctgtatgggttctggccgttttccaagacggtggaggacattcctgtgagtcaccattattacgataataagctgccgaaacacggctttcaccagatgcccaaagagtattcacaaatccttcagcttcacatgaaaggcattctcaaactgcagttcagtaagtgcgaagttgcctag

SEQ ID NO: 30597 - DNA, 414 bp, Artificial Sequence
  Description of Artificial Sequence: Synthetic coding sequence
atgtttcctgtctcccaaccgtttgtcgattacccgtacaaccaatgtgctgtggtgggtaatggggggatcttaaataaatccctttgcggtaccgagatcgacaaatccgatttcgtatttagatgcaaccttcctccaaccaccggcgatgtcagtaaggacgtagggtctaagacaaacctggtaaccatcaatccaagcatcataacactgaagtatgggaatctgaaggaaaaaaaggctctattcctcgaagacattgctacatatggcgatgcgtttttccttttgcccgccttctcctttagggcgaatacgggcacgtcttttaaggtctattacactctcgaggaaagtaaggcgcgccagaagtgtaagacgaagaggaagaccattaactccattctgtag

SEQ ID NO: 30598 - DNA, 387 bp, Artificial Sequence
  Description of Artificial Sequence: Synthetic coding sequence
tgatacccatacaatcagtgcgccgttgtgggcaacggtggcatcctgaataaaagtctctgtgggaccgaaattgataagagcgactttgtgtttagatgtaatctgccaccaactactggcgacgtttcgaaagatgtggggtctaagaccaatttagtgacaatcaatccaagtattatcacactaaaatacggcaacctcaaggagaagaaagcgcttttcctcgaggacattgctacgtatggcgatgccttcttcctcctgccagcattttcttttagggccaataccggcacctctttcaaagtttactacactctcgaagaaagcaaagcaaggcagaagtgtaagaccaaacggaagaccatcaacagcatcctctag

SEQ ID NO: 30599 - DNA, 7713 bp, Artificial Sequence
  Description of Artificial Sequence: Synthetic coding sequence
atggcaggtccccggggccttctccctctgtgcttgcttgccttctgcctggcaggcttcagttttgtcaggggccaagttctgtttaaagggtgtgatgtcaagaccacctttgtgactcatgtcccttgtacaagctgcgctgccataaagaaacagacctgccccagcggatggctgcgggaattgcccgaccagattacccaagattgtcgttacgaggtgcagttggggggttctatggtgtctatgtctggctgtcgcagaaaatgccgcaagcaggttgtgcagaaagcatgctgcccagggtattggggctcaaggtgccacgagtgtcccggcggggcggagactccttgcaatggccacggaacgtgtttggatggcatggatcgcaatgggacttgtgtatgccaggagaatttcaggggctctgcctgccaggagtgtcaggatccaaaccgttttggccctgactgccagagcgtgtgttcttgcgttcacggcgtgtgcaatcacggccctcgaggcgacggctcctgcctctgctttgccggttatactggccctcattgcgaccaggagttacccgtatgccaagaactgcggtgcccacagaacacacaatgttcagccgaggcgccatcttgcaggtgtcttcctgggtacacccagcaggggtccgaatgccgagcgcctaatccctgctggcctagcccctgctctctcctggcacagtgttccgtgagcccaaaaggtcaggcacaatgccactgtcccgagaactaccacggcgacgggatggtttgtcttcccaaagatccctgtaccgataatcttggcggatgtccctccaactccaccctgtgtgtataccaaaagcccggacaggccttctgtacgtgtcgacccggtctggtttccatcaatagcaacgccagcgccgggtgcttcgctttctgtagcccctttagctgcgaccgttccgccacctgtcaggttacggctgacgggaagaccagctgcgtttgtcgtgagagcgaagtaggagacggtagagcgtgctatgggcacctcctccacgaggtgcagaaggccacccaaacaggacgggtgttcctccagctccgggtggccgttgccatgatggatcagggctgtagggagattttaaccacagccgggccatttactgtccttgtcccttccgtgtctagtttctcatcccgcactatgaatgcttctctggcacagcagctgtgtcgccaacacataattgccggtcagcacattttggaagacactcgcactcagcaaacgaggaggtggtggacgctcgctggacaggaaataacggtaactttcaaccaatttaccaagtactcctacaagtataaggatcagccacagcaaactttcaatatatataaggccaataatatcgccgcaaacggagtctttcatgtggttacaggactgaggtggcaagcgcctagcggaacacctggggatccaaagcgcacaattggacagatccttgcttcgacggaggcgttcagcaggttcgagactattctggaaaattgcggcctcccatcaattctggatggtcctggcccattcacggtatttgctcctagtaatgaggccgtggactctttacgcgacggccgactgatttatctttttactgctggccttagtaagctgcaagagcttgtcaggtaccacatttacaatcacgggcaactgacagtagagaagctgattagtaaaggtcgcatcctcaccatggcaaaccaggtattggccgtgaacatttccgaggaaggacgtatcctcttagggccagaaggtgtcccactacagcgggttgatgtgatggctgccaacggcgtcatccatatgctggatgggatcctgcttccccccactattttacctatactccccaaacactgttccgaggagcaacacaagatcgttgccggctcttgcgtggactgccaggcgctgaacacctccacctgcccacccaactcagtcaagttggacattttcccaaaggagtgtgtgtatatccacgatcccacaggcctcaacgtcttaaagaaaggatgcgccagctactgcaatcagactattatggaacaaggctgttgcaaaggattttttggaccagactgcacacagtgcccagggggtttcagcaatccttgctacgggaaagggaactgctcggacggtatccaaggtaacggagcttgtctctgcttcccagattacaagggaattgcctgccacatctgctccaatcctaacaaacacggcgagcagtgtcaggaggattgcggttgtgttcatgggttgtgtgataaccggcccgggtctgggggggtgtgtcagcagggcacgtgcgctcccggctttagtgggaggttttgtaatgaatccatgggggactgtggtcctacaggcttagcacagcattgtcatctccacgccagatgtgtgtcacaggaaggtgtggccaggtgtcgctgtcttgacggtttcgaaggagacggcttttcgtgcacaccctccaatccgtgctctcaccccgaccgaggagggtgctctgagaatgctgagtgcgtcccggggtcacttgggacccatcactgtacctgtcacaaaggctggagtggagatggccgtgtgtgcgtggcaatagacgaatgcgagctagacatgagaggcggctgccatacggacgctttgtgttcatatgtgggccccggccagtcgcgctgtacgtgcaagttgggcttcgctggcgacggctatcagtgcagccctatagacccttgcagagccggcaatggcggttgccacggccttgctacatgccgcgcagtgggtgggggccagcgggtgtgtacttgcccccccgggtttggaggagatgggttttcttgttacggggatatctttagagagctggaggctaacgcccacttttccatcttctaccagtggttaaaaagtgcaggaattaccctgcccgcggataggcgcgtcaccgccctcgtcccaagcgaggcggccgtgagacagctgagtccagaggatcgggccttctggctccagccacgcacacttcctaacttggttcgggcgcatttcctccaaggcgcactgttcgaagaagagctggctaggctgggcggacaggaggttgcaacactgaaccctaccacacgctgggagatccggaatattagcgggcgggtgtgggttcagaatgcctctgtggatgtggcagacctgctggcaacaaacggcgttctccatatcttgtctcaggttctccttccacctagaggagatgtgccaggcggccagggactattacagcaactcgacttggttcctgctttcagcctgttccgcgagctgctgcaacaccatgggcttgtcccacagatcgaggccgccacagcctatacaatctttgtaccaaccaatcggtccctggaggcccaggggaactcgtcacacctggatgcagacactgtgagacatcacgttgtgctgggagaagctctaagtatggaaacccttcgaaagggcggccatcgcaactcactcttagggcctgcccattggattgtcttttataatcactcaggacagccggaggtcaaccatgtcccactcgagggccccatgctagaagctccaggaagaagtctcattggtctaagtggggtcttgactgtgggttcctcccgctgcctccactcacatgcagaagctctgagagagaagtgcgtgaattgtacacggcgttttcgttgtacacagggtttccaactgcaggacactccacggaaaagttgtgtgtatcggtctgggttttctttttcccgagggtgctcatatacatgcgccaagaagattcaggttcccgattgctgtcctgggtttttcggcacgctctgtgagccctgcccaggagggttgggcggggtgtgcagtggccacggacaatgtcaggataggtttctgggatccggcgagtgtcattgtcatgaaggattccacggcactgcatgcgaagtgtgtgagcttgggcggtatgggcctaactgtaccggcgtctgtgactgtgcacacggcttgtgccaagagggcttgcagggggacggttcctgcgtgtgtaacgttggatggcaaggattgaggtgtgaccagaagatcacctcaccccagtgcccgcgtaagtgcgatcccaatgctaactgtgtgcaagactcagccggagcctctacatgcgcctgtgctgctggctatagtggtaatgggattttctgtagtgaggtcgatccatgcgcccacggacacggggggtgcagtccccacgcgaactgcaccaaagttgcacccgggcagaggacctgcacctgtcaggatggctatatgggcgacggcgagctgtgccaggagatcaattcatgccttatccaccacggcggctgtcacatccatgccgagtgtattcctactggaccccagcaggtgagctgctcgtgccgtgagggctattcaggcgatgggatccggacatgcgagctgttagatccttgttctaaaaataacggcggatgctcgccatacgccacttgcaagtcgacgggcgatggacaacggacctgcacttgcgatacagcacacactgtcggcgatgggctgacctgtagagcgagggtgggattggaacttctgagagacaaacatgcaagcttcttcagcctgcggcttcttgaatacaaagagctgaaaggagatggacccttcacaatcttcgtcccacacgccgacctaatgtctaacctgtcacaagatgaactcgctcgtattagggcgcatcgacagctggttttccggtatcacgtggtggggtgcagacggttgcgctccgaggatctgctggagcaaggctacgccaccgcactcagcggacaccccttgcggttctccgagcgcgaaggcagcatatacctgaatgatttcgcacgggtcgtgagcagtgatcacgaggccgttaacggaattcttcattttattgatcgtgttctgcttcctcctgaggctctgcattgggagcctgacgatgcccccatccctcggcggaatgtaaccgctgccgcacagggatttggttacaaaatttttagcgggctgctgaaggttgcggggctgctaccacttcttcgggaagcttctcataggccatttacaatgctctggccgacagacgccgccttccgtgcactgccccctgacaggcaggcttggctatatcatgaggaccatagggacaagctggccgccattctacggggacacatgatcagaaatgttgaggcactggccagtgacttgcccaatctgggtcctttacggaccatgcatggcacgccgatatcattctcctgctcccggacgcgggcaggcgaattgatggtcggagaggatgatgcaaggatagttcagcggcatctcccgtttgaaggcggactggcctatggcatcgatcagctcctggaacctcccggcttgggggctcggtgcgatcactttgaaactcgacccctgcggctcaatacttgctcaatctgtggtctggaacctccctgcccggagggctctcaggaacaggggagcccagaagcctgttggaggttttatcccaagttttggacctcgccgccactccactccctgggtctgcggagcgtttgggtgcatccaagtctatgggggcggcctcaggggctgggtagaggctgccaccggaactgcgtgactacaacctggaagccgagttgttgcccaggacactacggcagcgaatgtcaggcctgtccaggcggcccctcttccccctgcagtgatcggggcgtctgcatggatggtatgtccggatcgggtcagtgcctgtgccgcagcggattcgcagggactgcctgcgagctctgcgcaccgggtgctttcggaccacattgccaggcttgtaggtgcacggtccacgggcgctgcgacgagggccttgggggttcagggtcatgcttctgcgatgagggatggacaggtcctagatgcgaggtacagttggaactgcagccagtgtgcactcccccttgcgcaccagaagcggtctgtcgggccggcaatagctgcgagtgcagcctggggtacgagggagacggtcgggtatgtaccgtggccgacttatgccaagacgggcacgggggctgcagcgagcatgctaactgcagccaggtgggcaccatggtcacctgtacatgcctccctgattacgagggtgacgggtggtcctgccgcgcccgcaacccttgcacagacggtcaccgcggagggtgttctgagcacgctaattgtctttctaccggcttgaacactcgtcggtgcgaatgccatgcgggatatgtgggagacgggctgcagtgtttagaagagagcgagcctccagtggaccggtgcttggggcagcctccaccgtgccatagcgacgcaatgtgtaccgatcttcactttcaagaaaaacgcgcaggagtcttccatctgcaggcgacctctggtccatatggccttaactttagcgaggctgaagcagcttgtgaggcccagggcgccgttctggcgtcattcccccaactatctgcagctcagcagctgggatttcacttgtgcctcatggggtggctggctaatggatcaacagcacacccagttgtatttcccgtggcggattgtggcaacggtagggtggggatagtgtccctgggcgctaggaagaacctgtcagaaaggtgggacgcttactgcttcagggtgcaggacgtggcctgccgctgtaggaatggctttgtaggggatggtatttctacgtgtaatgggaaactcctcgatgttcttgctgccaccgccaacttcagcaccttctacggcatgctgctcggatatgcgaacgctactcagagaggcctggatttcctcgacttcctcgatgacgagctcacttataagaccctcttcgtcccagtcaacgaggggttcgttgataacatgactttgtccggtccggacttggagcttcatgcctctaacgccacactgctgagcgccaatgcctcgcagggaaaacttctccccgcacattccgggctcagtcttatcatctccgacgctggacctgacaatagctcttgggcacccgtcgcccccggtaccgtcgtggtctccagaatcatcgtttgggatatcatggcatttaatggcatcatccacgcactagcatctccactcctggctccgccgcaaccccaagcagtattggctcctgaggcacctccagtggcagccggggtgggggccgttctcgccgccggtgcccttctcgggctagtggctggggcactgtatctgcgggctcgcggtaagcccatgggttttgggttctctgcattccaagccgaggatgatgcagacgatgactttagcccatggcaagaggggacgaatccgaccctggtctctgttccaaatcctgtcttcggcagtgacacgttctgcgagccttttgatgacagcttactcgaggaggatttccctgatactcagaggattctgactgtcaagtag

SEQ ID NO: 30600 - DNA, 3003 bp, Artificial Sequence
  Description of Artificial Sequence: Synthetic coding sequence
atggggcggagaaccttattcatcgggtgtcagcccaagtgtgtgaggacggtaatcacccgagagtgttgcgccggattctttggacctcaatgccagccttgccctgggaacgcccagaacgtctgcttcggaaatggaatctgcctggacggggtgaatggcaccggagtctgcgagtgtggagaggggtttagcggtactgcctgcgagacctgtaccgagggcaaatacggcatacattgcgaccaggcatgtagttgcgtacacgggcggtgcaaccaggggcccctcggcgatggttcctgtgactgtgacgtgggatggagaggcgtgcactgcgacaacgcaaccactgaggataattgtaacgggacctgtcacactagcgccaactgtctgactaattctgatggcaccgcatcctgtaaatgtgctgctgggtttcagggtaacgggacaatttgcactgctatcaatgcgtgcgagatttcaaatggcgggtgtagcgccaaggctgattgtaaaagaaccacccccgggcgtcgggtgtgtacctgtaaggcgggctacactggtgacggaattgtgtgtctggaaatcaacccttgtctcgagaaccatggaggatgcgacaaaaatgccgagtgcacccagaccggacccaaccaggctgcctgcaactgccttccagcctacactggagacggcaaagtgtgcaccctgattaacgtttgtttgacaaaaaatggtggatgcagtgaattcgctatctgtaaccataccggtcaggtagaacggacgtgtacatgcaaacctaattatataggagacggctttacctgcagaggctccatctaccaggagctgcccaaaaatcccaagacctctcagtattttttccagctacaggaacatttcgtgaaggatttagttgggcctgggcctttcacagtttttgcccccctcagtgctgcctttgatgaggaagcccgagttaaggattgggacaaatacggtctcatgccacaggtgcttcgctatcacgtggttgcctgccaccagcttctcctggaaaatctgaagctcatttctaacgctacttctctccaaggagagccaatcgtcatcagcgtctctcagtccacggtctacattaacaataaggcgaaaataatcagttccgatatcatctcaacaaacggcatcgttcacatcattgataaacttctttccccaaaaaatctgctgataacacctaaggataatagcggaaggattctgcagaacctgaccactctcgccacgaataatggttacattaaattcagcaatctcatccaagattcaggcctcctgtctgtaatcactgaccctatccacacacccgtcacactgttttggcccaccgatcaggccctccacgccctcccagcagaacagcaggattttctgttcaaccaagacaataaagataagctgaaggaatacctcaagtttcacgttatcagggacgcaaaggtcttggctgtcgatttgccaacttctacagcatggaagacgctgcaggggagcgaactgtcggtaaaatgcggcgcgggcagagatattggcgatttgttcttgaacgggcagacctgccgcattgtgcagagagagcttcttttcgacctgggagttgcctatggaatagattgcttgttgatcgacccaaccttaggcggaaggtgtgatacctttacgaccttcgacgcctccggagaatgcgggagctgtgtgaacaccccttcctgtccccgctggagcaaacctaagggtgttaagcagaaatgcttgtataatttaccttttaaacggaacctggaaggctgccgagaaaggtgttcactggtgattcagattccccggtgttgtaaaggctattttggcagggactgccaggcctgccccggcggtccagatgcgccgtgcaataatcgcggagtttgtttagatcagtacagtgccaccggggagtgcaaatgtaatacaggctttaacggtaccgcatgcgaaatgtgttggcctgggaggttcggcccagattgcctgccttgtggctgcagcgatcatggccagtgtgacgatggcattaccgggtcaggtcagtgcctatgtgaaaccggttggactgggcccagctgcgacacccaagctgtacttcctgccgtttgtacccctccatgttctgctcacgcaacgtgcaaagaaaataatacatgtgagtgtaacctggattacgaaggagatggcatcacatgcacagtggtcgacttttgtaagcaggataatggcgggtgcgctaaggttgcacgatgctcccagaaagggacaaaagtttcctgcagttgtcagaaaggatacaagggtgacggtcacagctgtacagaaattgacccttgtgcggacgggctgaacggaggatgtcacgaacacgcgacctgcaagatgacaggccccgggaagcacaagtgcgaatgtaagtcacactatgtgggagatggtctgaattgcgagccagagcagttgccaattgacagatgtcttcaggacaacggccaatgccatgccgacgccaagtgcgtggatctccattttcaagacacaacagtgggtgtcttccacctcaggtcgcccctaggccagtataaacttacgtttgataaggcccgggaagcctgcgccaacgaagctgcgacaatggcaacatacaatcagctcagctacgctcagaaagccaaataccacttatgctccgccgggtggcttgaaaccggacgagttgcttatccaactgccttcgcatcacaaaattgcggctctggcgtggtggggatcgtggactacgggcccaggcctaacaaatccgagatgtgggacgtgttttgttaccggatgaagggctcagccggcctctttcaacaactgtcttcacgcccatgtatatctcgcactccggactag

SEQ ID NO: 30601 - DNA, 7656 bp, Artificial Sequence
  Description of Artificial Sequence: Synthetic coding sequence
atgatgctacaacaccttgtcatcttctgtctgggcctcgtagtccagaatttttgctcgccagccgaaactaccggtcaggcaagaaggtgcgaccggaagagtctgctcaccatcaggacagagtgtagaagctgcgcactgaacctgggtgtgaagtgccccgacgggtacacaatgatcacgtctgggtctgtcggtgtgcgtgattgccggtatacttttgaagtgagaacttactccctttcactgcccggttgtcggcatatatgtcggaaggactatctacagccaagatgctgtcccggccgatggggacccgattgtattgagtgccccggcggcgccggatccccctgcaatggtcggggaagttgtgcggaagggatggaaggcaacggcacttgttcctgtcaggaaggctttggcggaacagcctgtgaaacctgcgcggacgacaatctctttggaccctcatgttcaagcgtgtgtaactgtgtccacggggtgtgcaattccggcttagatggggacggaacctgcgaatgttatagcgcatacactggcccgaagtgcgataagcccatccctgagtgtgcagccttgctgtgcccggaaaattcaagatgcagccctagtaccgaggacgagaataagctggagtgcaaatgtctgccaaactatagaggcgacgggaaatactgcgaccccatcaacccctgcctgcgtaaaatctgccatccacacgcccattgtacttacctggggcctaatcgacattcatgtacgtgccaggagggctaccgaggcgatgggcaagtttgtctcccggtggacccgtgccaaattaacttcggaaattgccccacaaagagcacagtgtgtaaatacgacgggcctggacaatctcattgcgagtgcaaggaacattaccagaactttgtacccggcgtcgggtgcagcatgactgacatttgcaagtctgataatccttgtcaccgaaacgccaattgtaccacagtggcgccaggtcggacagaatgtatatgccagaaaggctatgttggcgatggacttacttgttacggcaacatcatggagagactgagagaacttaacaccgaacccaggggaaaatggcagggcaggctaacatcgtttatttctcttctcgacaaagcctatgcctggcctctgagcaaactgggaccattcactgtgctgttaccaaccgacaagggcctgaaaggcttcaacgtgaacgaattactagtggacaataaagccgcgcagtatttcgtaaaacttcacatcatcgcaggccagatgaatatagaatatatgaataacaccgacatgttctacactttgacagggaagagcggagaaatattcaacagcgacaaagacaatcaaatcaaattaaagcttcacgggggaaagaagaaggttaaaattatccagggcgatattatcgctagtaacgggcttctacatattttagaccgggccatggacaagttggaacccacattcgagagcaataatgagcagactattatgactatgttgcagccaagatattcaaaatttcgatccctcctggaggagactaacttgggacatgctctcgacgaggatggagtggggggtccatatactatcttcgttccaaacaacgaggccctgaacaatatgaaagacggcactttagactacctcctgtcgcccgaggggtcccgcaaactgctcgagcttgtaagataccacatcgtcccctttacccaactggaggtggcgacactgataagcactccacatatacgatcaatggccaatcaactgattcagttcaacacaactgacaacggacagatattggctaacgatgttgccatggaggagatcgaaatcacagcaaaaaacggccgcatttacacactgaccggggtgctgatccccccttccatcgtaccaattctgccacaccggtgtgatgagactaaacgggaaatgaagttggggacatgcgtctcttgtagcctcgtttattggtcgaggtgccctgccaactctgaacctacggctctgttcactcataggtgtgtgtatagtgggaggttcggcagcttgaagtccggatgtgccaggtactgcaacgctactgtcaaaataccaaaatgttgtaagggcttttatgggccagattgcaatcagtgcccaggaggcttttcaaacccctgtagcggaaatggccagtgcgctgatagcctgggcggcaatgggacatgcatttgtgaagaaggattccagggcagtcagtgccagttctgttctgatcccaacaaatatggaccaagatgcaataaaaagtgcctgtgtgtacacgggacctgtaataataggatcgacagtgatggggcatgcctaaccggaacatgtcgtgatggttcagcaggaagactgtgtgacaagcaaaccagcgcttgcggcccctatgttcaattttgccatatccacgccacatgcgagtattccaatggcaccgcttcttgcatttgtaaagcggggtacgagggagatggcaccttatgctccgagatggacccttgtaccggtttgaccccaggggggtgctcaagaaacgcagagtgcatcaaaactggcacaggcactcacacctgcgtttgccagcagggctggacgggcaatgggcgagactgttcggaaatcaataactgtctgcttccttccgccggtggatgccacgacaatgcttcgtgtctttacgtggggcctgggcagaatgaatgcgaatgcaaaaaaggattcaggggtaacgggatcgattgcgagccaatcacatcctgtctggagcagactggaaaatgtcaccccctggcctcatgtcagtcgacttccagcggggtctggagctgcgtttgccaggaaggctatgagggcgatggctttctatgctatgggaacgccgccgtggagctgagcttcctgagcgaggccgccatctttaaccgatggataaataatgccagtcttcagccaactttgagcgcaacatcaaacctgactgttttggtgccatcccaacaggccaccgaagacatggatcaggacgaaaaatctttctggctatcccaaagtaacatccctgcacttattaagtatcacatgctgctgggaacgtacagggtagccgacctccagaccctttcctcatccgacatgctggccacatccttgcagggcaacttccttcaccttgctaaagttgacggcaatattaccattgaaggagccagcatcgtcgacggagacaatgctgcaaccaatggcgtcattcacatcattaacaaagtgctggtgcctcagagacgcctgaccggctctctgcctaatctgctcatgagattggaacagatgccggactatagtattttccggggctacatcattcagtacaatctcgctaacgctattgaggcagctgatgcctacaccgtgttcgccccaaataacaacgcaatcgagaattatatccgagaaaaaaaggtgttgtccttggaggaggatgtactgagatatcacgttgtcttggaggagaaattattaaaaaacgatttgcacaatgggatgcacagagagaccatgttgggcttcagttactttctgtcctttttcctccataatgaccaactctatgtgaacgaggcgcccatcaactacaccaacgtggcaaccgataaaggggtgatacacggtctcgggaaagttctggagattcagaaaaaccggtgtgacaacaatgatactactatcatccgcgggcgctgcagaacatgctctagcgaacttacttgccctttcggcactaagtccctcggtaatgaaaagagacggtgtatctacactagctacttcatgggaaggcggactctattcataggctgccagccgaagtgtgttagaactgtcatcaccagagagtgctgcgccggattttttgggccccagtgccagccttgtccaggcaatgcccagaacgtttgcttcggtaatggtatatgccttgacggagtcaatggcactggtgtatgcgagtgcggcgaggggttttctggtacggcctgtgagacttgcaccgagggcaagtacgggatacactgtgaccaggcctgttcctgtgtccatggcaggtgcaatcaggggccgttaggggacgggagctgtgactgcgatgtgggctggcggggcgtgcattgtgacaatgcaaccacagaggataactgtaacggaacttgccatacaagtgctaactgtctgaccaatagtgatggtaccgccagctgtaaatgcgccgccggatttcagggtaacggcaccatctgcacagccatcaatgcctgcgaaatctccaacggaggttgctctgctaaggcagactgcaagcggacaacacctgggcggcgggtctgtacttgcaaggctggctacactggggacgggattgtttgtctggaaattaatccctgtcttgagaaccatggaggatgtgacaaaaatgccgagtgcactcaaacaggtcccaaccaggcagcatgtaattgtcttcccgcctacactggagatggtaaagtctgcaccctgatcaatgtttgcctgacaaagaacggaggttgtagcgagtttgcgatctgtaaccacaccggtcaagtcgaacggacctgcacttgtaaacctaattacataggagacgggttcacctgtcgaggctctatctatcaggaactgcctaagaatcctaaaacttctcaatactttttccaactgcaggagcacttcgtcaaagacttggtcggccccggcccgtttaccgtcttcgcacctctttcggcagctttcgacgaagaggcgagagtaaaagattgggacaaatacggcctaatgcctcaggtcctcaggtatcacgtggtggcttgtcatcagctgctcctggaaaacctgaaactaatttcaaatgccacatcgctgcaaggggagcctatagtcatctctgtgagtcagagcaccgtctacattaataataaagctaaaattatctcctcagatatcattagtaccaatggcattgtccatattatagacaaactcctcagccctaaaaaccttctgataacccccaaggacaattctggacgaatccttcagaatctcaccactcttgcaaccaataatggttacatcaaattcagcaatctaatacaggatagcgggctcttgagcgtgatcaccgatcccatccatacgccagttacccttttttggcctacagatcaggctctgcatgctttgcccgcggaacagcaagacttcttattcaatcaagacaataaggataagctgaaagaatatctgaagtttcacgtcatccgcgacgccaaagtcctggccgtcgatctccctactagcaccgcttggaaaacgctgcaggggtcagaattaagcgtgaagtgtggtgccggccgggatataggcgacctgtttctgaatggtcaaacctgccggatcgtccagagagaattgctgttcgatctcggcgtagcctatggtatagactgtctcctcattgacccaacgttaggggggcgctgcgacacattcaccaccttcgatgcgtctggtgagtgcgggtcctgtgtaaataccccatcttgcccacgctggagcaaaccaaagggcgtaaagcaaaagtgcctctacaacttaccatttaagagaaatctggaggggtgtcgagagaggtgctcactggtcattcagatcccaagatgttgcaagggctatttcggcagggattgccaagcttgcccgggaggccccgatgccccctgtaataatcggggcgtatgtttggaccagtacagtgcaaccggcgaatgcaagtgcaataccggctttaacggaactgcctgcgagatgtgctggccagggagatttggtccggactgtcttccttgcggctgctctgaccacggacagtgcgatgatggaatcaccgggagcggccagtgcctatgtgaaacgggatggacaggaccttcttgtgacacgcaagccgtactccctgccgtgtgcactcctccctgctctgcccatgcaacatgcaaggaaaataacacgtgcgaatgcaatttagattatgagggcgacgggataacctgtacagttgttgatttttgtaaacaggacaatggcggatgtgctaaagtggcgaggtgcagtcagaagggcactaaagtgtcgtgtagttgtcagaagggatacaagggagacggtcattcatgtacagaaattgacccatgcgccgacggactgaatggtggatgtcacgaacacgctacctgcaagatgacaggacctggaaaacataagtgcgaatgcaagtcccactatgtgggcgatggcctgaactgtgagccagagcagctacctatcgatcgctgtctgcaggataatggccagtgtcatgctgacgccaaatgtgttgacttacacttccaggacactacggtgggcgtatttcacctgagatccccgctgggccagtacaagcttactttcgataaagcacgtgaggcctgtgctaacgaagctgccaccatggccacatataaccagctatcttatgcacagaaggcaaaataccacctctgcagcgctgggtggcttgagacgggacgagtcgcttatcccaccgctttcgcctcacagaattgcggcagcggcgtggtgggaatcgtcgattatgggccccggcccaataagagcgagatgtgggatgtattctgctacaggatgaaagatgtcaactgtacctgtaaggtgggctatgtgggggacggtttcagctgcagtggaaaccttctgcaggtgcttatgtcattcccctcactaacgaactttcttacagaggttctggcctacagtaattcttcagcaagagggcgcgctttcctcgaacacctgactgatctgtccatacgagggaccctgttcgttccacagaatagcgggctgggtgaaaatgaaacgctgtccggccgcgatatcgagcatcatcttgccaatgtgtccatgttcttttacaacgacctggtgaacgggacgaccttgcagaccagactgggctccaaattacttattacagcaagccaggatcccttacagccaacggagacccgcttcgtggacggtcgggccatcttgcaatgggacatatttgcttccaatggaatcattcatgtaatctccaggcctttaaaagctcccccagctcccgtcaccctgacccacacaggtctcggggccgggatattcttcgccatcatcctggtgaccggggcagtcgccctggcggcatattcgtattttcgcatcaatagacgcactatcggcttccagcattttgaaagcgaagaagacattaacgtagccgcgctggggaagcagcaacctgagaacatctccaaccccctgtatgaaagtactacaagcgcacctccggagcccagctatgatccatttaccgacagtgaagagcgtcagttggaaggaaacgacccacttagaacactgtag

SEQ ID NO: 30602 - DNA, 1077 bp, Artificial Sequence
  Description of Artificial Sequence: Synthetic coding sequence
atgggagctgtgtggtccgccctgctcgtcggagggggtttggctggtgcccttttcgtttggctgcttaggggcgggcccggcgacactggcaaggatggcgatgctgagcaggagaaagacgcgccattgggcggagctgcaatcccaggaggtcaccagtccggcagctctggtttaagtcccggccctagtggacaagagctggtgaccaagcccgagcacttacaagagtctaatggccatttaatcagtaagacaaaggatctgggtaagcttcaggctgctagctggcgtctccagaacccatcacgtgaagtctgcgataattcccgcgagcatgtaccatctggacagttccccgacactgaagccccagcaaccagcgagacgagcaactcgaggagctacagcgaagtgagtcgaaacgagtccttagagagccccatgggagagtggggattccaaaagggtcaggaaatttccgcaaaagctgccacctgcttcgcggagaaactgcccagcagtaatctactcaaaaaccgcgcaaaggaagagatgagtttgtctgatctgaactcccaagatcgggtggaccacgaagagtgggagatggtgccccgacacagctcttggggcgatgtgggagttggggggtcattgaaggccccagtgctgaacctcaatcagggcatggataacggccggtctacactagtcgaggcacggggccagcaggtgcatggcaagatggaacgcgtcgcagtgatgcctgccggaagccagcaggtctccgtccggttccaggtgcactacgtgacctccacggatgtgcagttcatcgcggtgacaggagaccatgagtgcctcggtagatggaacacttatattccactgcactataacaaggacggtttttggtctcattccatcttcttacccgccgacacagtagtcgagtggaagttcgtcttagtagaaaatggcggcgtgacaaggtgggaagaatgttctaacaggttcctggagactggccacgaggacaaggtggtgcatgcatggtgggggattcactag

SEQ ID NO: 30603 - DNA, 630 bp, Artificial Sequence
  Description of Artificial Sequence: Synthetic coding sequence
atgggtgaatggggttttcaaaaagggcaggaaatcagcgctaaagcagcaacatgctttgccgaaaagctgccatctagcaaccttctcaagaatcgggctaaggaagaaatgtccttgagtgacttgaattcccaggaccgagtcgatcatgaagagtgggagatggtaccgcgccattcctcctggggggatgtgggggtgggtggtagtctcaaggccccggtgttgaacctaaaccagggaatggataatggccgttccaccctggttgaggctcggggacagcaggtccatggcaaaatggaacgagtggcagtgatgccggccggctcccagcaggtatctgtgcgattccaggtccattatgtcaccagtacggatgtgcagtttatcgctgtgacaggcgaccacgagtgcttgggccgctggaacacatatatccctcttcactacaacaaggatgggttctggtcccattccatctttctgcctgctgatactgtcgtggagtggaaatttgtgcttgtagaaaacgggggtgttacccgttgggaggagtgcagtaatcggtttttagagacagggcacgaagacaaagtcgtacatgcctggtggggaatccattag

SEQ ID NO: 30604 - DNA, 1113 bp, Artificial Sequence
  Description of Artificial Sequence: Synthetic coding sequence
atgctgcccagacggctgttggccgcttggctagccggaacaagaggcgggggacttctcgcactgcttgctaatcagtgcagatttgtgactggactccgagtacgcagagcccagcagatagcccagctatacggtcgcctgtactccgagtcaagcaggagggtgctcctgggaagactgtggcgccgccttcacgggcgacccgggcacgcgagcgccctgatggcagctctcgccggagtgttcgtatgggatgaggagcgtattcaagaggaggagttgcagaggagcataaatgaaatgaagcggctggaggagatgtctaatatgttccagtcatctggggtgcagcatcacccacccgagcctaaggcccaaactgaagggaacgaggattcggaagggaaagagcagcgttgggaaatggtcatggacaagaagcattttaagctatggcggcgacctatcaccggcacgcacctttaccagtaccgcgtgtttggcacttatacagacgtaaccccccgccaatttttcaatgtgcagctcgacaccgagtatcggaagaagtgggatgccctagtgattaagcttgaagtgatagagcgagacgtggtcagcggaagcgaagtcttacactgggtgacccatttcccataccccatgtattctcgtgactacgtatacgtcagacgttattccgtcgatcaagagaataacatgatggtgttggtgtcccgtgctgtggaacacccatccgttccggaaagtccggaattcgtgcgcgttagatcttacgaatcacagatggtcatcaggccacataaatccttcgacgagaacggtttcgattatctgctgacatactccgataacccacagaccgtgttccctagatattgcgttagctggatggtgagctccggtatgcccgactttctcgaaaagctgcacatggccacgctgaaggcaaagaacatggaaatcaaggtgaaggattacatcagtgctaaaccgttggagatgtcctcagaagcgaaagccacatctcagtcgtctgagcgaaaaaacgaaggaagttgtggtcccgctcgcatagaatacgcgtag

SEQ ID NO: 30605 - DNA, 738 bp, Artificial Sequence
  Description of Artificial Sequence: Synthetic coding sequence
atggagtctcgaaaggatataacaaatcaagaagaaatctggaagatgaaaccccgcagaaacctggaggacaacgattatctgcagactgctcatgccgatgagttcgattgtcctagcgaactccaacatgcccaggaactattcccgcagtggcacctgccaattaaaatcgctgcagtcatggctagtctgacttttctgtacaccctgttgcgcgaagtcattcacccactggccacttctcatcagcaatacttttacaagatacctatactggtgatcaacaaagtcctccctatggtttccataacattattagccctcgtgtacctccccggcgtgattgccgcgatagtgcaggtccacaacggcaccaaatataaaaagtttccacattggctggataagtggatgctcacgaggaaacagttcggcctattgtctttattttttgcagtgctgcacgctatctataccctgtcctatgctatgcggaggtcttacaggtataagctcctgaattgggcctatcagcaggtgcagcaaaacaaggaggacgcctggatcgaacacgacgtgtggcgcatggaaatctatgtgagcctgggcatcgttggcctggccatcctcgctttgcttgccgtgacgtcgattccgagcgtgtccgactcactgacgtggcgggagttccattatatacaagtgcacggaagaatcaacttcctgacactgtag

SEQ ID NO: 30606 - DNA, 765 bp, Artificial Sequence
  Description of Artificial Sequence: Synthetic coding sequence
atggaatcaagaaaggatattaccaaccaggaggaaatctggaagatgaaaccccgccggaatctggaggacaacgattacctccatgaggatacaggagagacttccatgctgaagcggccagtgctgctgcatctccagcagactgcgcacgccgacgagtttgactgcccttcagagcttcaacacgcccaagagctgttcccacagtggcacctccctataaagattgccgcagtgatggcttcacttacatttctctacactctgctgcgagaggttatccatcccctcgcgaccagccaccagcagtacttttacaaaattccgatcttggttatcaataaagtgctccccatggttagcatcacactcctggccctggtttatctcccaggcgtgatcgccgccatcgtgcaggtgcataacggaaccaagtataagaagttcccccactggcttgacaagtggatgctgacccggaagcagttcgggctgctgagcttatttttcgccgttctgcatgccatttacaccctttcttacgccatgcgcagatcctatcgatataaactgctcaattgggcataccagcaagtgcagcagaacaaggaggatgcctggattgaacatgatgtgtggaggatggaaatctatgtgtctctgggtattgttggattggccatcctggccctgctggctgtgacctcaatccctagcgtctctgatagtctgacgtggcgggagttccattatatccagtag

SEQ ID NO: 30607 - DNA, 1029 bp, Artificial Sequence
  Description of Artificial Sequence: Synthetic coding sequence
atggagagccggaaggatattacaaatcaggaagagatatggaaaatgaaaccccgccgcaatcttgaggacaatgattatcttcacgaggacaccggtgagacatctatgctaaaacgtcccgttctcctgcacctccagcagactgcccacgctgacgaattcgattgcccaagcgagctccagcacgcacaagaactgtttcctcaatggcacttgcctataaagatcgctgccgtgatggcttcgctgacctttctgtacaccctactccgagaggtgatccatccactcgctactagccatcaacagtacttctataagatacccatcttagtgatcaataaggtgctgcctatggtgagcatcaccttgctggccctcgtctatttaccaggtgtcatcgcagcgatcgtccaggtccacaatggcaccaaatataagaagtttccacactggctggacaagtggatgctgacccggaaacagtttggactgctgagccttttcttcgcagtactccacgccatctacacactgagttatgccatgagacgctcatacaggtacaagctgctgaattgggcgtaccagcaggtgcaacagaataaggaggatgcatggatcgaacatgatgtctggaggatggagatttacgtatctctcggtatcgtgggtctggccatcctcgcactcctcgctgttacgagtattccctctgtgtccgattccctgacgtggagggagtttcactatattcaggcaatcctgactggcagccttgtggccctgtgcaacttccaggccacaaaattggcgaagactcagctggtcggtacccccaatttctggcaggagcagcagtgcggcatacactttcctcccccctcaaaaactcgtagttacatctacttcattttatccgcagccagtccatccaagggcaacgtttcatcccacatgtttcaattgcacttggagaatctgaacaagaaagacaagttgttactaatcattttccagatttag

SEQ ID NO: 30608 - DNA, 771 bp, Artificial Sequence
  Description of Artificial Sequence: Synthetic coding sequence
atgccaggccccgctactgacgctggaaaaatcccgttctgcgacgcaaaagaggaaattcgggctgggctggagagttcggagggtggcggcggccctgaaaggcctggtgccaggggccaaaggcagaacatcgtttggcggaatgttgttctgatgagtctgctgcacctcggggctgtatactcgttggtgctcatccccaaagccaagccattgacccttctgtgggcctacttctgctttctgttggctgccctgggcgtaaccgccggggctcatcgtctgtggagtcaccgcagctatagagccaagttgcccctgcgcatttttctggctgtcgccaacagcatggccttccagaatgacattttcgagtggtctagggaccaccgggcccaccataaatacagcgaaaccgatgctgaccctcacaatgcacgacggggcttcttcttcagccacataggctggctgtttgtcagaaaacaccgagatgtgatcgagaaggggcggaagctggacgtgacagatctgctcgcggacccggtcgtaagaattcagcgcaatacccaacacatccagaaggaagggcgggccctcaaccaggaagcagcctgtgaaatgctgagggagtggcaccaagggcacatactgaaagttacacttccagggttgcacatactggccctcctgcacacacattgcaaccacagtgagaagtgctgtcttatgcttcgagcactgtctgtgagtctagaggtcttctag

SEQ ID NO: 30609 - DNA, 399 bp, Artificial Sequence
  Description of Artificial Sequence: Synthetic coding sequence
atgcctgggcccgccacagacgcagggaagattcctttctgcgatgctaaggaggaaatccgggcagggctcgagtctagcgaggggggaggaggccctgagcgtcccggcgctcgagggcagaggcaaaacatagtgtggcgtaacgtggtcctgatgtccctcctgcatctcggagctgtctacagcttggtactgataccaaaggccaagccactaacactgctgtgggcctatttttgtttcctgttggctgccctgggagttaccgcaggggctcacaggctatggagccacagatcataccgcgccaagttaccgctcagaatttttttggccgtcgccaactcgatggcttttcaagccgcagccgaagtcgtgctgacacagatgccatag

SEQ ID NO: 30610 - DNA, 993 bp, Artificial Sequence
  Description of Artificial Sequence: Synthetic coding sequence
atgcccggccctgccacggacgccgggaagattcccttttgtgatgccaaagaggagataagagcggggttggagagctcagagggaggcggtggccctgaaaggcccggcgcgcgtggccaaagacagaatatagtatggagaaatgtcgtgttgatgtctctcttgcacttgggtgcagtgtatagcctcgtgttaatcccaaaagctaaaccattgaccctgctgtgggcttatttctgttttctgcttgccgctctgggagtcacagcgggagcgcatagactctggtcccaccggtcctaccgcgcaaagctccccctgcgtatctttttggccgtggctaatagtatggccttccagaacgacatattcgagtggagccgcgaccacagggcacatcacaagtattcagaaaccgatgctgatccccacaacgctcggagaggattcttcttttcccacatcggatggctcttcgtcagaaagcatcgggacgtcattgaaaagggcagaaagctggatgtgacagacctgcttgctgaccctgtcgtaaggattcagaggaagtattacaaaattagcgtggtgctcatgtgcttcgtcgtcccgacactggtgccatggtatatttggggagagtccctgtggaacagttacttcctcgcatcaatcttgcgctacacaataagcctgaacatttcatggctggtcaactcagctgctcatatgtatgggaacaggccgtatgataaacatatcagccccagacagaatcccctggttgcgcttggcgcgataggggaaggcttccacaattatcaccacacatttccgttcgattacagcgcctctgagtttggcctcaacttcaacccgaccacctggtttatcgacttcatgtgttggctgggactggccactgatagaaagcgagccacaaagccaatgatcgaggccaggaaggcccgcacaggggatagcagtgcctag

SEQ ID NO: 30611 - DNA, 867 bp, Artificial Sequence
  Description of Artificial Sequence: Synthetic coding sequence
atggccgaaaagagacacactcgcgattccgaagctcagaggctgcccgattcatttaaagatagcccatctaaagggttgggcccctgcggatggatcctggtggcctttagcttccttttcacggttataacatttcccatttcaatttggatgtgtatcaaaattattaaagagtacgaaagagccattattttccggttgggacggatcttacagggtggagctaagggccccggcctgttttttattctgccctgtaccgattcattcattaaggtggatatgagaaccatctctttcgacatccccccacaggagatccttactaaggattccgttactatcagtgtggacggcgtggtgtattacagagtccaaaatgctacgcttgcagtggccaacattacgaacgccgattctgcaactagactgctggcccaaacaacgctacgtaatgtcctgggcacgaaaaatctctctcagatactttccgaccgggaggagattgctcacaatatgcagagtacattggatgatgccactgacgcctggggcataaaggttgagagggtggagatcaaggatgtaaagttaccagtacagctacaacgtgcgatggctgcagaggcggaagctagcagggaggcccgggcaaaggtgattgcggctgagggagaaatgaatgctagcagggctttgaaggaggcttccatggtgattacagaatcaccagccgcactgcagctgaggtaccttcagacattgaccaccatcgccgccgagaagaacagtacaatcgtctttcccctacccatcgacatgctgcaggggatcattggggccaaacacagccatctgggctag

SEQ ID NO: 30612 - DNA, 372 bp, Artificial Sequence
  Description of Artificial Sequence: Synthetic coding sequence
atggccgaaaagagacacacacgtgatagcgaagcccagagactgcctgactcttttaaagattcaccatcaaaaggactggggccttgcggctggatcctcgtggcgttctcttttctcttcaccgtgatcaccttcccaatctcgatctggatgtgcataaaagtcatcgctgccgaaggcgagatgaacgcctcccgcgctcttaaggaggcgtctatggtgataactgagtctcccgctgcacttcagctcagatacctccagacccttacaaccattgccgcggagaagaactcaactatcgtctttccactgcctatcgacatgttacaaggcataattggcgcaaagcactctcaccttggctag

SEQ ID NO: 30613 - DNA, 714 bp, Artificial Sequence
  Description of Artificial Sequence: Synthetic coding sequence
atgtgtatcaaaatcatcaaagaatatgaacgcgccattattttccggctgggacgcatcctgcagggtggggccaaggggccagggctcttttttatcctgccatgcacagactcctttattaaagtggacatgcgcactatttcatttgacattccaccacaggagattttgacaaaagattccgttacaatttctgtggacggcgtggtatactacagggtccagaatgccaccctggccgtcgctaacatcacaaacgccgacagcgccacacgactgctggcgcagactacattgagaaatgtgttgggaacaaaaaatctgagccagatcctgtctgatagagaagagatcgctcacaacatgcagagcacactggacgatgctacagatgcctggggcatcaaggtggaacgtgtggagatcaaggatgttaaactgccagttcagctccagcgggccatggcagcagaggcagaagccagcagagaagctagggcaaaggtgattgcagctgagggcgagatgaatgcatccagagccctgaaagaagcttccatggtgataactgaatcccctgctgctctgcagttaaggtatcttcaaacgcttacaactatcgcggccgagaagaattcaacaatcgtcttccccttgcccatagatatgctgcaaggcatcatcggtgccaagcactcacacctcgggtag

SEQ ID NO: 30614 - DNA, 3549 bp, Artificial Sequence
  Description of Artificial Sequence: Synthetic coding sequence
atgtgctccactaatcccgggaagtgggtcacctttgatgacgatcccgccgtccagtcgagccagaagtcaaagaattttcccctcgagaaccagggtgtgtgtcgccccaacgggcttaaactgaacctcccaggcctgcgagaattcccctcaggcagcagctctacctctagcacacccctttcatctcctatcgttgacttctacttcagtcccggcccaccgtccaactctcccctctctacgcctacaaaagactttcccggctttccaggaattcccaaagccgggacccatgtgctgtatccaattccagagtcttcatcggactcccctctggctatttccggcggagagagctcactgcttccaacacgccctacctgtctgtcccacgcactgctgccatccgaccactcatgcacacaccctacacctaaagtcggtctgcccgatgaagtgaacccgcaacaggccgagtcgctggggtttcagagcgacgatctcccccaattccagtatttccgcgaggactgtgcattttcatcacccttttggaaggacgagggctcagactcgcactttacgctagatccacccggcagtaaaaaaatgttttcctctaggaacaaagaaatgcccatcgatcagaaatctctcaacaaatgctcactgaattatatctgtgagaagctggaacacctgcagagcgctgagaatcaagactctctgagatcattgagtatgcactgcctgtgcgccgaagaaaatgcaagcagctttgtgcctcacactctgtttagatcgcaaccaaaatccggctggagcttcatgctgcgaattcccgagaagaagaatatgatgagtagccgccagtggggccccatttttctcaaggtcctaccaggaggcatcctccagatgtactatgagcagggcctggaaaagcccttcaaggagattcagctagacccctactgcaggttgagcgaaccaaaagtagagaacttttccgttgcgggtaagattcataccgtgaagatcgaacacgtgtcgtatacagaaaaacgcaagtatcactccaagaccgaagtcgtgcacgagcccgacattgagcagatgcttaaactgggttctaccagctatcacgactttctggactttcttacaacagtggaagaggaactgatgaagctacctgcagtatcgaagcccaagaagaactacgaagagcaggagatctcgctggagattgttgacaatttctggggcaaggtaacaaaagaaggaaaattcgtagagtctgcagtgatcacgcagatctattgtttgtgctttgttaacggaaatttggaatgcttcctgacgctgaacgaccttgaacttcctaagcgcgatgaatcgtactacgaaaaagactccgaaaaaaaagggattgacatcttggactatcattttcacaaatgcgtgaatgtccaggagttcgaacagtcccgaataatcaaattcgtgcctttggacgcatgcagatttgagctcatgcgttttaagactctgtacaacggcgataacctgccctttagcctcaaatcggtcgtcgttgtgcaaggcgcctacgtagagttgcaggccttcgtgaacatggccagcctcgctcagcgctctagctatgctgggagtctacggtcatgtgacaatattcggattcattttcctgtgccctctcagtggatcaaggccctctggactatgaatttgcagcgtcaaaaaagcctgaaagccaagatgaatcgtagggcctgtctgggcagtctccaggaacttgaaagcgagccagtaattcaggtgactgttggtagtgctaaatatgagtccgcctatcaggctgtagtgtggaagatcgatagactgcccgacaagaactcttccttggaccacccacactgtctgtcctacaagctggagctgggttcagaccaggagataccgtcagactggtacccctttgcaactgtgcagttctccgtaccagatacctgtgcctctagaaccgaggttcgatcactcggggtcgaatccgatgtgcaacctcagaagcacgttcagcagagagcgtgctataacatccaaccaaaactttatagatccgtgatagaagacgtaatcgaaggcgtgcgaaaccttttcgccgaagaaggcattgaggagcaggtgttgaaagacctgaagcagctgtgggagacaaaggttcttcaatcaaaggccactgaggacttctttagaaattctatccaatctcccctcttcaccctccagctgccacacagcctgcaccagaccctgcagtcatctactgctagccttgtcatcccggcagggagaactctgccttccttcaccacagcagagcttggaaccagcaattcctccgccaacttcacatttccggggtacccaattcacgttcctgcaggggtcactctccagaccgtgagcggccacttgtacaaagtgaacgtgcccattatggtgaccgagacatccgggagagccgggattttgcagcatccaatccagcaggtgttccagcagttaggtcagccctccgtcatccagacatcagtgccacagttgaacccttggagcttgcaagcaaccaccgagaagtctcagcggattgaaacagtgctgcaacaacccgccatcctacctagtgggcccgtggacaggaaacatctggagaacgccactagcgacattctggttagccctggtaacgagcataaaatcgtcccagaagctctcctctgccatcaggaatcctcccattacatctcactacctggcgtggtctttagtccacaggtctcacaaaccaacagtaatgttgagagcgtcctgtcaggctccgcctccatggcccagaacctccatgacgagtctctgtctacctctccccatggagccctgcaccaacatgtgaccgacatacagttacatattcttaaaaataggatgtatggatgtgactcagttaagcagccacgaaacattgaagagcccagcaacatccccgtgtccgagaaagacagcaactctcaggtggatctatccatacgggtgacagatgacgacatcggagagatcatccaagtagatggatccggggatacaagcagcaacgaggaaatcggtagcacacgcgatgccgacgagaacgaattcctgggaaacatcgacggcggagatctgaaagtccctgaggaggaagcagactctataagcaacgaagactctgcaaccaactcctccgacaacgaagatccacaagtgaacattgtggaagaagaccccctgaactcaggagacgatgtttccgagcaagatgtgcccgatctgttcgacacggacaatgtgattgtttgccagtatgataagatccacaggtcaaaaaacaagtggaagttctaccttaaggacggtgttatgtgcttcggtggaagggattatgtgttcgccaaagcaatcggtgatgctgaatggtag

SEQ ID NO: 30615 - DNA, 1434 bp, Artificial Sequence
  Description of Artificial Sequence: Synthetic coding sequence
gcctgcctattcctaatccctaagctgtaccgttccgttattgaggacgttattgaaggtgtacgcaatttgttcgctgaagagggcatagaggagcaggtcctgaaggatctcaagcaattgtgggagaccaaggtactgcagtccaaggcaactgaggacttttttcgcaatagtattcaaagcccgctttttaccctgcaactgcctcattctctgcaccaaacgctacaaagtagcacagcatccctggtgatccctgctggccggacgctgccttcctttaccactgcagaactggggacgtcaaattcatcggccaacttcaccttccctgggtacccgatacacgttccagccggggttacactccagaccgtctcaggccatctgtacaaagtgaacgtgccaatcatggtaaccgaaacatccggcagagctggaatactccaacatcctatccagcaggtctttcagcagctgggtcagccctccgtcattcagacttccgtgccccaactgaacccctggtcacttcaggcgaccaccgagaaatctcagcggattgaaacggtgctgcagcagccagccatactgccctccggccccgtcgatagaaagcatttggagaacgccacgtcagacattttggtgtccccaggcaacgagcacaaaattgttccagaagcactcctatgtcaccaggaatcctcgcattatatttctctgcccggggtcgttttttcccctcaggttagccaaactaatagcaatgtggaaagcgtgctgtcaggcagcgctagtatggcacagaatctgcacgacgagagcctgtctacctctccacacggcgcgttgcatcagcacgtcactgacatccaactgcacatcctgaaaaaccgcatgtatggatgcgatagtgtcaagcagcccagaaacattgaggagccctctaacataccggtttctgagaaggatagtaacagccaggtcgacttgagcatcagggtaacagatgacgacattggtgagataatccaggtggacgggtctggtgacacgtctagcaacgaagagatcggctccacccgggatgctgacgaaaacgagtttttgggcaacatcgatggcggagatttaaaagtgccagaggaagaagccgactcaattagtaatgaggacagtgccacaaacagcagcgacaatgaggacccacaagtaaacattgttgaggaggacccactgaattctggggacgatgtgtcagagcaggacgtaccagatttatttgatacagacaacgtgatcgtatgccagtatgataagattcaccggtcaaaaaataagtggaagttttaccttaaggacggagtgatgtgcttcgggggtagagattacgtgttcgctaaagctattggtgatgcggagtggtag

SEQ ID NO: 30616 - DNA, 3408 bp, Artificial Sequence
  Description of Artificial Sequence: Synthetic coding sequence
atgtgcagtactaatccaggcaaatgggtgacctttgacgacgatcctgccgttcaatcttcccagaaaagcaagaactttccgctcgagaatcaaggagtttgcagaccgaatggactgaagctgaacctgcccggccttagagagtttccgtcgggtagcagttccacaagctcaacaccgctctcctctccgattgttgacttctacttctcacccggcccccctagcaacagccccctctcaacacccactaaggacttccccggttttccggggattccaaaagccggaacccatgtgctgtatcccattcccgagagttccagcgacagcccactggccatttcagggggcgaaagtagtctcctgcccacccgtcccacgtgcttgagccacgcgctcctgccctctgaccactcatgcacccaccctacaccgaaggtgggccttcccgacgaggtgaacccacaacaggccgaaagtctcggcttccagtccgacgatctgccccagtttcagtactttagagaagactgtgctttctcctcacccttttggaaggacgaaggctccgacagtcattttacattggacccaccaggaagcaagaagatgttctcatcaagaaataaagaaatgcctatagatcagaagtctctgaataagtgctccttgaattacatttgtgaaaaacttgaacatttacaatcagctgagaatcaggatagcctgcgaagcttgtcaatgcattgcctttgtgccgaagaaaacgcaagttcgttcgttccccataccctgttcagaagccagcccaaatccggttggtcttttatgctgcgcattcccgaaaagaaaaacatgatgtcaagccggcagtggggccccatttttctgaaggtgctgcccggcggtattctgcagatgtattatgagcagggactcgaaaagccctttaaagaaatacaactcgacccttattgtcgtctttccgaacctaaggtggagaacttctctgtggcaggcaagatccacactgttaagattgaacatgtgtcttacaccgaaaaacgaaagtaccattccaagaccgaggttgtgcacgagcctgacatagaacagatgttgaaacttggttccactagctaccacgacttcctcgactttctgaccacagtggaggaagagctgatgaaactacctgcagtgtcaaagccaaagaaaaactatgaagaacaggagatcagcctcgagatcgttgacaacttctggggcaaggtgactaaggaagggaaattcgtggaaagcgcggttatcacacagatctactgcctctgtttcgttaacggaaatcttgaatgtttcctgactctgaacgacctggagctgccaaaacgagatgagtcatactacgagaaagactcagaaaaaaaagggatcgacatattggactatcacttccacaagtgcgttaacgtccaggagtttgagcagtcccgtatcattaagtttgttcctctggatgcctgtaggttcgagctgatgcgttttaagactctctacaatggcgataatttacctttttccctgaagtcagtggtggtggtgcagggtgcgtacgtcgagctccaggccttcgtcaatatggccagcctagcacagcgatcctcttatgctggcagcctccgcagctgcgataacatcagaatccactttcccgtcccttcacagtggatcaaagctttatggactatgaatttacagcgacagaagtccctgaaagctaagatgaataggcgagcgtgcctggggagcctgcaggaactggagagtgaaccggtcatccaggtaactgtgggatctgcaaaatacgagagtgcttaccaggctgtggtgtggaagattgatagactgccagacaagaacagtagcctcgatcatcctcattgtttatcatacaagctagagctcggtagtgatcaagagattccgtccgactggtacccttttgccaccgtccagttctccgtgcctgatacatgcgcgagtcgcacagaagtccggagcctgggcgtggagagcgatgtgcaaccccagaagcacgtgcagcagagggcctgctataacattcaaccaaaactctacaggtccgtgatcgaggacgttattgagggcgtgagaaatctgttcgcagaagaaggaattgaggagcaagtgctcaaggacctcaaacaactctgggaaacaaaggtcctccagtccaaagccaccgaggattttttccggaactcgatccaatcacccttgttcacactccagctcccccactcattacaccagactctacaaagtagcaccggtcacctgtacaaggtcaatgtacctataatggttacagaaacctctggcagagcgggcatcctgcagcatccaatccagcaggtgttccagcagctcggccagccaagtgttatacagaccagcgtgccccagctgaacccgtggtcgctacaggctacgacagagaagtcccaaagaatagagactgtgttgcagcaacctgccatcttgcctagcggccctgttgaccggaaacatttggaaaacgcgacaagtgatattttggttagccctggcaatgagcacaaaattgtgccagaggcattgctctgtcaccaagaaagctcgcattatatcagccttcccggggtagtgttcagtcctcaggttagccagaccaattctaatgtggaaagtgtcttaagtggcagcgcctccatggcccaaaacctgcatgatgagtcgctttccacttctccacatggggccctccatcagcacgtgacagacatccaactgcatatactgaagaacagaatgtacggctgcgacagcgtaaaacagccacgtaatatagaagagccctctaacatcccggtatccgagaaggatagcaacagtcaggtcgaccttagcatacgcgtaactgacgatgacataggtgagatcatccaggtggacggatccggggataccagctcgaatgaggagataggatcaacgcgggatgccgatgagaacgaattcctggggaacatcgacggaggggatctgaaagtacccgaggaggaagccgactctatttccaacgaggattcagcgacaaatagcagtgacaacgaagaccctcaggtcaacatcgtggaggaagaccccctcaatagcggcgatgatgtcagtgaacaggacgttcctgatctctttgacacagataacgtcattgtctgccaatatgataagattcatagatccaaaaacaagtggaagttctatttgaaggatggtgtgatgtgtttcggaggaagggactacgtttttgcgaaagctatcggcgacgctgaatggtag

SEQ ID NO: 30617 - DNA, 3549 bp, Artificial Sequence
  Description of Artificial Sequence: Synthetic coding sequence
atgtgttccaccaatcctggaaagtgggtgaccttcgacgacgacccggccgtgcagtcttcacagaagtccaaaaatttcccgctggagaaccagggcgtgtgtcgccccaacgggcttaagcttaatttacccggtcttcgggaattcccttcaggatcatcctctacaagtagtacccccctttcatcacccatagtggatttctacttcagccccggaccaccatctaattcacccttatcgactcccactaaagatttcccggggttccctggcatcccaaaggccgggactcatgtcctgtatccaatcccggagtcctcatccgactcacctctggctatctcaggcggtgaatccagcctgttgcctaccaggccaacgtgcctctcccatgcactgcttccatcagaccattcttgtacacaccctactcccaaagtcggactgccagatgaggtcaacccgcaacaggccgaatctttaggattccaatccgatgaccttccacagttccaatacttcagggaggattgcgccttcagctcacccttctggaaggacgagggaagcgattctcactttacgctcgatccaccaggctccaagaagatgttcagcagtcggaataaagagatgcccatcgaccagaagtctctcaataagtgttctcttaactatatctgtgaaaagctggaacacctgcagtccgcagaaaaccaggacagtctcaggagcttgagtatgcattgcctgtgcgccgaagagaatgcttctagctttgtgccacatacactctttaggagtcaaccaaagagtggctggagtttcatgctccgaatccctgagaagaagaatatgatgtccagtagacaatgggggccaattttccttaaagttctgccgggaggcatacttcagatgtattacgagcagggtctggagaagccttttaaggagatccagctggacccttactgccggcttagcgaaccaaaggtggaaaactttagtgttgccggaaaaatccataccgtgaagattgagcatgtgtcttatacagagaagagaaaataccactctaagacagaagtcgtgcacgaaccggatatcgagcaaatgctgaagctcggctctacgtcttaccacgactttctggactttctgacaaccgtcgaagaggagcttatgaaactgccggccgtgtctaaacccaaaaagaactacgaggagcaagagatcagtctcgaaatagttgataatttttggggtaaagtcacgaaggaggggaagttcgttgagtccgcggtgataacccaaatctattgcctctgcttcgttaatggaaatttggaatgctttctcactctgaacgatctggagctgcctaagagggatgaatcatattatgagaaagattccgagaagaagggtatcgacatcctggactatcactttcataagtgtgtgaatgttcaggagtttgaacagagcaggataatcaagtttgtgcctttagatgcctgcagatttgagctgatgcgattcaagaccttgtacaacggtgataatctaccattcagtttgaaatctgtcgtggtggtccaaggagcttacgtggagctgcaagcgttcgtcaatatggctagtttagcccagcgttccagctacgccggaagcctgaggagctgcgacaatattcgtatccacttcccagtgccgtcccagtggatcaaagcactctggactatgaacctccagcgccagaagtccttgaaggctaagatgaacagacgagcttgcttagggagcctgcaggagctggagtccgagccagtcattcaggtcaccgtcggatctgccaagtacgagtccgcataccaggccgtggtctggaagatcgaccggctaccagataaaaacagtagtctggatcaccctcactgcctttcttataaactcgagttgggatccgatcaggaaattccctcagactggtatcccttcgctaccgttcaatttagcgtcccagacacgtgcgcctcacgaactgaggtaagaagcctgggggtggaatccgatgtgcagcctcagaagcacgtacagcagagagcttgctataacattcagcctaagctgtataggagcgtcatcgaagatgtcattgaaggagttcgtaacctgttcgctgaagagggaatagaggaacaggtgctgaaggatctgaaacagttgtgggaaaccaaggtcctgcaaagtaaggccacagaagactttttccggaactctatccagtctcccttgttcaccctgcagctgcctcactccctgcatcagaccctacaaagcagcaccgcatccctggtgatcccagcagggcggacgcttccatcattcaccactgccgaactgggtacatccaatagctctgcaaactttacatttcccggctaccctattcacgtgccagccggcgtcacactgcagaccgtgagtggccatctctataaggtgaacgtgccgatcatggttaccgagacgtcaggtcgggctggtatcctccagcatccaattcagcaggtgtttcagcagcttggtcagccgtcggtcattcagactagcgtgccccaactcaacccatggagccttcaagctacaacagaaaaatcccagaggattgagaccgttctgcagcagcctgctatcctcccttccggccccgtggacaggaaacacctggagaacgcaacctcagacattctagtttcccctgggaatgaacacaaaatcgtgcccgaggcactgctctgccaccaggagtcttcccattatatctctttgcctggtgtagttttctctccacaggtgtctcagaccaattcaaacgtcgaaagtgtgctcagtggtagcgcgagcatggcacagaatttacacgatgagagtcttagcacctccccccacggagctctgcaccaacacgtaacggacattcagcttcatatactgaaaaacaggatgtacggttgtgattcagtcaaacaaccccgaaacattgaagaacccagtaatattcctgtgtcagagaaagatagcaacagccaggtggacctctctatccgggtgacagatgacgacattggcgaaattatccaggtagacggttcaggtgatacttcaagcaatgaggagattggcagcacccgcgatgcagacgaaaatgagttcctaggcaacatcgatggcggggatcttaaagtgcccgaggaggaggcggactcaattagcaacgaagactcagctaccaacagcagcgataacgaagatccacaggttaacatcgtagaggaggacccccttaacagcggcgatgacgtgtcagaacaggatgtaccagacttatttgacaccgataatgtcatagtgtgtcaatatgataagattcatcgctctaagaacaagtggaagttttatcttaaagatggggtgatgtgcttcggaggccgggactacgtattcgctaaggctataggcgatgccgaatggtag

SEQ ID NO: 30618 - DNA, 3549 bp, Artificial Sequence
  Description of Artificial Sequence: Synthetic coding sequence
atgtgtagcacgaatccggggaagtgggtaacatttgacgatgatcctgcagtgcagagcagtcagaagtctaagaactttccactggaaaaccagggtgtatgccgacctaatggattaaaactcaacctgcccggattgagagaatttccatcgggtagttctagcacgagttcgactcccctatcttctccaatagtggacttctattttagtcctgggcctcctagtaactccccactgtctacgcccaccaaagacttccctggttttcctggcatcccaaaagccggaacccacgtcctgtaccctatacctgagtcctccagtgactcccccctcgccatatccggaggagaatcatcccttttaccgacgcgcccaacctgtctcagccatgccttgctgccgtccgaccatagctgcacccatcccacccctaaagttggcttgccagacgaagtcaatccccagcaggcagaatcactggggttccagtctgatgatttgccccagttccaatacttccgcgaagattgtgcgttctcctcccccttttggaaagacgaaggatccgactctcattttactctggaccctccgggctccaaaaaaatgttctcaagcagaaataaggagatgcctatagaccaaaaatccctcaacaagtgcagcctgaattacatctgtgagaaacttgagcatctccagtctgctgagaatcaagattcattacggagcctgtcaatgcattgcctgtgcgcagaagagaacgcgtcctcatttgtgccccacacactttttcgctcccaacccaaaagtggttggtcttttatgctccggattcccgagaaaaagaatatgatgtcttcccggcagtggggaccaatatttcttaaggttcttcctggcgggattttacagatgtattatgaacaaggactggaaaagccattcaaagaaattcaacttgatccctattgtcggcttagcgagcccaaagtcgagaacttttccgtggcaggcaagattcataccgttaaaattgagcatgtgagctatacagaaaaacgcaaataccactccaagacagaagtggtccatgaaccggacattgaacagatgctgaagcttggcagcacctcctaccacgatttcctcgacttcttaaccacagtggaggaagagctgatgaagctccccgccgtgagcaagcccaaaaagaactacgaggagcaagaaatttctttagagatcgtcgacaacttctggggcaaggtgaccaaagagggaaagttcgtggaatcggcagttattacacagatatattgtctgtgttttgttaacggaaacctggagtgcttcctcacattgaacgaccttgagttgcccaagcgtgatgaaagttattatgagaaggatagtgagaagaaaggcatcgacatcctcgattaccatttccataaatgtgtgaacgtgcaggaatttgaacagtctagaatcatcaagtttgtcccacttgatgcatgccgttttgagctgatgaggttcaaaacactgtacaatggcgacaacctacccttcagtctgaagtccgtggtcgtagtccagggagcatacgttgaacttcaagcatttgtgaacatggcgtctttagcccagcgctcttcttacgctgggagcctgcgtagctgcgacaatatcagaattcactttcctgttccctctcagtggattaaagcgctgtggacgatgaatctccaacggcagaagagcctcaaggcaaaaatgaataggcgggcttgtttgggctctctccaggaacttgagtctgagcctgttatccaggtgaccgttggaagtgcaaaatacgagtcggcctatcaagccgtggtttggaagatcgatcgtctccccgataaaaactcgagccttgatcatcctcattgcctgagctataagctggaactcgggtcagaccaggaaatcccatccgattggtatccattcgcaaccgtccagttctccgtgcctgatacgtgcgccagccgaaccgaagtccggagtttaggcgttgagagcgatgttcaacctcagaaacacgttcagcagcgagcctgctataacattcagccaaagctatacaggagcgtgatcgaagacgtgatcgagggggttcgcaaccttttcgcagaggaaggtattgaggaacaggttctgaaagacctgaaacagctatgggagacaaaggtcctccaatccaaggcaaccgaggactttttcagaaattctattcaatctccactgttcactctgcagttgccgcactctctgcaccagaccctccagtcgagcaccgcgtccctcgtcatcccagccggaagaaccttgccctcttttacaaccgccgagcttggcacttccaactcatctgcaaactttacattccctggctaccctatacatgtaccagccggggtaacactgcagacagtgtctgggcatctttataaggtcaatgttccaatcatggtcaccgaaaccagcgggagagccggaatcttacagcaccctattcaacaggtattccagcagctggggcagccctcagtgattcagacttccgtgccacagctcaacccctggtcattacaggcgacaaccgagaaatcacagcggatcgaaactgttcttcaacaacccgcaattctaccctccgggcccgtggataggaagcacctggagaatgccacctccgatattctggtgagtcctggaaacgagcataaaatcgttccagaagctttgctgtgccaccaggagtcctcccactacatcagtctgccgggtgtggttttttcaccccaggtcagccagaccaattccaacgtggagagtgttcttagtgggtctgcgtcaatggctcagaacttacacgacgaaagtctgtcgacaagcccacatggcgctttgcatcagcatgtaaccgatatccagctgcacatcctgaaaaatcgaatgtatggttgcgattccgtcaagcagccgcgcaacatcgaggaaccctctaacattcccgtgtccgagaaggactcaaactcacaggtggacctgtcaataagggttactgacgatgatattggagaaatcattcaggtggacgggagcggtgacacttcttctaatgaagagataggaagcacacgggacgctgatgagaacgagttcctgggaaacatagacgggggggacttgaaggtcccagaggaagaggctgacagcattagtaatgaggactccgcaacaaatagcagcgataatgaggaccctcaggtcaatatcgtggaggaagatccgctgaacagtggagatgacgttagcgaacaagacgtacctgacctgttcgacacagataacgtcatcgtttgtcagtacgacaagatccaccggtctaagaacaaatggaagttctatctgaaagacggagtgatgtgctttggaggacgggattatgtatttgcaaaagccatcggagatgctgagtggtag

SEQ ID NO: 30619 - DNA, 3477 bp, Artificial Sequence
  Description of Artificial Sequence: Synthetic coding sequence
atgtgttccacaaaccccgggaagtgggttacatttgacgacgaccccgccgtgcagtccagccagaagtcaaagaattttccactcgagaatcaaggcgtctgtcgacccaacgggttgaaactgaatctacccggccttcgggaatttccctcgggctctagctccaccagcagtactcctctgagcagccccatcgtggatttctactttagtcctggcccacccagcaactctcctctgagcacccctacaaaggatttccccggatttccaggcattcccaaggccggtactcatgtactctacccgattccagagtcgtcatcagattctcccctggccatttctggaggcgagagctcactgctccctacacggcctacctgcttaagccatgcgctactgccatcagaccattcatgcacccacccaacccctaaggtgggactcccagacgaagtaaatccacagcaggccgagtctttgggcttccagtcagatgatctcccacagtttcagtatttccgcgaggattgcgccttttcgagtcctttctggaaagacgagggaagtgactcacattttactcttgatccgcctggctctaagaaaatgttcagttctcggaataaagagatgcctattgatcaaaagtcactgaacaagtgctctctgaactacatctgtgaaaaattggaacatcttcagtcagctgagaatcaggactccctgagatctctttctatgcattgtctgtgcgcagaagagaacgctagtagctttgtgcctcacacactcttcaggtcacagccaaaatctgggtggtcattcatgctcaggatccccgaaaagaagaacatgatgtcctcgagacagtggggacctatcttcctcaaggtgttgcctggggggatcctgcagatgtactacgagcagggactcgagaagcctttcaaagaaatacagctggatccttattgccgattatccgagcccaaagtggagaatttctctgttgcaggaaaaatacacacggtcaaaatcgagcatgtgtcatatacggagaagcgcaaatatcacagtaaaacggaggtggttcatgagccggacatcgaacagatgttaaagctggggtcgactagttatcacgacttcctggattttctaactacagtggaggaagagctgatgaagctgcctgccgtgtcgaagcccaaaaagaattacgaggagcaagaaatctcccttgaaattgtcgacaacttttgggggaaggtcactaaagagggcaagtttgtggaatcagcggtgataactcagatctattgtttgtgttttgtgaacggcaacttagaatgtttccttacactgaatgatctggaactgccgaaaagagatgagagttactatgagaaggactcggaaaagaaagggatcgatatcttggattatcacttccataaatgtgtgaatgtacaggaatttgaacagtctcgtatcatcaaattcgtccccctcgatgcatgtaggtttgaactaatgagattcaagaccctttacaacggagataatctgcccttttcactgaaatctgtggtggtggtgcagggcgcctacgttgagttgcaggcatttgtgaacatggcaagcctggcccaacgctccagctacgctgggtcgctgcggtcctgcgacaatatcagaatccattttccagtgccaagtcagtggattaaggccctgtggactatgaatctgcaaaggcagaagagcttgaaggctaaaatgaaccggcgagcctgcctcggaagcctgcaggagctggagtcagagccagtgatccaggttacagtggggtccgcaaagtacgagtcagcctaccaggcagtcgtgtggaaaatcgaccgactgcccgacaaaaacagcagtttagatcatccccactgccttagctacaaactggagctggggtctgatcaggaaataccatccgactggtacccattcgctacggtgcagttttcggtccccgatacctgtgccagcaggacagaggtgagatccctgggggtggagagcgacgtgcagccacagaagcatgtgcagcagagagcgtgctataacatccaaccaaagctgtacaggtccgtgatcgaagacgtgattgagggtgtgagaaacctattcgctgaagagggaattgaagaacaggtgctcaaggatctgaaacagctttgggaaacaaaggtcttgcagtccaaggcaaccgaggattttttccgcaactccatacagtcccccctgtttacattacagttgccccattctttgcaccagacccttcagagtagcacagcctctctcgtgatccccgccggacggacgttgcctagctttacaacggctgagctcggaacctccaactcaagtgccaatttcacatttcccggttaccctattcacgtgccggctggcgtgactttgcagacggtgagcgggcatctgtataaagtcaacgtgcccattatggtaacggaaacatcaggcagggccgggatcctgcagcatcctatacaacaggtctttcaacagctgggccaaccctccgtgattcagactagcgtgccacagctgaacccatggtcgctccaggcgacgacagagaaaagccagaggattgaaaccgtcctccagcaacccgcaatcctgccttctggccctgttgataggaagcacctcgaaaatgctacatctgatatccttgtgtcccctggtaatgagcataaaatcgtgcccgaggccttactgtgtcaccaagagagctcccattacatcagtctgcctggcgtagtattctcgccacaggtgagccaaacaaacagcaacgtagaaagcgtgctgagcgggtccgcatctatggcacagaatctgcacgacgaatcactgtccacctcccctcatggcgcactgcaccagcacgttactgacatccaactccacattctgaagaacaggatgtacgggtgcgatagcgtcaaacaaccacgtaatatagaggaaccttcaaatatccccgtgagcgaaaaggacagcaacagccaggtggaccttagcattcgggtgaccgatgacgatataggggagattattcaagtagacggatccggtgacacatctagcaacgaagaaatcggctccacacgggatgcagatgagaacgaattcctaggaaatattgatgggggggatctcaaagtgccagaggaagaggctgatagcatttccaatgaggacagtgccactaatagcagcgacaatgaggacccccaagtgaacattgtggaggaggacccgttgaattctggcgacgatgtatcagagcaggacgtccccgatctgttcgatacggacaacgtcattgtttgccagtacgacaagcagggtgatacaagagttcggcacggccagcagtag

SEQ ID NO: 30620 - DNA, 2208 bp, Artificial Sequence
  Description of Artificial Sequence: Synthetic coding sequence
atgtgctctacaaatcccgggaagtgggtgactttcgatgatgatccagccgtgcaatccagtcagaaaagtaagaacttccctctggaaaaccaaggcgtgtgcagacctaatggacttaagctcaacctgcctggactccgcgaattccctagtggttcctcctcaacctcctctacacctttgagctcaccaatagtcgacttctatttcagtccaggccctccgtctaatagccctctatctacccccacgaaggacttccctggttttcccggaattccgaaggcaggcacccacgtcttatacccaatcccagaaagcagtagcgattcaccactggcgatcagcggcggggagagcagtttgctgcccacccgccccacctgcttaagccacgcactgctcccgagcgaccactcatgcacacatccaacaccgaaagtgggcctgcccgacgaggtcaatccacagcaagcggaaagcctgggcttccaatcggatgacctgcctcagttccaatacttccgggaggattgcgccttctcttcccctttctggaaagacgaaggatcagacagtcattttacactggatcctcctggctctaagaagatgttctcatctcgcaacaaggagatgcctatcgaccagaaaagtttaaacaaatgctcattaaattacatttgcgaaaaactcgagcatctgcagtctgctgagaaccaggactccttgagatcactctctatgcactgcctttgtgcagaggagaacgcatcatccttcgtgccacacaccctgttccggagtcagcctaagtcaggttggagcttcatgttgcgcattcctgagaaaaaaaatatgatgtcttcacgtcaatgggggcctatcttcttgaaagtgctgcctggcggaattttgcagatgtattatgaacaggggctggagaagccatttaaggagatccaattggatccctattgcagactgagcgagcctaaagtggagaacttttctgtcgcaggaaagattcacacagtcaagatagaacatgtcagctatactgaaaagaggaagtaccattctaagactgaagttgtccatgagcccgatatagaacagatgttaaagctggggtctacgtcataccatgatttcctggactttctaacaaccgtcgaagaggaattgatgaagctccccgcagtgtcaaagcccaagaagaactacgaagaacaggaaattagcctggagatcgtcgataacttttgggggaaagtaaccaaggaggggaaattcgtggaaagcgctgtgatcacccaaatatactgcctgtgtttcgttaacggtaatctcgaatgcttccttactttaaatgatctggaactgcctaaaagagacgagtcctattacgaaaaagactcagagaaaaagggtatcgacatccttgactaccatttccacaaatgcgtgaacgtgcaggagttcgaacagtctcgaattattaagtttgtcccacttgacgcctgtcgtttcgagctaatgcgctttaagacactgtacaatggagacaatctgcctttcagcctaaagtccgtcgtggtggtccagggtgcctatgttgagcttcaggccttcgttaacatggcctccctggctcagaggtcttcctatgccggctcactgaggtcctgcgataatatccgcatacactttcccgtgccatcccagtggatcaaagccctgtggacgatgaatctgcagagacaaaaaagtctgaaagccaagatgaatcgacgcgcctgtctcggcagcctgcaggagctggagtctgagcctgtgattcaggtgaccgtgggatcagccaagtatgaaagcgcctaccaagcagtggtctggaagattgaccgattgcccgacaaaaacagctcactcgaccatccacattgtctgagttacaagctggagctgggcagcgaccaggaaataccatcagactggtatcccttcgccactgtgcagttctccgttccagatacttgcgcttcccggacggaggtgcggtctctgggagtagaatccgacgtgcagccacagaaacacgtgcagcagcgcgcctgttacaatattcaggttgaaatcgagaagaaatggattaaaattgacggggaggacccagataaaatcggcgactgcattacccagtag

SEQ ID NO: 30621 - DNA, 2208 bp, Artificial Sequence
  Description of Artificial Sequence: Synthetic coding sequence
atgtgtagtactaaccccggcaagtgggtcacgttcgatgatgaccccgccgttcagagttcccagaaatccaagaatttccccttagaaaatcagggcgtgtgcaggcccaacgggctgaagttgaacttgcctggactcagggaatttcccagcggatcatctagtacttcatcaacgcccttaagttcaccgattgtggacttctatttctcgcctgggcccccttctaactcacctttgtctaccccaactaaagattttcctgggtttcccggcatccccaaagccggtacacacgtcctgtaccctatccctgagtcaagcagcgactcccccctggctatctccggcggcgaatcaagcctcctgcccacacggccaacgtgtctgtcccacgccttgctcccatccgatcacagctgcacccaccctacacccaaggtggggctaccagacgaagtcaatccccagcaggctgagagcttggggttccagtcggacgatctgccacaattccaatattttagggaggattgcgcgttcagctcgcctttctggaaggatgagggtagcgacagccactttacactggacccccctggtagcaagaaaatgtttagcagtagaaacaaggagatgcctatcgatcaaaaaagtctgaataagtgttccctgaattacatttgcgagaagctcgagcatctacagagcgcagaaaaccaggactcgctgcgctcactgtccatgcactgtctgtgtgccgaggagaacgcttcttctttcgtcccgcatactctatttaggagccagcccaaaagcggttggtcatttatgttaagaatccctgaaaagaaaaatatgatgagttcccggcagtggggccctatttttttgaaagtcctgccaggaggaattttgcaaatgtattacgaacagggccttgagaagcctttcaaagagatccagctggacccatactgccggctctcagaacctaaggtggagaatttttccgtggcaggaaagatccacacggtgaagatcgagcacgtctcttacacagagaagaggaagtaccacagcaagactgaggtggtccacgaacccgacattgagcagatgctgaaacttggaagtaccagctatcatgacttcctagattttttaactactgtggaggaagaactcatgaagttgcctgccgttagtaagccgaagaagaattatgaggaacaggaaatctcgctcgaaatcgttgataacttttgggggaaggtgacgaaggagggaaaattcgtggaaagtgccgttatcacacagatatattgtctctgttttgtaaacggtaatttggagtgtttcttaacactcaatgaccttgagctgcctaagcgcgatgagtcctattatgaaaaagactcggagaagaagggtattgacattctggattatcattttcacaagtgcgtgaacgtgcaagagttcgagcagtcgaggattattaagttcgttcccctcgatgcctgccgcttcgagctcatgcgttttaagaccctctacaacggagacaaccttcctttctccctcaagtccgtggttgtcgtacaaggcgcttacgtcgagcttcaggcctttgtgaatatggcttccctcgcacagcgctccagctatgcgggctcactgaggtcctgcgataacatccgtatccatttccctgtgccctctcagtggattaaagccttgtggactatgaatctccagaggcagaaaagtctgaaggctaagatgaacagacgggcctgcctgggttcccttcaggagcttgaaagcgagccggttatccaagtaacggttggttctgctaagtatgagtcggcctatcaggccgtagtctggaagattgatcgtctgccagacaagaactccagtttggatcatccacactgtctgagctataaactggaactgggctccgaccaagagattccctccgattggtatccctttgccaccgtccaattttctgtccctgatacctgtgccagccgcaccgaagtaaggagcctgggagttgagagcgatgtgcaaccacagaaacacgttcagcagagggcttgctataacatacaggtcgagatcgagaagaaatggataaaaatcgacggggaggatcctgacaagattggggattgcatcacccagtag

SEQ ID NO: 30622 - DNA, 2208 bp, Artificial Sequence
  Description of Artificial Sequence: Synthetic coding sequence
atgtgttcgaccaatcctgggaagtgggtgaccttcgatgatgatcccgccgtgcaatcttctcagaaatctaaaaattttccgcttgaaaaccaaggcgtctgccggccaaatggtttgaagttaaatcttcctggtctgcgtgaattcccctccggaagcagctccacttcatcgacaccactttcctccccaatcgttgacttttacttctctccagggcccccatctaactcccccctctcaaccccaacaaaggattttcccggtttcccaggcattcctaaggctgggactcacgtcctgtaccccataccggaatcttcctctgactccccgcttgccattagcggcggggaaagctctctcctgccaacaaggcctacatgtctctcccacgccctgctcccatctgaccactcatgtacccacccaacaccaaaggtaggactgcctgatgaagtgaaccctcagcaggccgagtcactaggctttcagtccgatgacctcccgcagtttcagtattttagagaggactgcgctttctccagcccattctggaaggatgaggggagcgattcccatttcacactagatccacccgggtcaaagaaaatgttctcaagtaggaataaggagatgccaatagaccagaaaagtttaaataagtgctccctgaattatatttgcgagaaactggagcacttgcagtccgctgagaatcaggactccctccggtctttatcaatgcattgcctctgcgctgaggaaaacgcatcatcctttgtgccccacactcttttccggagccaacccaaatccgggtggtctttcatgctccgaatcccagagaaaaaaaatatgatgtcttctcgccagtgggggccaattttcttgaaggtgctgcccgggggaatcctacaaatgtactacgagcaaggtctggaaaaacctttcaaggaaattcagctggatccctactgcaggctcagcgagccaaaggtggagaatttctctgttgccggcaaaatccacaccgtgaagattgagcatgtgagctatacggaaaaacggaaatatcactcgaaaacggaggtcgtccatgaacccgatattgaacagatgctcaagttgggatccacttcttaccacgattttctggatttcctgaccacagttgaggaggagctcatgaagctccctgctgtatcaaaacctaaaaagaactatgaggagcaggagatttccctggagatcgtggataacttttggggcaaagtaactaaagagggaaagttcgtcgagtcggccgtgattacacagatctactgtttatgctttgtcaacggcaatctggagtgcttccttactctcaacgacctggagttacccaagagagatgagtcttattacgagaaggattccgaaaagaaaggcatcgatatacttgattatcatttccataagtgtgtgaacgtgcaggagtttgagcagagccgaataattaagtttgtgcctctagatgcttgccgttttgaactgatgcggtttaagactctgtataatggggataacctgccctttagcctcaaatccgtggtcgtcgttcaaggggcgtacgtggagttgcaggctttcgttaacatggctagccttgcacagcgatcctcctacgccggctccctccggtcttgcgacaatattcggatacactttcccgtgccgtcccagtggatcaaggcgctgtggacaatgaatctacaaaggcaaaagtctctgaaagctaagatgaaccgacgggcctgcttgggctctctccaggagctggaatccgagcctgtgatccaggtaaccgtgggatccgctaaatacgagagcgcctatcaggccgtggtgtggaagattgaccgactccctgataagaacagttcactcgatcacccgcactgtctctcatataaactcgagctgggttccgaccaggagatccctagcgattggtatcccttcgcaacggtccagttctcagtgcccgacacgtgcgcatcacgcacagaggtgagaagcctcggtgtcgaaagtgacgtgcaacctcaaaagcatgtgcagcagcgtgcctgctataatatacaggtggaaattgagaaaaagtggatcaagatcgatggggaagaccccgataaaataggcgattgcattacccagtag

SEQ ID NO: 30623 - DNA, 2718 bp, Artificial Sequence
  Description of Artificial Sequence: Synthetic coding sequence
atgaccacactggaccatgtgattgccacacaccaatccgagtgggtatctttcaacgaggaaccgccctttcctgctcatagccaaggggggaccgaggagcaccttccagggttatcctcaagcccagatcagagcgagtcaagctccggcgagaatcatgttgttgacgggggctcacaggatcactctcactccgagcaggatgactcttccgagaaaatgggattgatttcagaggcagcttcacccccaggttcacctgaacaaccgccgccagacctggcaagtgctatctcaaactgggttcagttcgaagatgacaccccttgggcatccacttcacctcctcatcaagaaaccgcggagacggccctgcccctgacaatgccatgttggacgtgtcccagttttgatagccttggccgctgtcctctgaccagtgagtccagctggaccacccactcggaggacacttctagcccctctttcggctgttcatacacggatcttcagttgatcaacgcggaggagcaaacctctggacaggcgtctggcgcagactctactgacaacagctcgagcctgcaggaggacgaggaagttgagatggaggccatctcgtggcaggcctctagcccagccatgaacggtcaccccgcccccccagtaacgtccgcaagattccccagctgggtgacttttgatgataacgaggtcagttgtccgctgccaccggtgacctcccctctgaagcccaacacaccaccttccgcgtcagtgattccagacgtgccatataactctatgggatcttttaagaaaagggatcgcccaaagagtaccctgatgaatttctcaaaggtgcagaaactggatataagcagcctgaaccgaactccctccgttacagaggcaagcccatggagagcaactaatcctttcctcaatgaaaccctgcaggatgtgcaacccagtcccatcaatccatttagcgctttcttcgaagagcaagagcgcaggtcacagaacagtagtatcagctcgacaactggcaaatcccagcgcgacagcctgatcgtaatctatcaggatgctattagcttcgacgactcgtccaagacacagagtcactccgacgcagtggagaaactcaaacagctccagattgacgacccagatcacttcgggagcgctacgcttccagatgacgaccccgttgcatggatcgaactcgacgcccatcccccaggaagtgcacgatcacaacccagagacggctggcctatgatgctgagaattcctgaaaaaaagaatattatgtccagcaggcactggggtcccatattcgtaaagctgacagatacaggttatctccagctgtattatgaacaaggcctggaaaagccatttcgagagttcaagctggagatctgccacgaaatctctgagccacgtttgcagaattacgatgagaatggacgcatacattccctccgcatagaccgcgtgacttataaggagaagaaaaagtatcagccaaagccagcagtcgcccacaccgcagaacgcgaacaggtcatcaagctgggaactacaaattatgacgacttcctgagttttattcacgcagttcaggacaggctaatggacctcccagtgctgagtatggatctgagtacggtcgggctaaattatctcgaggaggagatcaccgtggacgtgcgagatgaattctccgggatcgttagtaaaggggataatcaaattttgcagcaccacgtgctgacaaggatccatatcctatccttcctgtctggcttggcggagtgtcgactgggcctcaacgatatcctggtcaagggcaacgagatcgtgctccggcaggacatcatgcctacgacaactaccaagtggatcaagttgcatgagtgtagattccatggctgcgtggatgaagacgtctttcataactcaagggtcatattgtttaacccactggacgcttgtcggtttgagctgatgagattccgaaccgtctttgcggagaagaccttgcctttcacattgcggaccgcaacatcagttaacggcgccgaggtggaggtgcagagctggcttcgaatgtcaaccggcttttccgctaaccgcgaccctctgacccaggttccttgtgaaaatgtgatgatacggtacccggtgcctagcgaatgggtgaaaaacttccggcgggagagtgtattgggagaaaagtcactgaaagctaaggttaatcggggggctagcttcggaagcacatccgtcagcgggtccgaacccgtaatgcgggtaaccctggggaccgcaaagtacgagcatgcctttaactcgattgtttggcggattaataggctccccgataaaaatagtgccagcggccatccacattgctttttttgccatcttgagctcggaagtgacagagaggtgccaagtagattcgcaaaccatgtgaatgtggaattctccatgcctacgacctcagcatcaaaagctagcgtgaggtcgatctcggtggaagataagactgatgtacggaagtgggttaattatagcgcacattattcctatcaggtggcattaggttctatctggctcatgctgcctaccccgtttgtccacccaacaaccctgcctttgctgttcctgctcgctatgctcactatgttcgcctggtag

SEQ ID NO: 30624 - DNA, 2799 bp, Artificial Sequence
  Description of Artificial Sequence: Synthetic coding sequence
gggcagcaatgcgaagatgatcaatgtcttttttccatgaccacattggaccatgtgattgccacccaccagtccgaatgggtctctttcaatgaggagccaccctttcccgcacactctcagggcggcacagaggagcatctgcccggactgtcctctagccccgatcagtcggagagctcatcaggagaaaaccatgtggtggatgggggctcccaggaccattcgcacagtgaacaagatgattcctccgaaaagatgggactgatctcggaggcggcaagtccacccggctctcctgagcagccacctcctgacctggcatcagctattagtaactgggtccagttcgaggacgacaccccatgggcttccactagccctccgcaccaggaaacggcggaaacagcgctgcctctgacaatgccgtgctggacttgtcccagctttgattctttgggaaggtgccctctcacctctgagagctcctggacgactcactctgaagacacgagctccccaagcttcggctgcagctacaccgacctgcaactgatcaatgccgaggagcagacctcaggacaggcgagcggcgcagactcgacagacaacagctcctctctgcaggaagatgaagaagttgagatggaagcaatatcttggcaggcctcgagtccggctatgaacgggcacccagcgcctcccgtcacgtccgcacggtttccctcctgggtgacctttgatgataatgaggtgagttgtcctttgcctcccgtaactagcccgcttaagcccaacacaccgccctctgctagtgttatcccggatgtgccgtacaattccatgggatcctttaagaaacgtgataggcccaagagcactctgatgaacttcagcaaggtccagaaactggatatttcatctctaaaccgcacccccagtgtcacggaagcaagtccctggagagccacgaacccgtttctcaacgagaccctccaggatgtacaaccatctcccatcaaccccttcagtgcattttttgaggagcaggagcgcagaagtcagaattcttccatttcatccacaacgggtaagtcacaaagagacagccttatcgtgatctatcaagacgcaatctcctttgatgacagctctaagacccaaagccactccgacgccgtagaaaaactgaaacagcttcagattgatgatcctgatcactttgggtcagccacacttccagatgatgacccagttgcatggattgagctggatgcgcacccacccgggtcagcccggtcccagcccagagacggctggccaatgatgctaagaattccagaaaagaagaatattatgagttccaggcactggggccctatatttgtgaaactgaccgataccggctatttgcagctctactatgagcagggattggaaaaaccctttcgggagttcaaacttgaaatttgtcatgaaataagcgagccgaggctccaaaactatgacgagaatgggagaatacatagccttcggatcgacagggtaacatataaagagaagaagaaatatcagcctaaaccagccgtggctcatactgctgagcgagaacaggtgataaagctggggaccaccaattatgacgacttcttgtcatttatacatgcagttcaggaccgcctcatggacctgcccgtcctgagtatggacctcagcaccgtcggattgaattacctggaagaggagattactgtggatgtgcgggacgaattcagtggcatagtatccaaaggcgataatcaaatcctccagcatcacgtgctaacaaggatacacatccttagctttctttccgggctggcagaatgccgcttggggttgaacgacatcttggtgaagggcaatgagatcgtcctaagacaggatatcatgcctaccactacgactaagtggatcaagttacacgagtgtcggttccacggttgtgtcgacgaagatgtctttcataattcacgtgtgatactgttcaaccccctggacgcctgtcgcttcgaacttatgcgcttccggacagtgttcgctgagaagacattgccattcaccttaaggactgctacttcagtcaacggagcggaggtagaggttcaatcatggctccgcatgtctactggcttctccgctaacagagaccctcttactcaagtgccctgtgagaatgttatgattagatatccggttccctccgagtgggtgaaaaacttccgccgagagtcagtacttggggagaagagcttaaaagccaaggtcaacaggggtgcgagttttggctccacttcggttagtggcagcgaacctgttatgcgggtgacattggggaccgctaaatatgaacacgccttcaactctatagtgtggcgaattaatagactgccagataaaaattcagcttccggccacccgcactgcttcttttgtcacctggagctgggctcagatagagaggttccgtccagattcgccaaccatgtgaacgtggaattttccatgccaacaacatcagcatccaaagcctcagtcaggtccattagcgtggaggataagactgacgtgagaaaatgggtcaactactccgcccattactcataccagacaactgagactgacaatttgcccaaccccctgtactgcagctgcctcccacatactgatctcaaacggggatccaagcgcgttgttaagatccgctggaatgcctcactagaagtgccattggcaagctctatccggacaatggtgtag

SEQ ID NO: 30625 - DNA, 12 bp, Artificial Sequence
  Description of Artificial Sequence: Synthetic coding sequence
atgacaacctag

SEQ ID NO: 30626 - DNA, 153 bp, Artificial Sequence
  Description of Artificial Sequence: Synthetic coding sequence
atgactaccctagaccacgtcattgctacccaccagtctgagtgggtctcattcaatgaggaaccacccttcccggctcactcccaggggggaaccgaggagcaccttcccgggttgagctcaagtccagatcagtccgaatctagcagctag

SEQ ID NO: 30627 - DNA, 2763 bp, Artificial Sequence
  Description of Artificial Sequence: Synthetic coding sequence
atgacaacactcgatcatgtcatagcaacccatcagtctgaatgggtcagttttaacgaggagccaccatttcccgctcattcccaggggggcacggaagaacatctacctggactgtcatccagtcctgaccagagcgaaagtagcagtggcgaaaaccacgttgtggacggaggttcacaagatcacagccacagcgagcaggacgactcttccgaaaaaatggggctgattagcgaagccgcttcgcctcccggctctcctgagcagcccccccctgatttagcctccgctatctccaactgggtacaatttgaggatgatactccctgggcctctacttctcccccacaccaggaaactgctgagacagcgctgcccctgactatgccctgctggacgtgcccctccttcgatagcctgggcaggtgcccactgacgtctgaatcgagttggaccacccacagtgaagatacctctagcccatcgttcggctgcagctacaccgacctgcagttaatcaacgcagaagagcagacgagtggccaggcaagcggggccgatagcacagacaatagcagttcccttcaagaggacgaagaggtggagatggaggcgatctcctggcaggccagttcccctgccatgaacgggcatccagcccctccagtgacttccgcccgttttccctcatgggtcacatttgacgataacgaggtgtcctgccccctccctccagtgaccagtccattgaagcctaacacacccccttccgcgtcagttatcccggacgtaccttacaattccatggggagttttaaaaaaagggataggcccaaatccaccctaatgaatttcagcaaagtccagaagctggatatatcctctctaaaccgtactccctcggtcactgaggcatctccttggagagccaccaatccattcctgaatgagactctccaagatgtgcagcccagcccgattaaccccttctccgccttcttcgaggagcaagaacgtcgcagccaaaactcatctatcagcagtaccaccggcaagagtcaaagagactcattgattgtgatctatcaggacgcaatcagctttgacgactctagcaagactcaaagccactcagatgccgtggagaagctgaagcaacttcagattgatgaccccgatcacttcgggagtgctactctcccagatgatgacccagttgcatggattgagttggacgcgcaccctccagggagcgccagatcacagcctagagacgggtggccgatgatgctgaggattcctgaaaagaagaacatcatgagcagcaggcactggggccccatattcgtgaaactgacggatactggctacctccagctgtactatgagcaggggctggagaagcccttcagagagttcaaactcgaaatatgccatgagatcagcgaacccagacttcaaaactacgacgagaatggacgcatacattccttgaggatcgacagggtgacatataaggagaaaaagaagtaccagcctaagcccgcggtcgcccacacagctgagagggagcaggtcatcaagctaggaaccactaactacgacgattttttaagctttattcatgccgttcaggatcgactgatggacttaccagttctgagcatggatctttctaccgtaggtctcaactacctggaagaagagattaccgtcgatgtgagagatgaatttagtggaattgttagcaaaggcgacaatcagattctccaacaccacgtcctgaccaggattcatattcttagcttcctgagtggtctggcagaatgccgcctggggttgaacgacattttggttaagggcaacgaaatcgtgctgcggcaggacatcatgcctaccacaacaactaaatggatcaagctgcacgagtgtagatttcatggttgcgtggacgaggacgtttttcacaattcacgggtgatcctgttcaacccccttgatgcgtgtaggttcgaactgatgcgctttaggacggtgtttgcagaaaaaaccctgcccttcacattgcggactgctacttctgtgaatggagccgaagttgaagtgcagtcctggttaaggatgtccaccggattctcagcaaatagagaccccctgacacaggtgccttgcgaaaatgttatgatcagataccctgtcccctccgagtgggtgaagaattttcgacgggaatctgtgctgggtgagaagtctttaaaagccaaagtgaacagaggagcctcttttggctctacctctgtcagtggctctgagcctgtgatgcgagtgacactgggaacagcgaagtacgagcatgcgtttaactccattgtgtggaggatcaatcgcctgcccgacaagaattccgcctctgggcatccccattgcttcttctgccaccttgaactaggaagtgatcgggaagtgccctccaggttcgcaaaccatgtaaacgtggaattctcaatgcctactacctccgcatctaaggcgagcgtgcgctcaatctctgtggaagataaaactgacgtaagaaagtgggtgaactactccgcccactattcctaccagactactgaaaccgacaatttgcctaacccactctactgctcttgtctgccgcacaccgatcttaagcgagggagcaaaagggtcgtgaaaataagatggaatgcctcgcttgaggtgccgctcgcctcatccattcgcactatggtatag

SEQ ID NO: 30628 - DNA, 441 bp, Artificial Sequence
  Description of Artificial Sequence: Synthetic coding sequence
atgtggccagctccatgctccgtaggccgcttgctgatttttttcatgtgctcctcaagtggttacgttgtgcaggggtgtggtccgtctccaggagcccgcacaacactggggtccccgctttcactgtggtctatcaaaacccctagccatattttttgcactaggcgggcgatcaacctggggttccctagtcccccgctcgttcagctgattttttggtcgcttaatgctggcttagatctctacttgtgtcttatatcctcatgtgggttctcacaggtgttctggcctgttgaggctttctgctccttctcgctcagttttttcgccctcgccttatcccacaagtttgttatatgcagacttgaccaacacatcttttctggatttaccaaatctctcaagaacctgccgccctgtcaccgaaccgatatctag

SEQ ID NO: 30629 - DNA, 201 bp, Artificial Sequence
  Description of Artificial Sequence: Synthetic coding sequence
atggttgcgaagcagaggatacggatggccaacgagaagcactctaagaacattacccaaagagggaatgttgctaaaacttcaaggaacgccccagaagagaaggcgtccgtgggaccttggctgctcgccttgttcatcttcgtggtttgtgggagcgctatttttcagatcattcagtcaatacgcatggggatgtag

SEQ ID NO: 30630 - DNA, 201 bp, Artificial Sequence
  Description of Artificial Sequence: Synthetic coding sequence
atggtggctaagcagagaatacggatggccaacgaaaagcactctaagaacatcacacagcgcggaaacgttgccaaaacgagcaggaatgcccctgaagaaaaggcctctgtgggcccatggttgcttgccctattcatcttcgtagtgtgtggctcggccattttccaaattatccagtctattcgaatgggcatgtag

SEQ ID NO: 30631 - DNA, 198 bp, Artificial Sequence
  Description of Artificial Sequence: Synthetic coding sequence
atggttgctaagcaacgcatcaggatggccaacgagaagcactccaagaacataacccaacgaggaaatgttgcgaagacgcttaggccccaggaagaaaagtaccctgtgggtccttggctcttagcattgtttgtctttgtcgtgtgtggttccgctatcttccaaattattcagagcatccggatggggatgtag

SEQ ID NO: 30632 - DNA, 2343 bp, Artificial Sequence
  Description of Artificial Sequence: Synthetic coding sequence
atggacgagcaggccgggcctggggtgtttttctccaataatcaccccggagctggaggtgccaaaggcctgggcccactcgccgaagcagctgccgccggcgatggagccgccgccgccggggctgcgagagcccaatacagcctgccagggattctgcattttctccagcacgagtgggcaagatttgaggttgaacgggcccagtgggaagtagaacgggcggagttacaggcccagatcgctttccttcagggcgaaagaaagggacaagagaacctgaagaaggatctggttagacgcataaaaatgctcgagtacgccctcaagcaggagagagcaaagtatcacaagctcaagtacggcacagagcttaaccagggtgatatgaaaccgcccagctatgactctgatgaaggcaatgaaacagaagtgcagcctcagcaaaacagtcagctgatgtggaagcagggtcggcagttgctgcggcaatacctacaagaggtggggtacactgacaccatcttagacgtgaagagcaagagggtgagagctctcctgggcttttccagcgatgtcaccgatcgagaggatgacaagaatcaggattcagttgtcaatggaacagaggctgaggtcaaagaaaccgcgatgattgctaagagcgaactgacagattccgccagcgttctagacaattttaagttccttgaatccgctgcggctgatttcagcgacgaggatgaggacgacgacgtggatggaagggagaagtccgttatcgatacaagcacgatcgtccgaaagaaggccctcccagactctggagaagacagggacactaaagaggctctaaaagaattcgactttctggtaacatctgaggagggtgacaatgaaagcagaagcgctggggatggaacagattgggaaaaagaggaccagtgtctgatgcccgaagcttggaatgtggatcaaggtgtgatcacaaaactcaaagagcagtataaaaaagaacgcaaggggaaaaagggtgtgaaacgcccgaatcgcagcaaacttcaggacatgttagccaacctgagggatgtcgacgagctgccgagtctccagcctagtgtcggcagccctagccgccccagcagcagccggttacccgagcacgaaattaaccgtgccgacgaagtcgaggctctgacatttccaccatcgagcggaaagtctttcattatgggtgccgacgaggccctggaatctgagttgggcctgggagaattggctggcctgacagtggcgaatgaggcagacagtctcacatacgatattgctaataataaggatgcccttcggaagacctggaatccaaagttcactttgcggagccatttcgacggcattcgcgcactggccttccaccccatagagccagttcttataacggcctcggaggatcacactctgaaaatgtggaacctgcaaaagaccgctccagcgaagaagtccactagcttggatgtggagcctatctatacttttcgcgctcacaagggaccagtgctatgcgtcgtcatgtcttccaacggcgaacagtgctattcaggtggtacagacggactgattcaaggatggaataccacaaatccgaacatagacccttatgactcctacgatcctagtgtgttgcgtggaccactcctgggccacactgatgccgtgtggggcctagcatactccgcagcccaccagagacttctgtcgtgctctgcggatggcaccctgagactttggaacaccaccgaggtggctccggctctctccgttttcaacgacaccaaagagctgggtattccagccagcgtagaccttgtttcttccgatccgtcccatatggtcgcgagttttagtaagggttacacatccatcttcaacatggaaacacagcagcggattctaactctagagagtaacgtcgatactaccgctaactcctcctgtcaaataaaccgggtgatctcacaccccactctgccaatctctatcactgctcatgaggatcgacacatcaagttttatgataacaacaccggcaaactcatccactctatggttgcccaccttgaggccgtgacttccctcgccgttgaccctaacggattgtatttgatgtctggcagccacgactgcagcatcagactgtggaacctggaatctaagacctgcattcaggagtttaccgcgcaccgtaaaaagtttgaagagtcgatacacgatgtcgcatttcacccatccaaatgctacatcgccagcgctggagccgacgcccttgctaaggtgttcgtatag

SEQ ID NO: 30633 - DNA, 2196 bp, Artificial Sequence
  Description of Artificial Sequence: Synthetic coding sequence
atggatgaacaggccggccctggcgtttttttttccaataaccatcccggcgctggcggagcaaagggcctcggcccgcttgccggcgccgcaagggcacagtatagcctgcctggcattctgcattttctgcaacacgaatgggctcgtttcgaggtggaacgggctcagtgggaggtcgaaagggctgagctgcaggcccagatagcattcttacagggcgagaggaaaggccaagagaatctgaagaaagacctcgtgagaagaatcaagatgctcgagtacgccctgaagcaagaacgcgcaaaatatcacaagttgaaatacggaaccgaactcaatcaaggtgatatgaagcctccctcttacgactcggatgaggggaatgagacagaggtccagccacaacaaaacagtcagctcatgtggaagcagggccggcagcttctgcgacagtacctccaggaggtcggatacactgacactatcttggatgtgaaaagcaagagggtgagggccctgttaggctttagtagcgacgtgaccgacagagaagacgacaagaaccaggactcagtagtcaatggaacggaggcagaagtcaaagaaactgcgatgattgccaaatctgagctgactgactccgcttcagtcctggataactttaaattcttggaatcggccgcagccgattttagcgatgaggacgaggatgacgatgtggatggaagagagaagagtgttatagacacatctacaatcgtgagaaagaaagctttgccagattcgggcgaagatcgagacaccaaagaggccttaaaggaattcgactttttagtgacatccgaagaaggcgataatgaatcaagatccgctggcgacggcacagactggggtcccaatagaagtaaactgcaagacatgctcgcgaaccttagggatgtggatgagctcccgagcctgcaaccatcagtcggcagcccatcccggccctcttcttctcgattacccgagcacgaaattaatagagctgacgaggtagaggctctgacttttccaccctcaagcggaaaatctttcatcatgggagccgatgaggcacttgagagcgaacttgggttgggtgaactggctggactcactgtcgccaacgaggcggacagcctcacctacgacattgccaataataaggatgcactcaggaaaacatggaaccccaaatttactctgaggtcacacttcgacggcatccgggccttagctttccatcctatcgaaccagtgttaatcacagcctccgaggaccacactctgaaaatgtggaatcttcaaaagaccgcccccgccaagaaatccacttctctcgacgttgagcctatctacaccttccgcgcgcataagggcccggtcctgtgcgtagtaatgtcaagtaatggggagcagtgctattcaggcggtaccgacggtctgatacagggttggaacactacaaaccctaacatcgatccctacgatagctatgacccttccgtgctgcgcgggccccttctgggtcatacagacgctgtctggggactggcctacagtgctgcccatcagaggttactgagttgcagtgccgacggcaccctgaggttatggaacactactgaagtcgctcccgcactatcagtgttcaacgacacaaaggaactcggaattccagcatcagtggaccttgtgagttctgacccctcacatatggtggcctcattctctaaggggtacacctccatcttcaacatggagactcaacagaggattcttaccctggagtcaaatgtggacactaccgcaaacagctcgtgccagataaatcgggtgatctcacatcctactctgcctatcagtattaccgcacacgaagacagacacatcaaattttatgataataatactggaaagcttatccacagtatggttgctcacctggaagccgtgacctctctggcagtcgacccaaatggattgtatttgatgtcagggtcccatgactgctcgattcgcctgtggaacctggaatccaaaacttgcatccaggagttcaccgcccaccggaagaagttcgaagaaagcatccatgatgtggcctttcacccgtcgaagtgctatatcgcaagcgccggggccgatgctcttgcaaaagtattcgtgtag

SEQ ID NO: 30634 - DNA, 2268 bp, Artificial Sequence
  Description of Artificial Sequence: Synthetic coding sequence
cgaccgccttggacttctcgccgcgtgcccgcttcctcctcagccaccaccaccagggcacagtacagcttgccggggatcctgcacttcttacagcacgaatgggctcggtttgaggtggagcgcgcccaatgggaggtggagagagctgagctgcaagcccagattgcctttctgcagggggaacggaagggccaggaaaatttaaaaaaagatttggtgagacggatcaagatgcttgagtatgccttgaaacaagagcgcgccaagtaccacaagctaaagtatggcacagagctgaatcagggagacatgaaaccccctagttatgacagtgacgaggggaatgaaacagaggttcagccccaacaaaattcacagttgatgtggaagcagggaaggcagcttctgagacaatatctccaggaggtcggatacacggacaccatcctggacgtgaagtctaaaagagtgagggctctcctgggattcagcagtgatgttacggaccgtgaggacgataagaatcaggatagcgtggtgaatggaacagaggcggaagtaaaggagaccgctatgatcgcaaagtcggaactgactgattccgccagcgtcctggataattttaaattccttgagtccgccgcagcggatttttctgatgaggacgaagatgacgacgttgacggccgggagaagtcagtgatagacacaagcacgattgttcggaagaaagcgcttccagactccggcgaagatcgggacactaaggaagcactgaaggagtttgacttcttggttacttccgaagagggcgacaacgaatcccggtcagcgggtgacggaacggattgggaaaaggaggaccagtgccttatgcctgaggcgtggaatgtggaccagggggtgataacgaagctgaaagaacagtataagaaggagagaaagggaaagaagggcgtgaagcgcccaaaccggagtaagctgcaggatatgctcgccaatctgagggatgtggatgagttgccttctctccaaccatcggtcgggtctcccagtcgaccttcgagtagtcgactgcccgaacacgaaattaaccgcgccgacgaggtggaggcactgactttccctccttccagcggcaaatcctttatcatgggagcagatgaagctctggagagcgagctgggcctgggggaactcgccgggctgactgtcgctaatgaggccgactcgcttacctatgacattgcaaataacaaggatgctctccgaaaaacatggaatcctaaatttaccctacggtcccacttcgacgggatccgggcgttggcctttcacccaatcgaacccgtactcataaccgcttctgaagaccataccctcaagatgtggaacctgcagaagacagcacctgcaaagaaaagcacgtctctagacgttgaacctatatacactttccgggctcacaagggaccagtgttatgcgtggtcatgagcagcaatggggaacagtgctattcaggtggcaccgatggcctaatccaaggatggaacactacaaaccccaacattgacccttacgatagttacgacccatccgtgctcagagggccactcttaggccacaccgatgcagtgtggggtctggcctactccgccgcccatcaaagattgttaagctgtagcgctgacggaaccctccggctgtggaataccaccgaagtagcccctgctttgagcgtgtttaatgacacgaaagagctgggaatccctgccagcgtggacttggtcagctctgatccgagtcacatggtggcgagcttctccaagggatatacttctatcttcaacatggagacccaacagaggatccttaccctggagtcgaacgtcgataccacagcaaacagctcttgccaaatcaatagagtcatcagccaccctacacttccgattagcattacggcccacgaggacaggcatatcaagttctacgataataatacagggaagcttatccattctatggtcgcgcatctggaggcggttacaagcctggccgtcgaccctaacggtctttacctgatgtccggaagccacgattgttctattcgcctgtggaacctggaaagcaagacctgtattcaggagtttaccgctcatcgcaagaaattcgaagaaagcatccacgatgttgctttccatccctcgaaatgctatatcgcatctgcgggcgccgacgcactcgccaaggtgtttgtgtag

SEQ ID NO: 30635 - DNA, 2142 bp, Artificial Sequence
  Description of Artificial Sequence: Synthetic coding sequence
atggacgagctggccggaggcggcggtggcggcccaggcatggccgcgccacctaggcaacagcagggtcccggcgggaatctgggcttatcccctggaggcaatggggcagccgggggcggcggcccccccgccagtgaaggggctggacctgccgctggaccagaactctcccggcctcagcagtacacaatcccagggatcctgcattatatccagcatgagtgggcccgtttcgagatggagcgagcgcattgggaggtggagcgggccgagctgcaggcccgcatcgcttttctgcagggagagcgcaagggacaggagaacctgaaaaaggatctggtccgaagaatcaagatgctggagtacgcactgaagcaggagagggcaaaatatcacaagctgaaatacgggacagagctgaaccaaggagatttgaagatgcctacctttgaaagcgaggaaactaaggacactgaagctcccactgctcctcagaatagccaactcacctggaagcaaggccgacaacttttgagacagtatttgcaggaggtcggatacacagatacaattctggacgtgaggagccagagagtaagatcactcctgggactgagcaactcagagcctaacggatcagtggagactaaaaacctggagcagattctgaacggcggcgagagcccgaagcaaaaagggcaggagatcaagcggtcatccggggacgtgctggagacctttaatttcttagagaatgctgacgactctgatgaagatgaggagaatgatatgatcgaagggatccctgaggggaaagacaagcaccgaatgaacaaacacaaaattggtaacgaaggccttgcagccgatctcactgacgatcccgacaccgaagaagctctgaaggaattcgacttccttgtgactgcagaggatggagagggggccggcgaggctcgcagctccggcgacggaaccgaatgggctgagcctatcacttttccatccgggggaggtaagtcatttattatgggtagcgatgacgtcttgctcagtgtactaggcctaggtgacctcgcagatcttacggtaaccaacgatgctgactactcctatgatctgccggctaacaaggatgcctttcgaaagacatggaatcccaaatatactctccgctctcacttcgatggagtccgcgcactggctttccaccccgtggagccggtgctcgtaacagcttcagaggaccacactctgaagctgtggaatctgcaaaaaactgtgcccgcaaaaaaaagcgcttcactggatgtggaacccatctacacattccgagcgcatatcggacctgtcttgtcgctcgctataagctcaaacggcgaacagtgcttcagcggtggaatcgatgccactatccagtggtggaatatgccatcgccatctgtggacccttatgacacctacgaacccaatgttctcgcgggtaccttggtcggccataccgacgccgtctggggcctggcctatagtggcatcaagaaccagctgctgtcttgcagcgccgacggcacagtccgactgtggaatccccaggagaaactgccttgcatctgcacttacaatggcgacaaaaagcacgggattcccacctctgtggattttattggttgcgaccccgcacacatggtaacctccttcaacactggatcggctgtcatctacgacctggagacatcacagtcactggtgattcttagcagtcaggtggacagcggcctgcagagcaacaaccacattaatcgcgtcgtgagccatcctaccttgcccgtcaccattaccgcacatgaggatcggcacatcaagtttttcgataataaaactggaaaaatgatccatagcatggtggcccatctggatgccgtgacttccctcgcggtggatccaaacgggatttatctcatgtccgggagccatgactgctctatacggctctggaatctggattcgaaaacatgtgttcaggaaatcaccgcgcatcgtaagaagttggacgagagcatctatgatgtggcctttcatagttccaaagcatatattgcatcggcaggcgccgacgcgctggccaaggtattcgtatag

SEQ ID NO: 30636 - DNA, 2394 bp, Artificial Sequence
  Description of Artificial Sequence: Synthetic coding sequence
atggacgaactcgctggcgggggcggtgggggccctggcatggccgcacctccaagacagcagcagggccccggtggcaatctgggactatcaccaggcggaaacggcgctgcaggaggaggtgggccaccagcgtcagagggagccggccccgctgctggcccggaactttccaggcctcaacagtacaccataccagggattctgcactatatccagcatgagtgggcacggttcgagatggagcgggctcactgggaggtggaaagagcagagctgcaggcccgcatcgcttttctccagggagagaggaagggtcaagaaaatctgaagaaggacctcgtaaggcgcattaaaatgctcgagtacgccttgaagcaagagcgggcaaaataccacaagctgaagtatggcaccgagctgaaccaaggcgacctgaagatgcctactttcgaaagtgaggagactaaggacacagaagctccaacggccccccaaaattcccagcttacctggaaacagggtcggcagttgcttagacagtatctccaagaagtcggatacaccgacacgattctagatgttaggagccagcgggtgcgttccctcctggggctgagcaatagcgaacctaacggttccgttgagacaaagaacctggaacagatattgaacggaggcgaatcaccaaagcagaaaggtcaagaaatcaagcgaagtagcggagatgtgctcgagactttcaacttccttgaaaacgccgatgattccgatgaggacgaggagaacgacatgatcgaggggataccggagggaaaagacaagcaccggatgaacaaacataaaattggaaatgaaggtctcgcagcagatctgacagatgaccccgacacggaagaggcccttaaggagtttgacttcttagtcacagcagaagacggagagggagctggggaggcaagatccagcggagacggaactgaatgggataaggatgacctatcaccgacagccgaggtgtgggacgtcgatcaagggctgatcagtaagttaaaggagcagtataagaaagagagaaaagggaaaaagggagttaaacgggcgaatcggactaaactctatgatatgattgcggatctaggggacgatgaactgcctcacattccttctggcattattaaccagtctcggtcagcttccacgcgcatgaccgaccatgaaggcgctcgagccgaggaagccgaaccaataacattcccctccggcggcggtaagtccttcatcatgggctccgacgatgtccttctctccgtgctgggcctcggggatctagcggatctgaccgtgactaacgatgctgattactcctatgatctccctgccaacaaggacgccttccggaaaacgtggaacccaaagtatactttaagatcacatttcgacggagttcgggcactagcattccaccccgtggaacctgtcctggtgacggcaagcgaagatcataccttgaaactgtggaatctgcagaagacagtgcctgcaaagaagtcggcctcactcgacgtggaaccaatttacaccttccgcgcccacatcgggccggtactgtctctggccataagctccaatggagaacagtgtttttccggggggatcgacgcaaccatccagtggtggaacatgccatcccccagtgtggacccatatgacacttatgagcctaacgtgcttgcgggcacactcgttggccacactgatgctgtctggggactggcctactccggtattaaaaaccagttgttgtcttgctccgcggacggcaccgtcagactctggaacccccaggaaaaactgccttgcatttgcacctataacggggacaaaaagcatggaattcctacgtccgttgactttatcggttgcgacccagcccatatggttacctcttttaacactggttctgccgtcatttatgacttagagacgagccagtcgctcgtgatcttgtcttcccaggtggatagcgggctccagtcaaacaatcacataaatagggtcgtgtcacacccgaccctaccagttactattacagcccacgaggatcgccatattaaattctttgacaacaaaaccgggaaaatgattcattccatggtcgcccacctggacgctgtgacctcactggccgtcgaccccaacggcatatacctgatgtctgggtctcacgactgcagtattcgcctctggaacctcgacagtaagacatgcgtgcaggagatcaccgcccatcggaagaaactcgacgagagtatatatgacgtggcgtttcacagttcaaaggcctatatcgcgagtgcaggggctgacgcgctggccaaagtctttgtctag

SEQ ID NO: 30637 - DNA, 2118 bp, Artificial Sequence
  Description of Artificial Sequence: Synthetic coding sequence
atgaccaaatttggtttcctacgtctttcttatgagaagcaggatacattgctcaagctactaatcctcagcatggctgccgtgctctctttcagcacccgcctgttcgccgtcctccgcttcgaaagcgtgatccacgaattcgatccctattttaactaccgaacaacaaggttcttggccgaggagggattttacaaattccacaattggtttgacgaccgcgcatggtaccctttgggcagaatcatcggtggcactatctatcccggccttatgattacatctgccgcaatctaccatgtcttacacttcttccacatcacaattgatataagaaatgtttgcgtttttctggctccactctttagcagttttacaacaatcgtgacatatcacctgacgaaggaattgaaggacgccggagcgggtctgcttgcggcggcaatgatcgctgtggttccgggatatatttccagatccgttgctgggagttatgataacgagggaatagcaattttctgcatgcttttgacctactatatgtggattaaggcagtcaagactggttccatatgttgggccgccaagtgtgccctggcttacttttacatggtatccagttggggtgggtatgtgtttctcattaacttgatcccgcttcatgtgctggtgctcatgttaacaggacgattctcacacagaatctatgttgcctactgcaccgtgtactgtctgggcactattctgtccatgcagatatccttcgtcggattccaacctgtgctctcctcagagcacatggcagcctttggtgtgtttgggctgtgccagatccacgcgttcgtggattatctgagatcaaagcttaacccccagcaatttgaagtgctgttcaggtctgtaatctctttggtgggattcgtactgctgaccgtgggggctttgctgatgttgactggcaagatctcgccttggaccgggagattctatagtttgttagacccatcttacgctaagaacaacatccccattatagcaagcgtctcagaacaccagccaacgacctggtcctcgtattacttcgatctacagttgctcgtatttatgtttcccgtgggcctctattattgttttagcaatcttagcgatgcgagaatcttcatcataatgtacggagtgacgagtatgtatttttccgccgttatggtccgactgatgctggtgctggcacccgtcatgtgtatactgtccgggatcggtgttagccaagtgctttctacgtatatgaagaatctcgacatatcgcgccctgacaaaaagtccaagaagcagcaagattccacctaccccattaagaatgaggtggccagcggtatgatcctggtgatggcattttttctgatcacctacacctttcattcaacatgggtgacctccgaagcctattcttccccttcaatcgtgctctctgctcgcggaggcgacggttctagaattattttcgacgatttcagagaggcgtattactggcttagacacaatacacctgaggatgctaaggttatgtcatggtgggactacggataccagattacagcaatggctaatcgtacgattttggttgataacaacacctggaacaacacccacatttcacgggtgggacaggccatggcatcaactgaggaaaaagcctacgagatcatgcgcgagcttgacgtgtcttacgttcttgtcatatttggcgggctgaccggctacagcagcgatgatatcaacaagttcctctggatggtccgcattggagggtccacagatacgggtaaacatattaaggagaacgactactacaccccaactggagaattccgggtcgacagggaaggatctccagtactcctgaattgtctcatgtataagatgtgttactatcggttcggccaagtctataccgaagctaaacgccccccaggcttcgacagggtgaggaacgctgaaataggaaataaagactttgaattggatgtgctagaagaggcctacactacggagcattggctagtgcggatctacaaggtcaaagatctggataataggggtctttcacgaacttag

SEQ ID NO: 30638 - DNA, 2118 bp, Artificial Sequence
  Description of Artificial Sequence: Synthetic coding sequence
atgaccaagttcggctttttgagacttagctacgagaagcaggatacgcttctaaagcttctgatcctcagcatggctgctgtactatcattcagcactagactgtttgccgtgctacggtttgagagtgtgattcacgagttcgacccatattttaactataggactactcgctttctcgctgaagaggggttctacaagtttcataattggtttgacgatagagcgtggtacccactcgggcgaatcatcggaggaaccatttaccctggcctgatgattacctccgctgccatttatcatgtcttgcactttttccatatcacaattgacatcagaaacgtgtgcgtttttctggccccccttttttcctccttcacaactatcgtcacctaccacctcacaaaagaactgaaagacgctggtgctggcctcctggccgccgccatgatagccgtagttcccgggtacattagcaggtcagtggccggtagctatgataatgagggaatagcaatattttgtatgctcctgacttattacatgtggataaaagccgtgaagaccggttccatctgttgggctgcaaaatgcgccttggcttatttttatatggtatcaagctggggcggatatgtttttttgattaatttaatcccgctgcacgtcctggtactgatgctgaccggccggttttcacacagaatatacgtcgcctactgtacagtgtactgccttggaacaattctgtctatgcagatctccttcgtgggattccagccagttttgagttcagaacacatggccgcgttcggcgtctttgggctctgccaaattcacgcattcgtcgattacctgcgatcgaagctcaatccccagcagttcgaggtgctgttccggtctgtgattagtctggtcgggttcgttttactgacagtgggcgcactgctgatgttgactggaaaaatttccccctggactggcaggttttacagcctgctggatccatcttacgcaaaaaacaacatcccgattatcgccagcgtcagcgaacatcagcctacaacctggagctcgtattacttcgatctccagctcttggtctttatgttcccggtgggtttgtactattgcttctcaaacctgtcagacgccagaatctttatcattatgtacggagtgacttctatgtatttctcagccgtgatggtgcgcctgatgctggtgctggctcctgttatgtgtatcttatcagggattggtgtttcccaggtgctgtctacgtatatgaagaatttagatatctccaggcctgataagaagagtaagaaacagcaggacagtacctaccccataaagaacgaagtcgctagcggaatgattctagtgatggcatttttcttaatcacatacacattccattccacatgggtcacaagcgaggcatactcatccccttctattgtgttaagtgcacgcggtggtgacggatccaggatcatatttgacgatttccgcgaggcttattattggctcagacataatactccagaggatgccaaagtgatgagctggtgggattacggatatcaaataacagctatggctaataggacgatcctggtcgacaacaatacgtggaacaatacacacatttcccgcgtcggacaggctatggccagtaccgaggaaaaggcctacgagattatgagggagttagacgtatcttacgttttggttatcttcggcggcttaaccggttattccagtgatgacatcaataaatttctgtggatggtcaggatcggaggatctaccgatacagggaagcatattaaagaaaatgattactacactcctacaggcgagtttagagtggacagggaggggtcccccgtgcttctaaattgcctgatgtataagatgtgttattacaggttcggccaggtctataccgaggccaaacgtccaccaggttttgacagagtgcggaacgcggaaatcggcaacaaggacttcgaactggatgttttagaagaggcatatacaacggagcactggcttgtgaggatttataaagtgaaggacttggataaccggggattatctcggacatag

SEQ ID NO: 30639 - DNA, 2481 bp, Artificial Sequence
  Description of Artificial Sequence: Synthetic coding sequence
atggcggagccttctgcacctgaatctaaacataagtccagcttaaattcctccccttggtccggcctgatggcgctaggcaactccagacacggacaccacggccccggcgctcagtgtgcacacaaggccgccggcggcgccgcgccgcctaagccagctcccgccgggctgtccggcgggttgagtcagcccgccggatggcaaagcctactgagcttcaccatactctttctggcgtggctggccgggttcagcagcagactattcgccgtgattagatttgagagtatcattcacgagttcgatccctggttcaattatcgcagcactcatcacctcgccagccacggcttctatgagttcctaaattggtttgatgaacgcgcatggtacccactagggcgaattgtggggggcacggtttatccagggctgatgataaccgccgggctgatacattggatcctgaataccctaaatatcaccgtgcacattcgggacgtctgtgtgttcctagcaccaaccttctccggtcttacgtccatctccacgttcctgctcacgagagagctgtggaaccagggagctggcctgcttgccgcgtgtttcattgccattgtaccaggctacatctccaggagcgtggctggctcatttgacaatgagggcatagccatcttcgcactccagttcacttactatctgtgggtgaaaagcgtgaagaccgggagcgtattttggacgatgtgctgctgcctgtcttatttttatatggtcagtgcgtggggcggttacgtttttatcattaatttgattccgttgcacgtattcgtgctgctattgatgcagagatatagtaagagagtctacatcgcgtacagcaccttttacattgtcggtctcatactctcaatgcagatccctttcgtgggatttcagccaatccgaacaagtgagcacatggctgccgctggcgtgttcgcattgctgcaggcttacgcttttctccagtacctacgggaccgcctaacaaagcaagagtttcaaacactgttcttcctcggcgtgtcactggccgccggcgccgtgttcctttccgtgatctatctgacttacacaggctatatagccccctggagcggtcgattttattctctgtgggatacagggtatgcgaagatccacattcctatcatcgccagcgtctctgagcatcagcccaccacctgggtatcatttttttttgacctccacatcctggtgtgtaccttccctgccggattgtggttctgtatcaagaacattaatgacgagcgggttttcgtggccctgtacgccatatccgccgtttactttgccggagtcatggtcaggttaatgttaaccctgacccctgtcgtgtgcatgcttagcgcaattgctttcagcaacgtcttcgagcactatctgggcgatgatatgaaacgggagaaccctcctgtggaggacagttctgatgaagatgataagcgcaatcagggaaatctgtacgacaaggccggtaaggtcagaaaacatgcaaccgaacaggaaaagactgaggaggggttaggacctaacattaagtctatagtgaccatgctgatgctgatgctgctgatgatgtttgccgtacattgcacttgggtgacatctaacgcatattcttcgccttctgtcgtactcgcatcatacaaccacgatggtacccggaatattttagacgattttcgggaagcttatttttggctgcgtcaaaacactgatgagcacgccagggtcatgagctggtgggattatggctatcagatcgccgggatggccaacaggacaaccctggtagataataacacctggaataattcccacatcgcactcgtgggcaaggccatgtctagcaacgagaccgccgcttataaaattatgagaactctcgatgtcgattacgtgctagtgatattcggaggcgtgataggatactcaggggacgatattaataagttcctctggatggtgcgtatcgccgagggcgaacaccccaaggatattagagaatccgattatttcacaccccagggagagttccgtgtggataaggctgggagtcctaccctgttaaactgccttatgtacaagatgagttattaccggttcggcgagatgcagcttgacttcagaactccgccgggattcgatcgaacaaggaatgctgagatcggcaataaagacatcaagtttaaacacctggaagaggcctttacatccgaacactggctggtgcgaatttacaaggtgaaagcacctgacaaccgcgaaacactggaccacaaaccccgtgtcacgaacatctttcctaaacaaaagtatctttccaagaagactactaagaggaaaagagggtacattaaaaataagctcgtcttcaaaaaaggaaaaaagatctctaagaagaccgtttag

SEQ ID NO: 30640 - DNA, 1005 bp, Artificial Sequence
  Description of Artificial Sequence: Synthetic coding sequence
atgcttgggatcatggcttggaacgccacctgcaagaactggctggctgcagaggccgctctcgagaagtattatctgagtatcttctacggcattgagttcgtggtgggcgtcctgggcaacacaatcgtcgtctatggatatattttcagccttaaaaattggaattcctccaacatctacctgttcaatctaagcgtgtcagacctcgccttcctgtgcaccttgcctatgctcatcagatcatatgccaacgggaattggatttacggtgacgtgctctgcatcagtaacagatacgttcttcatgccaatctctacacgtcaattctgttcctgacgtttatttcaattgatcggtaccttatcatcaaataccctttcagggagcatttgttgcaaaaaaaagagttcgccattttaatcagccttgccatttgggtcctggtcactctggagctgttaccaatcttgccactcatcaatcctgtgataacagacaatgggacgacttgtaacgattttgccagtagcggcgatcccaattataaccttatatactcgatgtgcctgaccttactcggatttctgatcccactgtttgtcatgtgctttttttattacaagatcgccctgttcctgaagcaacgcaatagacaagttgccactgccctgcccctcgagaaacccctcaacttggtgatcatggcagtggtcattttcagtgtgctttttacaccatatcatgtgatgcgaaatgtccggatcgccagtagactgggttcctggaagcaatatcagtgtacacaggtggttattaactcattttacatcgtcacacggcctttggcatttcttaattccgtgataaatccagtgttttatttcctgctgggagatcacttcagagatatgttaatgaaccaactgcgccataacttcaaatccctgacctctttcagtaggtgggcacacgaactcctgcttagctttagggaaaagtag

SEQ ID NO: 30641 - DNA, 1323 bp, Artificial Sequence
  Description of Artificial Sequence: Synthetic coding sequence
atggcttctcctgtggcagcccaggcaggcaaactcctacgtgcgctagctttaaggcctagattcctggcagccggcagccaggctgtgcagctgacaagccgaagatggctgaacttgcaagagtatcagagcaagaagctcatgagtgacaacggcgtgagagtgcagcgctttttcgtcgccgacacagcgaacgaggctctcgaagcagccaagagactgaacgccaaggagatcgtccttaaagcccagattttagccggtggcaggggcaaaggagttttcaattccgggctcaaagggggcgtgcaccttacgaaagatcctaacgttgtcgggcaacttgctaagcaaatgattggatacaacctggccactaagcagactccgaaagagggggtgaaggtcaataaagttatggtggctgaagctctggatattagcagggagacctacttagccattctgatggatagaagttgcaatggtcctgtattagttggctctccccaaggcggggtggatatcgaagaggtcgcggctagcaatcccgagctgatttttaaggaacagatagacatattcgaaggaatcaaagactcacaagctcagaggatggctgagaatctgggatttgtagggccacttaagtcccaggccgccgatcagatcaccaagctgtacaatctgttcctaaagattgacgccactcaggtagaagttaatccatttggcgaaacacctgagggacaggtcgtttgtttcgacgccaaaattaacttcgatgacaatgccgaattccggcagaaagacattttcgcaatggacgacaaaagtgagaacgagccaattgagaacgaagctgcaaaatacgacctgaagtatatcgggctggacggaaacatcgcatgtttcgttaacggtgctgggctcgccatggcgacatgtgacattatattcctgaatggaggaaagcccgcgaacttcctggatctaggcggaggcgttaaagaagcacaggtttaccaggccttcaaacttctgactgccgacccaaaggtggaggctattctcgtgaacatcttcggcgggattgtgaactgcgccattattgcaaatggcatcactaaagcatgccgtgagttagaactgaaggtcccgctcgttgtcagactggaaggtacatttatggagaaaaaagggagctatatgcatattaaacaggagactggaaattccaatgaaaacatcacagggattcaggaaaatgtcgctcatcaaaacctgtcaaagtgcgctatttccatctttctgtgctag

SEQ ID NO: 30642 - DNA, 1299 bp, Artificial Sequence
  Description of Artificial Sequence: Synthetic coding sequence
atggcgagtccagttgccgcccaggcaggcaagttattacgagctctggctctcagacctaggttcttagctgccggaagtcaggctgtccaactgactagtcggagatggctgaatctccaggaataccagagcaaaaagctgatgagcgacaacggtgtgagagtccaacgcttcttcgtcgctgatacggctaacgaagctttagaagcggcaaaacggctaaacgccaaggaaattgtgcttaaggcacagatcctggccggaggaaggggcaagggggtgttcaacagcggattaaagggtggcgttcatttgacgaaagatccgaatgtcgttggccagttggctaaacagatgattggttacaatctcgctactaagcagacgccaaaagagggcgttaaggtgaataaggtgatggtggctgaggcgctggatatcagccgcgagacttatctcgccatcttgatggaccgctcttgcaacggaccagtattagtgggatcacctcagggtggagttgatatcgaggaagttgccgcatccaatcccgaactgatctttaaggaacagattgatatcttcgaaggaatcaaggactctcaggcccagcgcatggcagagaatctcggctttgtgggacctttgaagtcccaggccgccgatcagattactaaactttataacctcttcctgaaaatcgatgccacacaggtggaggtaaacccctttggggagacccccgaaggtcaagtagtgtgttttgacgcaaagattaatttcgacgataacgccgagtttcgccaaaaagatatattcgccatggatgataaaagtgaaaatgaacctattgagaacgaggccgctaagtatgacctgaaatatattgggctggacggcaatattgcatgctttgtgaacggtgccgggttggctatggctacctgcgatattatctttttaaatggaggaaagccagcgaattttttggacctaggcggcggcgtgaaagaagcccaggtgtatcaggcctttaagctcctgacagctgaccccaaagtggaagccatcctggttaacatctttggtgggattgttaactgcgccatcatagccaacgggatcactaaggcctgccgcgaactggagctcaaggtgccgctagtggtacgcctggagggcactaatgtgcaggaagctcagaaaatacttaataactctgggctccctatcacaagtgccatcgatctagaggacgcggctaagaaggctgtggcctctgttgcgaaaaaatag

SEQ ID NO: 30643 - DNA, 753 bp, Artificial Sequence
  Description of Artificial Sequence: Synthetic coding sequence
atgtccgacaatggtgtgcgcgtgcaacgcttttttgtggcagacactgctaatgaggccctggaggcagcgaagcgccttaatgccaaggagatcgtgctaaaggcgcaaatcctcgccggtggccgtggcaaaggagtattcaatagtgggttaaaaggcggcgtccatttgacaaaggaccccaacgtggtcggccagctggccaaacagatgattggatataatctggcaactaagcagacaccaaaagaaggcgtgaaggtgaacaaagtcatggtggccgaggccctcgatatcagcagagaaacgtacctggccatcctcatggacagatcctgtaacggccccgttctggtcggctcgccccaggggggcgttgacatcgaggaggtcgcagcatcaaaccctgagctaatctttaaagagcaaattgatatcttcgagggcatcaaagactctcaggcccagcgcatggcagagaatcttgggtttgtcgggcctctgaagtcacaagtcgaggcaattttggtcaatatcttcggaggaatcgtcaattgtgccatcatagcgaacggaattacaaaagcatgcagggagcttgagctcaaggtgccattggttgtccgcctagaaggaaccaatgtacaagaggcgcaaaagatcctaaataattcaggtctaccgattaccagcgccatagatttggaagatgccgcaaaaaaggcagttgcatccgtcgccaaaaaatag

SEQ ID NO: 30644 - DNA, 642 bp, Artificial Sequence
  Description of Artificial Sequence: Synthetic coding sequence
atgtttggctggagcttcgtcttcgaagattttgtgagtgatgaattaaggaacaaagctactcagcctatgaagtctgtcctttggtggctcccagtagaaaaagccttctggcggcagcccgctggcccagggtccgggatcagagagcgcttagagcacccagtgctccacgtgtcctggaacgacgcacgcgcctactgtgcctggcggggaaagaggctgccaactgaggaggagtgggagttcgcagcacggggcggactaaaaggacaggtctacccatggggaaattggttccagcccaatcggaccaacctgtggcagggaaagttcccaaagggagataaagcagaggatggcttccacggagtctccccagttaacgctttccccgcccagaataattacggtctctacgatctgttggggaatgtgtgggagtggacagcttccccttaccaagcggcggagcaagatatgagagtacttcgtggcgcctcctggatcgacaccgccgacgggtctgctaatcatagggctcgagtcactacccgaatgggaaacacccccgattccgcaagtgataacttgggattcagatgcgcagctgacgctgggaggcctcccggagaactttag

SEQ ID NO: 30645 - DNA, 1077 bp, Artificial Sequence
  Description of Artificial Sequence: Synthetic coding sequence
atgcgggcacacgcacaacgtggtcgagggtgcacaaggagatccgccgctgtgctgatggccaggcatggtctgccacttcttcccctgcttagcctcctggtcggagcttggttaaaactgggaaacggtcaagccacgagcatggtgcagctccagggcggccggttcctgatgggtacaaacagtccagactctagagatggagatggtcccgtacgggaagcgaccgtgaagccattcgccattgacatctttccagttacaaacaaggatttcagggatttcgtaagagaaaagaaataccgtaccgaagctgaaatgttcggctggtcttttgtgttcgaggactttgtcagtgatgaactgcggaacaaggccactcagcccatgaagtccgtgctgtggtggcttcccgtggagaaagctttctggcggcaaccggccgggcccgggagcggcattagagagcggctggaacatcccgtcctgcacgtcagctggaatgacgcgagggcctattgcgcctggcgcggcaagcgtctgccgaccgaggaagagtgggagttcgcagcccgagggggactcaaggggcaggtctacccttggggtaactggtttcagcctaaccggactaacctgtggcagggtaaattcccaaagggggataaggcggaggatggcttccatggcgtgagccccgtgaatgctttcccggcacagaataactatggctgggccactctacagattcagccacagacgacatcagtctccgccgtcctgcagactcaggcaggacggcagggaagctgcaagcagcccgggggggacaaggaaaagtctctgctgggctctctaagtttcccagggcacgtggccaacagcgcgatcccatctagcagagcctctgcttctggcaaaaacttcccttttcccgtctcccatccaagcgtcgccggcgcatcccaccagggacgaagaggtctgagtcttctctgctttggggagggcgcgcaatgtgttctgaccatggccggcggtcaagtgttcttgctcgaggctaaatactactag

SEQ ID NO: 30646 - DNA, 711 bp, Artificial Sequence
  Description of Artificial Sequence: Synthetic coding sequence
atgagggcccatgcccaacgcggccggggatgtacaaggcgcagcgccgccgtgctaatggccagacacggtcttccgctgctgccacttctatctctcctggtgggcgcttggctcaagctcggcaatgggcaggccaccagtatggtacagctacagggcgggaggtttctgatggggacaaacagtcccgatagcagggacggggatggccccgtgcgggaagcaacggtaaagccatttgctatagacatctttcccgtgacaaacaaagacttccgtgacttcgtaagggagaaaaaataccgtaccgaggcggagatgttcggatggtcttttgtttttgaagatttcgtgtctgacgaattacgcaataaggccacacagcccatgaagggaaaattccctaagggcgacaaggccgaagacggattccacggtgtaagccctgtcaacgcttttccagcacaaaataactacggcctatacgacttgctaggaaatgtgtgggaatggacagcaagtccctatcaagccgctgaacaggatatgcgggtgttacggggagcctcgtggattgacaccgcggatggttcagcaaatcacagggcaagggttacaactcggatgggaaacactcctgacagcgcttctgataatctggggttcaggtgtgctgccgacgctggcaggcccccgggtgaattgtag

SEQ ID NO: 30647 - DNA, 918 bp, Artificial Sequence
  Description of Artificial Sequence: Synthetic coding sequence
atgcgggcccatgcccagaggggtagggggtgcacaaggcggagcgccgccgtgttaatggccaggcacggcctgccactgcttcctcttctctcccttctcgtcggcgcatggttgaagctaggaaacggccaggcaacctctatggttcaactgcagggcggccgcttccttatgggcactaatagtccagactctcgcgacggggatggacctgttcgcgaggcaacagtgaaaccctttgccattgacattttcccagtgaccaacaaggactttagagacttcgtgcgtgaaaagaagtaccggaccgaagctgagatgtttggttggagctttgtctttgaggactttgttagtgacgaacttcgaaataaggcaacacaacccatgaagccggcaggcccgggctccgggatccgggagagactggaacatccagtgttacacgtgtcatggaacgatgcacgcgcttattgcgcatggagagggaagcggctgcctactgaagaggaatgggaattcgccgcccgcggaggcttaaagggacaggtgtacccctggggcaattggtttcagccaaatagaaccaacctctggcagggaaagttcccaaagggagacaaggctgaggacggcttccatggcgtctctcccgtgaacgcatttcccgcgcaaaacaattatggactgtacgaccttctggggaacgtttgggaatggaccgcgtccccctaccaggctgccgaacaggacatgcgggtcctcaggggagccagctggatcgataccgcagatggttctgcgaatcatcgggcaagggtgacaacaaggatgggaaacacgcctgactctgcctctgacaacctggggttcaggtgcgcagccgacgctggaagaccacctggcgagctgtag

SEQ ID NO: 30648 - DNA, 885 bp, Artificial Sequence
  Description of Artificial Sequence: Synthetic coding sequence
atgagggcgcacgcacagaggggtagaggctgtactaggcgcagcgccgcagtgctgatggcgcgccacggcctgcctctgcttcccctgcttagtcttcttgtcggcgcctggctcaagcttggcaacggccaagctacctccatggttcagctgcagggagggagattcttgatgggaacgaatagtcccgactctcgggatggggacggacccgttagggaggcaaccgtgaagcctttcgcgattgatattttcccagtgaccaataaggactttagatatatccgggactttgtccgagaaaagaagtaccggacagaggcggaaatgttcggctggtccttcgtgttcgaagattttgtatctgacgaactccgcaacaaggccactcagcccatgaaaagtgtattatggtggctgcctgtggagaaagctttttggcggcagccagccggccctggcagcggcattcgagagcggttggagcatcccgtgctgcatgtgtcctggaacgacgccagagcatactgcgcttggaggggtaagcgcctacccactgaagaggagtgggagtttgctgccagggggggcctgaagggccaggtgtatccatggggaaattggttccagccaaataggaccaatctttggcagggaaaatttcctaaaggagacaaggcggaggacggattccatggagtaagtcccgtcaatgctttccctgctcaaaacaactacggcttgtacgacctattgggcaacgtttgggaatggaccgcctctccttatcaagccgcggagcaggacatgcgtgtcttgcgcggcgcaagttggatcgacactgccgatggctccgcgaaccaccgcgctcgcgtgacctag

SEQ ID NO: 30649 - DNA, 963 bp, Artificial Sequence
  Description of Artificial Sequence: Synthetic coding sequence
atgagggcgcatgctcagcgggggcgcggatgtacccgtcgcagcgccgccgtgctgatggccaggcatggtctgcccctcctgccgctgctcagcctgttggtgggagcatggcttaaattgggcaatggccaagccacttcaatggtccagctccaaggagggcgctttttgatgggaaccaatagcccagatagtcgggatggcgatggacccgtaagggaggcaacggtcaaacctttcgccatagacattttcccagttaccaataaagactttcgagatttcgtccgggagaaaaagtacaggactgaggcagagatgttcggatggagcttcgtgtttgaagatttcgtgagcgacgaactcagaaataaggctacccaaccgatgaaatccgtcctctggtggttgcccgtagagaaggccttctggcggcagccagccgggccagggtccggaatccgggaaagactggagcacccggtgctacacgtgtcctggaatgatgcccgggcttattgtgcctggcgcggcaaaagactgcccaccgaagaagagtgggaattcgctgcccgcggcggcctgaaggggcaggtctacccttggggcaactggttccagccgaatagaacaaacctctggcagggaaaattcccgaaaggggataaggcggaagacgggttccatggggtatctcctgtaaacgcttttcccgctcaaaacaactacggtctctacgacctgctgggcaatgtttgggagtggactgcgagtccgtaccaggcggctgagcaggatatgagggttctgagaggtgccagttggatagatacagccgacggcagtgccaaccatcgggcaagggtgacaacgcggatgggcaatactccagatagtgcctccgacaacctcggattccgctgtgccgcagacgccggtcgcccccccggagagctttag

SEQ ID NO: 30650 - DNA, 1821 bp, Artificial Sequence
  Description of Artificial Sequence: Synthetic coding sequence
atggtgcgaggggctcgacagccacagcagccaaggagccggctggctccccggctcaccggaaccgtcgaaaaacccccacggaagcgaagatctaggacagagtttgcacttaaagagatcatgagctccggcggcgcagaagacgatattcctcagggcgagcggaagactgtcactgatttctgctatctcctcgataagtctaagcagctgttcaatggcctccgcgacctcccacagtatgggcaaaaacagtggcagtcctacttcggacggacgttcgacgtgtacactaagctttggaagttccagcagcagcaccggcaggttctcgacaaccgctacggcttaaagcgatggcagatcggcgaaattgcctcaaagatcggacaattatattatcactactacctgcgtacatccgagacatcatacctgaacgaagcattcagcttctactcggccatcaggcagcgaagttactactcccaggtcaataaggaggacagacccgagctcgtcgtgaagaagttaaggtactacgcacggttcattgtggtctgcctcctcttgaacaagatggacgtcgtgaaggacctggttaaagaactttccgacgagatcgaggactatacacatagatttaatacagaggaccaagtggagtggaacctcgtgctccaggaggtcgccgccttcatagaggctgatccggtcatggttttgaacgatgacaacactatcgtgattacaagcaacagactggccgagacaggcgctccactccttgaacaagggatgatagtcggccagttgtccctagcagacgccctcattatcggtaattgtaacaaccaggtgaagtttagcgaattaacagttgacatgtttcggatgctgcaggctttagagcgagagccaatgaatctcgcatctcagatgaataaacccggtatgcaggagtcagccgacaaacctacgcgcagagagaaccctcacaagtacttgttgtataagccgactttcagtcagctttacacgttcctcgctgccagcttcaaagaacttcctgccaattctgtgctcttgatctatctgagtgccactggagttttccctaccggccggagtgactcggaaggaccgtacgatttcggcggagtcctcacaaattcaaaccgtgacatcattaatggggatgccattcacaaaaggaatcagagtcataaggagatgcactgtctgcatcccggcgatttatatccttttactagaaagcccctctttatcatcgtggattctagtaactctgtcgcgtacaaaaactttacaaatctctttggtcagccacttgtttgcctcttgtcacccaccgcatacccaaaagccctgcaggaccagtcacagagggggagcctgttcacgctgttcctgaacaaccctctgatggcattcctgtttgtttccggcctctccagcatgcggcgtggactgtgggaaaagtgccaggaatatctgcgcaaaattaaccgggatatagcccagctcctgacacactcaagatctatcgaccaggcctttctgcaattctttggggacgagttcctgcggctgcttctcaccaggtttatattttgttcggcgacaatgcgaatgcacaaaatcttccgcgagactcgtaactaccccgagtcctaccctcagctgccccgggacgaaacagtcgaaaatccacacctccagaaacacatcctcgagctggcctctatactggacgtgcgaaatgtgttcttcgaaaatacaatcgatgattactag

SEQ ID NO: 30651 - DNA, 1890 bp, Artificial Sequence
  Description of Artificial Sequence: Synthetic coding sequence
atggtacgaggagcacgacaacctcaacaacccagatcacggttggctccccggcttaccggcactgtagaaaagccacctcggaaaaggcggagttcaattcgggggtctggggacagtagtcacagccagtcacagggagaacgataccagcactttaccgaaaagacagaatttgcgcttaaggaaatcatgtcctcaggaggggccgaagacgatatcccacagggagagcggaagaccgtgacagacttttgctatctactggataaatctaagcagttgtttaatggccttcgcgacctgccacagtatggacaaaagcagtggcagagctactttggacggactttcgatgtatatactaagctatggaaattccagcagcaacataggcaggtcttggataaccgctacggcctcaagcggtggcagatcggggagatcgcctccaaaatcggacagttatattaccattactacctccgcacttcagagactagctacctcaacgaggcttttagcttctactctgctattcgtcagaggtcctactactcccaagttaataaggaggaccgacccgaactcgtcgtgaagaaactgagatactatgctcgcttcattgttgtttgcctgttgcttaacaagatggacgtggtaaaagacctggttaaggaactgtctgatgagattgaagactatacacatcgtttcaacacagaggatcaggtagagtggaatctcgttctgcaagaggtggctgcgtttattgaggccgaccccgtgatggttctgaacgacgataatactattgtcatcactagcaaccggctagccgaaactggagccccattgctggagcagggtatgatagtgggccagcttagcctggctgacgccttgataattggaaactgtaataatcaggtcaagtttagcgagctcacagtggacatgttcaggatgttacaagccctcgagcgagaacccatgaacctcgcaagccagatgaacaagccaggtatgcaggaatctgcagacaagcccactaggagggaaaacccacacaagtacctgctgtataaaccaactttcagccagctgtatacctttttggctgcgtccttcaaggaactgcccgccaactccgtgctgctcatttacctgtcagccaccggagtatttccaacaggtcgatctgactctgaggggccttacgattttgggggagtcctaacgaactctaacagggacattatcaacggcgatgccatccacaaacgcaaccagtcccataaggaaatgcactgtctccatcctggggacctatatccctttactagaaaaccattgttcattatcgtagattcctctaatagcgtggcgtataagaacttcactaacctattcggccagcctttggtttgtctactcagtccgacagcctaccctaaagccctgcaggaccagagtcagagaggcagtcttttcacactctttctgaacaaccctctgatggccttcctcttcgtgtccggcttatccagcatgcgtcgaggcttgtgggagaaatgccaagagtacctgcgtaaaattaatcgggatatcgcccagttactcactcactctcgtagtatcgatcaagccttcctgcagtttttcggagacgagtttttgcgcctcttactgacaagatttatcttttgctcggctaccatgaggatgcacaaaatcttccgggagacaagaaattatcccgagtcttacccccagctgcctcgggacgagactgtggagaaccctcacttgcagaaacacatcttggagctcgcttcgatccttgacgtccgcaacgtgttcttcgaaaacaccattgatgactattag

SEQ ID NO: 30652 - DNA, 1746 bp, Artificial Sequence
  Description of Artificial Sequence: Synthetic coding sequence
atggtgttcagaaacgtcggcagacccccggaggaggaggacgtggaagccgcccccgagccaggaccaagcgagctgctgtgcccaaggcaccggtgcgcacttgatcctaaggcacttccaccaggactggctttggagcgaacctggggccccgcagccgggctcgaagcccagctagccgctcttggcctgggacaacctgccggcccaggcgtgaaaaccgttggggggggatgctgtccttgcccttgccccccccagcctcccccaccccaacctcagcctccggcagcagctccccaagctggtgaagaccctacggaaacctccgatgctctgcttgtcctagaaggcctggagagcgaggctgaaagcctggagacaaattcttgttccgaagaagaacttagttccccaggaaggggtggcggcggcggagggcggctcctgcttcagccccctgggcctgagctgcctcctgtaccctttcccctccaagacctcgtccccctgggtaggctctctagaggcgagcagcagcaacagcagcagcagcagcctccaccacctccccctcccccagggcctctgcgccccctggctggtccgagtcgtaaaggctcttttaaaatccgcctttctcgactgtttcgaacaaagtcctgtaacggcgggtcaggcggcggggacgggacaggaaaacgcccctcaggtgagcttgccgccagtgccgccagtctgacagacatggggggctcggccggaagagagctggatgcaggtagaaagcccaaattgaccagaacacaaagtgcttttagtccagtctcgttcagccctttgtttactggggagaccgtgagcctggtcgacgtcgacatcagccagaggggcctcacaagccctcacccccctacccctccccctcccccaagaagatcgctttcactgttggacgacatctctggaacactgcccacctccgttctggtggcccctatgggttcctcactgcaatcctttccactccctccaccaccgcctccccatgcccctgatgcttttcctagaattgctcctatcagagccgctgaatctctgcactcacagcccccccagcacctccagtgtccactgtaccgccccgacagcagctcctttgccgccagcctccgagagctagaaaagtgtggatggtactgggggccaatgaattgggaggacgccgagatgaaattgaaggggaaaccagatggatccttcctcgtacgtgattccagtgatccgcgatatatcttgtccttgagtttccgcagccaggggattacacaccacaccagaatggagcactatagaggaaccttcagcctgtggtgccaccctaaatttgaggaccggtgtcagagtgttgtggaatttatcaagagagccatcatgcacagcaagaacggaaaatttctgtacttcctgaggagtagagtgccagggttgccaccaactcctgtacagctgctgtaccccgtgagccgtttttcaaatgttaagagcctgcagcatctgtgccgctttagaattcgccaactcgtacgtattgatcacattcccgacttgccgttgcctaaacccctgattagctatataagaaagttttactattatgacccccaggaagaggtttatctgtctctaaaagaagcccagctcatttccaagcagaagcaggaagtggagcccagcacctag

SEQ ID NO: 30653 - DNA, 1746 bp, Artificial Sequence
  Description of Artificial Sequence: Synthetic coding sequence
atggtgtttcgaaatgtggggcggccccccgaagaggaggacgttgaggcagcccccgagccagggccaagcgaactactctgcccccgccacaggtgcgcccttgatcccaaggctttacccccaggccttgcacttgaaaggacatggggcccagccgccggactggaagcccagctggctgctctgggactggggcagcccgccgggccaggagtgaagaccgttggggggggatgctgtccctgtccatgtccccctcaaccgccccccccacagccgcagccgcctgctgccgcaccccaagccggggaggacccaacagaaacatctgatgctttgctggtgctcgaagggctggaaagcgaagctgaatctttggagacaaatagctgcagcgaggaggaactgagttcaccaggcagagggggcggaggtggcggtcgcttactgctccagccacccggtccagaacttcccccagttccctttcctctacaagacctcgtaccactgggccgactaagcaggggagagcagcagcaacagcagcagcagcaaccaccaccgccgcctcccccccctggtcccttgaggcccctcgctggaccatcacgaaaaggcagcttcaagattcgattatcaagactgttccgtaccaagtcctgcaatggggggagtggcgggggtgacggaacagggaaacggcccagcggggaattggcggcaagcgccgcaagcctgaccgatatggggggttctgccggaagggaactcgatgccgggagaaaacccaagctcacaaggacccagagtgccttcagtccagtgtcttttagtccactcttcactggggagaccgtatccctcgtcgatgtcgatatcagccagcgaggacttacttccccgcatccaccaactcccccgcctcccccacggaggagcctgtcattgcttgacgatattagcgggacactacccacttccgtactggtcgcgcccatggggtcctcactgcaatcatttcctttacctcctcctcctccaccacacgcacctgatgcgttcccccgtattgctccaattcgagcagccgagagcctgcactctcagcccccacagcatctgcagtgcccactttacaggccggactcgagttccttcgcagcctctctccgggaactggagaaatgcggatggtattggggcccaatgaactgggaggacgctgagatgaaactcaagggcaaacccgatggcagcttccttgtgcgggactccagcgacccgcggtatatcctctccctttcttttcgctcacaggggattacgcatcacacacgcatggagcactataggggcactttctcactatggtgccacccgaaatttgaagatcggtgccagtctgttgtcgagttcatcaaacgcgccatcatgcactccaagaacggcaagtttttgtactttcttagatcccgggtgcccgggttgccaccaaccccggttcagcttctatacccggtgagccggtttagcaacgttaaatctctgcagcacctgtgcaggttcaggatcagacagctcgtcagaatcgatcacattcccgacctgcccctcccgaagcccctcatctcttacatccgcaaattttattactacgatccccaggaggaagtgtacctgtccctcaaagaagcccaactcatctccaaacaaaaacaggaggtggagccttccacctag

SEQ ID NO: 30654 - DNA, 2169 bp, Artificial Sequence
  Description of Artificial Sequence: Synthetic coding sequence
atgggaaggggaccctgggacgccggcccatcacgccggctgttgccactgctgctccttctcggtttagcaaggggtgcagctggagcccccgggcccgatgggctggacgtttgcgctacgtgtcacgagcatgctacctgtcagcagcgcgaaggcaagaaaatttgcatctgcaattacggtttcgttgggaatgggaggactcagtgtgtagacaaaaacgaatgtcagttcggagcaacattagtctgtggcaatcataccagctgccacaatactcccggggggttttactgcatttgtctcgaagggtatcgagctaccaacaacaataaaacctttatccccaacgacgggaccttttgtactgacatagatgagtgtgaggtgagcgggctgtgccggcatggaggacggtgcgtgaacacacatggctcttttgaatgttactgcatggacgggtatctcccacgtaacggccctgagccttttcacccaaccactgacgccaccagttgcacagaaattgattgcggcaccccacccgaggtacccgatggctatatcattggcaattacacgtctagtctcggcagtcaggttaggtacgcgtgcagagaagggtttttctccgtccctgaggataccgtcagctcctgtactgggttgggtacctgggagtcacccaagctccattgccaggaaattaattgcggtaaccctcctgagatgcggcacgcgattctggtgggtaatcactctagtcggctgggcggagtggcacgatacgtgtgtcaggagggcttcgaaagtcccggaggaaaaataacctctgtctgtaccgagaagggaacatggcgcgagtcgacactgacatgtactgaaatcttgactaaaattaacgacgtatctttatttaacgacacatgcgtccgctggcagatcaacagccggcgtatcaacccaaaaatatcatacgtgatttctattaagggccagagactcgatcccatggaaagtgtcagggaggaaacagtcaacctgaccaccgactccaggacccccgaggtgtgtctcgctttatacccaggaactaattacacagtcaacatctccactgccccacctcgaagatctatgcccgcggtcattggatttcagacagctgaggtggacctgctagaggacgacggaagctttaacatcagcattttcaacgagacatgtcttaagcttaataggcgctcccgcaaagtgggcagcgagcacatgtatcagtttaccgtcctcggacaacgttggtatcttgctaacttcagtcacgcgacatcgtttaatttcactacccgggaacaggtccctgtggtttgcttagacctgtatcctacaacagactacacggtaaacgtgactctgcttcgaagccccaagagacatagtgtgcagattaccatagccactccgccggctgtgaagcaaactatctcgaacatcagcgggtttaacgaaacctgcctacggtggagatccatcaagacggctgacatggaagaaatgtacctgtttcatatttgggggcagagatggtaccagaaggagtttgctcaagaaatgacattcaatatcagcagcagttcacgggatcccgaggtgtgcctggatctgcgccccggcacaaattataacgtgagcttaagagccctttcgtcggaattgccagtggtcatctccctaacaacccagataacagaaccaccgctgcccgaagtcgagttctttaccgtgcatcggggaccactaccccggttgaggctccggaaggcaaaggaaaaaaatggacccattagctcttatcaggttttggtcttacccctggctcttcagagcacattctcatgtgactctgaaggcgcctcttcttttttttcaaatgccagtgatgccgacggctacgtggccgccgagttgctcgcgaaggacgtgcctgacgatgccatggaaattcccattggagaccgcctgtactatggggaatattacaacgcccccctgaaaagagggtccgactattgcatcattctgcggataacatccgaatggaacaagatcaggcacagttgttgctgcaggtggagagtgctggactgggtaccttggctcctgtag

SEQ ID NO: 30655 - DNA, 2274 bp, Artificial Sequence
  Description of Artificial Sequence: Synthetic coding sequence
atgggccgcggcccttgggacgcaggcccatccaggagattgcttccactgctcctactcctcggcttagctcggggggcggccggtgccccggggcccgacgggctggacgtttgcgccacatgtcacgagcatgccacatgccaacagcgggaggggaagaagatatgtatttgcaattatgggttcgtgggaaacggaagaacacagtgcgtggataaaaatgaatgtcagttcggtgctaccctcgtgtgtgggaaccatacttcttgccataacacccccggtggtttctattgcatctgtctggaaggataccgagcaaccaataataacaagacattcatcccgaatgatgggactttctgcaccgacattgacgagtgcgaagtgtctggactgtgccgacatggcggacggtgtgtaaacacccacggttccttcgagtgctactgcatggatggctatcttcccagaaatggacctgaacctttccaccctactacagacgcaacatcatgcacggaaatcgattgtggaactcccccagaagtgccagatgggtatattatcgggaactacacttcaagcttgggttctcaggtgaggtacgcttgcagggaaggattctttagcgttccagaagacacagtctcgagctgtactggactgggtacttgggagtcccctaaactccattgtcaagaaatcaattgcggcaaccctcccgagatgcgtcacgccatcctggttgggaatcattctagcagacttgggggagtggccaggtatgtgtgtcaggaaggcttcgagtcccccggggggaaaataacatcagtatgtactgagaaggggacctggagggagtcaactttgacttgtaccgagattctgacaaaaattaacgatgtaagtcttttcaacgacacctgtgtgaggtggcagatcaattcccgacgcattaaccccaagatcagctacgtcataagcatcaagggccaacggcttgatcccatggaaagcgtccgcgaggagaccgtaaacctcaccacagacagcaggacgccagaagtctgtctggcattgtatccaggcactaactacacagtcaatatctccacggcaccgccaagaaggagtatgcctgcggtcatcggcttccaaaccgccgaggttgacctgttggaagacgatggcagcttcaatatcagcatatttaatgagacgtgtcttaaactcaacagaaggtccaggaaagttgggagtgaacatatgtaccagtttacagtcctgggccaacgctggtacctggccaacttcagtcacgccacctcttttaattttaccaccagggagcaggtgcctgtggtttgtctcgatctgtatccgacgaccgattataccgttaatgttaccctgcttcgctccccgaagcgtcattccgtgcaaataacaatcgcgaccccccccgccgtgaagcaaacaattagtaacatttcaggttttaacgagacatgcctgcgttggcggagcatcaagacggctgatatggaagagatgtatttgttccacatctggggacagcgctggtatcagaaagagttcgcacaggagatgacatttaatattagcagctcaagccgcgaccctgaggtgtgtctcgacttacgccccggcacaaattacaatgtgtcattgagagccctctcatcagagctcccagtggtaattagccttaccactcaaattactgaacctccactgccagaggtggaatttttcaccgttcatcgaggccccctgcccagactgcgcctacgtaaggcaaaagagaaaaacggcccaatttcttcttatcaagttctggttctgcccctcgctctgcagtcaacattctcctgcgattcagagggcgctagctcttttttttctaacgcttcagacgcggacggatacgtcgccgccgaactccttgcgaaagacgtgccagacgacgctatggaaatccctattggagaccggctgtattatggagagtactataacgctccactcaaaagagggtccgattattgcattatcctccgaatcactagtgagtggaataaagtgcggcgccactcctgcgctgtgtgggcgcaggtaaaagagataccatgcaattgcaactttttgcgcctccacatccacagggctaactccggagacactcaaatccggcacagctgttgttgtagatggcgggtgctggactgggtaccctggcttttatag

SEQ ID NO: 30656 - DNA, 2244 bp, Artificial Sequence
  Description of Artificial Sequence: Synthetic coding sequence
atgggaaggggaccatgggacgccggaccttcaaggaggctgttgcccctgctcttgcttctgggcttggcccgcggagcagccggcgcccccgggcctgatggcctcgatgtttgtgccacttgtcatgaacacgcgacttgccagcaacgagaagggaagaaaatatgcatctgcaattacggctttgttggcaatggccgcacacagtgcgtggataagaacgaatgccagtttggagctactctggtatgcggtaatcacacctcatgccacaatactccgggcggtttttattgcatctgcctcgaaggttaccgcgccactaataataataaaacctttattccaaacgacggcactttttgcaccgacattgacgaatgcgaagttagtggcctgtgtagacacgggggccgatgcgtgaacactcatggcagctttgaatgttactgcatggacgggtacctgcctcgaaacggaccagagccgtttcacccaacaactgatgctacctcatgtaccgaaatcgattgcggaactcctcctgaggtgccagacggttacataataggcaactacaccagttctctggggtctcaggtccggtatgcctgcagggaaggcttttttagcgtccccgaggacactgtgtcttcttgcaccggtctgggcacatgggaatctccgaaactacattgccaggagatcaattgcggaaatccgccagaaatgcggcacgcgatcctcgtgggcaaccactccagccggctgggtggtgtcgcacgctatgtttgccaggaagggttcgagtcccctggcggaaaaattactagcgtctgcactgaaaaggggacgtggcgtgaatcgaccctgacctgtactgaaattctcacaaagattaacgatgtctcactatttaacgatacttgtgtgcggtggcaaataaatagtcgccgaattaaccctaagatcagttacgttatcagcattaagggtcaacgccttgatcctatggagtctgtgagggaggagaccgtgaatctcaccaccgattctcgtacccctgaagtttgcctggctctgtacccagggacgaactatacagtcaacatcagcacggctcccccccgccgatctatgcctgccgtcatcggattccagaccgctgaggttgatctcctggaggacgacgggtcattcaacatttccatttttaacgagacctgtttgaagctaaatcggcggagcaggaaggtaggcagcgagcatatgtaccagtttactgttctgggacagcgttggtatctcgcgaatttctcacacgccacgtctttcaactttacgactcgtgagcaggtccctgtcgtttgtctggacctgtacccaaccacggactatacagttaacgtcacacttttgcgctcccccaagcggcacagtgttcagataaccatcgcaactcctccagccgtaaaacagacaatctcaaatatcagtggcttcaacgaaacctgcctcaggtggagaagcatcaagactgctgacatggaggagatgtaccttttccatatctggggccaaagatggtatcagaaggagttcgctcaggaaatgacattcaatatctccagttcatccagagaccccgaagtgtgtttggacctgcgtcccggaactaattataatgtttcacttagagcgctctcaagtgagctgccggtggtaataagtctgactacacaaatcacagagcctcctctgcctgaggtcgagtttttcaccgtgcatcgaggcccgcttccccggctcaggctcagaaaagctaaggaaaagaatgggcccatctcctcatatcaggtgctcgttctgcccttggcccttcagtctactttctcatgtgattcagagggggccagttctttcttcagtaacgcttccgacgcggatggatatgttgcagccgagttattagcgaaagatgtgcccgacgatgccatggagatacccataggtgacaggctgtattacggtgagtattataatgcccctttgaaacgcggctctgactattgcattatcctgcgaattacttctgagtggaataaagtgcgccgtcactcctgtgctgtatgggcccaggtgaaggactcaagcttgatgctgttgcagatggcgggggttggtctcgggagcctcgcggttgttataatcctgaccttcttgagtttctcagcggtctag

SEQ ID NO: 30657 - DNA, 2469 bp, Artificial Sequence
  Description of Artificial Sequence: Synthetic coding sequence
atgaaacctgcactgctcccctgggctctcctgcttttggcgaccgccctaggccctggacccgggccaactgccgatgcccaggagtcctgcagcatgcggtgtggcgctctggatggtccgtgctcctgtcacccaacttgttcgggccttgggacctgttgtcttgacttccgggacttttgtctagagatcctcccctacagcggctccatgatgggtggtaaagatttcgtcgtccgacacttcaagatgtcctcccccaccgacgcctcagtaatctgtcgctttaaggattccatacaaacactgggccatgtggactccagcggccaggtgcactgcgtgagccccctgctttatgagtcggggagaatcccattcaccgtttccctggataatggccattcattcccccgcgcgggaacttggctggccgtacacccgaacaaggtctctatgatggagaaaagtgagcttgtgaacgaaacccgctggcaatactacggtactgccaatacttcaggaaacctatctctgacctggcacgtgaaaagcttgccaacccagacaatcaccatagagctctggggatatgaagagactggaatgccgtactcacaggagtggaccgccaagtggagctacctctaccctttagccacacacattcccaatagtgggtcctttacatttacacctaagcctgccccaccctcatatcagcggtggagagttggagccctccgaatcattgactccaaaaattacgccggccagaaggatgtacaggcgctgtggaccaatgaccatgcccttgcttggcatcttagtgacgatttccgggaagacccagtcgcgtgggcccgcacccagtgccaggcctgggaagaactcgaagaccagctgcctaacttcttggaagaactgccagactgcccttgcactctgactcaagcccgcgccgactctgggaggttctttactgactacggatgtgatatggagcaggggtctgtgtgcacgtaccatcccggagccgtgcactgtgtcaggagcgttcaggcgtcattacggtatgggtccggacagcagtgctgttatacagctgacggcacgcaactgctgacagcagattcttctgggggatcaacaccagacagggggcacgactggggagccccgccttttaggaccccgcctcgggttcctagcatgagtcattggttgtacgatgtcttaagcttttactattgctgtctgtgggctcctgactgcccccgctacatgcagcggagacccagtaacgattgtcgtaattacagacctccaaggttagcctccgccttcggcgatcctcacttcgttactttcgacggtacgaattttactttcaatggcagaggtgagtatgttttgctggaagcggccctcaccgacttgcgagttcaggcacgcgctcaaccaggaactatgagcaatggtacagaaactcgtggcaccggtcttacagctgtcgccgtacaggagggcaatagcgacgttgtggaggtacgactcgcaaaccgcacaggcgggttggaggttcttttaaatcaagaggtgctctcatttaccgaacagtcctggatggacctgaaggggatgttcctctctgttgcagccggtgatcgcgtcagcatcatgctggcctccggggctggtctggaggtttcagtgcagggcccattcctctccgtgtcagtgctgcttccagaaaagtttttaacccacacacacggtctcctgggcactcttaacaatgatcccactgatgactttacgctccacagcggcagggtcctccctccgggtacaagcccacaggaattattcctgtttggcgccaactggactgtacacaacgcctcttccctgctgacttatgatagctggttcctggttcacaatttcctgtatcagcctaagcatgaccccactttcgaacctttgtttcccagtgagactaccctgaacccctccctggctcaagaggcggccaaactgtgtggagatgatcatttctgcaattttgacgtggcagctaccggaagcctgtccaccggcacagccactagggtcgcgcaccaactccaccaaaggcggatgcaatccttgcagcccgtcgtgtcttgcggatggcttgctcctcccccaaatgggcaaaaagaaggtaaccgctacctggcaggttcaacaatctatttccactgtgacaatggatattctctggccggcgctgagactagcacctgccaggcagatggtacttggagtagcccaacacccaagtgtcagccggggcgaagctatgccgtgctactcgggatcatcttcggaggcctggcagttgttgccgctgtggcccttgtttacgttctccttcgcagacgaaagggcaatacgcacgtatggggcgcacagccgtag

SEQ ID NO: 30658 - DNA, 729 bp, Artificial Sequence
  Description of Artificial Sequence: Synthetic coding sequence
atgaagaacattggcctggtgatggagtgggagattcctgagatcatctgtacttgtgcaaaattgagactacctccacaggctacctttcaggttctgagaggaaatggcgcatccgtgggcacagtgttaatgttcaggtgtccctcaaaccaccaaatggtgggctcaggcctcctgacatgtacatggaagggcagtattgcggagtggagcagcggaagtcccgtttgtaagctggtgccgccccacgagactttcggctttaaagttgcagtcattgcctctattgtgagctgtgcaattatcttgttgatgtctatggcattcttaacatgttgtttgttgaagtgcgtgaaaaaatctaagaggaggcgctccaaccggtccgctcaactgtggtcccagctcaaagatgaagatctagagactgtccaagctgcatacctgggcctgaaacacttcaacaaacctgtgtccggcccatcccaggctcatgacaaccacagctttaccactgaccatggagagtccacttctaagctcgcaagcgtcacccgcagtgtggacaaagatcccggaattcctcgtgctttgtcccttagcggctcaagctcttctccccaggcgcaggtcatggtgcacatggcaaaccctcgacaacccctgccggcgagcggactagccaccggaatgccacagcagcctgcagcctatgcactcggatag

SEQ ID NO: 30659 - DNA, 768 bp, Artificial Sequence
  Description of Artificial Sequence: Synthetic coding sequence
atgcggtgggccgccgccacactgcgcgggaaagcccggccgaggggccgcgcaggcgttaccacacccgccccagggaatcgcactggcacctgcgccaagctaaggctgccaccacaggcgactttccaggtcctaagagggaatggcgcttccgtgggcactgtcctcatgttccgatgcccttccaatcatcagatggtaggctcaggactgttgacttgcacttggaaaggttccatcgccgagtggtccagtggtagccccgtgtgtaagctggtcccaccccatgaaacatttggcttcaaagttgccgtcatcgcctccatcgtgagctgtgccatcattctgcttatgtccatggcttttctgacgtgttgtctgttgaagtgcgtgaagaaaagcaagcgccggcggtccaaccggagtgcgcagctttggagccagctcaaggatgaggatctcgagaccgttcaggccgcttatctggggttaaagcatttcaataaacctgtgtccggtcctagccaggcccacgacaatcatagttttacaacggaccacggcgaatctactagtaaactggcaagcgtgacacggtcggtagacaaggatcctggaatccctcgagctctgagtttaagtggatccagtagcagtcctcaggcacaagtgatggtgcatatggctaatcctcgccagcctctccctgcaagtgggcttgcaacaggcatgccccagcagcctgcagcgtatgcgctgggatag

SEQ ID NO: 30660 - DNA, 711 bp, Artificial Sequence
  Description of Artificial Sequence: Synthetic coding sequence
atgtatcatggaatgaatccgtcaaatggtgacggattcctggaacagcagcaacagcagcagcagccacaatccccccagcggctgcttgcagtgatcctctggtttcaactggccttatgtttcgggcctgctcagctgacaggtggatttgacgacctgcaggtgtgtgcggacccagggattcctgagaacgggttccggaccccatccgggggagtcttttttgaaggcagtgtcgctaggtttcactgccaggacggcttcaagttgaaaggtgccactaagagactctgcctaaagcacttcaatggcacactaggttggatccctagtgataatagtatctgcgttcaagaagactgtcgcatcccacagatcgaagatgcagaaatccataacaaaacctaccgtcacggggagaagctcatcatcacttgccacgaaggctttaaaattcgctacccagatctgcataatatggtttccctgtgccgcgacgatgggacgtggaacaatctacccatctgtcaggggtgcttacgacccctggcgccccaacacacccccgctcaaggcactagaacgcaggctcagggcagtcagaaaccggttactgcctctcaagctctactgtcctgctctaaagtgtgtatccacctacctggtgccaaacgggcgcctacactactgcgtactactttaacctag

SEQ ID NO: 30661 - DNA, 321 bp, Artificial Sequence
  Description of Artificial Sequence: Synthetic coding sequence
atgtatcacgggatgaacccgagcaacggggacggcttcttggaacagcagcagcagcagcaacagccccaatcaccacagagactgcttgctgtcatcctttggttccaactggcactctgtttcggtccagcccagctgactggcgtccatttgacaagggacctactcgggttcgaagggtgtcccgagtgccctccaccccctggtttcaaggaggaatcacaggaatttgcacagcaggtcaccccactcagaagccttactcacgctaacccctggtcttctggaccactctgcattcctaaaagctggtcttag

SEQ ID NO: 30662 - DNA, 1473 bp, Artificial Sequence
  Description of Artificial Sequence: Synthetic coding sequence
atgtatcacggcatgaacccctctaacggcgacggcttcctagaacagcaacagcagcagcaacagccacagagtcctcagcgcctgcttgccgtaatcctgtggtttcagctagcactctgttttggccctgctcagcttaccgggggctttgatgatctgcaggtttgcgccgaccctggtatccctgagaatggattccgcaccccgagcgggggtgtattcttcgaagggtcagtggcccgctttcactgccaggatggatttaagcttaagggagccactaaacggttgtgcctgaaacattttaacggaacactcggatggatccccagcgacaattccatatgtgttcaggaggactgccggatccctcaaatcgaggacgcagaaatccataacaaaacgtatcggcacggtgagaaacttatcatcacttgccacgaaggcttcaaaatcaggtatcctgatctacacaacatggttagcctatgcagggatgatggcacgtggaacaacctacccatttgtcagggatgcctgcggcctctggcatccagcaacggatatgttaacatttctgaattacagacttcgtttcccgtgggcacggtaatttcatacaggtgttttcctgggttcaagctagacggtagtgcctacctagaatgtctgcagaacctcatatggtcctcgtcccctccaaggtgtctggcattagaggtgtgcccactccccccaatggtgtcccacggcgatttcgtgtgtcaccctagaccctgcgagcggtacaatcatggtactgtggtagaattctattgcgatcccgggtatagcttaacatccgattacaaatatatcacctgtcagtacggtgagtggttcccttcctatcaggtttactgtatcaagtccgagcagacatggccaagcacccacgagactctgctaaccacttggaaaatcgtcgcctttaccgcaacctccgtgctgctagtcctgcttttagtgatcctggctcgaatgttccagaccaagttcaaggcacacttcccaccaagaggtccccccaggtcttcaagctctgatccggatttcgtcgtggtcgatggtgtccccgtgatgctaccctcctacgatgaggcagtgagtgggggcctcagtgcgctcgggcctggatacatggcctcggttggccaaggctgtcccctgccagtggacgatcagtcccccccagcttacccaggcagcggcgatacagacactggtccaggtgagagcgagacatgcgattctgtcagcggttcctcggagctcctccagtctctgtacagcccacctagatgccaggaatcaactcatccagcaagtgataaccctgacataattgcttccactgcagaagaggtggcctcgacaagccctgggattgacattgcagacgaaatcccattaatggaagaggatccatag

SEQ ID NO: 30663 - DNA, 873 bp, Artificial Sequence
  Description of Artificial Sequence: Synthetic coding sequence
atgtatcatggtatgaacccttccaacggggacggattcctggagcagcagcagcagcagcagcagccccagtcccctcaacggctgctcgctgttattctgtggtttcaactggcactttgttttggccccgcgcagctgaccggggggttcgacgacctccaggtctgcgctgatcccggcattcccgaaaatggtttcagaactccatccggtggtgtgtttttcgagggctcagtggctcgcttccactgtcaagacggattcaaactgaagggtgcgacgaagcgtctgtgcctgaaacattttaatgggactctcgggtggattccttccgacaattctatatgcgtccaagaagattgccggatccctcagattgaggatgctgagattcataataagacctacaggcacggagaaaaactgattattacctgtcatgagggtttcaagattcggtaccccgatctacacaatatggtgagtctctgtcgagacgacggtacttggaataatcttcccatatgccaaggctgcttgcgacccctggcgtcaagcaatgggtacgtgaatatcagcgaattgcagacaagcttccccgtgggaaccgtgatttcttaccgctgttttccggggtttaagttggacggcagtgcctacttagaatgccttcagaacctgatttggtcgtccagtccaccaagatgcctcgccttagaaggcgggaggccggaacatcttttccccgtcctctacttcccgcacattcgattggctgcagcagttttgtacttttgtccggtgctgaagtcttcccccacacctgcccctacttgtagcagtacttccactactacctctttgttttag

SEQ ID NO: 30664 - DNA, 321 bp, Artificial Sequence
  Description of Artificial Sequence: Synthetic coding sequence
atgtatcatggaatgaatccgagtaatggggatggcttcctagaacagcagcagcagcagcagcagcctcagtctccacagagactcctcgccgtcattctatggttccaactggccttgtgctttgggccagctcaattgacaggggtacatttgacccgggacctgctcggttttgagggctgcccagagtgtccgccacccccagggtttaaggaggagtcccaggagttcgcccagcaagtgacccccctccggtcccttacccacgctaacccatggtccagtggacctctctgtatccctaaatcttggtcttag

SEQ ID NO: 30665 - DNA, 1473 bp, Artificial Sequence
  Description of Artificial Sequence: Synthetic coding sequence
atgtatcatggaatgaatccgtcaaacggggatggattcctcgaacagcagcaacaacagcagcagccccagtccccccagcggttgcttgctgtaatactgtggtttcagctggccctttgcttcggaccagcccagctcacgggcggtttcgacgatttacaagtgtgcgctgacccagggatcccagaaaatggcttccgaacacctagcgggggggtgtttttcgaagggtccgtagcccggttccattgtcaggatggattcaagttgaagggggccactaaacggctttgtcttaagcactttaatgggacattagggtggattccatcagataactctatatgtgtccaagaagattgtcggattccccagatcgaggacgctgagatccataataaaacctacaggcatggggagaagctcataatcacctgccatgagggcttcaagatccgatacccagacctccacaatatggtgtccctgtgccgggacgacggtacatggaacaatctgccaatctgtcaagggtgcctgcgccctctggcatcctcgaacggttatgtgaacatctcagaactgcaaacaagctttccagtcggcacagtgatctcgtacagatgtttcccaggatttaagctcgacggctcagcttacctggagtgcttgcaaaatttgatttggagttcatcccctccccgttgcttagccctggaagtctgccccctgcctccgatggtctcccacggcgacttcgtctgtcacccgcgcccctgtgagcgatacaatcacggcacggtggtagaattctactgcgatccaggatactccctgacgagcgattacaaatatatcacgtgccaatacggtgaatggtttccttcctatcaggtctactgcatcaaatctgagcaaacatggccaagtacccacgaaaccctgcttactacgtggaagatagtggctttcaccgctactagcgttctgctggtattactcctggtcattcttgcaaggatgttccagacgaagtttaaggcacacttccctcctcgaggccctcccagatcaagttcatctgatcctgatttcgtcgtagtcgatggggtcccagtcatgctgccatcttatgacgaggcggtctctggtggtctgagcgctctgggtcctggctacatggctagtgtgggccagggatgccctctgcctgtcgatgaccaatctcccccagcatatccaggctcaggcgatacagacaccggacctggggaaagcgagacgtgcgacagtgtaagcgggagttccgaactgctgcagagcctgtatagcccacccagatgtcaagagtcaacccatccggcttctgacaatcctgacatcatagcctcaaccgctgaagaggtcgcgtcgacctccccgggaatcgacatcgccgatgaaattccgctcatggaagaggatccttag

SEQ ID NO: 30666 - DNA, 993 bp, Artificial Sequence
  Description of Artificial Sequence: Synthetic coding sequence
atggtttcactctgtcgggacgacgggacctggaacaatctgccaatctgccagggctgtctgagacctctggcctcctcaaacgggtatgtaaatatctctgagcttcagacttcgttcccagtcggcacagttatatcctatcgatgcttccctggttttaaactggacggttctgcatatctcgagtgcttgcagaacctcatttggtcaagttctccaccccgctgtctcgccttagaggtttgcccccttcctccaatggtgagtcatggcgatttcgtctgccatcctcgaccctgtgagagatacaaccacggcacggtggtagagttctattgtgatcctggctacagtctgaccagcgattataagtatatcacttgccaatatggagaatggtttcccagctaccaggtgtactgcattaagtcagaacaaacatggccttccactcatgagacactgctgacgacctggaaaatcgtggcatttacggcaacatctgtgttgctggtacttttgcttgtcatactggcacgcatgttccagactaagttcaaggctcatttccccccccgtggcccccctaggtctagcagctccgacccagattttgttgtggtggatggggtaccagtaatgctgcctagttacgatgaggcagtgtcgggtggattgtccgccttggggccagggtacatggcctctgtgggacagggttgccctctgccagtggacgatcagagtccgcctgcatacccagggtcaggcgacaccgacacaggacctggagagagcgaaacttgcgactccgtgagcggctcttcggagctactgcagtcattatattctccccctcggtgtcaggaaagcactcacccggcaagcgacaatccagacattatcgcttctactgccgaagaggttgcctctacctctcctggaattgacatcgccgatgagatacctctcatggaggaagatccatag

SEQ ID NO: 30667 - DNA, 1266 bp, Artificial Sequence
  Description of Artificial Sequence: Synthetic coding sequence
atgtaccacgggatgaacccctctaacggagacggattcctggaacagcagcagcaacagcaacagccgcaaagcccacagcgactgttggccgtgatattgtggttccagctggctctgtgttttggccccgcacagctgacaggcgactgcaggattcctcagatcgaagacgccgagatccataacaaaacgtaccggcatggtgaaaagctgatcattacgtgccatgaaggttttaaaattcggtatcccgacctccacaacatggtgagtctgtgtagggacgatgggacctggaataacctcccaatctgccaggggtgcctccgacccctggctagttccaacggctatgttaacatctctgagctgcagaccagctttcccgttggaaccgtgatcagctatagatgcttccccgggtttaaattggatggaagtgcttatttagagtgtctccagaacctgatttggtcttcatcacctccacggtgccttgcactcgaagcacaggtgtgccccctcccgcctatggtgtcacacggagattttgtttgtcacccacgaccttgcgaacgatataaccacgggaccgttgttgagttctattgcgatcctggatactcactaacaagcgactataagtatatcacctgccagtacggtgagtggttcccaagctaccaggtttattgtatcaagtctgagcaaacatggccaagtacacatgaaacactccttacaacttggaaaatcgtggcattcaccgccaccagcgtgctcctagtgctacttcttgtaatccttgctcggatgtttcagacaaaattcaaagcgcactttcccccgcgcggcccccctcgctcctcctctagcgatcccgacttcgtggtggtggacggggtgcctgtgatgctgccatcctacgatgaggccgtctctgggggcctgtccgccctgggaccggggtacatggcttctgttggacagggatgcccactgccagttgacgaccaatcaccaccagcctatcccggcagtggagataccgacacaggtcctggcgagtctgagacttgcgactctgtctctggctcctctgagctgttgcaaagcctgtactcacctccaaggtgtcaagaaagcacacaccccgcttcagataaccctgatataattgcctccacagcagaggaagtcgcctcaacctctcctggtatcgatatcgccgacgaaattccacttatggaggaagacccttag

SEQ ID NO: 30668 - DNA, 1890 bp, Artificial Sequence
  Description of Artificial Sequence: Synthetic coding sequence
atgacagccgagggcccatctcctccagctagatggcatagaaggttgccaggactgtgggccgcagcgctgttgctcctgggattaccgaggctgtccgttagagctgatgggaagttctttgtcctagagtcccaaaatggtagccagggtctccagttggaagctgccaggctatcctgtaaatcccgcggcgcacatctggcctcagccgatgagctcagacgggtggtgcaggattgcagttttgccgtgtgcaccaccggatggttggctgatggcacgctcggaacaacagtatgctccaaaggcagcggagagcagcaaatcatgcgggcagtggacgtccggatagaaagtaacccagtgcctgggggaacgtactcagctctttgcataaaggacgaagagaagccgtgtggagacccacctagctttccgcataccatcctgcagggaagaactggcttggagatgggcgacgagcttttatatgtttgcgcccccgggcacatcatgggacaccgtgagactgcatttacactcctctgtaattcctgtggagagtggtacgggcttgtgcaggcttgcggcaaagacgaagctgaggcccatattgattacgaggacaattttccagatgaccggagcgtcagcttccgagagttgatggaagatagcagaacggaagctgatgaagaccgtgggcagggcgactctagcgaagaagctcctaaacaggatcgcctggttagcattagtgttggccgggaaaacatcgccagagataaggtattcgtgccaacaaccggactgcctggagctggcagctctgtacctgctgattcgcccggctcacgactcctgcaaaaacacctgttttggttcccagcagaggccttccataagcccgggctggagaaggaggtcgatgatgacacaaaaaagcagttcagtgcaggagataatcattctggggtcaagctggtgcctggagagcccgagactaaggttatctacggtaacaccgatggcccctctggccccttcgttgggaagaacgattccaaggctggggatccggtggttagttcttctgatgagagctggctggatggatacccggtgacagagggagcctggcggaagactgaagccgaagaagaagaggacggagacagaggggacgggagcgtgggcctggatgagaatgtcctcgttacccctgaccagcccattctggttgaggtgaagaagccaaagtcctcaacactcacgccatctgagggtatgactcacagctcagtcttaccgtcccagatgctggatgtcgaggcactggccttacggcccgtgaacgcttctgagacagaaggtatcggggatggcgacctgaccaagtatcagagcacgttgccttggagattcattacagaggagagcccaatggccactttgtcctacgaacttacgtcaagcacactggaaatcttaacagtcaacacagtcaaacagactccaaaccacatcccttctaccataatggctactactcagcctccggtggagacaactgttcctgagatacaggactcgtttccttatttgctgtctgaagatttctttgggcaggagggaccagggcccggggccagcgaggagctgcatcccactctggagtcttgcgttggggacggatgtcctggcctttcccgcggcccggtgatcgctaccattgtgactgtcctctgcctgctgctgctcttagccggcgtggggatggtgtggggctacagaaagtgccagcacaagtcctctgtatacaaattgaatgttggccaacgccaggcgagacattatcaccagcaaatcgaaatggagaaggtgtag

SEQ ID NO: 30669 - DNA, 3825 bp, Artificial Sequence
  Description of Artificial Sequence: Synthetic coding sequence
atggcttcagggagtggtgactcagtgacacggaggtcagttgcttctcagttttttacccaggaagaaggccctggaattgacggcatgaccacctcggagcgggtagtagatcttctgaatcaggcagccctgatcacaaatgacagcaagattaccgtgctcaagcaagtgcaagaactcatcattaataaggatcccaccctgctggataattttctggacgaaattatagcattccaagccgataagtcaatcgaggtgcgaaagtttgtcattggctttatcgaagaggcgtgcaaaagagatatcgaactcctgcttaaattgatcgccaacctcaacatgctgctgagggatgaaaacgtcaacgtagtgaagaaggctattcttactatgacccagctgtacaaagtcgccctacagtggatggtaaaatcacgggttatttctgagctgcaggaggcttgttgggacatggtgagcgctatggctggcgatatcattttgctgttggattctgacaacgatggaattaggacgcatgccatcaagtttgttgaaggcctgatcgttacattatccccgagaatggctgattccgagatcccgcgcaggcaagagcacgatattagtcttgacaggattccccgtgatcacccctacatccagtacaacgtgctttgggaggaaggaaaggctgccctggaacagctgctcaaattcatggtgcaccctgcaataagctccattaacctgactacggccttaggaagcctggccaatatcgctaggcaaaggcctatgtttatgagtgaggtaatccaggcctacgagacactgcatgcaaacctgccaccaaccttagccaagagccaggtgtccagcgtccggaagaatcttaagctacatcttctgtcagtccttaagcatcccgctagccttgagtttcaggcgcaaataacaactctcctagttgatctcggtactccacaggccgagatcgctagaaatatgcctagctctaaggatacccgcaagaggcctcgcgatgatagcgattccaccttaaaaaagatgaaactggaaccaaatttgggcgaggacgacgaggataaggacctggaaccgggccctagcggaacgtccaaggcgtccgcacagatttctggccagtccgacactgatatcacagcggagttcttgcagccactgcttacccccgataatgtcgctaatctcgtcctgatcagcatggtgtacctgcccgaagctatgccagcctcatttcaggccatatataccccggtggaatctgccggcacagaggctcagataaaacatctggccaggctcatggcaactcagatgacagcggctggcctggggcctggcgttgagcagaccaagcaatgtaaagaggagccaaaagaggagaaggtggtcaagacggagtccgttctgatcaagagacggctttcagctcaggggcaggccatttccgtggtggggtccctaagttctatgagtcccttggaggaggaggccccccaagcgaaacggcggcccgaacctattatccccgtgacacagccaagactcgctggcgccggggggcggaagaaaatttttcgtttatccgacgtcctaaagccactgacggacgcccaggtggaagctatgaaacttggagccgtgaagcggatccttcgcgccgaaaaagccgttgcctgctctggtgccgcccaggtccgtattaaaattctggcatcgctggttacacagtttaactctggacttaaggctgaggtacttagttttatccttgaggatgtaagggctcggcttgacctagcgttcgcttggctgtatcaggagtataatgcttacttggcggcgggggcctctggatccctggataaatatgaagattgcctgattcgcctactcagtggattgcaagagaaaccagatcaaaaagacggcattttcacaaaagtcgtgttggaagcacccctgataaccgagagcgcactggaagtagttagaaagtactgtgaagatgaatcacgaacttacttaggcatgtccacacttagggatctcatatttaagagaccatcccgacagttccagtacctacacgtgctgctggatctatccagccacgaaaaagataaagtgcgcagtcaggccctcctgtttatcaagcggatgtacgagaaggaacagttgcgcgaatacgtagagaagtttgccctgaattatctgcagctcctggtacaccctaatccccctagcgtgctgtttggagctgataaagacacggaggtggccgccccctggaccgaagaaactgtgaaacagtgcctgtacctgtatttggctctgttaccacagaatcataaacttattcacgaactggctgccgtttacactgaggccatagcagatattaaaagaacagtgctgagagttattgagcaacccatacgtggaatgggtatgaacagtccagagctgctgttgttagtcgagaattgtcccaagggtgcagaaactctcgtcactaggtgtttgcactctctcacagataaagtacctccaagtcccgaactggtgaaaagggtgagagatctgtatcacaaacgactcccagatgtccggtttctgataccggtactcaacggacttgagaaaaaagaagtgatccaagcactgcctaagcttatcaaattgaacccaattgtggtgaaagaggtcttcaaccgcctcctcggcacgcagcacggggaaggaaattctgcactctcgccactgaaccccggagagctgctgatagcgctccacaatattgattccgtgaagtgcgatatgaagagcatcattaaggccacaaacctgtgtttcgcagagagaaatgtctacactagcgaggtgctagccgttgttatgcagcagctcatggagcagagtcccctgcccatgctcctcatgcgcacagtgatacagtcactgacaatgtatccaaggcttggcgggttcgtgatgaacattctgagccgactcatcatgaaacaggtgtggaaatatcccaaggtttgggaggggtttattaaatgctgtcaaaggacaaaaccacaatcttttcaggttatcctgcagcttcccccgcagcagttaggcgccgtttttgacaagtgtccagagctcagagaacccctcctcgcacatgtaaggtcattcacaccacaccagcaggcgcacattcctaactctatcatgacaattctggaggcttccggtaaacaggaacccgaggcaaaagaggcccctgctggaccattggaagaggatgatctcgaacccctcacactcgcacccgctcctgcaccacgacctccccaggatctgattggcttacggctggcccaggagaaggctctcaaaagacagttggaggaggaacagaaattaaagccagggggtgtgggagcccccagctcatcttcaccttccccgagtccatccgctaggcctgggcctcccccttccgaggaggccatggatttccgggaagaaggccctgagtgcgagacccctggtatctttatcagtatggacgacgacagtgggcttaccgaagcagctctcctggattcaagcctggaggggccgctgccaaaggaaaccgctgcgggagggctgacactgaaagaggaaaggtcaccacagaccctggccccggtgggggaggacgcgatgaaaactccttcaccggccgctgaagatgcccgggagcctgaagctaaggggaatagttag

SEQ ID NO: 30670 - DNA, 465 bp, Artificial Sequence
  Description of Artificial Sequence: Synthetic coding sequence
ttgacagctgcaatggcctcagggtcaggcgactccgtgaccaggcggtctgtggcatcacaattctttacacaagaggagggcccaggcattgatggcatgaccacatcagagcgcgtcgtggatctgctcaaccaggccgctttgataaccaatgactcaaaaatcactgtgctcaaacaggtccaggagctcatcataaataaggatcctacactccttgacaattttctggatgaaattatcgccttccaggctgacaaatccatcgaggtccgaaagtttgtgattggctttatcgaagaggcttgtaagagggatatcgagttgctgctcaaattaatagctaacctgaatatgctgttaagagacgagaatgtcaacgtggtcaaaaaagccattctgaccatgacacagctgcccgtgccggtacccgcatgccctcctcgacctcaattaccctag

SEQ ID NO: 30671 - DNA, 3900 bp, Artificial Sequence
  Description of Artificial Sequence: Synthetic coding sequence
atgtccaggtctcgcgcatccattcacaggggcagcatacccgcgatgagttacgctccttttagggacgtccggggaccaagcatgcacagaacccaatacgttcattcaccttacgaccgtcccggatggaacccgcgtttctgcattatatccggtaaccagctgttgatgctggacgaagacgaaatccatccgctacttattcgcgacaggcgaagtgaatcctcaaggaataagctgttgcgaaggacggtgtcagtacccgtggagggccgcccccatggcgaacacgaatatcacctcggacgctccaggcgcaaatcagtgccaggcggtaagcagtactcaatggagggggcaccagcagctccttttaggcccagccagggcttcctcagtcggcgcttgaagtctagtataaagaggacaaaatcacaacccaagctggatcggacgagctcatttcggcagattttgcccaggtttaggtcggcagatcatgatagagcccggctgatgcaatccttcaaagaatctcactcccacgagtccctgctgtctcctagcagcgctgctgaggccttggagttaaatctcgacgaagacagtataattaagcctgtacactcctccatcttaggccaagagttttgtttcgaggtgacgacatcctccggcacaaaatgcttcgcttgtcgcagtgctgccgagcgagataagtggatagaaaatttacaaagggccgttaagccgaacaaggacaacagccggcgtgtggacaacgttctcaagctgtggattatcgaggcccgggagttgcctcccaaaaaaaggtactattgcgagttatgcctggacgatatgctctatgcccgcacaacaagcaaacctaggagcgcctcaggcgacaccgttttttggggcgaacacttcgagtttaataatctcccggccgtccgggcgcttcgtctccacctgtatagggactccgacaagaagcgcaagaaagacaaggccggatacgtgggtctggtgactgttccggtagccacgctagctgggcgtcattttacggagcagtggtacccagtcacccttcccacaggctccggcggttccggaggcatgggctccggcggcggtggcgggtcaggaggcggtagtggcgggaagggtaagggaggctgcccggccgttcggttgaaagcacgttaccagaccatgtccatcctacctatggagctgtacaaggagtttgccgagtatgtgactaatcactacagaatgctgtgtgcggtgctggagcccgccctcaacgtgaagggcaaagaggaggttgctagcgcgcttgtacacattctccaatctaccggcaaggccaaagactttctatccgatatggccatgagtgaagtggaccgctttatggaaagggaacatctgatcttccgggaaaatacgttggctactaaggccatcgaagagtacatgaggctgatcggccagaaatacctcaaggatgctattggggagtttatacgggcgttatatgaaagcgaggagaactgtgaggtggacccgatcaagtgcacagcaagtagtttggcagagcaccaagccaatctaaggatgtgctgtgaactcgcgctgtgtaaggtggtcaacagccattgcgtgttcccaagagagctcaaagaggttttcgcatcatggcgacttagatgcgctgaacgaggccgagaggatattgcagaccggctgatctcagcctctctgttccttaggtttctctgtcctgctattatgtctccctccctatttgggctgatgcaagagtatcccgacgagcaaacgtctcggaccctgaccctgattgccaaggttattcaaaaccttgctaatttcagtaagttcactagtaaagaagacttcttgggctttatgaatgaatttctggagctggagtggggatctatgcagcagttcctttacgagatctctaatcttgatactctgaccaattctagttcattcgaagggtatatcgatctggggcgagagctgtcaaccctacacgctcttctttgggaagtgctgccccaactctcgaaggaagccctactcaagttgggtccactgcccagactactcaacgacatttctactgctttgaggaacccaaacatccaacgccagccatcacggcaaagtgagaggcctagaccacagcctgtcgtgttgagaggacctagcgccgaaatgcagggatacatgatgagagacctgaattcatcaatagacctgcagtcatttatggccagggggttaaattcttctatggacatggctcgcttaccctcgccaaccaaagagaagccacccccccctcccccgggggggggcaaggacctgttctatgtttcccggcctccccttgcccggagctcaccagcctactgcacctctagctccgacatcactgagcctgagcagaagatgttaagtgtgaataagtctgtgtcgatgctagacttacagggcgatggacctggagggagactgaattcttcttctgtatcgaatttggccgccgtcggcgacctgctccattccagccaggccagtctgacggctgccctggggctgagacccgcccctgccgggcggctgagccaggggagcggatccagtatcacagcagcaggaatgcgcctcagtcaaatgggggtgacgactgacggggtgccggcccagcagttgagaatcccattaagctttcagaacccactctttcatatggccgccgacggtcctggacctcccggggggcatggggggggaggcggccatggccccccatcctcccaccatcaccaccatcatcaccaccatcatcgaggaggggagcctcctggtgacacctttgcaccttttcatgggtattctaaatctgaagatctgtcttcgggtgtccctaaacctccggccgcctccattctccactcccactcatacagcgatgagttcggtcccagcggcacagatttcacccgtcgtcagctaagcctgcaagacaatctccagcatatgctgtcaccacctcagattacaatcggccctcagagacccgcacctagcggcccaggtggagggtcaggcggcgggagcggcggtggcggggggggccagcctcccccccttcagaggggcaagtcgcagcagctcactgtttctgctgcacaaaaacccaggccctcttccggtaacctgctgcagagcccggagccatcttacggacccgctagaccaaggcagcaatcattgtctaaggagggctcaatcggggggtctgggggctcaggtggagggggaggtggagggttgaaaccttcaatcacaaagcagcactctcaaactccttccaccctgaatccgactatgcctgcgtcagagaggaccgtcgcgtgggtgtcaaatatgccccacctatcagctgacattgagagcgctcacatcgagcgggaggaatataaactgaaggagtattccaagtctatggacgagagtcgtttagaccgggtcaaagagtatgaggaagagatccacagtctgaaggagcgtcttcacatgtctaatcgaaagctagaagaatatgagcgccggctgttgagccaggaagaacagacctcaaaaatcctgatgcaatatcaagcccgacttgagcagtcagagaagcgtctccgacagcagcaggcagaaaaagactcccagatcaaatccattattgggaggctgatgctggtggaggaggagctccgccgcgatcatccagccatggctgagccgttacctgagcccaagaaaaggttactggacgctcagttattaatccggtag

SEQ ID NO: 30672 - DNA, 1464 bp, Artificial Sequence
  Description of Artificial Sequence: Synthetic coding sequence
gaggacttcttgggttttatgaatgaattcctggaattggagtggggaagcatgcagcagtttctctacgaaatttctaatttggacactttgaccaactcttcgtcgttcgaaggctatatcgatctggggcgggagctaagtaccctgcacgctctactttgggaagtgctgcctcagttatcgaaggaggccctgctgaagctaggacccctcccacggttgctcaatgatatctctaccgcactgaggaatccaaatattcagaggcagcccagtagacagagcgagaggcctcggccacagcccgtcgtgctgagaggcccgagtgccgaaatgcaaggatatatgatgagagacctgaactcatcgatggacatggcgcggctgccgagtccaacaaaggagaagcccccgcctcccccaccgggaggcggcaaagatttattttatgtgagtaggccacccctggccaggagttcacccgcatactgtacctcgtctagcgatataacggagcccgaacaaaagatgttaagcgtgaacaaatccgtttccatgctggatctgcaaggcgatggtcccgggggccgtctcaattcaagctcagttagcaatttggcagccgtgggcgacctcttgcactccagtcaagctagtctgacagctgccctgggattgcggccagcaccagctggtagactaagccaggggtctgggtctagtattacggcggctggcatgaggctgagccaaatgggagtcacaaccgatggggtccctgcgcagcaactaagaatacccctctcgttccagaacccacttttccatatggcagcagacgggccgggcccccccggtggacacggcggcggcggagggcacggacctccgagcagccatcatcaccatcaccatcatcatcaccaccggggcggagagcctccaggagacacgttcgccccctttcacggttactcaaagtccgaggatctgagtagcggcgttccaaagccccccgcagcctctatcctccattcccattcatattcagacgagtttgggcccagtggcacagactttacccggcgccagctgtccctgcaggacaacctccagcatatgctaagccctccccaaatcacgatcggtccacagcggcctgcaccgagtggccctggcgggggctccggtggtggctcgggcgggggaggggggggacagccccctcctctccagcggggcaaatctcaacagctaaccgtgtccgcagcccagaagccccgaccatcctcaggcaatttactgcagagcccggagccaagctacggtccagccagaccgaggcagcagtcactgtccaaggaggggagtattggcggatccggcggaagcggagggggaggcgggggtgggctaaaaccttccattacaaagcagcactcccagacgccatccacctag

SEQ ID NO: 30673 - DNA, 3900 bp, Artificial Sequence
  Description of Artificial Sequence: Synthetic coding sequence
atgagtcgctcaagggcctcgattcatcgcggctctattcccgccatgtcttatgcacccttccgcgacgtgcgaggaccatccatgcaccgaacgcagtacgttcactccccctatgaccggcctgggtggaatccccgcttttgtattatctctggtaatcagctgctgatgcttgacgaggatgaaattcacccacttttgataagagacaggcgatctgaaagctctcggaataaattactcaggcgcactgtctccgttccagtcgagggtagaccccacggcgaacacgaataccacctcggtcggagtcgtaggaaaagcgtccccggaggcaaacagtattctatggagggagctccagcagccccttttcggccctcccaaggctttctctccaggcgcctcaagtcttcaatcaagcggaccaagagccaaccaaaattagatcgaacaagctcatttcgccaaatccttcctcggtttcgatcagccgatcacgaccgggcccgtctgatgcagtcatttaaggaaagccattctcatgagtcgcttctttccccatccagtgctgctgaggccctagagttgaacttagatgaagactctataatcaaacccgtccatagtagtattcttggtcaggagttttgctttgaggttaccacgtcttcaggaaccaagtgtttcgcttgcagaagtgccgccgagcgggacaaatggatagagaatctccaaagagctgttaagcccaacaaggacaattcgagaagggtggataacgtacttaagctttggatcattgaggcccgggaactcccgcccaagaaacgatactactgcgaactttgtttggatgatatgttgtatgcccgcactacttctaaaccccgctctgcatccggagataccgtgttctggggagaacatttcgagttcaataacctcccagctgttcgggctctccgtctgcacctgtacagagatagcgataagaaaaggaagaaagataaggccggctacgtggggctggtgaccgtcccagttgccaccttagcggggagacactttactgaacagtggtatcctgtgacacttcctaccggctccgggggctcaggtggcatggggtccgggggtggtggtggaagcggcggaggctctggcgggaaagggaagggagggtgccctgccgttcgcttgaaggccagataccagaccatgtcaatccttcctatggagctttataaagaattcgccgaatatgtgactaatcattaccgaatgctgtgtgctgtgctcgaacctgctttgaatgtcaaaggaaaagaagaggtcgcctcggctctggtacatatcctccagtctacgggcaaagcaaaagacttcctgtccgatatggctatgtctgaggttgaccggtttatggagcgcgaacaccttatcttccgcgaaaatacactcgcgaccaaggctatcgaggagtatatgcgacttatcgggcagaagtatttgaaagatgctattggagagttcatcagggcgctctatgagtccgaggaaaactgtgaggtggaccctataaaatgcactgcaagctctctggctgaacatcaggctaatctgaggatgtgctgcgaactggctctgtgtaaggtggtgaactctcactgtgtcttcccgcgggagctgaaagaggtctttgctagctggaggctgcgctgcgcagagcgcggcagggaagatatcgctgaccgactgatctccgctagcctcttcctacgctttctctgccccgccataatgtccccgtcactgttcggactgatgcaagaatatccagatgagcagacctctagaactttgaccttgatagcaaaagtgatccagaaccttgctaacttcagcaagttcacatccaaagaagatttcctgggattcatgaatgagtttcttgaacttgagtggggttctatgcagcaatttctgtacgaaatatccaatctcgacactcttaccaacagctcatcgtttgagggctacatagatctaggaagggaactgtcaactctgcacgccttgctttgggaagttttgccacagctgagcaaggaagcacttttgaaactgggacccctcccaagattacttaacgacatttccactgctctaaggaacccaaacattcagcggcagccatcccgccagtctgaaaggccccgtccccagccagtggtgttgaggggaccttcagccgagatgcagggttacatgatgcgagatttgaacagttccatcgatctacaaagttttatggcgcgcgggcttaattcttctatggatatggcacggctcccaagccctactaaagaaaaaccacctcctccaccccctggcggcgggaaagacctgttctacgtcagccggccacctcttgctcgctcttcacccgcttactgtacttcttctagcgacataactgagccagagcagaaaatgcttagcgtaaataagtcggtaagtatgctcgatctacagggagacggaccaggcggcagacttaatagcagctctgtcagcaacctggcagcggtgggagacctgttacatagcagccaggcctccctcactgctgccctgggactgcgccccgcgcccgctgggaggctaagtcagggtagtggctcaagcattacagctgctggcatgcgactgtcccagatgggggtcaccaccgatggtgtgcccgctcagcaactgcggatccccttgtcttttcagaaccctctattccacatggcagcggacggtcctggacctccagggggccacggagggggcggcgggcatggccctccatcttcccatcatcatcaccaccaccaccatcatcacagagggggggagccccctggggataccttcgctccattccatggctacagtaagtccgaggacctgagctctggcgtaccaaaaccacccgcagcgtcaattctgcattcgcatagctactctgacgagtttggcccctcaggaactgatttcacaaggcgacagctaagcctccaggacaacttgcaacacatgttgagcccaccgcagattactattggcccccagaggcccgccccctcgggacctggcggcggcagcggaggaggctccggaggaggcggcgggggccagccacctccccttcagcgaggtaagagccagcagctgacagtgtccgctgcacagaagcctagaccatcttccggtaaccttctgcaatcaccggaaccgagttacggcccggcgagaccaagacagcagagtctctcaaaggaaggctcgattgggggcagcgggggctctggcggaggcggtggcggggggctgaagccgtctattaccaaacaacattcccaaacacctagcacgcttaatcccactatgcctgctagcgaacgaacagttgcctgggtgtcaaacatgccacacctgagcgcagatatcgaatccgcccacatcgagcgggaagagtacaagttgaaagaatatagcaaaagtatggacgagtcccggttggatagggtgaaggagtacgaagaggagatccacagtctgaaagagcgtctgcacatgtcaaatcgcaaattagaagaatatgagaggcggctgctcagtcaagaggaacagacaagtaagatcctgatgcaataccaggcccgcctagaacagagcgagaaacgcttgagacagcagcaagcagaaaaagattcacagatcaagagcatcattgggaggctgatgttagtagaagaagagttgaggcgtgaccaccccgccatggcagagccccttccagagcctaagaagagattgctcgatgcacagctgcttattcggtag

SEQ ID NO: 30674 - DNA, 3855 bp, Artificial Sequence
  Description of Artificial Sequence: Synthetic coding sequence
atgggcttacggccacccaccccttctccctccggaggtagctgctctgggtcactgcctcccccgagccgctgccagcccctgaggcgccgttgcagctcttgttgctttccaggcgaatatcatctgggtcgttccaggaggaaaagtgtgccgggaggcaagcaatattctatggagggagccccggcagcacctttcagaccttcgcaagggtttctctccaggaggctgaagagttcaatcaagcggacaaaaagccagcccaagctggatcggacaagctcctttcgccagatcttgccgcgctttagaagtgccgaccacgatagggctagactaatgcagtctttcaaggagagccactcacatgagagcctgctgtctccctcttccgccgctgaggccctcgagctgaacctcgacgaggactctattatcaagcccgttcactcttccattcttggacaggagttctgtttcgaggtcaccacttcctctggtaccaaatgcttcgcttgcaggagcgccgcagaacgggataaatggattgaaaaccttcagagagcggtgaagccaaacaaggacaactctcgccgcgtagataatgtcctgaagctgtggatcatcgaggctcgggaattaccccctaagaagcgttactattgtgagctctgtctggatgatatgctgtatgcaagaactaccagtaagccgcgcagtgccagcggcgatacggttttctggggcgaacactttgagttcaacaatctgcccgctgtacgtgctctgcggcttcacctatacagggattctgacaaaaaaaggaaaaaggataaggccggatacgtggggctggtcacggtgcccgtcgcaacattagccggtcgccattttaccgagcaatggtaccccgttaccttgccgaccgggagcggggggtctggggggatgggttccggaggtggaggggggagtggcggaggatccggcggcaaagggaaaggcggctgcccagctgtgcgcttgaaggccagatatcagactatgagcattctgccaatggaattgtataaggagtttgcagagtacgttaccaatcattatcggatgttgtgcgcggtgctcgaacctgcattgaacgtgaaaggcaaagaggaagtggcctcagcgctagtacacattctgcaaagcacgggaaaggctaaagattttttgagcgacatggccatgagtgaggtcgatcggtttatggagagggagcacttaatcttcagagagaacaccctggcaacaaaggcgattgaggaatatatgcggcttatcggccagaagtatttgaaggacgctattggggagtttattcgcgccctgtatgaatccgaggaaaactgtgaagttgacccaattaaatgtaccgcatcctcattagcagagcaccaggcaaacttgcggatgtgttgtgaactggctctgtgtaaggtcgtaaattcccactgtgtattccctagggaactaaaagaggtattcgctagctggcgactgcggtgcgcagagcgcgggcgggaggacatcgccgatagattgatttctgcgtccttgtttctgcgatttctctgccctgcaattatgtccccatcattgtttggactcatgcaggaatacccggatgaacagactagccgcacactaactctcatagcaaaggtcattcagaatctggcaaatttttccaaattcacgtcaaaagaggatttcttgggattcatgaatgagttccttgaactcgaatggggcagcatgcaacaattcctgtacgagatcagcaacctggatactctcacaaacagtagcagtttcgagggatacatagatctgggacgtgaactgagtaccctgcacgcactgctgtgggaggtactgccacagttgagcaaagaggctctactaaaactgggacctctgcctaggttgctcaacgacattagtacagctttgaggaatccaaatatccagcggcagccatcccgacaatcagaacggccaagaccccaacctgttgtcctgagagggccttcagccgagatgcaggggtacatgatgcgcgatctgaatagtagtatagatctgcaatcttttatggcccggggactcaactcatctatggacatggctcgcctacccagtccgactaaagagaagcccccacctccaccacctgggggcggtaaagatcttttttacgtttctagaccgcccctcgcacggtcttccccagcgtattgcactagctccagtgatataactgaacctgagcagaaaatgctgtctgtcaataagtccgtgtctatgctcgacctgcagggagacggcccgggcggtaggttaaattcctcctcagtaagtaatctcgctgctgtgggcgacctcctacactcttcccaggccagcttaaccgcggcactggggctgaggcccgcccctgcagggcgcctgagccagggtagcggatcttcaatcaccgccgctggcatgagactttctcagatgggcgtaacgactgatggcgtgcctgcgcagcagctgcgtattccgctcagctttcaaaacccactgtttcacatggcagcagatgggcctggaccaccaggagggcacggtggtggaggaggacacgggcctccttccagtcaccaccatcaccaccatcaccaccaccaccgggggggagaaccccccggtgacacatttgcacccttccatggttacagtaagagtgaggacttgagctcgggcgtgcccaagcctcccgcagcgagtatactgcactcacatagttactctgatgaattcggccccagtggtacggactttaccaggcgtcagctgagcctccaggacaacctgcagcatatgctgtccccacctcagattacaatcgggccccaacgccctgcccctagcgggcctgggggaggctctggtggaggatccgggggaggtggcggggggcagcctcccccactccagcggggcaagagtcagcagctgacagtatctgcggcccagaagccaaggccctcatcaggcaacctgctccagtctcccgagccaagctatggacccgcccgccctcggcagcagagcctgagtaaagaagggtctattggcgggtctggcggctcagggggagggggggggggcgggcttaaaccaagtatcaccaaacagcacagccagactcccagtactttgaacccgacaatgcctgcaagtgagcggaccgttgcttgggtgagcaacatgccgcacctgtcagcagacattgagagcgcacacattgagcgtgaggagtacaagttaaaagagtatagcaagtctatggacgaatctcggctggatcgggtcaaggaatacgaagaagagatccactctttgaaggagcggctgcatatgtctaaccgcaaactggaagaatacgagcggagactgctgagtcaggaagaacagacaagcaagatcctgatgcagtaccaggcacggcttgaacagtctgagaagcggttgcgccaacagcaggcagagaaagactctcagattaagtccatcatcggcaggctgatgctggtggaggaagaactgaggcgtgaccacccggccatggcagaaccattgcccgagcctaagaaacgcctgttggacgctcaggaacggcaactgccgcctctggggccgactaatccccgagtgacactggcccctccctggaacggcttggcgcctcccgctccacctccaccacctcgcctgcagatcacagaaaacggagagtttcgcaacaccgcggaccactag

SEQ ID NO: 30675 - DNA, 4032 bp, Artificial Sequence
  Description of Artificial Sequence: Synthetic coding sequence
atgagcagatcccgggccagcatacacaggggttccatcccagccatgtcatacgccccctttcgggacgtgcggggccccagtatgcatcggacccagtacgttcactctccatacgaccgcccaggatggaacccaagattctgtattattagtggaaaccagctgctgatgctggatgaagatgagattcacccacttttgatccgtgatcggcggtcagagtcaagcagaaacaaactgctgaggagaaccgtaagtgtgcccgtggaaggacgtccccatggagaacacgaatatcaccttgggcgctcgcggcggaagagcgttcccggaggaaaacagtattccatggagggggctcctgctgcccccttccgacccagccaggggttcctctcacgaagactcaaatcctccattaaaaggaccaaaagccagccaaaactggatcggacaagctccttccgtcagatcctgccccgtttcagatccgccgatcacgatcgggcaagactgatgcaatccttcaaagagtcccatagccatgagagcctactgtccccatcatccgccgcagaagctctggagttgaatctggacgaggactcaattattaagccagtgcattctagcattcttggccaggagttttgctttgaggtcactacctcaagcgggactaaatgcttcgcttgcagatccgcagccgagcgggataaatggatcgaaaatctccagagggccgtgaagccaaataaagataacagccgccgggtggataacgtcttgaaactgtggattattgaggcccgcgaactgcctccaaagaagcggtactactgtgaactgtgtttggacgacatgctctacgcaaggactacgtctaagcccagaagcgctagtggcgatactgtgttctggggcgagcatttcgagttcaataatctccccgctgtccgcgccctgagacttcacctttaccgcgatagtgacaagaaacgcaagaaggacaaggctggctacgtggggcttgtgacagttcccgtcgcaacccttgcagggcggcacttcactgaacagtggtatccggtgactttgcctaccggcagtgggggatcaggaggcatgggtagtggtggcggtggaggatctggtggcgggtctggtgggaaaggaaaagggggctgccctgccgtcaggctgaaagccaggtaccaaactatgagtatcctacccatggagctgtataaagaattcgctgaatatgtgacaaatcactatagaatgttatgcgccgtgttggagccggccttaaacgtgaagggcaaggaggaggtggcatcagcactggtacacatcctgcaatctacaggaaaggccaaagactttctcagtgacatggctatgtccgaggtggaccgctttatggagcgggaacacttgatctttcgggagaatacacttgccacgaaagccattgaggaatacatgaggctgattgggcaaaaatacctgaaggatgctatcggtgagtttatcagagcattatacgagtccgaggaaaactgtgaggtcgatccaatcaagtgcactgcttcgagtcttgcagaacatcaggccaatctgaggatgtgctgtgagcttgcactgtgcaaagtggtgaactcgcattgtgtcttcccccgcgagctgaaggaggtctttgcctcatggaggctacgctgcgcagagcgtggcagggaagacatcgctgaccggctgattagtgcatcactcttcctccgatttctctgccctgctatcatgtcaccctcattgtttggcctgatgcaggagtacccagacgaacagacaagcagaacactgacacttattgccaaggtaatccaaaacctcgccaatttcagcaaatttacaagcaaggaagactttttgggtttcatgaatgagttcctcgaactggaatggggctcaatgcagcagttcctttatgagattagtaacctggacaccctgacgaatagtagcagcttcgagggctacatagatctaggccgcgagctaagcacgctgcacgccctgctctgggaggtcttgcctcaactctccaaagaagcactactgaaattgggtcctcttccccgcctactgaatgacatctccactgctcttcgtaaccccaatattcagcgccaacctagccgtcagtctgagcgaccacgaccgcaacctgtggttctgcgtggccccagtgcagaaatgcaaggatacatgatgagggatctcaactcctcaatagatctgcagtcttttatggcgaggggcttgaactccagtatggacatggcaagactcccctctcctacaaaggaaaagccaccgcccccccctccgggcgggggaaaagacctcttctatgtgtcccgacctcctctggcacgatcttcccccgcttactgtacttcatcgtcagatatcacagagcccgagcaaaaaatgctgtctgttaacaagtcagtttctatgctggatctgcagggggacggcccgggagggcgcctgaattcctctagcgtgtctaacctggccgctgtcggggacctgctccattcgtctcaggcatccctgactgccgctctcggcctccgcccagctcctgccggacgacttagtcagggaagcggctcaagtataacagcggcagggatgaggctctctcagatgggggtaaccactgacggcgtgcccgcgcagcagctgaggatccctctatcctttcagaatccactgttccacatggctgctgacgggccagggcctccaggtggtcacggtgggggcggcggacacgggccaccatcctcccaccaccaccaccatcatcaccaccatcatagaggtggtgagcccccaggcgacacctttgccccattccacggttattctaaaagcgaggacctctccagcggtgtgccgaagccaccggctgcatcgatccttcactcacattcgtattcagatgagtttggcccaagtggcactgattttacgagaagacagctgagcctgcaagacaatctacagcacatgctgagcccaccacagataaccatcggcccccaacggccagctcccagcgggcctggcgggggcagcggcggcgggtctggaggggggggcggaggtcagccacctccacttcagagaggcaagtcccaacagctgacagtgtccgccgcacaaaagccgcgaccatcaagtgggaaccttcttcaatcaccagagccctcttacggcccagcacgcccaaggcaacagagcctatcaaaagaggggtcaatcgggggaagcggcggtagcggaggagggggcggaggcggactaaaaccgagcataaccaagcagcatagccagaccccaagcacccttaatcctactatgcccgcgtcagaaaggactgtcgcctgggtctccaacatgccacacctcagcgccgatatcgagtccgctcacatcgagagagaagagtataagttaaaagagtattccaagtcaatggacgaatctagattggacagagtgaaggaatacgaggaggagatccatagcctcaaggagcgactacatatgtcaaataggaagctcgaagaatacgagcgccggttactctctcaagaagaacaaacatccaagattcttatgcaataccaagccaggctggaacagtccgagaagcgattgcggcaacagcaggccgagaaggatagccaaattaagtccattattgggcgcttgatgctggttgaagaagagttgcgcagggaccacccagcaatggctgagcccctacctgagcccaaaaaacgcctattggacgcacaggaaagacaactacccccattgggaccgaccaatccaagagtcacacttgctccaccctggaacggactcgcaccaccagccccacctccccccccgcgtttgcaaatcactgagaatggagaattccgtaatacagccgaccactag

SEQ ID NO: 30676 - DNA, 3879 bp, Artificial Sequence
  Description of Artificial Sequence: Synthetic coding sequence
atgagccggtctagagcctcaatccacaggggttccatcccagccatgtcttatgccccattcagagacgtgcgcggaccgagtatgcaccgaacacaatatgttcactccccctatgatcgtcccggctggaatccgagattttgtattatttcaggaaaccaactgctgatgctggatgaggacgaaattcaccctctgctaataagggatcgccggtcagagtccagtcggaataagctgctccggcggaccgtcagcgtccccgtcgagggtcgcccacacggggaacacgagtaccatctgggacgcagcaggcggaaaagcgtgccaggcggcaaacagtacagtatggaaggggcaccagccgcccctttcaggcccagccagggcttcctttcgcggcggctcaagtcttcaatcaaacgaactaaaagccagccaaagttggaccgcacatcaagctttagacaaatcctgcctagatttaggtcagctgaccacgaccgggcgaggttaatgcaaagttttaaggagagtcattcacacgagtccctcttgtccccctcctcggccgcagaggcactggagctaaatttggacgaggattctatcattaagcccgtgcattcctccatcttgggtcaggagttctgtttcgaagtgactacgtccagcggtacgaaatgttttgcctgccgctccgccgctgaaagggacaaatggatagagaatctgcagagggccgtgaagcccaacaaagataattcccgacgggttgataatgtgctaaagttgtggatcattgaggcaagggaactgccaccgaagaaacgttactactgtgagctttgtttggatgatatgctgtacgcccgcacgactagcaaaccacgcagtgcttccggtgacaccgtcttctggggagaacatttcgagttcaataatttgccggccgtcagagccctccgcctgcatctgtatcgcgactcagacaagaagaggaagaaggacaaggccgggtatgtcggcctggtgactgtgcctgttgctaccctggctgggcggcatttcactgagcagtggtatcctgtaactctgcctacaggatctgggggctctggcggtatggggtctgggggtgggggtggcagtggagggggtagtggaggcaaagggaagggcggttgcccagccgttcgactcaaggccaggtaccaaacaatgtccatcctgcctatggagctctacaaggaattcgcagagtatgtaactaaccattacaggatgctgtgcgctgtgttggagcctgccctgaacgtgaaaggtaaggaagaggtcgcatctgcgctggtccacatcctgcaaagtacaggcaaggccaaggactttctctcggacatggcgatgagtgaagtggaccgttttatggagcgggagcatttgattttcagagagaatacactggctaccaaagccatcgaggagtacatgcgacttataggccagaagtacctgaaagacgcgataggcgaatttataagggcactgtatgaaagcgaggagaattgtgaggtggacccaattaagtgtactgccagtagccttgctgagcatcaagccaatctgagaatgtgttgtgaattagctttgtgtaaggtcgtgaatagccactgtgtgttcccacgggagctgaaagaagtcttcgccagttggagactacggtgcgcggaacgcggtagagaggatattgctgaccgattgatctctgcttcactgttcctccggtttctttgccccgccatcatgtccccgtccctcttcggccttatgcaagagtacccggacgaacagacctcccgcaccctgaccttgattgccaaagtgatccagaacctcgcgaacttcagcaagttcacctctaaagaagacttcctggggttcatgaacgaatttttagagttggagtggggctctatgcagcagttcctgtacgaaatttccaacttggacacgcttaccaattccagctcctttgagggatacatcgacctgggcagggagctatccacgttacacgcactactctgggaagtgcttccccagctgagcaaggaggctctgctgaagcttggcccactgccccgtctgctgaatgacatttccaccgccctccgaaatccgaacattcagaggcaacccagcaggcagtccgagcgccctagaccgcagcccgtggtgctgcggggccctagtgctgaaatgcagggatatatgatgagagacctaaattcaagcatggacatggcccgtctgccgtctccaactaaggaaaaacctcctccaccaccacctgggggcgggaaggatctgttctatgtgagccgcccgcctctcgccagatctagccctgcatattgcacaagtagctcagacatcactgaaccagagcaaaaaatgctttctgtgaataagagtgtgtcaatgttagatctgcagggcgacggaccaggcggccggttgaattctagcagcgtcagcaacctcgccgccgtcggagatctgctacatagtagtcaggcaagcttaaccgctgcattgggcctgagaccggcacccgcaggtcgccttagccagggctccggatctagcatcacggccgcaggcatgagattgagccaaatgggagtgacaactgatggggtgcctgcacagcaattgcgtattcccctcagctttcagaaccccctgtttcacatggcagccgacggccccggtcctccggggggacacggaggcggaggtggtcatggcccccccagctcgcatcaccatcatcaccaccatcatcaccatagaggcggagagcctccaggggatacatttgcacctttccatggctactccaaaagtgaagaccttagcagtggcgtgcccaaaccacctgccgcctccattctacacagccatagctactcagatgagttcgggccatcaggcacagactttactcgcagacagctgagtttgcaggacaatctccagcacatgctaagtccgcctcagataacaatcggtccacaacggcccgcgccatctgggcctggtggcggctccggcggtgggtccggaggaggtggcgggggacagccaccacctcttcagcgggggaaatcccagcagctcactgtctcagccgctcagaagcctaggccaagtagcggcaatctcctgcagtcccctgaaccctcatatggcccagctcgcccccgacagcagtcactaagcaaggaaggtagtatcgggggtagcggtggaagtggcggcggcgggggtggcggcttgaagcctagtatcaccaaacagcatagccagacgccctctaccctgaaccccactatgcccgcaagcgaacgtaccgtggcttgggtgtccaatatgccacacctgtctgccgatatagaaagtgctcacatcgaaagggaagaatataaactgaaggaatattctaaatcgatggatgaaagccgactggaccgagagtatgaagaagagattcatagcttaaaggaaagacttcacatgtcaaatcgaaagctggaggagtacgaacggcgcctgcttagtcaggaggagcagacttccaaaattctgatgcaataccaggccagactagagcaatctgagaagaggctgcgacagcagcaggcagagaaagattcccagataaagagcatcatcgggcgactcatgttggtggaagaagaactgcgcagagaccaccctgcaatggccgaacccctgcccgagccgaagaagcggttgcttgatgcccagcggggctcgtttcccccatgggtgcagcagaccagggtgtag

SEQ ID NO: 30677 - DNA, 4032 bp, Artificial Sequence
  Description of Artificial Sequence: Synthetic coding sequence
atgagccggtcacgtgctagcatccaccgcgggagtattccagccatgtcatatgcacccttcagggatgtgcggggtcctagcatgcatagaacacagtacgttcactcgccatatgatcgtccagggtggaacccaagattctgcatcatatcaggaaatcagctcctgatgttggacgaagacgagatccaccccctgcttatccgtgatagacggtccgagtcttcgagaaacaagctgctgcgacgaaccgtctctgtccctgtggaaggcaggcctcatggtgaacatgagtatcacttgggccggagccgtagaaagtctgttcctggagggaagcagtattctatggaaggcgcgccagccgccccttttaggccgtcccagggctttctcagcagaaggcttaagtcctctataaagaggaccaagtcgcagcccaaactggaccggacctccagctttcgacaaatccttcccagattcagatctgccgaccacgatcgggctcgactgatgcagtcattcaaggaatctcattcccacgaatcgctgctgtctccatctagcgctgccgaggcattggaattaaatcttgacgaggattcaattattaaacctgtccatagttctattctggggcaagaattttgcttcgaagtgactacttcctccggaacaaaatgctttgcttgtcgatcagcggctgaacgcgacaagtggatagagaacctccagcgggctgttaaacccaacaaggataactctcgccgggtagataatgtgctgaagctgtggatcattgaagcacgggagctgccaccgaagaagcgatactactgcgaactgtgcctggacgacatgctgtacgcccggacaacttctaagccccgcagtgctagtggtgacaccgttttctggggtgagcatttcgagttcaataatctccctgctgtaagagcgctgaggttgcatctctaccgggactctgataaaaaaaggaagaaggacaaagctggatacgttggacttgttactgtcccagtcgccaccctcgccggcagacatttcaccgaacagtggtatcctgttacattaccaactggtagcggcggttccggcggaatgggcagcggtggcggtggtggcagtggtggtggctctggcggcaaaggaaagggcgggtgtccagccgtccggctgaaagcgcgttatcagacgatgagtattctgcctatggaactatacaaggaattcgctgaatacgtgacaaatcactatcgaatgctctgcgcagtcctggaacctgccctcaatgtgaaggggaaggaagaagtggcatccgccttggttcacatcctgcagagtaccggaaaggctaaagatttcctctccgacatggccatgtccgaggtggacaggttcatggagagagagcacctcatttttcgcgaaaacacattagcaacaaaagccattgaagagtacatgagattaatcggacaaaaatatttaaaggacgccattggtgaattcatccgggccttgtacgagtccgaggaaaattgcgaagtggaccccatcaagtgtactgcaagctctctcgccgagcaccaggccaacctgaggatgtgctgtgaacttgctctctgtaaggtggtcaattcccattgcgtttttccacgcgaactgaaagaagtctttgcgtcctggcgcctgagatgtgcagaacgcggaagggaagatatcgctgatcggctgattagcgcatccctattcctgaggtttctatgcccagctattatgagtcctagcctcttcggacttatgcaggaataccctgatgaacaaacatcaagaaccctgactctgatcgcgaaggtgattcagaatctggctaatttcagcaagtttactagtaaggaagactttctgggattcatgaacgagtttctggaacttgagtggggcagcatgcagcaatttctgtatgagatcagcaatttggacactcttacaaattcttcatccttcgagggctacattgatcttggccgagagctctctactttacatgccctgttgtgggaagtcttgccccagcttagtaaggaagccttgctgaaacttgggccactccccaggctgctcaatgacattagcacggctctgagaaatccaaatattcaaagacagccttctaggcagagtgaaagaccacgccctcagcccgtggtgctgcgcggccccagcgccgagatgcaaggatatatgatgagggacctcaattcctctatcgatctccagagttttatggctcgtgggctgaattcctccatggacatggcacgattaccttcaccaacgaaggagaaaccaccacctccccctcccggtggtggaaaggatctattctacgtgagccgcccacccctggccaggagctcacccgcatattgcacctcatcgtctgacattactgaaccagaacagaagatgttgtccgtgaataagagcgtgagtatgctggatcttcagggcgatggccctggaggtcgacttaacagttcatctgtttccaatctcgcagctgtcggagacctgcttcatagcagtcaggcctcactgaccgctgcactcggactgaggccggctccagctggacgactctcgcaaggatctggatcgtccatcacggccgccgggatgcgcttgtctcagatgggtgtgactaccgacggggtacctgcccagcagctcaggattcctctgtccttccaaaaccccctgtttcacatggcagccgatggccctggcccgcctggagggcacggcggtgggggaggtcacggtccaccctcctcgcaccaccaccaccaccaccatcaccaccataggggcggggagccgcccggggatacctttgctccattccacggatactcaaagtcggaagatttatcttctggcgtcccaaagccacctgcagccagcattctgcacagtcactcctatagcgacgaattcggtccctctggaacagactttactaggagacagctgagcctacaagacaatctgcagcacatgctgagtcccccccagatcacaattggtccacagcgtccggctcctagcggcccagggggcggcagtggggggggatctggcggcggcggcggaggccaaccccctccgctgcagagaggaaagagccaacagctcacggtgagcgcagcacagaagcctcgcccctccagtggaaatctcctccagtcgcctgagccatcctacggacctgcccgacccaggcagcagtcactgagtaaggagggtagtatcggcggaagtggcggatctggcggcggaggtggtgggggcctgaaacctagtataacaaaacagcactcccaaactccttccacactgaaccccacgatgcccgctagtgagcgcacagtcgcctgggttagtaacatgccacatctgagtgccgacatcgagagcgcacacatcgaacgcgaagagtacaaactcaaagagtattctaaatcgatggatgagtcaagactagacagagtcaaagagtacgaggaggaaatccactcactgaaggagcggctgcacatgtcaaaccgtaaacttgaggaatatgaacgaaggctgctctcccaggaggaacagacttcaaagattcttatgcagtatcaggcgaggcttgagcagagcgagaaacggctgcgacagcagcaggcagagaaagactcccagatcaagagcattataggcaggctgatgttggtggaggaggagcttcggcgggatcaccctgctatggccgagcctctccctgagcccaaaaagaggctcttggatgctcaagaacgccagttgccaccactagggccgaccaacccaagagtcactctcgcccccccatggaatggactggctccaccagctccccctcctcctccgagattgcagattacagagaacggagaattccgaaacaccgccgatcactag

SEQ ID NO: 30678 - DNA, 3900 bp, Artificial Sequence
  Description of Artificial Sequence: Synthetic coding sequence
atgtcaaggtcacgcgcctcaatccaccggggcagtattccagctatgagctatgccccatttcgggacgttcgcggaccgtcgatgcatcggacccagtatgtccattctccttacgaccgccccgggtggaacccaaggttctgcatcatctcaggtaaccagctactcatgctcgatgaggatgagatccacccattgttaatccgggatagacgctcagaatcctccaggaataagctcctgaggcgtaccgtgtccgtgcccgttgagggtagaccacacggagagcacgagtaccatctggggcgtagccgacggaagagcgtcccgggggggaaacagtacagcatggaaggcgcccccgcagcccctttcagaccatctcaaggattcctttccaggcgcctaaagtccagcattaaaagaaccaagtcccagcctaagctggaccgaacatcatcctttaggcaaatcctgccaagatttaggtcggctgatcacgatagggcgcgccttatgcaaagttttaaagaatcccactcgcatgagtccctgttaagcccctcttccgcagctgaggctctagaactgaacctcgatgaagatagcataattaagcccgtgcatagcagcattctgggacaggagttctgcttcgaagtgaccacgagcagcggtacaaagtgtttcgcctgccggagtgccgcggagcgggataaatggatcgagaatctgcagagagccgtgaaacccaataaagacaactcacggcgggtggacaacgtcttaaagctgtggattatcgaggctcgcgagctacctcccaagaagagatactattgtgagctgtgcctggacgatatgctatatgcccgaactacctccaagcccagatccgccagcggagacacggttttttggggagaacacttcgaatttaacaatctgcctgctgttagggcattgaggttgcacttgtacagggatagcgacaagaagcggaagaaagacaaagcagggtacgtagggctggttacagtcccagttgccaccctagccggcagacacttcacggaacaatggtaccccgtgactctgcccaccggctctgggggttccggaggcatggggtctgggggcggaggaggaagcgggggcgggagtggaggcaaaggaaagggcggctgtcctgccgtaagactgaaggctcgataccaaaccatgagcattctccccatggagctgtacaaggaattcgccgaatacgtgactaatcactataggatgctatgtgcagtcctagagcctgccctaaatgtgaaagggaaggaagaggtggcttctgctttggtccacatcctccagagcacaggcaaggcaaaggacttcttgagtgatatggctatgtctgaggttgacaggtttatggagagggagcatctgatttttcgagaaaacaccttagccactaaagcgattgaggagtatatgaggctcataggacaaaagtacctgaaggacgcgatcggggaatttataagagcactctacgaatctgaggaaaattgcgaagtcgaccctatcaagtgcaccgcctcaagtctggcagagcaccaggctaatcttagaatgtgctgtgagctcgccctttgtaaagtggtgaactcacattgcgtatttcctcgggaactgaaggaagtgttcgcgagctggaggctgagatgcgcagaaagaggccgggaggatatcgcagacaggttgattagcgcctctctgtttttgagattcctctgtccagccatcatgagcccttcgctgttcggacttatgcaagagtatcctgacgagcagacttcgcgtaccctgactctgatcgccaaagtgattcagaacctcgccaattttagtaagtttaccagcaaggaagacttcctgggatttatgaatgagttcctggaacttgaatgggggagcatgcagcagttcttgtatgagatctccaacctcgacacattgacgaattcaagctcttttgagggatatattgatctcggtcgggaactctcaacgctgcacgctctgttgtgggaagtgctgccccaactcagtaaggaagcactcctgaaactgggcccactgccccgtctgctgaacgacattagcaccgctttacgaaaccccaacatccagcgccagccttcgagacagtcggaacggccccggccccagcctgtggttcttagaggaccgtccgccgaaatgcagggttatatgatgcgggatctcaatagcagcattgatcttcagtcctttatggctagaggcctgaattcctccatggacatggccaggttaccatcaccaaccaaggagaagcctccaccgccgcctccaggtggtggcaaggaccttttctacgtttcgcgcccacccttggctcggagcagcccagcttactgtacttcatcatcagatatcacagagcctgaacagaaaatgttgtccgtgaataagtccgtgagcatgctcgatctgcagggggacggtcccggtggcaggctcaattcgagctcagtttctaatctggcggctgtgggggatctgctgcactcgtcacaggcttccctcacagctgctctgggcctcagacctgctccagcaggcaggctaagccagggcagtggcagttcaataacagcagctggcatgagactcagccaaatgggcgtgaccaccgatggagtgccggcccaacagctgcgcatccccctcagcttccaaaaccccctgttccatatggctgccgacggcccagggccgccaggaggccatggggggggtggtggtcacggacctcccagttctcatcatcaccaccatcatcaccaccaccaccgcgggggggagcctccaggagacacctttgccccattccacgggtactccaagtccgaagatcttagttcgggcgtgccaaagccacccgctgcgagcatccttcattcacacagctatagtgacgagtttgggccatctgggaccgattttacccgtcggcaactgtccttgcaagataatctccaacatatgttatcccccccccagatcacaatcggaccgcagcgccccgctccttcaggccctggcggcggctctggcggaggcagtggtggaggcggcggcgggcagcctccccccttacagaggggcaagagccagcagctgactgtgtccgccgcgcaaaaacccagaccctcaagtgggaatctattgcaatctcccgagccatcttacggtcctgcacgccctcgtcaacagtccctctcgaaggaaggctctattggaggctcaggcggatccggtggcgggggaggtggtggactgaaacctagtatcaccaagcagcactcccagacacctagcactctcaaccctaccatgccagcttctgaacggacagttgcctgggtttctaatatgccccatcttagcgcagatatcgagtccgcccatattgagagagaagaatacaagctgaaggaatacagcaagagcatggatgaatcaagattagacagggtgaaagaatatgaggaggagatccactccctgaaggaaaggctacacatgtcaaacaggaagctcgaagaatacgagcgaaggctcctgtcccaagaggaacaaacatctaagattctaatgcaataccaggccaggctggagcagtccgaaaaacgattacgtcaacaacaggcggaaaaagattcccaaatcaaatccattatcggaaggttgatgctggtggaggaggaacttaggcgggatcatccggccatggccgaaccactgccggagcctaaaaaaagattgctggacgcccagctgctgattaggtag

SEQ ID NO: 30679 - DNA, 2049 bp, Artificial Sequence
  Description of Artificial Sequence: Synthetic coding sequence
atggaagagggatttcgggaccgggccgctttcattagaggcgccaaggacatcgccaaggaagtcaagaagcacgcagccaaaaaggtcgtgaaagggctggacagggtgcaggatgagtactcacggcgcagttactctcgattcgaagaagaagacgatgacgacgacttccccgcccctagcgacggatattatcgaggcgaggggactcaagacgaggaggagggtggtgccagctctgacgcaactgagggccatgacgaggacgacgagatttacgagggcgaataccaggggattcccagagccgaaagcggggggaaaggtgagcgtatggcggacggtgctcccctggccggggttagaggcggtctgtccgacggggaaggcccgccaggaggaagaggtgaggcgcagcgccggaaagaacgggaggagttggctcaacagtatgaggctatcctgagagagtgtgggcatggcaggtttcagtggacgttatactttgtactcggcctcgctctgatggctgatggtgtcgaagtattcgtcgtgggcttcgtcctgccgtccgccgagaaggatatgtgtctctccgattccaacaaaggtatgctgggcctcattgtgtacctcggtatgatggtaggcgcttttctttggggaggtctcgccgatcgcctcggtcgtaggcagtgtctgttaattagtctgtctgtgaacagcgtgttcgccttttttagcagctttgttcagggatatggtacgttcctgttctgcaggctcctcagcggggtggggatcgggggaagcattcctatagtattttcatatttttctgaattcttagcccaagagaagcggggagagcaccttagctggttatgtatgttctggatgatcggcggagtgtacgccgccgctatggcctgggccatcattccgcattatggatggagcttccagatgggcagcgcataccagtttcacagctggcgggtgtttgtcctcgtttgcgcattcccaagtgtgtttgcaatcggtgcactgaccacccaacccgagtctccaaggttcttcctggagaacggaaagcatgatgaagcgtggatggtcctgaagcaagtccatgataccaacatgagggccaaaggtcaccccgagagggtgttctcagttactcacataaaaacaatacatcaagaggatgagctgatcgaaattcaatctgataccggtacctggtaccaaagatggggcgtgcgcgccctctcactggggggccaagtgtggggcaactttctctcctgcttcggacccgagtaccgaaggattaccctgatgatgatgggtgtttggttcacaatgtctttctcctactatggtctgacagtctggttccccgacatgatccgccacctgcaagcggtggattacgcaagcagaactaaggtgttccccggcgaaagggtcgaacacgtgacgtttaacttcacattggaaaaccaaatccacagaggcggccagtacttcaatgataagtttattggcttaagactgaaatcagtctcattcgaggatagtctctttgaggaatgttattttgaggacgtcacatccagtaatacgttcttcagaaactgcacctttataaacaccgtgttctataatactgacctcttcgaatataaatttgtgaactccagactcatcaattcgacattcctacacaataaggagggatgccccctcgatgtgacaggcaccggcgaaggcgcttacatggtctactttgtcagcttcttaggaactctggccgttttgccaggaaatattgtgagcgccttactcatggataagattggcagactgcgaatgctggctggatcaagcgtgatgagctgcgtctcatgcttttttctgagcttcggcaactctgagtctgcgatgattgccttattgtgtctctttggtggggttagcatcgctagctggaacgcactggatgttctgacagttgagttgtacccttccgacaagagatag

SEQ ID NO: 30680 - DNA, 2229 bp, Artificial Sequence
  Description of Artificial Sequence: Synthetic coding sequence
atggaagagggtttccgagaccgcgccgcatttatcagaggagctaaggacatagcaaaggaggtgaagaagcatgctgccaaaaaagtggttaagggactagatcgagtgcaggacgagtacagtagaagaagctactcgaggtttgaagaagaggatgatgacgatgacttcccagctccgtcggatggctactataggggcgaaggtacacaagatgaggaagagggaggtgcctcctcagacgccactgagggccacgatgaggatgatgagatttacgagggcgagtaccaaggcatcccccgggcagagtcaggcggcaaaggtgagcgtatggccgacggagcgcctcttgcaggggtgcgtgggggcctcagcgacggcgagggcccccctggcgggagaggagaggcccagcgacggaaggagcgcgaggagctcgctcagcagtatgaggccatattacgagaatgtggacacggcagatttcaatggacactgtactttgtgctaggcctagcgctaatggctgatggcgttgaggtatttgtagtggggttcgtgctgccgtcggcggaaaaggatatgtgtctgagcgattctaacaaaggcatgttgggactcattgtgtatctaggaatgatggttggcgcatttctgtggggggggctggctgacagactgggaaggaggcagtgtttactcatctctctttccgtcaattccgtgtttgcattcttcagtagtttcgtccagggctacggtacctttcttttttgccggctgctgtcgggggtcggtatcggcgggtcgatccctatcgtgttttcttacttttctgagtttctggcgcaagagaaacggggcgagcacctatcttggctatgcatgttttggatgattgggggggtctatgctgccgctatggcctgggccattatccctcattatggctggtcgttccagatggggagcgcataccaattccatagctggagagtctttgtcctggtgtgcgcgtttccctccgttttcgccattggtgcacttaccacacagccagaatcaccccgtttctttctggagaatgggaaacatgacgaggcgtggatggtattgaagcaagtgcacgacacaaacatgagggcgaaaggccaccctgaaagagtgttttcagtgacccatattaaaactatccaccaagaggacgagctaattgaaatccagtccgataccggaacctggtaccagcggtggggtgtccgagcactgagtttaggcggccaggtctgggggaatttcctgtcctgtttcggtcccgagtatcggcgcatcaccctcatgatgatgggcgtctggtttaccatgagcttctcatattacggcctcacggtctggtttcccgacatgatcaggcacttgcaggccgtcgactatgcaagcaggacgaaggtgtttccaggggaacgagttgagcacgtcacattcaattttacactggaaaatcaaattcacagaggtgggcagtacttcaacgacaaattcatcgggttgcgcctgaagagtgtctcttttgaggattccctgtttgaggaatgttactttgaagacgtgacttcaagcaacactttttttaggaactgtacgttcattaatactgtgttttacaataccgatctgttcgagtataagttcgtaaactccagactgattaacagcaccttcctgcacaataaagaaggctgcccgcttgatgtcaccgggacaggcgagggcgcatatatggtgtattttgtttcctttttaggaactttggcagtcctccccggaaatatcgtgtctgccctgcttatggacaaaatcggacggctcagaatgctcgcgggatccagcgtcatgagctgcgtgtcatgtttttttctttctttcggcaactccgagtctgctatgattgcgctgttgtgtctattcggaggtgtaagcattgcgagctggaatgcccttgacgtcctgactgtagagctgtacccgtctgataagagaactacagctttcggtttcctcaacgcactgtgcaaactcgccgctgtgctcgggatcagtatctttaccagcttcgtgggtatcacgaaagctgcacccattctgttcgcatctgccgcgctggcactgggcagcagcctcgctctcaagcttcctgagactcggggtcaagtactgcaatag

SEQ ID NO: 30681 - DNA, 2052 bp, Artificial Sequence
  Description of Artificial Sequence: Synthetic coding sequence
atggacgattataaatatcaggataactacggagggtatgcccctagcgatggttattataggggcaatgaatccaatccagaggaagacgcgcaatcggatgtgacagaaggccacgatgaggaggatgagatctatgagggagaatatcagggaattccccaccctgatgatgttaaggccaaacaggccaaaatggccccttcccgcatggatagcttgcgtggacagacagatctgatggcagaaagactggaggacgaggagcagctggcccatcagtacgagaccattatggacgagtgtggccacgggagattccagtggattctgtttttcgtcctgggactggctctaatggccgacggggtggaggtttttgtggttagctttgcactcccttccgctgagaaggatatgtgtttgtcgtcatctaaaaaaggaatgctagggatgatcgtgtatcttggcatgatggccggcgctttcattttggggggcctggcagataaactggggcgcaagcgagtcttgtccatgtccctggccgtgaacgcatcttttgcgagtctgagtagctttgtgcaaggatacggggcattccttttctgtcgcctgattagtggaatcggaataggtggcgctctgcctatcgttttcgcatactttagcgagttcctttcccgggagaagcggggcgagcatttgtcctggttgggcatcttttggatgacgggggggctttacgctagtgccatggcatggagtatcattcctcattacggttggggattctccatgggtacaaactaccacttccactcctggagagtcttcgtgatcgtgtgcgctctcccgtgcacagtatctatggtggctctgaaattcatgcccgaaagcccacgatttctcctggagatgggcaagcacgacgaggcatggatgatacttaaacaggtgcatgacaccaatatgcgggccaaaggcactccggagaaggtcttcaccgtctcaaatattaagacccctaaacagatggatgaattcattgagatccaatcatcaacagggacctggtatcaacggtggctagtccggttcaaaactattttcaagcaggtctgggacaatgcactgtactgcgtgatgggaccataccggatgaataccctcatccttgccgtggtgtggttcgccatggccttttcttactacggactgaccgtgtggttccccgatatgattagatacttccaggatgaggagtacaaatcaaagatgaaggtattctttggcgagcacgtgtacggcgccactatcaattttacaatggaaaatcagatccaccaacatggcaaactagtcaacgacaaattcactagaatgtacttcaagcatgttttatttgaagatacattctttgacgaatgttatttcgaagacgtgacttctaccgatacgtatttcaaaaattgtacaatcgagagcacaatcttctataatactgatctctatgaacataaatttatcaactgtcgcttcattaatagcactttcctggagcagaaggagggctgccatatggacttagagcaggataacgacttccttatctatttagtgagcttcctgggcagcctctctgtgctgccagggaacattattagcgctctcctgatggaccgtatcggtcgcttaaagatgatcggcggatctatgctcatcagcgcagtgtgctgtttttttctgtttttcgggaacagtgaatccgcaatgatcgggtggcagtgcctgttttgtgggaccagcatcgcagcatggaacgccctggatgtcataacggtggaactctacccaaccaaccaacgtgccaccgccttcggcatactgaacgggctgtgcaagttcggcgcaattctaggaaacactattttcgcaagtttcgtgggcattactaaagtggtgcccatcctgcttgcggccgcatccctggtaggtggcgggctgattgcattacggctgccggagactcgtgaacaggtgctgatgtag

SEQ ID NO: 30682 - DNA, 2052 bp, Artificial Sequence
  Description of Artificial Sequence: Synthetic coding sequence
atggacgattacaagtaccaggacaactacggtggttacgctccatctgatggctattaccgtggcaatgagtccaatcccgaggaggacgcccagagcgatgttacagaggggcacgatgaagaggacgaaatatatgagggcgagtatcaggggattcctcatcccgacgatgtgaaagctaaacaagccaagatggcaccttcgaggatggatagtctacggggccaaaccgatctcatggccgaaaggctggaggacgaggagcagctggctcatcaatacgagacaatcatggatgagtgtggtcacggaagatttcagtggattcttttcttcgtgttgggtctcgcactgatggccgatggcgtggaagtgttcgtcgtcagtttcgcacttccgtcggccgagaaagatatgtgtctgagctctagcaagaagggtatgcttggaatgatcgtgtatttgggcatgatggcaggcgccttcatcttaggagggctcgcagataaactgggccgaaaacgagtcttgtcaatgtccttggcggtcaatgctagctttgcctctctgtctagcttcgtgcagggatacggtgcattccttttttgccgtctgatttctggtatcggcattgggggtgcactacccattgtgttcgcttacttttccgagtttctaagtcgtgagaagcggggagagcacctctcctggctgggaattttctggatgaccggaggcctgtacgcatctgccatggcatggtctatcatcccccattatgggtggggctttagcatgggtactaactatcactttcattcatggcgtgtctttgttatcgtctgtgccctcccctgcacagtgagcatggtggctctcaagtttatgccagagtcacctcgtttcctgctggagatggggaaacatgatgaagcatggatgatcttgaaacaggtccacgacacaaacatgagggctaaaggcacccccgaaaaagtgttcaccgtctccaacataaagactccgaaacaaatggatgagtttatagagatccagtcgtctaccggtacttggtatcaaaggtggttagtgagattcaaaactatttttaaacaggtctgggacaacgccctgtattgcgtgatgggcccatacaggatgaatacactgatcctggccgtcgtgtggttcgccatggcgttttcctattacggtcttacagtctggttcccggatatgatacgctacttccaggatgaagaatataaaagtaagatgaaagtttttttcggggaacacgtgtacggagctactattaactttacaatggagaatcagatccatcaacatgggaagcttgtcaacgacaagtttactcgcatgtattttaaacatgttctttttgaagacaccttttttgacgaatgctactttgaagacgttacctccacggacacatatttcaaaaattgtaccatcgagagtactatcttctacaatacggacttgtacgaacacaagttcatcaattgccgcttcattaactctacatttcttgagcagaaggaagggtgtcacatggatttggagcaggacaacgacttcctgatttacttggtgtcttttttgggctccttgtccgtgctacccggcaatattatctccgccctgctgatggataggatcggaaggttaaaaatgattggaggctctatgttgattagcgccgtgtgttgtttttttctgttttttggcaattcagaatcagctatgatcggatggcagtgtctcttctgtggaacaagtatcgccgcctggaacgcgctggacgtgattactgttgagctctatccgaccaaccagcgggcgactgccttcggaatcctgaatggcctttgcaaattcggggcaatactgggcaataccatttttgcctcttttgtcggcattaccaaagtggtgccaattctcttagccgccgcttcactcgtgggtggcggactgatcgccctccgcctcccggagaccagagaacaggtgctgatgtag

SEQ ID NO: 30683 - DNA, 1599 bp, Artificial Sequence
  Description of Artificial Sequence: Synthetic coding sequence
atgatagtttatctgggaatgatggccggtgccttcattctaggcggcctcgcagataaacttggacggaaaagagtgctgtctatgtccctggcagtgaatgctagcttcgcgagtctgtcatcatttgtgcagggctatggtgctttccttttctgcagactgataagcgggatcggtatcgggggagctctgcctatcgtctttgcctacttctccgaatttctcagtagggagaaacggggcgaacacctctcctggcttgggatcttctggatgactggcggcctgtacgcttcagcaatggcttggtccatcattccccattatggctggggcttctcgatgggcactaattaccactttcactcctggagggtcttcgtcattgtatgtgcattgccctgtactgtttccatggttgccctgaaatttatgccagaatctccaaggtttctgctggaaatggggaaacacgatgaagcctggatgatactgaagcaggtccacgacacgaatatgagagccaagggcaccccagagaaggtatttacagtgtctaatatcaagactccaaagcagatggacgaatttatagaaatacagtcctcgacaggtacttggtaccagagatggctcgtgcggttcaaaaccattttcaagcaggtatgggacaacgcactgtactgcgtaatggggccttacagaatgaataccttgatcctggccgtggtatggttcgccatggctttttcctattacgggctaaccgtgtggtttcccgacatgattcgatattttcaagatgaggaatacaaatctaagatgaaggtattttttggagaacatgtttacggggcaaccataaacttcactatggagaatcagattcatcaacacgggaagctggtgaatgacaagtttactcggatgtatttcaagcatgttctgtttgaagatactttttttgacgaatgctacttcgaggatgtgacttcaacagatacgtattttaagaactgtacgatcgaatccactattttctataatacagatctgtacgagcataagtttattaattgtagatttattaacagcactttcctggagcagaaggaggggtgtcacatggacttggaacaggacaatgactttctaatatatctcgtgtctttcttgggaagtctgagcgtcctgccgggcaacatcattagcgcccttctgatggatcggatcgggcgacttaaaatgatcggcgggtctatgctgatctccgccgtatgctgctttttcctcttcttcggcaacagcgaatccgctatgattggctggcagtgtctcttctgtggaactagcattgctgcttggaacgcgcttgacgtcatcaccgtggagctctaccccactaaccaacgggccacagcattcggtatcttgaacggactgtgcaagttcggggctatcctggggaataccatctttgcctccttcgtgggcattaccaaggttgtccccatccttctcgcagctgcaagcctggtgggcggcggtttaattgctctgagactgccggaaacacgtgagcaagtgctcatgtag

SEQ ID NO: 30684 - DNA, 2052 bp, Artificial Sequence
  Description of Artificial Sequence: Synthetic coding sequence
atggatgattacaagtatcaagataactatgggggatacgctcctagtgacggatattatcggggaaatgagtccaacccagaagaggacgcacagtccgacgttacagaggggcacgatgaagaggacgaaatttacgagggggaatatcaggggattccccacccggacgatgtcaaggccaagcaggctaagatggcaccaagcagaatggactcccttcgaggtcaaaccgatctgatggcagaacgactggaagacgaagagcagctggcccaccagtatgagaccatcatggacgaatgcgggcatggacgtttccagtggatactgttcttcgtgctggggctcgctctgatggccgatggggtggaagtctttgtggtgtcgtttgcactgcctagcgccgaaaaagacatgtgcctgtcttccagcaagaaggggatgctgggtatgattgtgtacctgggaatgatggcaggcgccttcattctgggtggtctcgcagataaactgggccgcaagagggtgctgagcatgagccttgccgtgaatgcatcatttgcatccctgtcctcgttcgtgcaaggctacggggcctttttgttctgccgcctgatctccggaatcggaattgggggtgctctgcctatcgtgtttgcttactttagtgaattcctttcccgggagaagcggggagagcacctgagttggctcggcattttctggatgacgggtggactctacgcttctgctatggcctggagcataatccctcattatggctggggcttctccatggggaccaactaccattttcacagttggagggtgtttgtgatcgtttgcgcgttaccctgcacggtcagtatggtcgcactaaagtttatgcctgagtctccccggttcctgctcgaaatgggaaagcatgacgaggcgtggatgatcctaaagcaggtacacgacactaatatgagggccaaaggcacacccgaaaaggtcttcacagtttcgaatatcaagactcctaagcagatggacgaattcatcgaaattcagtctagcacaggaacatggtaccaacgctggttagtgagatttaaaaccatctttaaacaagtgtgggataacgctctctattgtgtaatgggcccttatcgaatgaacacactgatactggctgtggtgtggttcgctatggccttctcttattacggtctcaccgtgtggttcccagatatgatccggtactttcaggatgaggagtataaatccaagatgaaggtgttcttcggagaacacgtgtacggcgccacaatcaacttcacaatggaaaaccagatccaccagcacggaaaactggtgaacgacaaatttacccgcatgtattttaaacatgtcctttttgaggacaccttctttgacgagtgctacttcgaggatgtgacctctaccgatacttatttcaagaattgcacaattgaatccactatattttataacaccgatttatacgaacacaaattcattaactgtcggttcatcaatagcacctttctggaacagaaagagggctgtcatatggatctggaacaggacaatgacttcctaatttaccttgtgtctttcctcgggtctctgtccgtcctccccgggaacataattagcgccctgctcatggaccggataggtagactcaagatgattgggggttccatgctcatctcggctgtctgctgcttcttccttttctttggaaattccgaaagcgctatgattggctggcaatgcttgttctgtggtacttcaatcgcagcttggaacgcactggacgtaatcactgtggagttgtacccaacaaatcagcgcgctacagctttcgggatccttaatggactgtgcaaattcggcgctatcctcgggaacactatatttgcgagctttgtcggcatcaccaaggtcgtaccaatcctgctcgcagcggccagtttagtgggtggaggcctgatcgcactgagattgcccgagactcgcgagcaggtgcttatgtag

SEQ ID NO: 30685 - DNA, 2031 bp, Artificial Sequence
  Description of Artificial Sequence: Synthetic coding sequence
atggaggattcttataaagacagaacttctctcatgaagggagcaaaggatatcgctcgcgaggttaaaaagcaaaccgtgaagaaggtcaatcaagccgtagatcgcgcccaggacgagtacacacagcggagctacagccggtttcaggacgaggaggatgatgatgattattatccagctggagagacctacaatggtgaggccaacgatgacgagggctcatcggaagccacggagggccacgatgaagacgatgaaatctatgaaggcgaataccagggaatcccctctatgaaccaggctaaggatagtatcgtatcagtagggcagcctaaaggggacgagtacaaagatcgtcgggagctggagagtgagcgtagggctgacgaggaagaattggcccagcagtatgagctgatcattcaggaatgcggccatggcagatttcagtgggccctgttcttcgtactagggatggcactgatggccgacggggtcgaagtctttgtagtcggctttgtgttgccgagcgcagagactgatctttgcattcccaacagcggcagcggctggcttgggtctatcgtctacctgggaatgatggtcggagcctttttttgggggggattagcagacaaagtggggcggaaacagagcctcctgatttgtatgtccgtgaatggatttttcgcattcctgagctcctttgtccaggggtatggcttttttttgttttgtaggctgctgtctgggtttgggatcggaggcgccattcccaccgtgttttcgtatttcgctgaggttctcgcacgcgagaaacgtggcgagcacttaagttggttgtgtatgttctggatgatcggaggaatctatgcgtctgctatggcctgggccattatcccacactatggttggagcttcagcatgggctcggcctaccagttccactcctggagggtgttcgttatcgtttgcgctcttccatgcgtttcttcagtggtcgccttaacctttatgcccgaaagcccaaggtttttactcgaagtcgggaagcacgatgaggcatggatgatactgaagcttattcacgataccaatatgcgcgcccgcggacagccggagaaggtgttcaccgttaacaaaattaagacgccgaagcagatcgatgagttaatcgagatcgagtctgataccggtacctggtaccgccgctgctttgtcagaatccgaactgagctatacggcatctggttgacctttatgcgatgctttaactacccagtgcgggacaatacaatcaaactcaccattgtctggttcactctttcctttggatactacgggttgtcagtgtggtttccagacgttattaagccactccagagcgacgagtatgctttgctcacaaggaatgttgaacgcgacaagtacgccaactttacaataaatttcacgatggagaaccagatacatacgggaatggaatatgacaacgggagattcataggagtaaagttcaagtctgttacctttaaagattcagtcttcaagtcttgcacctttgaagacgtgacttccgtaaatacatactttaagaattgcacttttatcgacactgtttttgacaatacagacttcgagccatacaaatttatcgattcggaattcaaaaactgcagtttctttcacaataaaaccggatgtcagataacgttcgacgatgattactctgcttactggatttactttgtcaacttcttgggcaccctcgccgtgttgcccgggaacattgtcagcgcactgttgatggaccgtatcggtcgtctcaccatgttgggcggcagtatggtgctcagcgggatcagctgcttcttcctctggttcgggacgtcagaatctatgatgatcggaatgctgtgtctatacaatggcctgacaatctccgcctggaacagcctcgacgttgttacagtggagctgtatccgactgatcggcgtcgccgggtgctcccttgctgtcccggatag

SEQ ID NO: 30686 - DNA, 2184 bp, Artificial Sequence
  Description of Artificial Sequence: Synthetic coding sequence
atggaagactcttacaaggacagaactagcctcatgaaaggggctaaagacattgcaagggaggttaaaaaacagaccgtcaagaaagttaatcaagccgtagacagggcccaggacgaatacacccagcgcagttactccagattccaggatgaggaggacgatgacgactattatccagctggagaaacgtacaacggtgaggcgaacgacgacgagggcagctcagaggccacagagggtcatgacgaggacgacgaaatttatgaaggcgaataccaaggaattcctagcatgaatcaggctaaggattccatcgtgagtgtgggccaaccaaagggcgatgagtacaaagacaggagggagctcgagtccgagagacgggctgatgaggaggagctggctcagcagtatgaactaataatacaagagtgtggacatggacggttccagtgggcccttttcttcgtgctggggatggccctcatggccgacggggtagaggtgtttgtggtgggctttgtcttgccatccgctgagaccgacctgtgtatcccgaacagcggttcgggctggctgggcagcattgtgtacctgggcatgatggtgggtgccttcttctggggaggcttagcagacaaagttgggcgaaagcagtcgctcttgatctgtatgtcggtgaatggcttcttcgcatttttgtcctcgttcgttcagggatatggcttttttctcttctgtcgcctgctgagcggtttcggtatcggtggcgccatccctaccgtgttctcctactttgccgaagttttagcccgagagaaacgcggagagcatttgagctggctgtgtatgttctggatgatagggggaatttacgcttctgccatggcctgggcgatcatcccccactacggatggtccttctccatggggagtgcgtatcagtttcacagttggcgggtattcgtgattgtctgtgccctgccctgcgtgagttctgtcgtggctctcaccttcatgccggaatcaccccggttcctgctagaggtgggaaaacacgatgaagcttggatgatcctcaagctcattcacgatactaatatgcgcgcccgagggcagcccgagaaggtcttcaccgttaataagattaaaacgccaaagcagatcgatgaactcatcgagatagagtcagatactggaacatggtaccgcaggtgcttcgtgcgaatccgtaccgaactgtacggtatctggttgaccttcatgagatgttttaactatccagtcagagacaatacgataaagttaaccatcgtgtggttcacactgtcatttggctactacggattatcagtgtggttccccgatgtgattaaaccgttgcaatctgacgaatatgccttgctgacccgcaatgttgagagagacaagtacgcgaatttcaccatcaattttacaatggagaaccagattcatactggcatggagtatgacaacggtcgatttatcggtgttaagttcaagagcgttactttcaaggatagcgtgttcaagtcttgcacgttcgaggacgtgaccagtgtgaatacctacttcaagaactgcacttttattgatactgtgtttgataacaccgatttcgagccctataagtttattgactcagagtttaagaactgctcattcttccataataaaacaggctgccagattacattcgacgacgactattctgcctactggatttacttcgtgaatttcctaggtacactagctgtcctgcccgggaatattgtgtctgccctcctgatggatcgaataggacgtttgaccatgctgggcgggtccatggtgttgtcaggtataagctgtttctttctgtggtttgggacgtcggaaagtatgatgatcggaatgctgtgcctatataatggcctgaccattagtgcctggaatagtctggacgttgtgactgttgaactgtatccaacagaccgtcgcgcaacaggcttcggattcctgaatgccctttgtaaggctgctgctgtgcttgggaatttgattttcggctcgttagttagcataaccaagtccatccccattcttctcgcaagcaccgtgctggtctgtggggggttagtgggactgtgtctgcccgacacaaggacacaggttctgatgtag

SEQ ID NO: 30687 - DNA, 780 bp, Artificial Sequence
  Description of Artificial Sequence: Synthetic coding sequence
atggcccctaacatttacctagttcgtcaaaggatctccagattagggcagcggatgtctgggttccagatcaacctgaaccccctcaaagagcccttgggattcattaaggtacttgaatggatcgcttccatcttcgcctttgccacctgtggaggctttaagggccagaccgaaatccaggtgaactgccctccagccgtgactgagaataaaaccgtaactgctacctttgggtaccctttccgattgaacgaagcgtccttccaacccccacctggggtgaatatctgtgatgtgaattggaaagactatgtattgattggtgattactccagtagtgcacagttctatgtaacattcgccgttttcgtgttcctctattgcatcgccgctctgctgctgtacgtcggatataccagcctctatctcgactctcggaagttacccatgatcgatttcgtggtgacactcgtagctacattcctgtggcttgtgagcactagcgcctgggccaaagcccttaccgatatcaagatcgccaccggtcacaatattatcgatgaattaccgccatgcaagaaaaaagctgtcctgtgctacttcggctctgttacatctatgggttcgctgaacgtgtctgtgattttcggatttctgaatatgattctgtggggaggcaacgcttggttcgtttacaaagaaaccagcttacactcgccatctaacacttctgcgccgcatagccaggggggcattcctcctccaactggcatatag

SEQ ID NO: 30688 - DNA, 726 bp, Artificial Sequence
  Description of Artificial Sequence: Synthetic coding sequence
atgtccggattccaaatcaacttgaatcccctcaaggaacctcttggctttattaaagtgcttgaatggatcgccagcattttcgctttcgccacttgcggcggcttcaaggggcaaacagaaatacaagtgaattgccctcctgccgtgacggaaaataaaacggttactgccaccttcggctatccttttagactcaatgaagcatctttccagcctccacccggggtaaacatctgcgacgttaactggaaggattacgtgctcattggcgactatagctcatctgcacaattctatgtaactttcgctgtatttgtgttcctgtactgtatcgctgctctgctgctttacgtgggatacacttcactttacctggactctagaaagctacctatgattgatttcgtcgtgacattagttgccacctttctttggcttgtatcaacatctgcctgggctaaggctcttactgatatcaaaatcgcaactggccacaacatcattgatgagctgccaccgtgcaagaagaaggcggtgctgtgctactttggtagcgtaacatccatgggatccctgaacgtgtctgtcatcttcgggtttctgaacatgatcctgtggggcggcaacgcatggttcgtgtacaaggaaacctctctgcattctccaagcaatacctctgccccacattctcagggaggaatccccccacccaccggaatctag

SEQ ID NO: 30689 - DNA, 819 bp, Artificial Sequence
  Description of Artificial Sequence: Synthetic coding sequence
atgtctagcaccgagtcagccggcagaacagctgataaaagtcctagacagcaggtcgacaggctgctggttggcctcagatggaggaggcttgaggagcctttgggctttatcaaagtgcttcagtggttgttcgctatctttgccttcggatcttgcggctcctacagcggcgagaccggagccatggtgcgctgcaataacgaggcaaaagacgtgtccagtatcatcgtggccttcggctaccctttcagattgcatcgaattcagtacgagatgcccctatgtgacgaagagagttcctccaaaactatgcatctgatgggggacttttcggcccctgcagagttctttgtcacactcggcattttctctttcttctatactatggctgctctagtgatttatctaagattccacaacctgtacaccgagaacaaaagattccctctcgtggatttctgtgtgaccgtttcatttacattcttctggctggtcgccgccgcagcttggggcaagggccttaccgacgtcaagggcgcgacacggccgagctctctgaccgcagcaatgagcgtgtgccacggagaagaggcggtgtgctccgccggagccacgccatcaatgggactggccaacataagcgtgctcttcggattcatcaatttcttcctatgggcaggaaattgttggttcgttttcaaagaaaccccatggcatggccaagggcaaggccaggatcaggatcaggatcaggatcagggacagggcccatctcaagaatccgcagccgagcagggggccgtggagaaacagtag

SEQ ID NO: 30690 - DNA, 627 bp, Artificial Sequence
  Description of Artificial Sequence: Synthetic coding sequence
atgtcatctactgaaagtgctgggagaaccgccgataagagcccacgtcaacaagtagaccgcctcctcgtggggctgcggtggaggcggttggaggagcctttggggtttataaaggtgcttcaatggctcttcgccatcttcgcattcggttcatgtggctcttatagcggggaaacaggggccatggtcagatgtaataacgaagcgaaagatgtgtctagtataatcgttgcctttggctacccttttcgtttgcaccgcattcaatatgagatgcctctctgtgacgaggaatccagttcaaagactatgcatctcatgggcgactttagcgcacccgccgaattttttgttaccttaggtatcttttctttcttttacaccatggcggcacttgtaatatatttgaggttccataacttatacacggagaataaacgattccccttggtcctttttggcttcattaactttttcctgtgggctggcaattgttggttcgttttcaaagagaccccctggcacgggcagggacagggacaagatcaggaccaagatcaagaccaaggccaggggcctagtcaggagagcgcggccgaacaaggggccgtagagaaacagtag

SEQ ID NO: 30691 - DNA, 798 bp, Artificial Sequence
  Description of Artificial Sequence: Synthetic coding sequence
atgtgcatggttatattcgctcccctgtttgcaatattcgccttcgccacatgcggcgggtattccggtggcctgcggttaagcgtcgactgcgtgaacaagacagagagtaatctgtccatcgacatcgcgttcgcatatccctttcggctgcatcaggtcaccttcgaagtgcctacttgtgaaggaaaagaaaggcagaagctggctcttattggcgattccagcagcagtgccgagttttttgttactgtggctgtcttcgcgttcctgtatagcttggcggctaccgtggtgtatattttctttcagaataaataccgggagaataacaggggcccattgatcgactttattgtgaccgtcgtgtttagtttcctgtggttggtgggatcaagcgcttgggcgaaaggccttagcgacgttaaagtggccacagatcctaaagaggtgctgcttttgatgagtgcctgcaagcaaccttcaaacaagtgcatggccattcacagtcctgtcatgagttctctcaatacctccgtcgtcttcggttttctgaactttattctctgggctgggaatatctggttcgtcttcaaagaaactgggtggcattcaagtggccagcgctatctgagcgacccaatggagaagcactccagtagctataatcagggaggatataatcaggattcctatggctcgtcgtctggttacagccagcaggcttctctgggccccacatccgatgagttcggccaacaacctaccggccctacgtcattcacaaatcagatttag

SEQ ID NO: 30692 - DNA, 831 bp, Artificial Sequence
  Description of Artificial Sequence: Synthetic coding sequence
atgtgtatggtaatcttcgctccccacaacgaagaatgtaaatcacacttccatctcctgtttgctatttttgcatttgcaacctgtggcgggtactcgggaggacttcgcctcagcgtggactgtgtaaataaaaccgagagtaacctttcgatcgatattgcattcgcttatccgtttcgcctgcaccaggtgactttcgaagttcccacttgtgagggtaaggagcgccagaagctggcgctgatcggagactcctcaagttccgccgagttttttgtcacggtcgctgtattcgccttcctgtattccttggccgccaccgtagtgtacatcttttttcagaacaaataccgagagaacaaccgcggaccactgatcgacttcatcgtgacagtggtgtttagctttctctggcttgtcggcagtagcgcctgggcaaaggggctttccgatgtcaaggtcgcaacggacccaaaggaggtccttttactcatgagcgcttgtaaacagccgagcaataagtgtatggctattcatagccccgtgatgtctagcttgaatacctcagtggtctttggcttcttgaacttcattctgtgggctggtaacatttggttcgtgtttaaggagacgggctggcacagttctggacaacggtatctgtctgacccgatggaaaaacattcaagtagttataatcaaggtgggtataatcaggactcatatggcagctcatccggctactcccagcaggcatcactgggtccaacttcagatgagttcggccagcaaccgacgggcccgacctctttcaccaatcagatctag

SEQ ID NO: 30693 - DNA, 858 bp, Artificial Sequence
  Description of Artificial Sequence: Synthetic coding sequence
atggatccagtttcccagttagcgagtgcaggcacgttcagagtccttaaggaacctcttgcttttcttcgcgctctggagctcctctttgctatcttcgccttcgcgacctgcggaggatattccggaggcctgcgcctgtcagtcgattgcgtgaataagacagagtccaacctcagtatcgacatcgccttcgcctatcctttccgcctacatcaggtcacttttgaagtgccaacctgtgagggtaaagaaaggcagaaactggcactcatcggggacagctcatcctccgccgaattctttgttacagtggccgtttttgctttcttgtacagtctggcagctacagtggtctatatcttttttcaaaacaagtaccgcgagaataaccgcggccctctcattgactttatcgtgacagtggtcttctcattcctgtggttggtcggctcttctgcgtgggcgaagggactgagtgatgtgaaggttgctacggacccaaaggaggtcttattgctcatgagcgcctgtaagcagcctagtaacaagtgtatggctattcattctcccgtgatgtctagtctaaacacttccgttgtgtttggattcttaaacttcatactgtgggccggcaatatttggttcgtgttcaaagagactgggtggcacagctccggccagcgttacttatcagatccaatggagaagcactctagctcatataatcaaggaggctacaatcaggactcatatgggtcctcttccggctattcccagcaggctagcctcggacccacaagcgatgaattcggacagcagccgacaggaccgactagctttactaaccagatatag

SEQ ID NO: 30694 - DNA, 177 bp, Artificial Sequence
  Description of Artificial Sequence: Synthetic coding sequence
atgtctggacagacgctcactgatcgaatcgcagcagcacaatattccgtcactggttccgccgttgctagagcagtgtgcaaagctacaactcatgaggtaatgggcccaaaaaagaagcacttggactacttgcagaccttctttcagcaagtgctgccgaattttgagatttag

SEQ ID NO: 30695 - DNA, 2634 bp, Artificial Sequence
  Description of Artificial Sequence: Synthetic coding sequence
atgagtgggcaaactctgacggatagaattgcagccgctcagtacagtgtgaccgggtcagccgtcgctagagcggtgtgtaaggccaccacgcacgaggtcatgggccctaagaagaaacacttagactaccttatacaggctacaaatgagacaaacgtgaatatcccacagatggcggacaccctttttgaacgggctactaacagcagctgggtggtggtgtttaaggccctagtgaccacacaccatctgatggtgcacggcaatgagcgtttcatccagtaccttgctagtagaaatactctctttaatctctccaacttccttgacaaaagtggctcgcatggctatgatatgtcgacattcatacgacggtatagtcgatacctgaacgagaaggcgttcagctaccgccaaatggcatttgattttgctcgagtgaagaagggcgccgacggagtcatgaggacaatggcacctgagaagcttttgaagagtatgccgatactgcaaggtcagatcgacgcactgctcgagttcgatgtgcatcccaatgagctcacaaatggggttataaatgctgcttttatgttactgtttaaggatctgatcaaacttttcgcctgttataatgatggcgtgattaacttactcgagaagtttttcgagatgaaaaaggggcaatgcaaagacgcccttgagatctataaacgtttcctcaccagaatgacccgtgtgtctgaattcctgaaggtggccgagcaggtgggaatcgacaaaggcgacattcctgacctaacgcaggccccctcaagcctgatggagaccctggaacagcacctcaacactctggagggaaagaaaccaggaaacaagagcggcgctccatccccactgtccaaatcgagtccggccactacggtgacatctcccaactcaacgcctgcgaaaacaatcgatactagcccccctgtggaccttttcgcaacagccagtgcagctgtccctgtgtctacgagcaaaccgagcagtgatctcttagatctacaaccagacttcagctctggcggggctgcagcagccgcagcccccgcaccaccgccccccgctgggggagctacagcatggggggatctcttgggcgaagattccctggcagcacttagcagtgtgccatctgaggctcagatcagtgatccttttgccccggagccaacccccccgacgactaccgccgaaatagctacggccagcgctagcgcctctaccacaacgacagttacagccgtgaccgccgaagtggacctgttcggggacgccttcgctgcatctcctggggaggccccagctgcgagcgagggggcagccgcccctgcgaccccaacacctgtggctgcagctctggacgcttgttctgggaacgatcctttcgcccccagcgagggctctgcggaggctgctccagagctggatctgttcgcaatgaagcccccagaaaccagtgtgccagtggtgacacccaccgccagtaccgccccacccgttccggctaccgcacccagccctgcacccgctgtggccgcagccgcggctgctaccaccgctgcaacagccgctgccaccaccacaactactacatctgcagctacagcaaccaccgctcccccagcattggatatttttggggacctctttgaatctacccccgaagtcgcagcagctccaaagcctgatgccgccccctccatcgacttattttccacagacgcattttccagccctccccaaggtgcctcacccgtccctgagtcttcactcaccgccgatctactctcggatgcgtttgggtcatcggctagcgaaccccagccagcctctcaggcagccagttccagttccgcctccgccgatctgctggccgggtttggaggatctttcatggccccaagtccctcacccgtcaccccggcccagaataacctactgcagcccaattttgaggctgccttcggcactacaccgtcgacttcatcaagttcctcattcgaccccagcgtgtttgacggtctgggcgatctgctcatgcctacaatggctccagcaggacagcctgcccctgtgtcaatggtccctccgtcccccgcgatggcagcttccaaggcccttggttccgaccttgattcatctctcgctagcctcgtcggcaacctggggatttccggcactaccacaaaaaaaggcgacttacagtggaacgcgggcgagaagaaactgacaggcggagccaattggcagccaaaagtggccccagccacatggtctgccggggtgccccccagcgccccactgcagggagcagtacctccgacctcctcagtgccgcccgttgcaggggcgccatctgtgggacagccgggagccgggtttggtatgccccccgctggaaccgggatgccaatgatgccacagcagcctgttatgttcgcccagcccatgatgcggcccccatttggcgctgccgccgtacccggaacccaactgagtcccagtcctacccccgccagccagtcccccaaaaagccccctgctaaggatccactggccgatttgaacatcaaagatttcttgtag

SEQ ID NO: 30696 - DNA, 2709 bp, Artificial Sequence
  Description of Artificial Sequence: Synthetic coding sequence
atgagtggccagacactgacagacaggattgccgcggcccagtacagcgtgacggggtcagctgtagctcgtgctgtgtgtaaagccactacacacgaggtgatgggaccaaagaaaaagcacctggattatctgatacaggctacaaatgaaaccaacgtgaacatcccacagatggcagatacactctttgagagggctacgaatagttcatgggtcgtggtgtttaaggccctggttacaacccatcatcttatggttcacggcaatgaacgtttcatacagtacctcgcttctcgaaacacattatttaatctcagcaattttctggacaaatccggcagtcacggctatgacatgagcacttttattcgcaggtacagccgatatctgaacgaaaaagcgttttcctacagacaaatggcctttgattttgccagagttaagaagggagcagatggggtgatgagaacaatggcccctgagaagcttttgaagagtatgcctatcttgcagggccagattgacgcgctgctcgagtttgacgtgcatcctaatgagcttaccaatggagtgattaacgccgccttcatgctgctgtttaaggatctgatcaagctgtttgcctgctataacgatggcgtgattaatcttctcgaaaagttttttgaaatgaagaaggggcagtgcaaggatgctttggagatctacaaaagattccttaccagaatgacacgcgtgagcgagttcttgaaggttgccgagcaggtcggcattgacaagggcgacataccagacctcacacaggcccctagtagccttatggagacgctagaacaacacctgaacacactcgagggcaagaaacccggcaataacgaaggttctggtgctcccagtcccctttcaaagtcttcacctgccaccactgtgaccagcccgaacagcacaccggctaagacaatagacacttctccacctgtggatcttttcgcaactgcttcagccgcagtgccagtcagcacctctaaaccttcctctgacctgctggatctgcaaccagatttctccagcggcggggcagccgcagccgctgcacccgcccctccgccacccgctgggggggcaacagcctggggggacctcctgggagaagactctctcgcagccctcagctcggtacctagcgaggcacagatcagtgatccattcgctccggagcccaccccccctaccactacggctgagattgcaaccgccagcgcatcagcttccaccacaaccaccgtcaccgcggtaacggccgaagtggatctattcggggacgcctttgccgcgagtccaggggaggcgcctgccgcctcggagggtgcagctgctcctgctaccccaacaccagtggcagccgcactggatgcctgcagcggcaacgacccattcgcccccagtgaaggctccgcagaggccgcacccgagctcgacttgttcgctatgaagccaccagagacgtccgtgccagttgtgacgcccactgcttcaacagcgccccccgttcctgctacggcaccctcccccgcgccagccgtggctgcggcagccgcagctaccaccgccgcaaccgctgccgcaaccactacaactactacatcagctgcaacagccaccacagcccctccagctttggacattttcggagatttattcgagtccacccctgaagtggctgctgcacccaaaccagatgctgcaccctctatagacctgttctccacagacgccttttcatccccccctcagggagcgtccccagtacctgaaagctcgctgaccgctgacctcctaagcgtggacgcttttgctgcgccatcccctgccacaaccgcgagtcccgccaaagttgattcatctggggtgatagacctattcggcgacgcctttggcagctcagcgtcggagccccaaccagccagccaggccgccagttcttctagtgctagcgctgacttgctggctggctttggcggttctttcatggctccatcgccctctcccgtgacccccgcacagaataacttacttcagcccaatttcgaggccgcctttggaaccaccccgagcacttcgtcttctagttcgttcgatcccagcggggatctcctgatgccaaccatggctcctgctggccagccagcgccggtgtcaatggttcctccctcacccgccatggccgcctctaaggccttgggctccgacctcgatagctccctcgccagcctggtcgggaatttagggataagcgggacaacgaccaaaaagggtgacctccaatggaatgcaggggaaaagaagcttaccggaggtgctaactggcagcctaaggtcgcccccgctacttggagtgccggggttccacccagtgccccactacagggcgcagtccctcctaccagttccgtgccgccggtcgccggtgccccttcggtcggacagcccggagccggttttggcatgcctcctgctgggaccggtatgccaatgatgcctcagcagccagtaatgttcgctcagcctatgatgagaccgccattcggagctgctgctgtcccaggaacccaactctcgccaagcccgacacctgcgtctcagagtcctaaaaagccccccgctaaggacccccttgccgacctcaacatcaaggatttcctttag

SEQ ID NO: 30697 - DNA, 450 bp, Artificial Sequence
  Description of Artificial Sequence: Synthetic coding sequence
atgtctggtcagaccttaacagatagaattgccgctgcacaatattcagtgaccggaagtgcagtggctcgagctgtgtgtaaggcaactacacacgaggtgatgggaccgaagaagaaacatcttgactacctgatccaggccaccaatgaaacaaacgtaaatatcccacagatggcagacactctgtttgagcgggctacaaactcctcttgggtagtggtgttcaaggcccttgtaacaactcatcatctgatggtgcacggaaatgagcggtttattcaatacctcgcttctagaaacactctgttcaatttatcgaatttccttgacaaatctggcagccatggctacgatatgagcacattcatccggcggtactctcgatacctgaatgagaaggcatttagttacaggcagatggcattcgacttcgcacgggtgaaatag

SEQ ID NO: 30698 - DNA, 2724 bp, Artificial Sequence
  Description of Artificial Sequence: Synthetic coding sequence
atgtcaggtcagacactgactgatcggatcgccgcagctcagtacagcgtaactggttccgccgtggccagagccgtgtgtaaagctacaacacacgaggtgatggggccgaagaagaagcatcttgattatctgatccaggctaccaatgagaccaatgtgaacatcccccagatggctgatactctcttcgaacgcgctacaaattcctcttgggtcgtagtgttcaaagccctcgtgaccacacaccatctgatggtgcatggtaatgagagatttattcaatatcttgctagccgaaacacccttttcaacctctctaacttcctggacaaatctggcagtcatgggtacgatatgtcaaccttcattagacggtatagcaggtatctcaatgaaaaagcattttcatacaggcaaatggcgtttgacttcgcccgcgtgaagaaaggagcagatggcgtcatgcggacgatggcaccggagaaactgttaaagagcatgccaatcctgcaaggtcaaattgatgccttattagagtttgacgttcaccccaacgaactgacaaatggcgtgatcaatgccgcttttatgctgctgtttaaggaccttatcaagctttttgcatgctataacgacggggtcattaatctgctcgaaaagttcttcgagatgaagaaaggacagtgtaaggatgccctggagatctacaaaaggtttctcactaggatgaccagagtgtctgagttcctcaaagtagcagaacaggtcggtatcgacaaaggggatataccagatctgacacaggcccccagcagcctaatggaaacactggaacagcatttaaacaccctggagggcaagaagcctggtaataatgaggggtcaggagctcccagtccactgtcaaaaagctcccccgccaccaccgttacctccccaaatagtactccggctaaaacaattgataccagtccacccgtcgatctttttgccactgccagtgctgctgtcccggtctccacctcgaagcctagcagtgatctcctggacctccagccggatttcagctccggcggagccgccgcagctgccgcgcctgcaccccctcctccagctggcggcgcaaccgcatggggcgatctcctcggtgaagactcgttggctgcactctcttcggtgccatccgaggcccagatctcggaccccttcgccccagagcctaccccaccgaccacaacggctgaaatagcaaccgccagtgccagcgcttccacaaccactacagttaccgccgtaacagcagaagtggacctcttcggcgacgcctttgctgcctcaccgggggaggcacccgctgcctctgaaggtgcagcagcaccagccactcctactcctgtcgctgctgcactggatgcttgcagtggcaatgatcccttcgcgcccagcgaagggagtgcggaggccgcccctgaactggacttattcgcaatgaaacctcctgagacgtcagtccccgtcgtgactccaactgcctctactgcaccgcctgtgcctgctaccgcccccagcccagcacctgccgttgcagccgccgctgctgctacaactgcggccacagcagcagccaccacgactaccacgacgtcggccgctacagccacaaccgccccacccgcactagatatcttcggagatctgttcgaatccaccccagaagtggccgcagccccgaaacctgatgcagcaccatccatcgacctgtttagcaccgatgccttttccagtcctccccagggcgccagccctgtaccggagagtagtctgaccgcagatttgctctcagtggatgccttcgctgccccctcccctgccactaccgcatcccccgcgaaggtagactcctctggggtgatcgatttgttcggagacgccttcggatcttctgcttccgagccccagcctgcatctcaggctgcatcatcaagcagtgcgagcgctgacctgctggcgggctttggtggctcttttatggcaccgagtccgtcccctgtgacaccagcccaaaacaaccttctgcagcccaacttcgaagcggcatttggcacaacaccttcaacgtcttcctcatcctcttttgacccatccgtgtttgatggtctgggagatttactaatgcccacaatggcgcctgctggacagccagcccctgtgtccatggtgccaccatctccagccatggcggcatctaaggctctcggctccgacttggactcctccctcgcaagcctagtgggaaatctgggcatcagcgggactaccacaaaaaagggagacctgcaatggaatgccggagaaaaaaagcttactggcggagctaactggcaaccaaaggtagccccggccacgtggtcagctggagtcccgccttcagcccccctacagggcgcggtgccccctacgagctccgtaccgccagtggccggggccccctccgttggccagccgggcgctgggtttggcatgccacccgcaggcacaggtatgcccatgatgccacaacagcctgtaatgttcgcccaaccaatgatgagacctcccttcggagctgccgccgtgccaggcacgcagctttccccgagccctactccagccagtcagtcaccaaagaagccaccagcaaaggatccactggctgatctcaatataaaagacttcctttag

SEQ ID NO: 30699 - DNA, 2724 bp, Artificial Sequence
  Description of Artificial Sequence: Synthetic coding sequence
atgtccggacagaccctgaccgacagaattgcagccgcccaatattcagttactggaagcgcagtggccagagctgtatgcaaggctacgacacatgaagtgatgggacccaaaaaaaagcacttggattacctgatacaggctaccaacgaaactaatgtcaacattccccagatggcagacacactcttcgaacgcgcaactaacagctcatgggtcgtggttttcaaagccctagtgactacccatcatctgatggtccatggaaatgagcgatttatccaatacctggcctctcgcaatactctgttcaacttaagtaatttccttgataagagtggatcgcacggctatgacatgtccacttttattagacgctattcgaggtatctcaatgaaaaggccttcagctaccgccagatggcttttgatttcgcccgcgtcaaaaagggcgcagatggcgtcatgcgcaccatggcacctgagaaactgctgaagagtatgccaatcctgcaggggcaaattgacgctctcctggagtttgatgtgcatcccaatgagctaactaatggtgttataaacgccgctttcatgttgctgtttaaggatcttataaaactgtttgcgtgctacaacgatggtgttattaacctactagaaaagttctttgagatgaagaaaggtcagtgcaaagacgctcttgagatctataaaaggttcctgactaggatgactcgggtttccgagtttttaaaggtggctgagcaggtcggtatagataaaggtgacattcccgatctgactcaagccccttctagcctgatggaaactctggaacagcacctcaacacactagagggaaagaagcccggaaacaataagatctctggagcaccctcacctttgagcaagagcagccctgccacaaccgtaactagtccgaactccacccctgccaagaccattgacacatccccaccggtggatctctttgccaccgcctccgctgcagtgccagtctccactagcaaacctagttcagacctccttgacctacagccagacttctcaagcggcggagctgctgccgcggctgcacccgcgccacccccgcccgccggaggggctaccgcctggggcgacttacttggagaagattctctggccgccctttctagtgtgcctagcgaagctcagatcagcgatccttttgcgccagagcctacacctcccaccactactgcagaaatcgccacggccagtgcctccgcatccactacgaccacagtcacagccgtgactgctgaggtcgacctatttggcgatgccttcgccgcctctccaggagaggcccctgctgcatctgaaggcgccgccgcaccagctactccaaccccagtggcggccgccttagatgcttgctcaggcaatgacccctttgccccttcagaaggaagtgccgaggcagcacccgagctcgacctttttgcgatgaagcctcctgaaacctctgtgccggtcgttactccaaccgcttccaccgcccccccggttcccgccacagctcctagtcccgcccccgcagtggccgcagctgccgcggcgactacggctgccacggctgccgctacaaccactactaccacaagcgccgctaccgctacgactgcccctcccgcgttagatattttcggggacctttttgagtccacacccgaagtcgcagccgcccccaagcccgacgcagccccatccatagacctgttttctactgacgccttctcttcaccaccccagggcgcctcacctgtgcctgaatcatccctgacggccgacctgctttccgtggatgcattcgctgcaccttcccccgccaccacagcctcacccgcaaaagtggattctagtggggtaatagaccttttcggggatgcattcgggagctcagcctcggaacctcaaccagcctcacaggcggcctcatctagctccgcctcagcagatctgttagcagggttcggtggttcattcatggcaccctcaccaagtcccgtgacacccgcccagaataatttgctgcagccaaattttgaggccgccttcggaacaacacccagcacctctagctcttcttcatttgatccttccgtatttgatggcttaggggacctcctgatgcccaccatggcacctgccggacagcccgcaccagtgtcaatggtaccacccagcccagctatggccgcatccaaggctctgggttcggatctggacagttctctggccagtcttgtggggaacctgggtatttcgggcacaaccactaaaaaaggcgatctccagtggaacgcaggtgagaagaagctgaccggtggggccaattggcagcccaaggtagctccagctacctggtccgcaggcgtgcccccatccgcccccctgcagggcgcagttccgccgacaagtagcgttccccctgtcgcaggcgcgccctctgtgggtcagccaggtgcgggttttggtatgcccccagccggcacgggaatgcctatgatgccccagcaaccagtgatgtttgctcagccaatgatgcggcctcctttcggggcagcggctgtgcctggaacccagctatcaccctcgcctacgcccgcctcgcagtccccaaagaagccccctgcaaaggatccacttgccgatctgaacataaaagacttcctctag

SEQ ID NO: 30700 - DNA, 1803 bp, Artificial Sequence
  Description of Artificial Sequence: Synthetic coding sequence
atgagtgggcagacgctgaccgaccggatcgcggccgcccaatattccgtaaccggttccgcagtggcaagggccgtctgcaaggctacaacacacgaggtgatgggacccaaaaaaaaacacctggactaccttattcaagcgactaatgaaacgaatgtgaatatacctcaaatggccgacaccctgtttgaacgcgcaactaactcgtcatgggtagtcgtgtttaaagcactcgtgactacgcaccaccttatggtccacggtaatgaacgttttatccagtacctcgcctctcgcaatacattattcaacctgtccaatttcttggataaatcgggttcacatgggtatgatatgagcactttcattagacgctactcccgttacctgaatgaaaaagcgtttagttacaggcagatggcattcgactttgcccgagtcaaaaagggcgcagacggtgttatgagaacaatggcacccgagaagctgcttaaaagcatgcccatcttgcagggacagattgatgcccttctggaattcgacgtgcatccaaatgaattgaccaacggcgtgataaacgcagcttttatgctgctctttaaggatctgatcaaactgtttgcctgctacaacgatggagtaatcaatcttctggaaaagttttttgaaatgaagaagggacagtgcaaagacgctttggaaatctataaacggttcctcaccagaatgacacgcgtgtccgagtttcttaaagtggccgaagccccatcctcgctgatggaaaccttagagcagcacttaaacactctcgaggggaaaaagcccggcaacaaaagcggtgccccttcacctctaagcaaatcctcaccagccactaccgtcacctcgccaaatagtacaccagccaagacgatagatacatcaccacccgtcgacctctttgccacagcttctgccgccgtgcccgtgtctacgtccaagccctcctcagacctgctggatctacaaccagacttttcttctgggggagcagcggctgctgctgcccctgcccccccccccccggcaggtggagcaacggcatggggtggttttggaggctcatttatggcaccatccccgagcccggtgacacctgcacagaacaatctgttacagccaaatttcgaggccgcttttggtaccaccccaagcacctcctccagctccagcttcgaccccagtgtgtttgacggcctgggggatctgctgatgccaaccatggcgcccgcagggcagccagctcctgtgtccatggtgcccccaagtcccgccatggccgcatctaaggcactaggtagcgatctggactcttccctggcatctctggttggaaacctcgggattagtggaaccaccactaagaagggagatttacaatggaacgccggagaaaagaagctgaccggcggggccaattggcagcctaaggtcgccccagctacttggtctgccggcgtgccgccatcagctccacttcagggcgccgttccacctactagttctgtcccgccagtggctggggccccgtctgtgggacagccaggcgccggctttggtatgccgcccgctggaactggcatgcccatgatgccccagcaaccggtgatgtttgcccaaccaatgatgagacctcctttcggcgccgccgctgtcccagggacacagctgagcccgagtcctacacctgcgtctcagagcccaaagaagccaccagccaaggacccactcgctgatctgaacattaaggattttctatag

SEQ ID NO: 30701 - DNA, 2724 bp, Artificial Sequence
  Description of Artificial Sequence: Synthetic coding sequence
atgtctggtcagaccctgactgacaggattgccgcggcccaatactccgtgactgggagcgccgtggcccgggccgtgtgcaaggccacaacccacgaagtgatgggtccaaagaagaagcatctcgactacctcatccaagccactaacgagaccaacgtcaatattcctcagatggccgataccttgttcgagcgtgccactaactcaagttgggttgtggtgtttaaggccctggtgaccacacatcatctgatggtgcacgggaatgaaaggttcatccaatacctggcctcacggaatactctgttcaatctatctaatttcctggataaatctggaagccacggctacgatatgtctactttcatccgcagatattccaggtaccttaacgaaaaggctttcagctatcggcaaatggcgttcgacttcgctcgcgtgaaaaagggagccgacggcgtgatgcgcaccatggcgccagagaagctacttaagtctatgccgatcctgcagggacagattgacgccctgttggagttcgatgtacatcctaacgaactaacaaacggcgtcattaacgccgcctttatgctcctcttcaaggacctgatcaagctgttcgcctgctacaacgacggtgttataaacctgcttgagaagttcttcgaaatgaaaaagggacaatgtaaagatgcgctcgaaatctataagagatttcttaccaggatgacaagagtctcggagtttctgaaggtggccgagcaggtgggcatagacaaaggcgatatccctgacctcacacaagctccatcttcactgatggagactcttgagcaacaccttaatactctagagggcaagaagcccggaaataacgaaggaagcggcgccccctctcccttaagcaaatcctctccagccaccacggtgacaagtcccaactctacacccgctaagaccatcgacacatcaccacctgttgatctgttcgccaccgcatcagcagctgtacccgtgtccacgagtaaaccctcctctgatttgctggacttgcagcccgactttagttcaggcggcgccgcggccgccgccgcccccgcccctccacctcccgcaggaggggcaaccgcttggggcgatttgttgggggaagatagtctcgcggccctctccagtgtgcctagtgaggcccagatttcagatccatttgcgcctgaacctacaccacccacaactacggcagagattgccactgcctccgcgtcagcgtctactaccactacggtcaccgcagtcacggcagaggtggatttgttcggagatgcctttgccgccagccccggggaggctcctgccgcctcggaaggcgctgccgctccagccacgcctacaccagtggcggcagccctcgacgcgtgcagcggcaatgatccgttcgccccctcagagggatctgctgaggctgcacccgaactcgatcttttcgccatgaagcctcccgagacatctgtcccagtcgttactccaaccgcatcaacagctcctcctgtcccagccaccgccccaagcccagcaccagccgttgcagccgccgccgccgctactactgccgccaccgccgccgcaacaaccactaccactacctctgcagctaccgctacgaccgccccgcccgctctggacatctttggagatctgtttgagagcacacccgaagttgccgcagccccaaaacctgatgccgctccttctatcgacctgttttcaacagatgctttctcgtccccaccgcagggtgccagtccagtcccagagagcagcctcaccgctgatctccttagcgtcgatgcgttcgcggccccaagcccagccacgaccgcaagcccggccaaggtggattccagtggggtgattgacctctttggcgacgccttcggcagttccgcttccgagccacagcccgccagccaggccgcatcttccagctctgcctccgctgacctattggccgggttcgggggcagctttatggcaccctccccgagcccggtcaccccagcccagaataatctgcttcagccaaatttcgaggctgcatttgggactaccccttctacttcaagcagctcaagtttcgacccttccgtcttcgacgggctgggcgatctgctgatgcccaccatggcccctgccggacaacccgctccggtgtcaatggttccaccctcccccgccatggccgcctcaaaggcgctcggaagtgatctggacagctcactggcctccctggtcgggaacctcggaatctctggaactaccaccaaaaagggggacctgcagtggaacgccggggaaaagaagctaactggtggagcgaactggcagccaaaagtcgctcccgcaacctggtcggctggagtgcccccaagcgcccccctgcagggagctgtccctcccacgtcctctgtgccccctgtcgcaggagccccatccgtaggccaaccaggggccggctttggcatgcctccagcaggaaccggcatgcccatgatgccccaacagcctgtcatgtttgctcagccaatgatgagacctcccttcggagccgcggccgttccggggactcagttaagtccgtcaccaacgcccgcctctcagtctcctaagaaaccgccggcaaaggatcccctggctgatcttaacatcaaggactttctttag

SEQ ID NO: 30702 - DNA, 633 bp, Artificial Sequence
  Description of Artificial Sequence: Synthetic coding sequence
atggagactctggaacagcacctaaatacgctggagggcaagaagccaggaaacaaatatgcaagtggcgccccatcgccattgtcaaagagcagccccgccactaccgtcacctctcccaattctacgccagccaaaacaattgacacctctcctcccgtcgaccttttcgccactgcgagcgcggccgttcccgtgtctacttccaaacctagttctgacctgttggatctgcagccagacttcagtagtggaggggccgccgccgcagctgctccggctcccccgccgcccgccggtggcgccacggcctggggagacttgctcggtgaggactctttagccgccctgtcttccgttccatccgaggcccagatttcagatccttttgctcccgagcccactcctcctaccacaaccgccgagatcgctaccgcttcagcaagcgccagcacaactaccactgtaacagctgtgaccgccgaagtggacctgttcggtgggagtgcagaggcggctccagaactcgacctgtttgcaatgaagccacccgaaacgtcggtccccgtagtcacgcccaccgcttctactgcccctccagtgccagccaccgcaccctcccccgcaccgtag

SEQ ID NO: 30703 - DNA, 456 bp, Artificial Sequence
  Description of Artificial Sequence: Synthetic coding sequence
atgtccggtcagactctgacggataggatcgctgccgcccagtattcagtgactggtagcgccgtcgctcgcgcagtgtgtaaggctacaacccacgaagtcatggggcccaagaaaaaacatctggactacctcatccaggcaacaaatgaaactaacgttaacatcccccagatggcagacaccttattcgagagggcaaccaacagttcgtgggtggtggtgttcaaagcattagtaaccacacatcacctcatggtgcacgggaacgagcgtttcatccagtacctagctagtcggaacacactgttcaatttaagcaatttcctggacaaatccgggagtcacggttatgacatgagtacgtttatccgcagatactccaggtacctgaacgaaaaggctttcagttacaggcaaatggcctttgattttgctagagttaagaagggctag

SEQ ID NO: 30704 - DNA, 459 bp, Artificial Sequence
  Description of Artificial Sequence: Synthetic coding sequence
atgtcgggtcagacactgacggacaggattgccgccgcccaatactccgttactggctcagcagtagctcgcgcagtatgtaaagcaaccactcacgaggtgatgggtcccaaaaaaaaacatctggactatctaattcaggccaccaatgagacaaatgtgaacatcccgcaaatggccgatactctcttcgagagggctacgaatagcagttgggtggtagttttcaaagcactcgtcacaacccaccatctcatggtccatggcaatgagcggtttattcagtatcttgcctcccgcaatacactgttcaacctgagcaacttcctcgacaaaagcgggtcccatgggtacgatatgtctacctttatcagacgttacagcaggtatcttaacgagaaggcattctcataccgtcaaatggccttcgacttcgcgagggtcaagaaaggggcgtag

SEQ ID NO: 30705 - DNA, 201 bp, Artificial Sequence
  Description of Artificial Sequence: Synthetic coding sequence
atgtccggccagactctgaccgataggattgctgccgcgcagtactctgtgacaggatccgcagtagcccgcgcagtttgcaaagctaccacccacgaagtgatgggcccaaaaaagaaacacctggactacttgatccaggcaaccaatgaaactaatgttaatatcccccagatggctgacaccctctttgagcgttag

SEQ ID NO: 30706 - DNA, 1803 bp, Artificial Sequence
  Description of Artificial Sequence: Synthetic coding sequence
atgtcggggcagaccctgaccgaccggatcgctgctgcacaatacagtgtgaccggatctgctgtggctcgagctgtgtgtaaggccacaacccacgaggtgatggggcctaaaaaaaaacacttggactatcttattcaggctactaatgaaacaaatgtgaacataccacaaatggcggacactcttttcgagagagcaaccaactcatcatgggttgtggtttttaaggccctggtgactactcatcacctgatggttcatgggaatgaaaggtttatccagtacctcgcttctagaaacacactgtttaatctgagtaacttccttgacaaatccggcagccatgggtacgacatgagtaccttcatacggcgttacagtaggtatctgaatgagaaggcgttttcataccgccagatggcctttgatttcgcccgtgtcaaaaagggcgctgacggcgttatgagaactatggcaccagagaagctgttgaagtccatgcctatactgcaagggcagattgatgcactgctggagttcgatgtacaccccaacgaactgacaaatggcgtaatcaacgctgccttcatgttactcttcaaagacctgataaagctgtttgcttgttataatgatggggtgatcaacctgctggagaagtttttcgaaatgaaaaagggacaatgtaaagatgctctggagatctacaaacggttcttgaccaggatgacacgcgttagcgagttcctgaaagtcgctgaggcgccgtcttcactgatggagaccctagagcagcacctcaataccttagagggaaagaagccagggaacaaaagcggagcccctagccccctgagcaaatctagtccagcgacaaccgtgactagcccaaacagtacaccagccaaaaccatcgataccagccctcctgttgacttgttcgctacagcgagcgcggcggtccccgtcagtaccagcaagccatcgtccgacttgttagatcttcagcctgacttctccagcggcggcgctgctgccgcagcggcccctgcccctccaccacctgcaggaggtgcaacagcgtggggaggctttggtggctcctttatggcgccatctccgagtcccgtcacacccgcccaaaacaatttgctccagcccaatttcgaggccgctttcgggacaactcctagcaccagcagcagcagctcttttgacccatccgtttttgatggtctgggcgatcttttgatgccgacaatggctcctgctggacaacctgcccctgtctctatggtgcctccatcacctgctatggccgcctcaaaagctcttggcagcgatctagatagtagtctcgcctcactggtaggcaatcttggaatatcaggaactaccaccaaaaagggagaccttcaatggaatgcaggtgagaagaagcttaccggaggggccaattggcagccaaaggtggctcccgcgacctggtccgccggcgtgccacccagcgcccctctgcaaggcgctgtgcctccaacctcctctgttccacctgtggccggcgcccctagcgtcgggcagccaggtgcaggcttcggcatgccaccggccggaaccggcatgccgatgatgccgcaacagcctgtgatgtttgcacagccaatgatgcggccacctttcggcgccgccgctgtgcctgggacacagctttctccaagtccaacacccgcctcacagagccctaagaagccccccgctaaggaccccctagcggacttgaacatcaaagatttcctgtag

SEQ ID NO: 30707 - DNA, 2709 bp, Artificial Sequence
  Description of Artificial Sequence: Synthetic coding sequence
atgtcaggccagacgctgacagatagaatcgctgctgcgcaatacagtgttactggatccgcagtggcacgtgctgtatgtaaggctacgactcatgaagttatggggccgaagaaaaagcacttagactatttgatccaggcaacaaacgagacaaatgtcaatatccctcagatggccgacacgctattcgaaagagccacaaatagttcctgggtggttgtgtttaaggctctcgtgacgactcaccacctgatggtccatgggaatgaacgcttcatccagtatctcgccagtagaaatacactcttcaatctgtctaactttctagacaaatcaggcagccacggatacgacatgtcaacattcatccggcgctattcccgctaccttaacgagaaagccttctcctatcggcagatggcgttcgacttcgctcgggtaaaaaagggtgccgatggagtgatgcggacaatggccccagagaagttgttaaagagtatgcctatcttgcaggggcaaatcgacgccctactcgagttcgacgtccatcccaatgaattgactaacggtgttattaacgccgcgttcatgctgctgttcaaagacttaataaagctgtttgcatgttacaacgacggcgttataaacctgctagaaaagttttttgaaatgaaaaaaggacagtgcaaggacgccttggaaatctacaaacggtttttaacccgtatgacgagggttagcgagtttctgaaggttgccgaacaggtgggcatcgataagggcgatattcccgacctgacccaggccccttccagccttatggagactctggaacagcacctcaatacactggaaggcaaaaagcccggcaacaacgaggggagcggggctccgtcccctttgtccaagagctcacccgctacaactgtcaccagtccgaactcgaccccagctaaaacaattgacacatcacctcctgtggacctgttcgcgaccgcatctgctgctgtgccagtaagcacatccaagcctagtagcgacctcctggatttgcagcccgatttttctagcggaggtgcagctgctgccgcagcgcctgccccccccccgcccgccgggggtgctacagcctggggggacctgctcggtgaggattcactcgccgctttgagcagcgtcccgagcgaagcgcagatctcagacccatttgctccagaaccgaccccgcccaccactacagctgaaattgctaccgcctctgcgtccgcctccacgactaccacggtgacagcggtcacggcggaagtggacctttttggggacgcattcgccgcatcaccgggcgaggcacccgcggcctccgaaggggctgccgcacccgctacccccacgcccgtggccgccgccctggacgcctgctccgggaacgatccctttgcacctagcgagggctccgccgaggccgcacccgaactggatctgtttgcaatgaagcctcccgagacaagcgtgcccgtcgtgactccaacagcctcaactgccccgcctgtccctgctacagcgccatctcccgctccagctgtggccgccgcagcagcagccaccaccgctgccacggcagcagcaactactactaccacgacatccgctgcaacagcgacaacggctccccccgctctggacattttcggggatcttttcgaatctaccccggaggtggcggcagcgcccaagcctgatgccgctccatcaattgacctgttttctacagacgctttcagtagtccacctcagggggcatcccctgttcctgagtcttctctgacggcagatttactgagtgttgacgctttcgcagcaccttcacctgcgacaacggcctcgcccgcaaaggtagacagctccggggtgatcgatctctttggtgacgcctttgggagctcggccagcgagccacagcctgcttcacaggcggcttcgtcaagcagtgcatcagcggacctgctggccgggttcgggggatccttcatggcccccagcccctctcccgtgactccagctcagaataatcttcttcagcctaactttgaagccgccttcggcactaccccttccacctcctcgtcatctagcttcgatccaagcggtgacttgctgatgcccaccatggcccccgccggccagcctgccccagtgtccatggtccctccatcccctgcaatggctgcaagtaaggccctggggagcgacctggattcttcacttgcctctcttgtcggaaatctcggtatctccggcaccaccaccaaaaaaggggacctacaatggaacgccggcgagaagaaactgacggggggggccaattggcagcctaaggtcgcccccgctacatggagtgcaggagtgccaccctctgcacccttacaaggcgcagtacctcccacctcatcagtgcctcccgtcgccggggccccatccgttggtcagcctggcgctggcttcggaatgcctcccgcgggaaccggtatgcctatgatgccccagcagcccgtcatgtttgcccaacctatgatgcggccgcctttcggcgccgctgccgtgccagggacacagctgagcccctctcctacgcccgctagccagagcccaaagaagcctccggccaaagatcccctggccgacctgaacattaaggactttctgtag

SEQ ID NO: 30708 - DNA, 2724 bp, Artificial Sequence
  Description of Artificial Sequence: Synthetic coding sequence
atgagcggacagactttaactgataggatagcggccgctcagtattccgtgaccggatcagctgtagcccgggccgtgtgtaaagccaccactcatgaagtgatgggccccaagaagaagcatctagactatttaatccaggccaccaacgagacaaatgtaaacataccacaaatggccgatactttgttcgagcgcgcgaccaactccagctgggtggtggttttcaaagctctcgtgaccacacatcatctgatggtccacgggaatgagcgcttcattcagtacttagccagtcgaaacacactctttaacttatccaactttctggataagagcggctcccacgggtacgacatgtccacgtttatccgccgctatagccgataccttaacgagaaagcgttcagctatcggcagatggcgttcgatttcgcacgggtcaaaaagggtgcagacggcgtgatgcgaactatggccccggaaaaactgctgaaatctatgccaattctccaaggccaaatcgacgcccttttggagttcgatgtccaccccaatgaactaaccaatggagttatcaacgctgctttcatgttgctctttaaggatctgataaagctcttcgcctgttataacgacggcgtcataaatctgttagaaaaattcttcgagatgaaaaaggggcaatgtaaggacgcgctggagatttataagcggtttctgactaggatgactagagtgtcggagtttctgaaggtcgcggaacaggtaggtatcgataagggagatatccccgacctgacacaggccccgtcgagcttgatggaaactcttgagcagcacctcaatacacttgagggtaagaagcccggcaataatgagggcagtggtgccccgtcccctctgtctaagagcagtcctgctactaccgtcacttcgccaaatagcacccccgcaaaaactatcgacactagtccaccagtggatttgttcgccacagcaagtgccgccgtccccgtctctacctcaaagccctccagcgatcttttggacctacagcccgacttcagttccggaggcgctgccgcagctgcagcacctgcacctccaccaccggccgggggcgccaccgcatggggagatttactcggggaagactcgttggccgcactctcttccgtgcctagtgaggcacaaatctcagatccttttgcccccgaaccgactccgccaaccaccactgctgagatcgcaacagctagtgctagcgctagcacaacaacaactgttactgctgttaccgccgaagtcgatctgtttggggatgcattcgccgctagtccaggcgaagctcctgccgcatcagaaggggcagcagcacctgccacgccgactccggtcgccgccgccttggatgcctgctcagggaacgaccctttcgccccttccgaagggagcgctgaagcagcacctgagctggacctctttgcaatgaagccccctgagactagtgtacccgtcgtgacccctaccgcaagcactgccccccccgtaccggcaactgccccctctccagctccagctgtggccgctgcggcggcagccaccacagccgcaaccgctgctgcaacaaccactaccaccacatcagccgccaccgcgactaccgccccccctgccctggacatatttggtgatctcttcgagagcactcccgaggttgcagcggctcccaaacctgacgccgctccttcgattgatttgttctctaccgacgctttttcgagtcccccacagggggccagccctgtgccggagagcagtctgacggcagacctcttatccgtggatgcctttgcggccccaagccctgctacaacggccagtccagctaaggtggattcttccggagtgatcgacctgttcggggatgctttcggaagttctgcctcagaacctcagcctgccagtcaggccgcttccagctcctccgccagcgccgatctcctcgccggctttggaggaagctttatggcaccgtcaccctcacccgtaacaccagctcagaacaatctgctgcaaccaaatttcgaggcagccttcgggacgacaccatcgacctcgagcagcagtagcttcgatccaagcgtgttcgacgggcttggcgacttgctgatgcctaccatggctcccgctggccagcccgcaccggtgtcaatggtccctcccagtccagcaatggccgccagtaaagccctcggcagtgacctcgattcttccttggcctctttggtgggaaacctcggcatttccgggactaccactaaaaagggcgacttgcaatggaacgccggggaaaagaagctgacagggggtgcaaactggcaacccaaggtggcaccagctacctggagtgccggggtgcctccaagcgctcccctgcagggcgctgtcccacccacctcaagtgtgcccccagtagcgggtgccccctcagtgggacagcctggtgccggtttcggcatgcctcccgccggcactgggatgcccatgatgcctcagcagccagttatgttcgcccagcccatgatgagaccacctttcggcgccgcagccgtgccagggacacaattgtctccttccccgactcccgcttctcagtcccctaagaaacctcccgcgaaagacccgctggctgatctgaacatcaaggactttctctag

SEQ ID NO: 30709 - DNA, 354 bp, Artificial Sequence
  Description of Artificial Sequence: Synthetic coding sequence
atgagcgggcaaacattaaccgaccggatcgcagctgcacaatactccgtgacggggtctgccgtagcaagagctgtgtgtaaagccacaacacacgaagtaatgggtcccaagaagaaacacctggactatctgattcaggctacaaacgaaactaacgttaatatcccccagatggccgatacactgttcgaacgggcaaccaattccagctgggtagtggtatttaaagctctcgtcaccacacatcaccttatggtgcacggaaacgaacggttcatccaatatttggcctctaggaataccttattcaatctatctaatttcctcgacaagtctggcagccacggctag

SEQ ID NO: 30710 - DNA, 1689 bp, Artificial Sequence
  Description of Artificial Sequence: Synthetic coding sequence
atggcaactgaacacgtgaacgggaacgggacagaagagcccatggatacgacttcagccgttatccattccgaaaactttcaaactcttctggatgctggcctccctcagaaagttgctgagaaattggatgagatctacgtggcgggcttggttgctcactcagaccttgacgagcgcgcaatcgaggctctcaaggaatttaacgaagatggagcactggctgttctgcagcagtttaaggacagcgacctgtcacatgtgcaaaacaaaagtgcttttctctgtggggtgatgaaaacatacagacagcgtgagaagcaggggacaaaggtcgccgacagcagtaaaggaccggacgaggccaagattaaggctttgctggagcggacagggtacacactggatgtgacaactggccaaagaaaatatggaggaccacctcccgactcagtgtactccggtcagcagccctcagtgggcacagaaatcttcgtcggcaagatcccgagagaccttttcgaggacgagctggtccccctcttcgagaaggccggtccaatttgggatctgaggctcatgatggatccattgacgggccttaataggggatatgcgttcgtgaccttctgcacgaaggaggccgcacaggaggctgtgaaactgtacaataaccatgaaatacgctccggcaaacacattggcgtatgtatcagcgtcgccaacaacagattgtttgtcggatctatccctaagtctaaaaccaaggagcagattctggaagaattctctaaagttaccgaggggctaactgatgtgattctataccatcagccggacgataaaaaaaaaaaccgcggtttctgtttcctagagtacgaggaccacaagaccgcagcccaggctcggagacgattaatgtctggtaaggtcaaggtttggggaaacgtcgggacggtggaatgggcagaccctatcgaggaccctgaccctgaggtgatggctaaagttaaagtgttgttcgtgagaaacctggccaacacagttaccgaagaaatcctggaaaaggcgttcagccagtttgggaaattggagcgcgtcaagaaactgaaggactacgccttcatccatttcgatgagagagatggcgctgtgaaagctatggaggagatgaatggaaaggacctggagggggagaatatagagatcgtctttgccaaaccccctgaccagaaacgaaaagagagaaaggcccagagacaggccgctaaaaaccagatgtatgacgactactattattacgggccgccccacatgcctcctcctacacggggacgaggcaggggaggacgaggtgggtatgggtaccctcctgattactacggttatgaagattactacgactactatgggtatgactaccacaattacaggggcggttatgaggacccctactacggatacgaggatttccaggtgggcgcacggggacgaggagggagaggcgctaggggggcagcaccaagccgtggaagaggggctgcgcctccaagaggcagggctgggtacagccagcgcggcgggccgggatcggctaggggcgtgcgcggcgctcgcggcggcgcccagcaacaaaggggccgcggccagggtaaaggagtggaggccggccccgatcttctccagtag

SEQ ID NO: 30711 - DNA, 1872 bp, Artificial Sequence
  Description of Artificial Sequence: Synthetic coding sequence
atggccaccgagcatgtgaatgggaacggtaccgaggaacctatggatactactagtgcagtcatacactctgagaatttccagactctgctagacgccggactacctcagaaagttgccgaaaaactggacgaaatatatgtcgcgggtctggtggcgcactccgatctcgacgagagggccatcgaggcattgaaggaattcaacgaggacggagctctggctgtgctgcaacaattcaaagactccgatctcagtcacgtgcagaataaatcagcatttctgtgtggcgtgatgaagacctacaggcagcgggagaagcagggtacaaaggtcgccgacagcagcaaaggtccggacgaagccaagatcaaggctctgcttgagcgaactggctacacattggacgtcacaaccggccagagaaagtatggcgggccacctccggactctgtgtactctggacagcagccgtcagtggggactgagatcttcgtcggaaaaataccaagagacctgttcgaggatgagctggtgcccctgtttgaaaaagccgggcctatatgggatttacggctcatgatggaccccttgaccggtcttaatcgcggctatgcatttgttaccttttgtacaaaggaggcagcgcaggaggcagtcaagttgtataataatcatgagatcaggtccggaaaacacatcggggtgtgtataagcgttgctaataaccggctgtttgtaggatctataccaaaatccaagaccaaggagcagattttggaagagttctccaaggttacggagggattgacggacgtgattctctaccaccagcccgacgacaagaagaagaatcgcggcttctgctttctggaatacgaagatcacaagaccgccgctcaggcccgtagaagactcatgtccggaaaggtgaaggtttggggcaatgtaggcaccgtggagtgggccgatccgattgaagatcccgaccctgaggtgatggctaaagtcaaggttctattcgtgaggaatctcgcaaatactgtgaccgaggaaattctggagaaagcttttagtcagtttgggaaactcgaacgggtgaaaaagctgaaggactacgcgttcattcattttgatgaacgggatggcgccgtcaaggcgatggaggagatgaatggaaaagatctggagggagagaatatagagatagttttcgctaagcctcctgaccagaaacgcaaggaacggaaagcacaaagacaggccgccaagaatcagatgtacgatgactactattactacggccctccccacatgcccccaccaactcggggacgcggccggggagggcgaggaggttatggctatcccccagattattacggctacgaagattattacgattattatggatatgactaccacaattaccgcggaggatacgaggacccatattacggctacgaggattttcaagttggagccaggggaaggggaggcaggggcgctcgtggagcggcaccctctaggggacggggagccgcaccaccacgtgggcgcgcagggtacagccaacgtggtggacccgggagcgcacgaggcgtacgtggtgcacgcgggggggcgcagcagcaaagggggaggggggtgcggggcgctcggggcggccgcggaggaaacgtgggcggcaagcgtaaggccgacggctacaatcagccagattctaaacggcgccaaactaacaaccagaactggggaagtcaaccaatagcacagcaaccccttcaaggaggcgatcactctggtaattacggatataaatcagagaatcaggaattctatcaggacacatttggacagcagtggaagtag

SEQ ID NO: 30712 - DNA, 558 bp, Artificial Sequence
  Description of Artificial Sequence: Synthetic coding sequence
atggccaccgagcatgtgaatggaaatggtactgaggagcctatggacaccaccagcgcagtaattcattccgagaattttcaaacgttgctggacgccggcttgccacaaaaagtagccgagaagctcgacgagatctacgttgccggtctcgtggcccattccgatctcgatgaacgggctatcgaggccctgaaagaattcaatgaagatggggcactcgcggtcttgcagcaattcaaagatagcgatctttcccatgtccagaacaaaagtgctttcctctgtggagttatgaagacatatcgccagcgagaaaagcagggcactaaagtggctgactcctcaaaggggccagacgaggctaagatcaaggccctgctagaaagaaccgggtatactttggatgtgaccactggacagagaaagtatgggggacctcctcccgatagcgtgtattcaggccagcagccttccgttggcaccgagatcttcgtcggtaaaatacctagggacttgttcgaagatgagttagttcccctgttcgagaaagcttag

SEQ ID NO: 30713 - DNA, 1260 bp, Artificial Sequence
  Description of Artificial Sequence: Synthetic coding sequence
atgcgcaatatttttaagcggaaccaggagcccatcgtggcccccgcaactacgaccgcaacgatgcccattggcccagtggacaactccaccgaaagtggaggtgctggcgaaagccaggaggacatgtttgccaagctgaaagaaaaactgtttaatgagatcaacaagatcccgctgccaccttgggcactcatagccatagccgtggtcgccgggctcctgctgctgacctgttgcttctgcatttgcaaaaaatgctgttgtaaaaaaaagaagaacaaaaaggaaaagggcaaaggcatgaagaatgctatgaacatgaaagatatgaaaggggggcaagatgatgacgacgctgagacaggcttaactgagggagagggggagggcgaagaagaaaaggaaccagagaaccttgggaagctgcagttttcactggactacgacttccaagctaatcagctcaccgtcggcgtccttcaggccgccgagttgcctgcgttagacatgggtggaacgtcggacccctatgtaaaagtttttctactgcccgacaagaagaagaagtacgagacaaaagttcatagaaagactttaaacccggcattcaacgagacctttaccttcaaagtaccctatcaggaactggggggaaaaaccttggtgatggcaatctacgacttcgatcgattttctaagcatgacataattggggaagtcaaggtacccatgaacacggtggatctgggccagccgatcgaggaatggagggacttacagggtggtgaaaaagaggagcccgagaaacttggagacatctgcacaagcctcaggtacgtgccaacagctgggaagctgacggtctgtatcctggaagcaaagaacctgaaaaaaatggatgtgggaggcctgtcagacccgtacgtaaagattcacctcatgcaaaacggaaagcgcctgaaaaagaagaagaccacggtcaaaaaaaaaacgctgaatccatactttaatgagtctttctccttcgaaataccctttgaacagattcagaaagttcaggtagtggtcacagtgctggattacgacaaactcggaaaaaatgaggccattggcaaaatcttcgtcggatctaacgccaccggtactgagctgcgccattggagcgatatgctggcgaacccgcggcggcccatcgcccagtggcactcattgaaaccagaggaggaagttgatgcgctattgggaaagaacaagtag

SEQ ID NO: 30714 - DNA, 1260 bp, Artificial Sequence
  Description of Artificial Sequence: Synthetic coding sequence
atgaggaatatatttaagcgcaatcaagagcccatcgtagcccctgcaactaccacagcgaccatgcccatcgggccggtggacaactccacggagtcagggggagccggcgagtcacaggaagacatgttcgctaagctaaaggagaagctcttcaacgagatcaacaaaataccacttccgccatgggctctgattgccatagcagtggtggcaggtctgctccttctgacttgctgcttctgcatatgcaagaaatgctgctgcaaaaagaagaagaataaaaaggagaaggggaaaggtatgaagaacgccatgaacatgaaagatatgaaaggtggacaggacgatgacgacgccgagacaggcctaacggaaggggagggagagggggaagaagagaaggagcctgaaaacctgggtaaacttcaatttagcctcgactacgattttcaggcaaatcagctgactgtgggcgtgctgcaggcagcggaactcccagccctggacatgggcggaacttctgacccttatgtcaaggtgttcctgctgccagacaagaaaaaaaagtacgagacaaaagtgcaccggaaaacactcaatcctgcttttaacgagactttcaccttcaaggtgccttaccaggagctgggcggcaagactctggttatggctatttatgacttcgataggttttcaaagcatgacatcatcggcgaggttaaggtgccgatgaataccgttgatttggggcagcccattgaagagtggcgcgacctgcaagggggtgaaaaggaagaaccggaaaagctgggggacatctgtacctcactgaggtacgtgcctacagcaggaaagctgaccgtgtgcatattagaggcaaaaaacctcaagaaaatggacgtcggagggttgtctgacccttacgtgaaaattcacttgatgcaaaatggaaaacgactcaaaaagaaaaagactacggtgaagaaaaaaacactgaatccttactttaacgaatccttctctttcgaaatcccttttgagcagattcaaaaagtgcaagtcgtggtgacagtgctcgactacgataaactgggcaaaaacgaggccattggcaaaattttcgtgggctccaacgccaccggcacggagcttagacattggagtgatatgcttgccaatccgcgccgcccaattgcccagtggcactccttaaaaccagaagaggaggttgacgcactgctcggcaagaataagtag

SEQ ID NO: 30715 - DNA, 1206 bp, Artificial Sequence
  Description of Artificial Sequence: Synthetic coding sequence
atgttacacttacacggatggcagacgatgcaaggccggaaaatgggccacccacccgtgtccccatctgcaccggctcccgcaggaactacagctataccggggttaatacccgatctggtggctgggacaccctggccaagatgggcacttattgctggagccctcgccgctggcgttttgctggtcagctgtctgctgtgcgcagcttgttgctgttgccgtaggcatcggaaaaaaccacgggacaaggaaagtgtagggctggggtccgcgcggggcactaccacgacccacctggtacaacccgacgtggacggactggagagctcccccggagacgctcagcagtgggggtgtcttcagctgagtcttgagtttgacttcggaagccaggaaatacgcgtcggcctcagacaggccgctgaccttagacccggtggaactgtcgacccatacgctagagtcagcgtaagcacacaggccggtcatagacacgagaccaaggttcatcgagggactttgtgccccgtttttgacgaaacctgctgctttcacatcccacaggcagagttacccggcgccacattacaggtgcagctttttaacttcaagcggttttccggccacgaacccctcggagagttgcgactgcctctcggaacagtcgatctccagcacgtgttggagcactggtatctcctggggccgcctgcagctacccagccagaacaggtcggcgagctatgcttttccctgcggtacgtgccaagctctgggcgattgaccgtggtcgtgctggaggctagagggctgcgccccgggctggccgagccttatgtgaaggtccagttgatgctcaaccagaggaaatggaaaaaaaggaagacagccaccaaaaaagggaccgccgctccctattttaatgaagcattcacctttctggttcctttctctcaggtacagaacgtggacctcgtgctcgctgtttgggatagaagtctcccacttaggaccgaaccggtgggcaaggttcatctaggggcccgagctagcggccagcctcttcagcattgggcagacatgctggcacacgctcggcggccaatcgcacaaagacaccctctgagacccgccagagaggttgatcggatgcttgcactgcagcctcggttaagactgaggctgcctctgccccattcatag

SEQ ID NO: 30716 - DNA, 477 bp, Artificial Sequence
  Description of Artificial Sequence: Synthetic coding sequence
atgggccatcccccagtgtctccgagtgccccagcgcccgccgggaccaccgcgatccctggcttgattccagacttagtcgctggcaccccttggccacggtgggcgctgatagccggcgctctggctgctggagtcttgttagtgagctgtttgctgtgcgctgcctgctgctgttgtaggcggcaccgaaagaaaccacgagataaagaatccgtgggcctcggcagcgcgcggggtacaacaacaactcatctcgtgcagcccgatgttgatggtctggaatcatcccctggcgatgcacaacagtggggatgtctgcagctttctctggagtttgacttcggcagccaagaagtcaagggccccgctgcccaggatcagaggttctgtgagtttcctgagcgggtcaccggagagggccagaccccttgcccaggatggtggggggcagacagggcgggcgcgctgggttag

SEQ ID NO: 30717 - DNA, 933 bp, Artificial Sequence
  Description of Artificial Sequence: Synthetic coding sequence
atgcccagttcaaagcctggatcaccagcgccacaggatccttccccctcctgccgtacttgcagcaaccaggtgcagcctggccatcttctgctgcccctcaccaaagcatctctgacaggcccatctccaccaccagctaagctcggccgcgcccagggcgccccaagtccaaagggcccgctggaaatcggctggtctcctgatgctcagcctcttcggctgggcgaaacatttcttcccaagggcgtggctcagttatctcgggcatcaagctctgggcacaaagtaggattcctgcaaccatggcctccgcaccctctgcttccacaagagagagtcccgaggcaccaaaggcagtgttgcccacgcgcaggtccagctttcggttgccttcgggggcggcctgggggatggcctgccaccgggtctggtggccgtcaacagggtcgaaagatgggacaccctccagtgtcacctagtgcccctgccccggcaggcacaacggccattcctggcttgatacccgatctggtagccggaacaccatggccccggtgggcactgatagcaggtgcactggccgccggggtgttgcttgttagctgcttgctgtgcgccgcctgctgttgctgccgtcgccatagaaagaaaccaagagacaaagagtctgtcggcctgggttcggcgcgcgggactaccacaacacaccttgtgcagccggacgtcgacgggctggaatcttccccaggggacgcacagcagtggggttgtcttcagttgtcactggaattcgatttcggatcccaggaagtgaaaggtcccgctgcacaagatcagcggttttgtgagttcccggagagagtgacaggcgaaggtcagactccttgcccaggatggtggggcgccgacagagccggggctctgggttag

SEQ ID NO: 30718 - DNA, 570 bp, Artificial Sequence
  Description of Artificial Sequence: Synthetic coding sequence
atgttagggtctcgggccgtcatgcttcttttgttgctcccctggacagctcaaggacgcgccgtgcccggcggttcttcccccgcctggacacagtgtcagcagctcagccagaagctgtgtacactagcctggtctgcacatcccctggtcggacatatggacttacgcgaggaaggtgatgaggaaactaccaacgacgtgccccatatccaatgcggggatggttgtgacccccagggcctgagagataattcccagttctgccttcagcgcatacatcaggggctgattttctacgagaaattgctgggatctgacatcttcactggcgagccaagcctgctcccagattcacccgttggccagctgcacgcctctttactgggcctgtctcaacttctgcagccggaaggccatcactgggagacccaacagattcctagcctttcaccatcccagccttggcaacgcctgcttctgaggttcaaaatcctgcgaagtctgcaggccttcgttgccgtggctgcacgggtcttcgcccatggggcggccacattgagtccttag

SEQ ID NO: 30719 - DNA, 1029 bp, Artificial Sequence
  Description of Artificial Sequence: Synthetic coding sequence
atgcaggtctctagcgtggatttcagcatggggacagagccagtgctacagcgtggtgagacaacaacgtctatcgggcgaatcaaacccgagttgtacaaacagaaatcagtcgactcagaaggaaaccagaacgaggacgtgaaaatatgcggcaaacttaatttcactctgcagtatgattacgagaatgaactgctggtggtcaaaattatcaaagcattagaccttcccgctaaggactttaccggaacatcagacccttatgtaaaaatgtacctgctgccagaccgcaaaaaaaaattccaaactcgtgtgcataggaagactcttaatcccctttttgatgagacgttccagtttccggttgcctatgaccaattgtctaaccggaaactgcatttctccgtctacgatttcgatcggttcagtcgccacgacatgattggtgaggttatcttagacaatctgttcgaagtcagcgatctctctcgcgaagctacagtctggaaggatattcattgtgccactacagagagcattgacctgggagaaatcatgttctcactgtgctatctcccaactgcaggcaggatgacgctgactgttattaaatgcagaaatctcaaggccatggacataaccggttcttccgacccttacgtcaaagtgagcttgatgtgcgaaggcaggcggctgaaaaaaaggaagaccaccacgaaaaagaacacccttaaccctgtgtacaacgaggcaatcatctttgatatcccacctgagaatgtggaccaggtgagcctgtcaatcgccgttatggactacgacagagtcggacacaatgaagtaatcggcgtgtgtcgcaccggcctggacgcagaggggctcggtagggaccactggaatgagatgctcgcgtaccatcggaagcctatcacacactggcatcctctactggaactacctgggagggcgacgagttttgatagccagggcagctgtcccagtcctaagccccctagtaccccatag

SEQ ID NO: 30720 - DNA, 1296 bp, Artificial Sequence
  Description of Artificial Sequence: Synthetic coding sequence
atggccgaaataactaatattcgaccatcctttgatgtcagtcctgtggtggctgggctgataggcgccagcgtgctcgtggtttgtgtatcagttacagtattcgtctggtcctgttgccatcagcaagccgagaagaaacagaagaatcccccttacaaattcatccatatgctcaaggggatttctatctatcctgagactctttcgaataagaaaaagataatcaaggtgcggagggataaagacggaccaggaagggaaggagggcgaaggaatctgttggtcgacgcagctgaggccgggctcttgagcagggacaaagatcccaggggtccctctagtggttcctgtatagaccagttgcctattaaaatggattatggagaagagctgcgtagtccaattacctctctgacccctggcgagagtaaaacaacatctccctcgagcccggaagaagatgtgatgctaggatcactcaccttctctgtggactacaatttccctaagaaagctctcgtagtcaccatccaggaggctcacggactgcctgtcatggacgaccagacccagggcagtgacccgtatattaagatgacgattttaccagacaagcgacatagagtcaagacgagagttctgaggaaaactctcgatcctgtatttgacgagacctttacgttttacgggatcccctacagtcagctgcaggatctggtactgcacttccttgttttatcgttcgacaggttctctcgcgacgacgtcattggagaggtgatggtgcctctggctggggtggacccctctaccggaaaggtgcagttgacaagggatattattaagcgcaatatacagaaatgcattagtcggggggagctgcaggtctctctgtcctatcagccggtagcccaaaggatgaccgtcgtggttcttaaggcccggcacctccccaaaatggacatcacgggcttgagtgggaatccctacgtcaaagtgaatgtatactacgggagaaagcgcatcgccaagaaaaaaactcatgtaaagaagtgcacactgaatccaatatttaacgaaagttttatctatgatatccccaccgaccttctccctgacattagcatcgagtttcttgtgatcgatttcgataggaccactaaaaacgaggtcgttggtcggctgatcctgggggcacactcggttacagcttcaggagccgaacactggcgggaggtctgcgagagcccccgaaagcccgtggcaaaatggcatagcttatcagagtactag

SEQ ID NO: 30721 - DNA, 375 bp, Artificial Sequence
  Description of Artificial Sequence: Synthetic coding sequence
atgaccgtagtcgtgttaaaggccagacacttacccaagatggacatcactggactgtccggtaacccatacgtcaaggtcaacgtgtattacggacgcaaacgaatagctaagaaaaagacccacgtgaaaaagtgcacgctgaaccccattttcaatgagtctttcatttacgacattcccacagacttgttgccagacatttcaattgaattcctggttattgacttcgaccgaaccaccaaaaacgaggtcgttggtcgactcatcttaggagctcattccgttaccgcctcaggggcagagcactggagagaggtgtgtgagagtccccggaagcccgtggcaaagtggcattcccttagcgaatactag

SEQ ID NO: 30722 - DNA, 1425 bp, Artificial Sequence
  Description of Artificial Sequence: Synthetic coding sequence
atggcttacattcagctagaacccctcaatgagggcttcttgagtcggattagcggtcttctcctgtgtcggtggacttgcaggcactgctgccaaaagtgctacgagtctagttgctgccagtccagcgaagatgaagtcgaaattttggggcccttccctgcccaaacccctccctggttaatggccagcaggtcctccgacaaggatggggactcagtgcacacagcttccgaagtgcctctaacaccacgaactaattcgccagacggacgccgctccagttcagataccagtaaatctacctattcgctaacgaggcggattagttccttggaatcccgcaggccctcctcaccactgatcgatatcaaacccatcgaattcggcgtcctgagcgccaagaaggaacctattcaacccagcgtgctgagaaggacctacaacccagatgattatttccggaagtttgaaccacacctgtattcactcgactccaactcagacgatgtggatagcctgacagacgaagaaatcctttccaagtatcagctgggtatgctccatttctcaacccaatacgacctgctgcacaatcatttaactgtgagagtgatcgaagccagagacctgcctccacctatttcgcacgatggatcgcggcaggatatggcgcacagcaatccctacgtgaagatctgcctgctgccagaccagaaaaacagtaagcagaccggagttaagaggaagacacaaaaaccagtatttgaagagcggtatacattcgagattccatttctggaagctcaacgcaggaccttactgctaacggttgtcgactttgataaattctcgaggcactgcgtaatcggcaaggtttccgtgccactgtgtgaggtcgatctggtgaaagggggccattggtggaaggctctcatcccttccagccaaaacgaggtggagttgggggaactgttattaagcctgaactacctgccttctgcaggccgactgaacgtggacgttatccgggccaaacagttgctccagacagacgtctcacagggcagcgatccatttgtgaagatacagctcgtacacgggttgaaactggtgaagactaaaaagacaagtttcttgcggggaacaatcgacccattctacaacgaaagtttttcatttaaagtcccccaggaagagctggagaacgcctctttggtgttcaccgtttttggacacaacatgaaaagttccaacgacttcattggccgcattgtgatcggccagtactcctctggcccatctgaaacaaaccactggcgacgcatgctcaatacacacaggacagcggtggaacagtggcactctttgcgctctcgtgccgaatgtgaccgcgtctctcccgcctctcttgaagtgacctag

SEQ ID NO: 30723 - DNA, 1431 bp, Artificial Sequence
  Description of Artificial Sequence: Synthetic coding sequence
atggcctcgcctgaacctcgccgcgggggcgacggggcggctcaagctgccaggaaaacccgggtggaggcaaacagccccctcccaaaaaattctggcagcctgaatgaggcggaagctctgaaccctgaggtaaccttgagcagtgaaggtagccttaacctagaggatatactctatcttgaggacacaggggacctcgacgagaccctgtacgtgcaggaaaccgaaaaggctgaggaagcattatatatcgaggaggcaatgcagccagatgaagccctgcatgtggaggaacccgggaatccagaggaaacagtctgcgtcgaagaaactacagagccggataggatacagtttgtggagggccccgtggagccaggtaagccaacgtctcccgagcacgtggtgtacgagggggagacggttacacgggcagaaaagagtaaccccgaggagagcctccgagccgagcagtcacccagtatggaggaaaacctctccatcgaagatctagaactgctcgaaggtcgttttcagcagtgcgtacaggcagtggcgcagctcgaggaagaacgggatcaattgattcacgagctggtactgctgagagaacccgccttgcaggaagttcagcaggtccaccaggacatattggccgcttataaactccacgctcaggcggaactggagcgagacggactaagggaggagattcggctggtgaagcagaagctgtttaaagtgaccaaggaatgtgttgcctaccagtaccagctggagtgtaggcagcaggatgtggcccagtttgcagacttccgggaagtcctgaccacccgggccacccagctgtccgaggaactagcacagttaagggatgcctatcagaaacaaaaggaacaattgcgtcagcaactggaagcacccccctcccagcgggacgggcactttctgcaggaaagtcggagactgagcgcccagtttgaaaacctgatggccgaaagtaggcaagacctcgaggaggagtatgagcctcaatttctgagactattggaaaggaaagaggccgggacaaaagccctgcagcgcacgcaggcagagatccaggagatgaaggaagctctgcggccgctccaagcagaagcccgccagctgagactgcaaaacaggaatctggaggatcagattgcacttgttcggcaaaagcgggatgaggaggttcagcagtaccgagagcagctggaagagatggaagaaagacagcgccagctccgcaatggggttcagttacagcagcaaaagaacaaggaaatggaacagctgaggctcagcttggcagaagaactgtctacatacaagggttgcctggagatttacggtcaaatctgtaatcctgaaacggcaaaaaactttctggcaaaggaccactag

SEQ ID NO: 30724 - DNA, 1449 bp, Artificial Sequence
  Description of Artificial Sequence: Synthetic coding sequence
atggcatctcctgagccccggcgcggaggcgacggcgcagcccaggcagcacggaaaactcgcgtggaggccaactctcccttacctaaaaactccggttctctcaacgaggcggaggctctgaacccagaggtcaccctgtcatcagagggcagcttgaatctggaagatattctctacctcgaggatacaggtgacttggatgaaacactgtacgtgcaggagaccgagaaggctgaggaggccctttacatagaagaggcaatgcagcctgacgaggccctgcacgtggaggagcccggcaaccctgaggaaaccgtctgtgtggaggagaccaccgaacctgaccggatacagttcgttgaaggaccagttgagccaggtaagccaacttcccctgaacacgtagtgtacgagggggagacggtgactcgggcagaaaaatcaaacccggaagaatccctacgggctgagcagagccccagcatggaagagaatctgtccatcgaggacctggaactcctagaggggcgatttcagcagtgtgtgcaggctgtggcacagttggaagaagaacgcgatcagctgattcacgaattggtgcttctgcgggaacccgccctgcaggaagtgcagcaggtgcaccaggatatcttggccgcctataaactccacgcacaggccgagctggagagagatggactaagagaagagatcaggctagtgaaacagaagctgtttaaagttaccaaagagtgtgtcgcttatcagtaccagttggaatgtcgccagcaggacgtagcacagtttgccgacttcagggaagtgctcacaacccgcgctacacagctctctgaagaacttgctcaattgcgcgatgcctatcaaaaacagaaagagcaactccggcagcagttggaagccccgccatctcaacgagatgggcacttcctccaggaatctcggaggctgagcgcacaattcgagaacctaatggccgaatctaggcaagacttggaggaggagtacgagccacagttcctgaggctgctcgagagaaaggaggccggtaccaaggctttacaacgtacacaggcagaaattcaggaaatgaaagaggctcttcgacccctccaagcagaagcaaggcagcttcgattgcagaaccgtaacctggaggatcagatcgcccttgtcaggcagaagagagatgaggaagtacagcagtacagagagcagctggaggagatggaggagcgacagcggcagttaagaaacggtgtgcagttgcagcaacagaagaataaggaaatggagcagcttcgtctgtcactcgctgaggaacttagtacctataaggctatgttactgccaaaatccctagaacaagctgacgcacctacttcccaggcaggaggcatggaaacacaaagccagggagctgtgtag

SEQ ID NO: 30725 - DNA, 273 bp, Artificial Sequence
  Description of Artificial Sequence: Synthetic coding sequence
atgcaaccggacgaagctctccacgtcgaagagcccggtaaccctgaggaaactgtctgcgtcgaggagacgactgaaccagatcgtattcagttcgttgaaggccccgtggagccggggaaacccacaagccccgagcacgttgtgtacgagggagaaacagtaactcgtgcagagaaatccaacccagaggaatccctccgagcagaacagtcaccgagcatggaggagaaccttagtatcgaggatctcgagctactcgagggtcgctag

SEQ ID NO: 30726 - DNA, 213 bp, Artificial Sequence
  Description of Artificial Sequence: Synthetic coding sequence
atgcagcctgacgaggcacttcacgtggaagaacctggaaatcccgaggagacagtttgcgtcgaagaaaccaccgagccagaccggatccaatttgtggagggacccgtggaaccaggtaaaccaacttctccggaacatgtggtctatgaaggagaaacggtaacccgcgcggaaaaatctaaccctgaggagtctttgagagctgagtag

SEQ ID NO: 30727 - DNA, 405 bp, Artificial Sequence
  Description of Artificial Sequence: Synthetic coding sequence
atgtcgccccttcgtcctttgttgctcgccttagccctggcaagcgtgccatgcgcccaaggggcctgtccagcttcagccgatctgaaacacagcgacggaacccggacttgcgccaagttgtatgataagtcagacccgtactatgagaactgttgcggcggtgctgaactgtcactggagtccggagccgacctcccgtacctgcccagcaactgggccaacactgctagcagcctggttgtggccccacggtgtgagttaacagtttggagcagacaagggaaggctgggaagactcacaaattttccgctggcacctaccctcgtcttgaggagtatagaagagggatcctgggagattggtcgaatgctatctcagcactgtattgtcgatgctcatag

SEQ ID NO: 30728 - DNA, 897 bp, Artificial Sequence
  Description of Artificial Sequence: Synthetic coding sequence
atgtccctctacccgtccttagaggatctaaaagtcgacaaagttatccaggcccaaactgcgttcagtgcaaatcctgccaacccggctattctgagtgaggcttccgcgccaatccctcatgatgggaacttgtatccccggctatacccagaactatctcagtacatgggcctatcgttaaacgaggaagagatcagagccaacgttgccgtggtcagcggtgcacccctgcagggtcagcttgtcgctaggccttcttccatcaactacatggtcgcaccagtgacaggtaatgatgtaggcatccgccgcgccgaaatcaaacagggcatcagggaggtgatattatgcaaagatcaggacggcaaaatcgggctgaggttgaagtccatagataacggtatttttgtgcagctggtgcaggctaacagtcccgctagtctagtgggccttcggtttggcgaccaggtgctccaaatcaacggggagaactgtgccggctggtctagcgataaagcacataaagtattaaagcaggctttcggggagaagataacaatgacaatcagagatcgccctttcgagagaacaataacgatgcacaaggacagcacgggacatgtgggctttatctttaaaaatggtaaaataacgtccattgtgaaggacagctccgccgctcggaacggcctactgactgaacacaatatctgcgagataaatggccaaaatgtaataggtttaaaggactctcagatcgccgatatcttgtccacctcaggaaccgtggtaactataactatcatgcccgccttcatctttgaacacatcattaaacgtatggcacccagcatcatgaagtcgctcatggaccacaccatcccagaagtgtag

SEQ ID NO: 30729 - DNA, 897 bp, Artificial Sequence
  Description of Artificial Sequence: Synthetic coding sequence
atgagcctgtacccttcgttagaggacctgaaggttgacaaagtgatccaggcgcaaacagccttctccgccaatcccgcaaatcctgctatcttatcagaagccagcgcgccaattcctcatgatgggaatctttaccccaggctgtacccagaactttctcagtacatgggcctgagtttgaatgaggaggagattagggcaaacgttgctgtagtgtctggggcccctcttcagggccagcttgtggcacgaccttcttcaattaattatatggtggcccccgtaactggcaatgacgtgggaatccggcgagctgagatcaaacaggggattcgagaggtgatcctgtgcaaggaccaggatgggaagatcggtctgcgtctgaaaagcatcgacaacggcatctttgtgcagctcgtgcaggcaaatagcccggcttctctggtcggtctccggttcggcgaccaggtgctccaaatcaatggggagaactgcgctgggtggtcaagtgacaaagctcacaaagtactcaaacaagcattcggggaaaagattaccatgacaattcgggatcggccattcgaacgcacaataactatgcacaaggactcaacaggacacgtggggttcatctttaagaatggtaagattactagcatcgtgaaagactcaagtgccgccaggaatggtctgctgactgaacataacatttgtgaaattaacggccagaacgtgataggtctcaaggattcgcagatagcagacatcctcagcacttcgggaacagtcgtgaccatcacgattatgcctgcattcatcttcgagcatataataaagcgtatggccccttctattatgaagagcttaatggatcacacgatacccgaggtgtag

SEQ ID NO: 30730 - DNA, 894 bp, Artificial Sequence
  Description of Artificial Sequence: Synthetic coding sequence
atgtcattgtatccttcgttagaggatctgaaggtggacaaggtgatccaggcccagaccgcgttctccgccaaccccgcaaacccggcgattctgagcgaggcctccgcgcccattccacatgacggcaatctgtacccccgactctatcctgagctctcgcagtacatggggctctcccttaatgaggaggagattcgcgcaaacgtggccgtggtttctggcgcacccctgcaaggactggtggctcgacctagctccattaattacatggtcgcccccgtaactggcaatgacgttggcataagaagggccgaaatcaaacaaggaatccgagaggtgattctttgcaaggaccaggacgggaaaattgggctcagacttaagtccattgataacggcattttcgttcagctggtgcaggcaaactcccccgcatcactcgtcggactgcgttttggcgaccaggtgttgcagatcaatggagagaattgtgcaggctggtctagtgacaaagcccataaagtcctcaaacaggcctttggagaaaagatcaccatgacaataagggacagaccttttgaacggactatcactatgcacaaagatagtacaggccacgtcggttttatctttaagaatgggaaaattacctctatcgtgaaggatagtagcgctgctagaaacggcttgctgaccgagcataatatatgcgaaattaatggccagaacgtgattggtttgaaggatagccaaatcgctgacatattaagtacatccggcactgtggtaacaattaccatcatgcccgcgtttatttttgagcacattattaagcggatggccccatccatcatgaagtccctaatggatcataccattcccgaagtgtag

SEQ ID NO: 30731 - DNA, 879 bp, Artificial Sequence
  Description of Artificial Sequence: Synthetic coding sequence
atgtctctatatccgagcttagaagacctgaaggcacagacggctttctcagcaaaccctgccaaccctgccatcttgtccgaggcgtcagcacccatccctcacgacggaaacctctatcctagactttaccccgaactaagtcagtacatgggcctgtctcttaacgaggaggagatccgtgcgaacgtcgctgtggtaagtggagcccctttgcaaggtcaactcgtggctagaccttcaagcatcaactacatggttgcacctgtgactggcaatgacgttgggatcagaagagcagagatcaagcagggtattagagaagtgatcctgtgcaaagaccaggacggcaaaatcggactccgacttaagtctatagacaatggcatcttcgtacagctggtccaagcaaacagccctgcctctcttgttggcttaaggtttggcgatcaggtgttacagatcaacggggagaattgtgcaggttggagcagcgataaagcacacaaggttttgaagcaggccttcggggaaaaaatcaccatgacgatcagggatcgacctttcgaaagaaccatcacgatgcataaggattctaccggccacgtgggcttcatcttcaaaaatggcaaaattacatccatcgtgaaggattcctcggctgcaagaaatggtctcttgactgaacacaacatttgcgagatcaacggacaaaacgtcattggtctcaaggacagccagatcgctgatatcctgagtacttcgggaacagttgtgacaatcaccataatgcccgccttcatttttgagcacattatcaaacgtatggctccatccatcatgaagtccctgatggatcataccatcccagaagtatag

SEQ ID NO: 30732 - DNA, 894 bp, Artificial Sequence
  Description of Artificial Sequence: Synthetic coding sequence
atgagcctttatcccagccttgaagacctgaaggttgacaaagtaatccaggcgcagactgccttctccgctaacccagctaaccccgccattctctccgaagcgagcgctcccataccccacgacgggaacctctatccgcgcctgtatccggaactgtctcagtatatgggtctctcccttaatgaggaagagatccgggctaacgtggcggtggtatctggggcacctcttcagggcttggtggctcgaccatcgagcatcaactacatggtagctcctgtgactggcaatgatgttggcatccggagagcagagatcaagcaaggaatcagggaggtcattctttgcaaggaccaggacggtaagatcggactgcgcctgaagtcaatcgataatggcattttcgttcaactggttcaggccaacagccctgccagcctagtcgggttgcggtttggtgaccaggtgttgcagattaacggagagaactgcgcgggctggtcatctgataaagcacataaagtcctaaaacaggcattcggcgagaaaattactatgactattcgtgataggcctttcgagcgcacgatcacaatgcacaaggactcaacgggtcacgtgggcttcatctttaagaatggaaagattacctccatagttaaggactcaagcgcagccagaaatggtcttctgactgaacacaacatttgcgagatcaacggccagaacgtgattgggctgaaagattctcagatcgctgacatactaagcactagtgggacggtggtgacaattaccataatgcctgcattcatatttgagcacattatcaaaagaatggcccccagtatcatgaagagcctgatggaccataccatccccgaagtctag

SEQ ID NO: 30733 - DNA, 879 bp, Artificial Sequence
  Description of Artificial Sequence: Synthetic coding sequence
atgtcatcattgtatcccagtttggaagatctgaaggtcgaccaggccatccaagcacaggtgcgagcctctccaaaaatgcctgcactccctgtgcaggcaaccgcaatctctcccccacccgtgctgtatcctaacctcgccgagctggagaactatatgggactctcactctctagtcaggaggtacaggaatctcttctgcagattccagagggagatagcaccgccgttagcggcccagggcctggccagatggtggcaccagttactggttactctctgggagttaggcgggctgaaatcaaaccaggcgttcgcgagattcatctctgcaaagacgagcggggcaaaactggccttcggctacgtaaggtagatcagggcctgttcgtgcaactggtccaagctaatacccccgcttcactcgttgggctgagatttggcgatcaattgttgcagatcgatgggagggattgcgccgggtggtctagccacaaggctcaccaggtggtcaaaaaggcatccggggacaagatagtggtggtcgttcgcgatcgtccttttcagaggaccgtgaccatgcacaaggactcaatgggacacgtgggcttcgtgattaaaaagggaaaaatcgtgtctctggtgaaaggatcttctgccgccagaaatggtctactgactaaccactatgtgtgcgaagtggatgggcagaatgtcataggcctcaaggacaagaagataatggaaattttggcgacagctggcaatgtggtcactcttacgataatcccttcggttatatacgagcacatggtgaagaagttgccgcctgttctgctccatcatacaatggatcactccattcccgacgcttag

SEQ ID NO: 30734 - DNA, 879 bp, Artificial Sequence
  Description of Artificial Sequence: Synthetic coding sequence
atgtcgagcctttatccgtccctcgaagatctgaaagtcgatcaggccattcaagcgcaagtaagggcatcgcccaaaatgcccgcgcttcccgtccaggctaccgccattagccctcctcccgtcctttatccaaatctggcagagctggagaattacatgggtctgagtttaagcagtcaagaggtccaggagtccctcctccagatccccgaaggggacagcacagctgtgtcaggccctggcccggggcagatggtcgcccccgtgacgggctacagccttggcgtgcgcagagccgaaattaaaccaggggtgcgcgagattcacctgtgcaaagacgagcggggcaagactggtctgcgtctccggaaagttgatcagggcctgttcgtacagctcgtccaggcaaacactccggcatccttggtggggttacgctttggagatcaacttttgcagattgatggaagggattgtgccggttggtcgagccataaagctcaccaggtcgtgaaaaaggcatcgggagataagatagtcgtggtggtaagagaccggccctttcagagaaccgtgactatgcacaaggacagcatgggccatgtcggcttcgtcattaaaaaggggaaaatagtgtccctggtgaaagggagcagcgccgccagaaatggactgctgaccaaccactacgtatgcgaggtagatggtcagaatgtgattggccttaaggataagaagatcatggagatactggcgaccgccggcaatgtggtgaccctcacgatcatcccctcggtaatatatgaacacatggtgaaaaagcttcctcctgtgttactgcaccacactatggatcattctatccctgatgcatag

SEQ ID NO: 30735 - DNA, 624 bp, Artificial Sequence
  Description of Artificial Sequence: Synthetic coding sequence
atggtggctcctgtgactggctatagccttggcgttcggagagctgaaataaagcctggcgtccgcgaaatccatctgtgtaaggacgagcggggcaagactggcttgaggctgagaaaagtggaccaaggtcttttcgtgcagctggtccaggccaacacaccagcatcactcgtcggactccgtttcggcgaccagttgcttcaaatagatggccgcgactgcgccggatggtcatctcacaaagcacaccaggtggtcaagaaggcctccggagacaagattgtcgtagtagtgcgggataggcctttccaacggaccgtaactatgcacaaggactcaatggggcacgtcgggttcgtcatcaaaaagggcaagatcgtatcactcgtgaagggatccagtgcggctcgcaacggactgctcaccaatcattatgtgtgcgaggtagatgggcagaatgtgatcggcctgaaagataagaaaattatggagatcctggctactgccggcaatgtggtgacactaacgatcattccttccgtgatttatgagcacatggtcaaaaagcttccaccggtccttttgcaccatacaatggatcactcgatacctgacgcttag

SEQ ID NO: 30736 - DNA, 879 bp, Artificial Sequence
  Description of Artificial Sequence: Synthetic coding sequence
atgtcatcactgtaccctagcctggaggatttaaaggtggaccaggccatacaggcgcaggtgagggcctccccaaagatgcccgcgttacccgtgcaagcgacagctataagtccaccccccgtgctgtaccccaacctcgcagaactcgagaactacatgggactgagtttgtctagccaggaggttcaagaatcactcttgcaaatccctgagggggacagcacagctgtgtccggcccagggccaggacagatggttgcccccgtcacaggctatagtctgggcgtgagaagagctgagatcaaacccggggtcagggagatccacctgtgtaaggatgagcgaggcaagacggggctgcgactgaggaaggttgatcagggtctattcgtccagttggtacaggctaacacccctgcatctctggtgggactgaggtttggcgaccagcttttacagattgatggacgagattgtgccgggtggagttctcacaaagcacaccaagtcgttaagaaggctagtggcgacaagattgtggtggttgtgcgggaccgcccatttcaacgaaccgttacaatgcataaggacagtatgggacatgtaggtttcgtgatcaagaagggcaaaattgtatctttggtgaaaggctcctccgccgccagaaatggactcttaacaaaccactacgtgtgcgaagtggatggccaaaacgtgatcggattgaaagataagaagattatggagatactggcaaccgcaggtaacgtggtcacgctgacaatcattccttccgtgatctatgaacacatggttaagaaattacccccggtgctcctgcaccataccatggatcattcaatcccagacgcctag

SEQ ID NO: 30737 - DNA, 750 bp, Artificial Sequence
  Description of Artificial Sequence: Synthetic coding sequence
atgtcactagaggacccctttttcgtggttcgaggagaggtgcagaaggccgtgaatacggcacgcggcctctaccaacgatggtgcgaactgcttcaggagagtgccgcggtgggacgtgaggaactagactggaccactaatgagctgcgtaacggactcaggagcattgagtgggatctggaagacctcgaagagaccattggtatagtggaagcaaaccctgggaaattcaagctgcctgctggcgacctgcaggaacggaaggtctttgtagagcgcatgagagaggccgtgcaagaaatgaaggaccatatggtcagccccaccgccgtagccttcttggagcgcaataacagagagatcctggccggcaagccagccgctcaaaagtcccctagcgatctcctcgacgcaagcgccgtgtccgccactagccgatacatcgaagaacaacaggccacccaacagttgataatggatgagcaggaccagcagctggaaatggtgtcaggaagcattcaagtcctgaagcatatgtccggaagggtcggtgaggagttagacgagcagggtattatgctggacgcatttgcccaggaaatggatcacactcagagtcgcatggatggcgttctccggaagctcgccaaagtgtctcacatgacatctgataggcggcagtggtgtgcaatagccgttctggtgggtgtgttgctcctcgtgctcatcttgttattcagtctgtag

SEQ ID NO: 30738 - DNA, 603 bp, Artificial Sequence
  Description of Artificial Sequence: Synthetic coding sequence
atgtccttggaagatcccttcttcgtggtgcggggcgaggtgcaaaaagctgtcaatactgccaggggactataccagcgttggtgtgagctgctgcaggagtccgccgcagtcggaagggaggaactcgattggaccactaacgagctgagaaacggtctgcgtagcattgagtgggacctggaagatctggaagaaacgatcgggatcgtagaagccaaccccggcaagccagcagcacaaaagagcccttcagatcttctggacgcctccgctgtgtccgctacctctagatacatcgaggaacagcaggccacgcaacaactgattatggatgaacaggaccagcagttagagatggtgagcggatccatccaggttctgaagcacatgagcggcagggtgggagaggaactggacgagcagggtataatgctagacgcattcgctcaggagatggatcacacacagagccgaatggacggagtgcttcgcaaactggccaaggtgtcccacatgaccagcgaccggcgccagtggtgtgccattgccgtgttggtcggtgtactgttgctcgttctcatcctgctgttcagcctgtag

SEQ ID NO: 30739 - DNA, 741 bp, Artificial Sequence
  Description of Artificial Sequence: Synthetic coding sequence
atgagcctggaggacccattcttcgtggtcagaggcgaggttcagaaggccgtcaacaccgccagaggtctgtaccagcgctggtgtgaactgcttcaggaaagcgcagctgtgggacgggaggagctggactggactacaaatgagcttcgtaacggactcaggtctatcgagtgggatctggaggatctggaagagaccattgggatagtggaggcgaaccccgggaaattcaagctgcctgccggcgacctccaagaacgcaaggtctttgtggaaagaatgagggaggctgtgcaggagatgaaggatcatatggtgtcacccacagctgtcgccttcttggaacggaataatcgcgagattctagctggtaagcccgccgctcagaagtctcccagcgacctgctggatgcatcagctgtgtcagcgacaagtagatacattgaagagcagcaggccacccagcagctgataatggacgagcaggatcaacagctggagatggtgtccggcagcatacaggtgttaaagcacatgtccggtagagtcggagaggaactggatgagcagggcatcatgctggacgcttttgctcaggaaatggaccacacacagagccggatggatggcgtgctccgcaaactggctaaagtctcacacatgacctccggcgaatcaccgcaggggcgagggcaatcgtggtggggccaagttgtcggcggtaccctcagcccctag

SEQ ID NO: 30740 - DNA, 750 bp, Artificial Sequence
  Description of Artificial Sequence: Synthetic coding sequence
atgtccctggaagatccctttttcgtggtcagaggcgaggtgcagaaggccgttaacaccgctcgcggtctgtaccagcgctggtgcgaactgctgcaagaatcagcagctgtgggcagggaggagttggattggaccactaacgagcttaggaacggccttaggtccattgagtgggatctggaggacctagaagaaacgatcggcatcgtggaagccaaccctggaaagtttaaacttccagcgggcgatctgcaggaaaggaaagttttcgtagagcggatgcgcgaggctgttcaagagatgaaggatcatatggtgagccccacagccgtggcctttttggaacggaataacagagaaatcctagctggaaagcccgctgcccagaaatccccttcagacttgttggacgcttccgcggtttccgctacatcgagatatatcgaggagcagcaggctacccagcaactgataatggatgaacaagaccagcagctggagatggtgtcggggagtatccaggtattgaagcacatgtccggcagggtgggcgaggaattggacgagcagggtatcatgctcgacgcattcgctcaggaaatggaccatacacagtctagaatggatggggtgcttcgcaagcttgcgaaagtcagccacatgacaagcgatcgccgacagtggtgcgctatcgctgtcctggtcggcgtgctattacttgtccttatccttctcttttctctttag

SEQ ID NO: 30741 - DNA, 741 bp, Artificial Sequence
  Description of Artificial Sequence: Synthetic coding sequence
atgtcattggaagatccctttttcgttgtgaggggcgaggtgcagaaggcagtgaatacggctagaggcctttaccagaggtggtgtgaactgcttcaggagtccgcggccgtgggccgtgaagagctcgattggactacaaatgagctgcgtaatggtctacgttctatagagtgggatcttgaggacttggaagagacaatcggcattgtcgaagccaacccagggaaattcaagctgccagcaggcgacctacaggagcgcaaggtatttgttgaacggatgagggaagctgtccaagagatgaaagatcacatggtaagtcccactgcagtagcgttcttagagaggaataatagggaaatcctcgccggaaagccagctgcacaaaagagccctagcgatctgctcgacgctagtgctgttagcgctacctctaggtacatcgaagaacagcaagccacccagcaactaatcatggatgagcaggaccaacagctcgagatggtgtcaggttcaatccaggtgctgaagcacatgagcggacgggtaggcgaagaacttgacgaacaaggtatcatgttagatgcttttgcccaggagatggatcatacacagagtaggatggatggggtcctgcgcaagttggcgaaggtctcccacatgacctccggcgagtcacctcaggggaggggtcagagctggtggggccaggtggtaggtggcaccctcagcccctag

SEQ ID NO: 30742 - DNA, 831 bp, Artificial Sequence
  Description of Artificial Sequence: Synthetic coding sequence
atgtcatatggccccctagacatgtaccggaatccgggcccctccggcccacaacttagggactttagctctattattcagacgtgttcggggaacatccagcgtatctcccaagcaaccgctcagattaaaaatctgatgtcacagctgggaacaaaacaggactcctcaaagctgcaggagaatctccagcagctgcagcacagcaccaatcaactggctaaagagactaatgaactcctgaaagaacttgggtcccttcctttgccactgagcacttccgaacagagacagcaacggctacagaaggagagacttatgaatgacttttcagcagccctaaacaacttccaagctgtgcagagacgcgtcagcgagaaggagaaagaaagtattgcgcgtgcaagggcagggtccaggctgtctgcagaggaacggcagcgggaagagcagctggtctctttcgactctcatgaggaatggaatcaaatgcagtcgcaagaagacgaggtggctatcaccgaacaggacttggaactgattaaggaacgagaaacggcaatccgtcagctggaggctgatatcctcgacgtgaatcagattttcaaggatctagctatgatgatccacgaccagggcgacctgatcgactcaatcgaggcaaacgtggagagctcagaggtgcatgtcgagagagcaacggagcagctgcagagggctgcttattaccagaagaagagtcgcaaaaaaatgtgtatcctcgttcttgtcctctccgtaatcatcttgatcctgggcctgatcatatggctcgtttataagaccaagtag

SEQ ID NO: 30743 - DNA, 705 bp, Artificial Sequence
  Description of Artificial Sequence: Synthetic coding sequence
atgtcttacggtccgctggacatgtaccgtaatccgggaccgagcggccctcagctcagggatttctcatctattatacaaacttgttctggaaacatccagagaattagccaggcaaccgcacagattaaaaacctgatgtctcagctcggcacgaagcaagatagctcaaagttgcaagaaaatctgcaacaattgcaacacagcaccaaccagctggccaaagagaccaatgagttactcaaagagttaggaagcttgcccctgcctctgagtactagtgagcaaagacagcagcgcttgcagaaagaaagattgatgaacgattttagcgccgccctcaacaactttcaagctgtacagagacgggtctccgagaaggagaaggagtccatcgctcgcgctcgagcaggctctaggctttctgctgaggaaagacagcgagaggagcagctggtcagcttcgattcctcgttgctactcgatatgaagaatgtcgctttacaggacttcatcgacagcaggggccttgaaccttgccatgaggaatggaatcaaatgcagtcccaggaggacgaagtggccattacagaacaggacttggaactgattaaagagcgagaaactgcaatacggcagttggaggcagatatcctcgacgtcaatcagatttttaaggatttagccatgatgattcacgactag

SEQ ID NO: 30744 - DNA, 1008 bp, Artificial Sequence
  Description of Artificial Sequence: Synthetic coding sequence
atggcggtggatattaccttattattccgagcatctgtgaagacagtgaaaacgcgcaataaggcactaggcgtcgctgtcggtggcggcgtcgacggaagtcgagatgaactgtttaggcggtccccgaggccgaaaggagatttcagttcccgggcccgggaagtgatttcccacattggtaaactgcgggattttttgctcgagcaccgcaaagactatatcaacgcttactcgcacacgatgagcgaatatgggcggatgaccgacaccgagcgagatcagatcgatcaagacgcccaaatctttatgcgaacctgctcagaggctattcagcagctccggactgaggctcacaaggagattcactcgcagcaagtgaaggaacatcggaccgccgtgctggacttcatcgaggattatctaaagcgagtgtgtaaactgtatagtgagcaacgggccatcagggtgaaacgagtggtagacaaaaagaggctctccaaactggagccggaaccgaacactaagacacgggaaagtaccagtagtgagaaagtcagccagagcccttccaaagattctgaagagaacccggcgacagaagagcgccctgagaaaatcctcgcagagactcagcccgagctgggcacctggggcgatggcaaaggagaagatgaattgagtccagaagaaattcagatgtttgagcaggagaaccagaggctcataggcgaaatgaactctctgtttgatgaagtgaggcagattgaggggcgcgtggttgagatcagcaggctccaggagatctttaccgaaaaagttctgcagcaggaagctgagatcgatagtatccaccagctcgttgttggggccaccgagaatattaaggaggggaacgaagatatccgcgaggctatcaagaataatgccggcttcagagtgtggatcctgttttttctggttatgtgcagcttcagcctgctttttctggattggtacgactcctag

SEQ ID NO: 30745 - DNA, 768 bp, Artificial Sequence
  Description of Artificial Sequence: Synthetic coding sequence
atgtccatggaagatccgttcttcgtcgtgaagggcgaagtacaaaaagccgttaataccgctcagggtctctttcagcgctggactgagctccttcaggacccttcaaccgccacccgggaagaaattgattggaccacaaatgagctgaggaataacctccggagtatagagtgggatctggaggatctggacgagacgatatctattgtcgaagctaaccccagaaagtttaacctagacgccacagagctgagcatcagaaaggccttcatcacttctacccgccaggtggtgagggatatgaaggaccaaatgtctacgagtagtgtacaggctctcgcagaaagaaagaacaggcaggccctgttgggggactctggttcacagaattggagtactggcactacagataagtacggtaggttggaccgagaacttcaacgggcaaattcccacttcatcgaggaacaacaggcccagcagcagttgatcgtggagcagcaggacgagcagctggaactcgtttcaggctctattggagtactgaagaatatgtcacagcggatagggggcgagctggaggagcaggcagtgatgctggaagacttctctcatgaactggaaagtacgcaaagtaggctcgataacgtgatgaagaaattagccaaagtctcacatatgaccagcgacagacgccagtggtgtgcgatcgccatactgtttgccgtgttactagtggttctaatccttttcctggtgctgtag

SEQ ID NO: 30746 - DNA, 465 bp, Artificial Sequence
  Description of Artificial Sequence: Synthetic coding sequence
atgaaggatcagatgtctacaagctcagtgcaagcactcgccgaacggaagaaccgacaagcactgctgggagactctggcagccaaaattggagcaccgggacaaccgataagtacgggagacttgaccgcgagttgcagcgcgctaactctcacttcatcgaggaacagcaggcgcagcagcaattgattgtcgaacagcaggacgagcaactcgagcttgtgtctggcagcatcggggtgctaaaaaatatgtctcaacgcatcggcggggaactggaagagcaggctgtcatgcttgaagactttagtcacgaactggaaagtactcaaagtaggctcgacaacgtgatgaagaaattagcaaaggtgtcacatatgacatctgatcgccggcagtggtgcgctatcgccatactcttcgccgtgttgctggtggtcctgattctgtttctcgtattgtag

SEQ ID NO: 30747 - DNA, 1779 bp, Artificial Sequence
  Description of Artificial Sequence: Synthetic coding sequence
atggcaccccccgtggccgagcgggggctgaagagtgtggtctggcaaaaaattaaagccacagtcttcgatgattgcaagaaagagggagaatggaagataatgttgctagatgagttcacgacaaagctcctggcatcatgttgcaaaatgacagatcttttggaagagggaattactgtggtcgagaacatatacaagaatagggaacctgtgcgacaaatgaaagccttgtattttatcacaccaactagcaagtcagtcgactgttttctgcacgattttgcatcaaaaagcgagaataagtataaagctgcttacatttatttcacagatttttgtccggataacctattcaataaaatcaaggctagttgcagtaaaagtattcgaaggtgtaaagagattaatatatcttttattcctcacgaatctcaggtgtacaccctcgatgtgcctgatgccttttactattgctattctcccgacccaggcaacgctaaaggtaaagacgccattatggagaccatggctgatcagatcgtgaccgtctgcgcaactctcgatgagaaccctggagtgagatataaatctaagcccctcgacaacgcttctaagctagcccagctcgttgaaaagaaattggaagactactataagattgatgagaaatctctcatcaagggcaagactcattcgcagctactgattattgaccgggggttcgatccagtgagcactgttcttcatgaacttacgttccaggccatggcatatgatttgctcccaatcgaaaacgatacatataagtacaaaaccgacgggaaggaaaaggaggcaatactggaagaagaggatgatctgtgggtcagaatccgacatcgccacattgccgtggtgctggaggaaattcctaaactcatgaaagaaatcagttccaccaagaaagcaaccgagggcaagacaagtctgagtgccttgacacagctgatgaagaaaatgccgcacttcaggaagcaaattacaaaacaggtggtgcatctcaacctggctgaggactgcatgaacaagttcaagctcaatattgaaaaattgtgtaagaccgagcaagatctggcactggggactgatgcagagggacagaaggtcaaggactccatgagagtgctccttccagtgcttctgaataagaaccacgacaactgcgacaaaattagagccatcctcctgtacatttttagtatcaatgggacaacggaagaaaatctcgatagactcatccagaatgtgaagatagagaatgagtctgatatgatacgcaactggagttacctcggcgttcccatcgttccacagagccaacagggtaaaccattgcgaaaagatagatccgccgaagagaccttccagctgagtcgttggactcctttcatcaaggatatcatggaggacgcaatcgacaaccgactggattccaaagagtggccttactgctcacagtgccctgcggtgtggaacggctccggggccgtgagtgcccggcagaaacctagagcaaactacctcgaagatagaaagaatggctcgaaactcatagttttcgttattgggggaattacatactccgaggtaagatgcgcgtacgaggtgtcccaggctcataagtcctgtgaggtgatcatcggaagcactcacgtgctgacaccgaagaaacttcttgacgatattaaaatgttaaacaagccgaaggataaggtttccctgatcaaggacgaatag

SEQ ID NO: 30748 - DNA, 2616 bp, Artificial Sequence
  Description of Artificial Sequence: Synthetic coding sequence
aggatttgctcccaggaggaggtggtcatcccatgtgcatatgactcagactctgagtctgtagatcttgagcttagcaatctggaaatcattaaaaaaggatcatcatctatcgagctgacggacctcgacatcccagacatccctgggctccactgtgagcctctctcccacagtcctcgacacctgacgcagcaggaccctctctccgaagctattgttgaaaagctgatccagagtatccagaaggttttcaacggagagctaaaaggcgaactggagaagttgaagttccttggggacctatcctctctaagtcaggcactgccttatgacgagaccgctaaaagcttcattcactctcatatcgcggacatcgtgcacacactcaacgtcctcgtgcaggaggagcgtccccacagcctgagttcaagcatgcgacaagaagtttttgtcaccattgccgaccttagctatcaggacgtgcacttactgctgggttccgaggatcgggctgaacttttttctcttacgattaaatctattattaccctccccagcgtcagaacattgacacaaatccaggagatcatgccaaatggaacctgtaataccgaatgcttatatcggcagacattccaggccttcagtgaaatgctgcaatcacttgtcgtcaaagatccgcatctggaaaatttagataccattattaagctcccccttcgcttccaacggctcgggcacctggtggcactcatggctcttctctgtggagacccccaggaaaaggtagccgaagaagccgccgagggcatacactctctcttacacatcactctgcgcctgaaatatattacacatgataaaaaggaccagcagaatctgaagcgcgcccttacaaagtgcagggaattcttagagttacattcatctgccgcaaagtgtttttacaactgccccttccggatcgcacaggtgccagagatcatgggcgtcatatgcgctcagctttccatcatctcgcagcctagagtacgacagcagattataaacacagtctcattgttcatttcaaggcccaaatataccgatatcgtcctatcttttttactgtgccatccagtaccttacaatagacacctcgcggaggtatggcgtatgctctccgtggagctgccatcaaccacttggatcctatggagattactgcggaaattacagaaatgccataacgaacccgcccaggagaagatggcttacgtggctgtcgcggccaccgatgccctctatgaggtctttctggggaatcgccttcgcgcagctacattccgactgttccctcagctactgatgacattgctgatccagattcaccattcgatcggtctcactatgtccgatgtcgatatcccctccggactatacaccgaacaggaagtcccaagcgaggtgacccccttatgttttgctatgcaagccaccaagaccttgctgttacgaacctgttgtctccaggagtttaacataatggaaaagaacaaaggctgggccctcctaggtggtaaagatggacatctccagggactgtttttactcgcgaatgccctacttgagcgcaaccagctgttggcgcagaaagttatgtacttactggtgccccttttaaaccggggcaacgataagcataaactaacctccgctggtttttttgttgagctgcttagaagcccagtggcgaagagactgcctagcatctattccgtcgcaagattcaaagattggctccaggacggaaatcatctgtttcgtatactggggctccggggcctttacaaccttgtcggccaccaggagatgagggaggacatcaaatctttactgccatatatagtggactctctgagggagacggatgagaagatcgtgcttagtgccatccagatcctgttacaattagtgagaaccatggacttcaccaccctcgctgcaatgatgcgcaccttgtttagtctcttcggcgacgttaggagcgatgtgcacagattctccgtaaccctattcggcgcagcaattaaaagtgtcaaaaacccagacaaaaaatctattgaaaaccaggtcctggacagcctagtgcctctcctcctctattcccaagatgaaaatgatgccgtggctgaagaatcccgacaggtcctcacaatctgcgcccagttcctgaagtggaagctgccccaggaggtgtactcaaaagacccttggcacataaagcctacagaagcggggactatttgccggttcttcgagaaaaaatgcaagggaaaaatcaatattctcgaacagacgctaatgtactccaaaaatcctaagttgcctattaggagaagtgccgtgctgtttgttgggctgctgtccaagtacatggatcataatgagttgcgccgtatgggcaccgactggattgaagatgacctgagagatttgctatgtgaccccgagccatctctatgcatcatcgcctcgcagactttgctcctcgttcagatggcccgagccgagcccaagccaaagcagcgagtaaattggctgcagaaactcatggggcgatcctctgcatag

SEQ ID NO: 30749 - DNA, 1620 bp, Artificial Sequence
  Description of Artificial Sequence: Synthetic coding sequence
atgggaacggagggcccgcctccccctgctgcctcgcggggacgtcagggttgtctgcttgtgccagcccgtacaaaaaccacgattgccctgctgtacgacgaggagtcagagaacgcctacgacattcgcctgaagctgacaaaggaagtgttgaccatccagaagcaggacgtagtgtgtgtgggcggatcacaccaggggagaaacagaaggaccgtcaccttacggcgccaacccgttggagggctggggctgagtatcaagggaggcagtgaacataacgtacctgtcgtcattagcaagatcttcgaggatcaggcagccgaccagaccggaatgctgttcgttggggatgccgtgctccaagtaaatgggattcacgtggaaaatgcgacccatgaggaggtggtgcatctgctccgaaacgctggcgacgaggttacgattactgtagagtatctgcgggaagctcccgccttcttgaagctcccactcggtagtcccggaccttcaagcgatcatagcagcggggcctcttcgccgctctttgactccgggctgcatctgaatggcaatagttccactaccgccccatcctctcccagtagtcccatcgccaaggacccaaggtacgaaaaacgatggctggacactctctccgtgcctctctctatggccaggattagccgttataaggctggtactgagaagctgcgatggaacgcatttgaggttctggccctggatggggtgagttcgggcattctgcgtttctacacggcccaagatggtaccgattggctacgagccgtatctgctaatatccgcgagttgactcttcagaacatgaaaatggctaataaatgttgcagcccctcagaccaggtggtacatatggggtgggtgaacgagaagctgcaaggagcagacagctcccagacatttcggcctaaattcctagcattgaaaggcccttccttctacgttttcagcactccccccgtcagtaccttcgattgggttagagctgaaagaacataccatctgtgcgaagttttgttcaaggtccataagttctggctgacagaggactgttggctgcaagccaacctgtatctgggtctccaggactttgattttgaggatcaacgaccatattgcttcagcatcgtcgcaggccacggtaaaagccatgtgtttaacgtagagttaggctctgagttggccatgtgggagaagtcattccagcgcgctacattcatggaggttcagcgtaccggttccagaacatacatgtgctcttggcagggcgaaatgctgtgctttacagtggacttcgccttgggtttcacctgcttcgagtctaagaccaagaatgtactgtggcgattcaagtttagccagttgaaagggtccagtgacgatggaaagactagagtaaagctcctctttcagaacctcgatacaaagcagatcgaaacaaaagaactggaattccaggatctaagagccgttctgcactgtatacatagcttcatcgcggctaaggtcgcatctgtcgatcctggattcatggactcccagtcacttgcgcgaaagtacatgtattcgagctag

SEQ ID NO: 30750 - DNA, 540 bp, Artificial Sequence
  Description of Artificial Sequence: Synthetic coding sequence
tgagatctgaagaacgtgtttcctccggaggtggccgttttcgaaccatccgaagcagaaatcagtcatacacaaaaagcaacactcgtctgcctcgctaccgggttttatcccgatcacgtggagttgagctggtgggtcaacggcaaggaagtgcacagcggggtcagcactgatccccagccattgaaagagcaacccgccctgaacgactctagatactgcctgtctagccgcctgcgggtgagcgccacgttctggcaaaacccccggaaccacttcaggtgccaggtccaattttatggactcagtgaaaatgatgagtggactcaagatcgggctaagcccgtgacacagatcgtatcagcggaagcttgggggcgcgcggactgcgggttcacaagtgagagttaccagcagggtgttttgtccgccactattctgtacgaaatattgcttgggaaagcaacgctctatgccgtgttggtatccgccttagttctcatggccatggtgaagaggaaagattcccggggctag

SEQ ID NO: 30751 - DNA, 465 bp, Artificial Sequence
  Description of Artificial Sequence: Synthetic coding sequence
taatcccagcctcacaccaagccttccgtcttcgtcatgaaaaacgggactaatgttgcttgtctggtcaaagagttctacccaaaagatattaggattaatcttgtgtcaagcaaaaagatcacagaatttgatcccgctattgtgatctcacctagcggcaaatacaatgctgttaagttaggcaagtacgaggactccaactctgtgacttgctccgtccagcacgacaacaagacagtacacagcaccgattttgaagtgaaaacagattccactgaccacgtcaaacccaaggagacagagaatacaaagcaaccatccaagtcctgtcacaagccaaaggccatcgttcacactgagaaagtgaacatgatgagccttaccgtactcggattgagaatgctcttcgcgaagaccgtagcagtaaacttcctgctcaccgctaaactctttttcctctag

SEQ ID NO: 30752 - DNA, 357 bp, Artificial Sequence
  Description of Artificial Sequence: Synthetic coding sequence
atgagatgggctttgctggtccttctcgcttttctttctcccgctagccaaaagtcgtccaatctggagggacgcacaaaaagcgtaacccggcagactggaagcagtgccgaaattacatgcgacctgaccgttacgaatactttttacatccattggtatttgcaccaggaggggaaggcgccccagagactcctttattacgacgttagcacggcgcgagacgtgctggaaagtggactgtctcccggaaaatactacactcacactcctcggcgatggtcttggattcttcggctgcagaacctcatcgagaatgattctggagtatattactgtgctacgtgggatagatag

SEQ ID NO: 30753 - DNA, 816 bp, Artificial Sequence
  Description of Artificial Sequence: Synthetic coding sequence
atgatcccgaaattgctttcactgctttgttttcgcttgtgcgtaggccaaggagataccaggggtgacgggagtctgcctaagccatccctatccgcctggccgagctccgtggtacctgccaactccaatgtcacacttcggtgctggaccccagccaggggcgtcagctttgtgttgcgtaagggaggaattattctggagagccctaagccgctggattctacggagggcgctgcggaattccacttaaacaacctgaaagttcgcaacgcaggcgagtatacatgcgagtactatcgaaaggcaagtcctcacatcttaagtcagaggagcgacgtgttgctgctgttagtgacaggtcacttaagcaaaccatttctgaggacataccagaggggcaccgttactgccgggggaagagttaccctgcaatgccagaagcgagatcagttattcgtgcctataatgtttgctttgctgaaggccggtacaccctcaccaatccagcttcagtcacccgccggaaaagaaatagacttcagcctggtggacgtcacggccggtgatgcgggcaattacagttgcatgtactatcaaaccaagtctcccttctgggcttccgaaccctctgaccagttggaaatcctggtgactgtgccaccaggcaccactagcagtaactactctctgggcaatttcgttcggttaggactcgccgccgttatagttgtgatcatgggcgcatttctggttgaggcatggtattctcggaacgtaagtccaggggagagtgaagccttcaaacctgaatag

SEQ ID NO: 30754 - DNA, 840 bp, Artificial Sequence
  Description of Artificial Sequence: Synthetic coding sequence
atgaaggaacgaaagaaaaaagaaaggaaggaaaggaaaagaaaaaaagaacgtaacgggctctgtgtcggacaaggggacacacgaggcgacggatcgctgcctaaaccctctctgtccgcgtggccaagctcagttgtgccagctaactctaatgtaacgctgcggtgctggacacctgcccgtggagtgtctttcgtcctgaggaagggcggtatcattctggagagtcccaaaccattagacagtaccgagggagcagcggagtttcatctgaataatcttaaggtgcgcaatgccggggaatatacatgcgaatattaccgtaaggcgtcccctcacatcctttctcagagatccgatgttctgttgcttcttgtaactgggcatctatcgaagccattcttgagaacctaccagcgcggtaccgtcactgctggcggaagggtcacgcttcagtgccagaagagagaccagctcttcgtccctatcatgtttgcactcctgaaggcagggacacctagtcctatccagctgcagtcaccagcaggaaaagagatcgatttttctctcgtggatgtgaccgcgggggacgctgggaactacagttgtatgtactatcagacaaagtccccattctgggccagtgagccgtccgatcagctggaaatccttgtgacagtcccgccgggcactacttcttctaactactctctgggcaactttgtgcgactcggtctcgcggctgtgattgtggtgatcatgggggcatttctcgtggaagcttggtatagcagaaatgtgagtcctggcgagtccgaggcatttaagcctgagtag

SEQ ID NO: 30755 - DNA, 951 bp, Artificial Sequence
  Description of Artificial Sequence: Synthetic coding sequence
atggctctgcagaccctgcaatccagctgggtcacctttagaaagattctcagccattttcccgaggagttgagcttggccttcgtgtatgggtcaggggtgtaccggcaggccggcccgagcagtgatcagaagaacgccatgttagatttcgtcttcaccgtggacgatccagtagcgtggcattccaaaaacctcaaaaagaactggagccactattcctttttaaaagttcttggtccaaagatcataacttcaatccagaacaattatggcgccggagtctattacaactcgctgatcatgtgcaacggaagactgatcaaatacggtgtcatcagtaccaatgtgctcatcgaagatctgctgaattggaataacctgtacattgccggccgccttcagaaacccgtcaaaatcatctccgttaatgaagatgtcactcttcgatcagcactggaccggaacctgaaatccgctgtgaccgccgccttcctgatgttaccagagtccttttcagaagaggacctgttcatagagattgccggcctctcctattcaggggactttcgcatggtggtgggcgaggataaaacgaaggtgctcaacatcgtcaaacccaacattgcgcatttccgcgagttgtatggaagtatacttcaggaaaaccctcaggttgtgtataagtctcagcagggctggctcgaaatcgataaatctcctgagggacagttcacccagcttatgacactcccaaagacactgcagcagcagatcaaccacattatggacccccctgggaagaacagagatgtggaggagaccctgtttcaagtcgctcatgatcccgattgtggagacgtagttagactgggcctgaaaaaatccgtgatctattcgagcctcaaactccacaaaatgtggaagggttggcttcgaaaaacatcatag

SEQ ID NO: 30756 - DNA, 2190 bp, Artificial Sequence
  Description of Artificial Sequence: Synthetic coding sequence
atgcagagtacgtcgaatcacttatggctcttgagcgatatcttgggacagggggcgaccgcgaatgttttcaggggtcggcataagaaaacaggtgacctttttgctatcaaagtttttaacaatataagctttttgcggcctgtggatgtgcagatgcgcgaattcgaagtgctgaagaagctgaaccacaagaatatcgtgaaactgtttgctatcgaggaggagactacaaccaggcacaaagtgctgattatggagttctgcccatgcgggtccctttacactgtgctggaagaaccctccaatgcgtacggactgcctgagtctgaattcttgatcgtgctgagagatgttgtggggggcatgaaccacctccgcgaaaacgggatagtgcatcgggacatcaagccgggcaatataatgagggtgatcggcgaagacgggcagagtgtctataaactgacagactttggggctgctcgcgaacttgaggacgacgagcagttcgtttccctatacggtactgaagagtatctgcacccggacatgtacgagcgagccgtgctgcgcaaggaccaccaaaaaaaatatggtgcaactgtcgacttatggtcgattggagtgaccttttaccatgccgctactggaagtctccccttccgcccgttcgaggggccccgccggaataaagaggtgatgtacaagatcatcacagggaaacccagtggagccatctccggcgtccagaaggcagaaaatgggcccatcgactggtccggggacatgccagtgagctgctccctgagcagaggcctgcaggtactactgactcccgtgttggctaatatcttggaagctgatcaggagaaatgttggggctttgatcaattctttgctgagacctctgatatcctgcacaggatggttattcatgtgttctccttgcaacaaatgaccgcccacaagatttacatacacagctataacaccgctaccatctttcatgagttggtgtacaagcaaacaaagatcatcagctcgaaccaggagcttatatatgaagggagaaggcttgtactggagcccggacgcttggctcagcatttccccaagacaaccgaagagaacccgatttttgtggtttctcgagaacctctgaataccattggattgatctatgagaagatctcactcccgaaagtccatcctcgctatgacctggatggagatgcttcgatggcaaaggccatcaccggcgtggtatgctatgcatgcagaattgccagcacattgttgctctatcaagagctgatgcgtaagggaatcagatggttgatcgagctgatcaaggatgattacaacgagacggtccacaaaaaaacagaggtggtaatcacgctggacttctgcatcagaaatatagagaaaaccgtcaaggtgtatgagaaattgatgaagattaacctggaagccgccgagctgggcgagatctcagatatccatacgaaactgctgcggctgtcttcctctcagggtacgattgaaacatcgctacaggacattgattcccggctttccccaggaggttccctggctgacgcttgggctcatcaagagggcacccaccccaaggatcgcaacgtagagaaactacaggtcttgttaaactgtatgactgagatctattaccagtttaaaaaggacaaggcggagaggcggctcgcttataacgaagaacagatacacaaatttgacaaacagaagctctactaccacgcaacaaaagctatgactcactttacagatgagtgcgtgaagaagtatgaagcatttctgaacaagagtgaggaatggatccgaaagatgctgcacttaaggaagcagctgctgagtttgaccaaccagtgtttcgatatcgaggaagaggtttcgaagtatcaagagtacaccaacgaacttcaggagacgttgccacagaagatgtttaccgcgtcctccggcattaagcataccatgacgccaatttacccgagttccaatacattggtggagatgacactgggcatgaaaaagctgaaagaggagatggagggagtggtgaaagagcttgcggagaataatcacattctcgagagatttggcagtctaaccatggacggaggccttagaaacgtcgactgcttgtag

SEQ ID NO: 30757 - DNA, 312 bp, Artificial Sequence
  Description of Artificial Sequence: Synthetic coding sequence
atgcaatctacctctaaccacctttggctcctatcggacatcttggggcagggcgccaccgccaacgtatttagggggcgccacaagaagactggggacctcttcgcaatcaaggtgttcaacaatatatcatttctgaggcccgtggatgtgcagatgcgggagtttgaggttctcaaaaagcttaatcacaaaaacattgtgaagctctttgccatagaagaagagactactaccagacacaaggttctcattatggaattctgtccatgtggctccctgtacaccgtgctcgaagagccttctaactag

SEQ ID NO: 30758 - DNA, 297 bp, Artificial Sequence
  Description of Artificial Sequence: Synthetic coding sequence
atgcagtcgacaagcaatcacctgtggctgttgagtgacattctcggccagggtgccacagccaacgtttttagagggagacataaaaaaactggggacctcttcgccatcaaggtctttaacaacatctctttccttaggccagtagacgtccagatgcgggagttcgaggtactgaaaaagcttaatcacaagaacatcgttaagctgtttgccatagaagaggaaactaccacacgccacaaggttctcatcatggaattctgtccatgtggtagcctgtacactgtgctgtag

SEQ ID NO: 30759 - DNA, 924 bp, Artificial Sequence
  Description of Artificial Sequence: Synthetic coding sequence
atgcacgatgacgagtccacaatcaattcctcttcctcagttgtccataagaaggaccacgtgttcattagagacgaggcgggacacggagatccacgacccgagccaagacccactcaatccgtgcagtcccaggcactgcattacagaaaccgagaaaggttcgccaccatcaaaagcgccagcctcgtgactagacagattcatgaacacgagcaggaaaacgaacttcgcgaacagatgagtggctataaaaggatgagacgacagcaccagaaacaactaatagccttggagaacaagctaaaggcagaaatggatgaacatagattgaaacttcagaaggaagtcgaaactcacgctaataattccagcatcgagctggaaaaactggcaaaaaaacaggtcgccataatcgaaaaggaggcaaaggtggctgccgcagatgagaagaagttccaacaacagatactggcccaacagaaaaaggatctgacaacctttcttgaaagtcagaagaagcagtataagatctgcaaggaaaaaattaaggaggaaatgaatgaggatcacagcacccccaagaaagagaaacaggagcgtatctccaagcacaaagagaatctccaacacacccaggcggaagaggaagcccatttactgacccagcaacgcctgtactacgacaaaaattgcagattcttcaaacgaaagatcatgattaagcgacatgaagtcgaacagcagaacatccgcgaggagctcaataagaaaaggaccgagggggacggcgcctgtcacgccaatccagacgaaagcacccgggagcttgagtaccggcagctccacacccttcagaaactccacgggtccgatcctttcactgcgccagacgggaccggaaagcctgccggtgttcaatag

SEQ ID NO: 30760 - DNA, 2697 bp, Artificial Sequence
  Description of Artificial Sequence: Synthetic coding sequence
atgagaaagggcgttctgaaagaccccgaaatcgcggacctcttttacaaagacgatccagaggaactttttatcggcttgcacgagatcgggcacggctctttcggggcggtctattttgcaacgaacgcccacacatcagaggtggtagctattaaaaagatgagttactctggaaagcagacacacgagaagtggcaggacatactcaaggaggtcaagttcctgcggcaactcaaacaccccaacaccatcgagtacaaagggtgttatctcaaggaacataccgcatggttagtcatggaatattgcctcggcagcgccagtgacctccttgaggtccacaagaagcccctgcaggaggtcgagattgccgctatcacccacggcgcgctgcacggcctggcttacttgcattcacatgctctcatccatcgcgacatcaaagctggaaatatcctcctcaccgagccagggcaggtgaagctggctgactttggctccgcgagtatggcctcacccgctaactcatttgtaggaaccccctactggatggctccagaggtgatattggccatggatgagggccagtacgatggtaaagtggatatttggtcactaggaatcacatgcatagaacttgcagaacggaagccccccctcttcaacatgaacgccatgtctgcattgtaccacattgctcaaaatgactccccaactctccagtctaatgagtggaccgattcttttcgtcgatttgtcgactactgcctacagaaaatccctcaggaacgtcctacatctgctgaattactgaggcacgatttcgtaagacgggatagaccacttcgtgtgttgatcgacctgattcagaggacaaaggacgcagtgagggagctggataatttgcagtatcgcaagatgaagaaaatcctgttccaggaaactaggaacgggccgctgaatgaaagccaggaggatgaggaggatagcgagcatggcacatcgctcaatagagagatggatagcctcggcagcaatcatagtattcctagtatgtctgtctcgaccggcagccagtcttcctccgttaatagcatgcaagaagtaatggatgagtcttcctcagaactggtcatgatgcatgacgacgaatctaccatcaattcttcgtctagtgtcgtgcacaaaaaggatcacgtcttcatccgggatgaagcgggacacggagaccctaggcctgaaccacggccaacccagtctgtgcaaagtcaggcgctccactaccgaaacagggaaagattcgcgacgatcaagtctgcctccctggtcactcgtcagattcatgaacacgaacaggaaaatgagctgagagagcagatgtctggctataagcgcatgaggagacagcaccagaaacaattgattgcattggagaacaagctcaaagctgagatggatgagcaccggctgaaactgcagaaagaggttgagacacacgccaataactcctcgatcgaactagagaaactcgccaagaagcaggtcgccatcatcgaaaaagaggcgaaggtggccgcagccgacgagaaaaagttccagcagcaaatcttagcccagcagaaaaaagatttaacaacatttctcgagagccagaaaaaacaatataaaatctgcaaagaaaaaattaaagaggaaatgaatgaggatcactccacccccaaaaaagagaaacaggagagaatctcaaaacacaaggaaaatcttcagcacactcaggccgaggaagaggcgcacctactgactcaacaacgcctgtattatgataagaactgtagatttttcaaacggaaaattatgattaaacggcatgaagtggagcagcagaatattcgcgaggaactgaacaagaagcggactcagaaggaaatggaacatgccatgctcattcgccacgatgaatcaactcgcgagttagaatatcggcagctgcacaccctgcagaagctccggatggatcttattcggctgcagcaccagaccgaattggagaatcagctggagtataataagaggagggagcgcgagttacatcgtaagcacgtaatggagttgcgtcaacaacccaagaacctcaaggcaatggaaatgcagataaagaaacagtttcaggacacatgcaaggtgcagacaaagcagtataaagctctcaaaaatcaccagttggaagtgacccccaaaaatgaacataagacaatcttgaagacactcaaagacgaacagacaaggaaattggctattctggctgagcaatacgagcaatcgattaacgaaatgatggcaagccaggccctgaggttggatgaagcccaagaggcggagtgccaggcccttcgactccagttgcaacaggagatggaactgctcaatgcatatcagagtaaaatcaagatgcagaccgaggctcagcacgagcgagaattacaaaaactcgagcaacgggtgagtctgaggcgagcccacctagaacagaaaattgaggaagaattggctgcactacagaaggagcgctctgagaggattaagaatctgctggagcggcaggaacgagagatagagacctttgacatggaatcactgcggatgggatttggtaacctcgtaaccctagatttcccgaaggaagactaccggtag

SEQ ID NO: 30761 - DNA, 2697 bp, Artificial Sequence
  Description of Artificial Sequence: Synthetic coding sequence
atgaggaagggagtactgaaggaccctgaaatagcggacctgttttacaaggatgatcctgaggagctcttcatcggactgcatgaaattggacacgggtccttcggggccgtgtattttgccacaaacgcccacactagcgaagttgtcgccattaagaagatgtcctactcaggcaagcagactcacgagaagtggcaagacatccttaaggaagtcaagtttctccgccagctcaaacatcctaataccattgaatataagggatgctatctgaaagagcacaccgcttggctggtgatggagtactgtctcggctcagcttctgaccttctggaggtgcacaagaaaccacttcaggaggtcgagattgccgctattacacacggtgcattgcatggtctggcgtacctgcactcccacgcattgatacatcgtgacatcaaggctggcaatatactgctgacggagcctggccaggtgaagttggccgacttcggctcagcatctatggcatctcccgccaattcctttgtcggaaccccgtactggatggcaccggaggtgatcttagctatggacgagggacagtacgatggaaaggtggacatttggtcgctcgggatcacttgtatcgagttggcagagcgcaaaccccccctgttcaatatgaacgccatgagtgccctctaccacatcgcacagaacgattctcctaccttacaaagcaatgagtggaccgactcgttccggaggtttgtggactattgtctacaaaaaattccccaggagcgccccaccagcgcagagctacttaggcatgatttcgtgcgaagggatagaccactgcgggtcctgattgatctgatccaacgtacaaaggatgctgtccgggagcttgacaacctgcagtaccgaaagatgaagaaaatccttttccaggagactcggaatgggccactcaatgaaagtcaggaggacgaagaggatagtgaacacgggaccagcctgaacagggaaatggattctctcggaagtaaccactcaattcctagcatgagcgttagtacagggtcacagtcttcttctgtcaacagcatgcaagaagtgatggatgagtctagctccgagctggtaatgatgcacgacgatgaatccaccataaattcaagtagctctgttgtccacaagaaggaccatgtgttcatccgggatgaagccggacatggtgacccaaggcctgagccacgccccacccagtctgtgcagtcccaggctcttcattaccgcaaccgcgaaagatttgctacgatcaaatccgctagtctggtaacgaggcagatccatgaacacgagcaggagaacgaactgcgagagcagatgtccggctataagaggatgcgaaggcagcaccagaagcagctcattgccctagagaacaagttgaaagctgagatggacgagcacagattaaaattgcagaaggaggtagaaactcatgccaacaacagctcaattgaactggagaaactagcaaaaaagcaggtcgcaataattgagaaggaggcaaaggttgctgcagctgacgaaaaaaaatttcaacaacagatcctggctcagcagaagaaggacctgacgacttttctagagtcacagaagaaacagtataaaatttgtaaggagaaaattaaggaggagatgaacgaggatcacagcactccaaaaaaagagaaacaagaaaggatcagcaagcataaagagaacctccagcatacgcaggccgaggaagaagcccacctgctcacccagcagaggctatattacgacaaaaactgccgcttcttcaagaggaagattatgatcaaacgccatgaagtggagcagcagaacatcagggaagagttaaacaaaaaacgtacgcagaaggaaatggagcatgccatgctcatccgtcatgacgaatcaacacgcgagcttgagtaccgacaactgcatacgcttcaaaaattgcggatggatcttatccggctgcagcatcagacagaactggagaatcagctggagtacaataaacgtcgggaaagagaactgcacagaaaacacgtcatggagctgaggcaacagcctaagaatcttaaggctatggagatgcagataaagaagcagtttcaggatacgtgcaaggtgcaaactaaacagtataaggccctcaagaaccatcaactggaagtcacccctaaaaatgagcacaagacgatccttaagacattgaaagacgaacagactagaaaacttgccattcttgccgagcaatacgaacagtcaattaacgagatgatggctagccaggcccttcgcctcgacgaggcccaggaggcagagtgccaggccttgagactgcagctccagcaggagatggaactgttgaacgcttatcaatctaagataaaaatgcaaactgaggcacagcacgagcgggagctacagaagttggagcagcgtgtctcattacgtcgagcacatctagagcagaaaattgaagaggaactggcagccctccaaaaagagcgctcagagcggatcaagaacctgctggagcgccaggaaagagagatcgagacttttgatatggaaagcttgcgaatgggattcggaaacctagtaaccctggattttcccaaagaggattatcggtag

SEQ ID NO: 30762 - DNA, 411 bp, Artificial Sequence
  Description of Artificial Sequence: Synthetic coding sequence
atgcggaaaggcgtactcaaagaccccgaaatcgccgacctgttttacaaggacgaccccgaagaactgttcatcggcctgcacgagattggccacggaagctttggggcggtctacttcgcgaccaatgctcatacctctgaggtggtggccattaagaagatgagctactccggaaagcaaacccatgaaaaatggcaggatatcttaaaagaggtcaagttcctccgtcagctgaaacacccaaataccattgagtataaggggtgttatctgaaggaacacaccgcctggctggtaatggagtattgtctggggagcgcatcagacctgctggaagtgcataagaaaccccttcaggaagtggaaattgccgctataacacacggcgccctgcatggcctggcttag

SEQ ID NO: 30763 - DNA, 57 bp, Artificial Sequence
  Description of Artificial Sequence: Synthetic coding sequence
atgaggaaaggcgtgctcaaggaccccgagatagccgacttattctacaaggactag

SEQ ID NO: 30764 - DNA, 282 bp, Artificial Sequence
  Description of Artificial Sequence: Synthetic coding sequence
atgcggaagggggttttgaaggacccagagatagcagatctcttttacaaggatgatccagaggagttattcatagggctgcacgagattggacacgggtccttcggcgccgtctacttcgcgaccaacgctcatactagcgaggtggtcgcgataaaaaaaatgtcttatagcggtaaacagactcacgagaaatggcaggatattttgaaagaagtaaagttcctgagacagcttaaacaccctaacaccatcgaatacaaggggtgctatttaaagtag

SEQ ID NO: 30765 - DNA, 66 bp, Artificial Sequence
  Description of Artificial Sequence: Synthetic coding sequence
atgcgcaaaggagtgcttaaagacccagagatcgcagacctgttctataaggacgacccagaatag

SEQ ID NO: 30766 - DNA, 189 bp, Artificial Sequence
  Description of Artificial Sequence: Synthetic coding sequence
atgcggaagggagtgcttaaagacccagaaatcgcagacctgttttacaaggatgatcccgaggagctgttcatagggttgcatgaaatcggtcatggctcatttggcgcagtgtactttgcaacaaacgcccatacctcggaggttgtggctatcaaaaaaatgtcttactctggaaaacaaacctag

SEQ ID NO: 30767 - DNA, 111 bp, Artificial Sequence
  Description of Artificial Sequence: Synthetic coding sequence
atgaggaaaggtgtgctgaaagatcccgagatcgcagatctgttctacaaagacgacccagaagagctgttcattggcttgcatgagatcggccacggcagttttggctag

SEQ ID NO: 30768 - DNA, 174 bp, Artificial Sequence
  Description of Artificial Sequence: Synthetic coding sequence
atgaggaaaggcgtcctgaaagatcccgagattgctgatctgttctacaaggacgatcctgaagagttattcatcggcctgcatgagattggccacgggtcgttcggggcagtctatttcgcaacaaatgcccatacatcagaagtcgtggcgattaagaaaatgtcttattag

SEQ ID NO: 30769 - DNA, 1407 bp, Artificial Sequence
  Description of Artificial Sequence: Synthetic coding sequence
atgggaacgcaagagggctggtgccttctcctttgcctggcgctaagcggtgccgccgagaccaaaccacaccctgcagagggccagtggagggcagtggatgtggtcctggactgcttccttgccaaggacggcgcccataggggagcacttgcctcctctgaggacagggcccgtgcgtcattggtactcaaacaggtcccagtcctggacgatggcagcctagaggatttcacggactttcaaggcggcactctggcgcaggacgatcctcctatcatctttgaagcctccgtggatctcgtgcagatcccacaggccgaagctctccttcacgcggactgctctggcaaggaagttacatgtgagattagccggtacttcctgcagatgaccgagactaccgtaaaaacagccgcatggtttatggccaacatgcaggtttcgggcggcggacccagtatttcccttgtgatgaagactccccgcgtcactaaaaacgaagcattgtggcaccctaccctgaatcttccactgtcaccccaaggcaccgtgcggacagcggtagaattccaggtaatgacacagactcaaagcctgagcttccttttggggagcagcgcctccctagactgcggctttagcatggctcccggtcttgacctgatctctgtcgaatggcgcctgcagcacaaggggcgcggccagctcgtgtacagctggaccgctggacagggtcaggctgtgcggaaaggagctacacttgagcctgcccaattggggatggcccgagacgctagcctgactttaccgggccttaccattcaggatgagggcacttatatctgccaaattaccaccagcctttaccgggctcaacaaatcattcaacttaacatccaagccagccccaaggttcgactttccttggcaaacgaggccctgctgcccactctcatttgcgacatcgcaggatactatccacttgacgtagttgtgacatggacgcgcgaggagctcggcggaagccccgcacaggtttctggtgcttcgtttagcagtctaagacagtccgtcgcaggcacctactctattagttctagcttgaccgccgaacccggctctgcaggagccacatatacctgtcaggtgacccatatctcactggaggagccgctgggagccagcacccaggtggtgccccctgaaaggcgaacagccttgggggtaatttttgctagctcactctttctgcttgctctgatgttcttgggcctgcagaggaggcaggcacccactggtttgggtctattgcaagctgagcgctgggagactacttcctgtgccgacacacaatcatcacacttgcacgaagaccgaacagcaagggttagccaaccctcctag

SEQ ID NO: 30770 - DNA, 1200 bp, Artificial Sequence
  Description of Artificial Sequence: Synthetic coding sequence
atgtgtgtgcaaaactgcggaccttcttttcagtccctcatcgtgaagaaggagttcgtaaaagaaaacctcgttaagttgcttaaccctcgctacaatttgccactcgatattcagaaccgcatactgaactttataaagacatggagccaggggtttccaggcggcgttgatgtgtccgaggtgaaggaggtgtatttggatctcgtgaaaaagggagtgcagttcccaccttcagaagccgaagccgaaacggcaagacaagagacggcacaaatatcctcaaacccaccgaccagtgtaccaaccgcccctgcactgtcttccgtcatcgctccaaagaactccaccgtcacccttgtgcccgagcagattggaaagttacactctgaattagacatggtgaagatgaatgtccgcgtcatgagcgcaatcctaatggaaaataccccaggttcggagaaccatgaggacattgagcttctgcaaaagttgtacaagaccggcagagaaatgcaagaacgtatcatggatcttctggtcgtcgtggagaacgaggacgtgacagtggagctaattcaggttaatgaggatctcaacaacgctatcctggggtacgagagatttactcgaaatcagcagcgtatcctcgagcaaaataagaaccagaaagaagccacaaacacaacttcagagccaagtgccccatctcaggacctgcttgatttgtcgcctagcccacgaatgccccgggctacgctgggcgaacttaacactatgaacaaccagctcagtggcctgaatttttctctaccatccagcgacgtgacaaataacttaaagccttcactgcacccacagatgaacctgcttgctttagagaacacagaaataccgccattcgcccagaggacctctcagaatttaacctccagtcatgcttacgacaacttcctggaacatagtaacagcgtattcctccagcccgtctcactccagaccattgccgccgcccccagcaatcagtccctccctcccctgccgagtaaccacccagcaatgacgaagtctgatttacaacccccaaactactatgaagtgatggaatttgacccactggcacctgctgtgacaactgaggcaatttacgaagagatagacgcccaccaacataaaggcgctcagaatgacggtgattag

SEQ ID NO: 30771 - DNA, 1431 bp, Artificial Sequence
  Description of Artificial Sequence: Synthetic coding sequence
atggctttcggcaaatcgcaccgcgacccttacgccacttcagtggggcatctgatagaaaaggcaacattcgccggcgtgcagactgaagactggggccagtttatgcacatttgtgacatcatcaatactacccaggatggccccaaggacgccgtgaaggcactgaaaaagaggatcagtaagaattacaaccacaaagaaatccagttaacgttatctctgatcgatatgtgcgtacagaactgcggacctagcttccagagtctaatcgtgaagaaggaatttgtgaaagagaatttagtcaaactgctaaacccacgctacaaccttccgcttgacattcagaaccgcattctcaacttcatcaagacttggtctcaaggattccccggcggagtggatgtgtccgaagtcaaggaagtttatctcgatcttgtcaagaaaggcgtccagtttcctccatcggaggctgaagcagagacagcaaggcaggagactgctcagataagttcaaaccccccaacctcagtgcctaccgctcccgcattgtcttcggtgattgcgccgaagaattccacggtcacattggtacccgaacagatcggtaaactccattccgaactggacatggtgaaaatgaacgtcagagtaatgagcgcaatcctaatggagaatacccctggatcggaaaaccacgaagatatagaacttctgcaaaagctgtataagacagggcgcgagatgcaagagcgcattatggatctccttgtcgtcgtggaaaatgaggacgtgaccgttgagctgatccaagtgaacgaggacctcaataatgcaatccttggatacgaaagattcacaaggaaccaacagaggattcttgagcaaaacaagaaccagaaagaggccacaaacaccacctcagagcccagcgctcccagccaggacctgctggacttgtcaccttccccgaggatgccaagagctacactgggtgaactcaatactatgaacaaccagctgtcaggtctgaatttctcgcttcccagcagtgacgtcaccaacaatctcaaaccttccctgcacccccagatgaacctcctggccttagaaaacacagaaatccctccttttgcacagaggacctcacaaaacctcacctcctcgcatgcatacgacaactttctagagcactctaactccgtgtttctgcagcctgtctcgcttcagacgatagctgcagctccctcaaatcagagtttgcccccgttgccctccaatcacccagccatgacaaagagcgatctgcagcctccaaactactatgaggttatggaatttgaccccctcgctcctgctgtgacgactgaggcgatctatgaagaaatcgacgcccatcagcacaaaggcgcacagaacgatggtgattag

SEQ ID NO: 30772 - DNA, 1200 bp, Artificial Sequence
  Description of Artificial Sequence: Synthetic coding sequence
atgtgtgttcagaattgtggcccttcattccagtccctaatagtcaagaaagaattcgttaaggagaatctcgtgaagctgctgaatcctaggtataatctgcctttggacatacagaacaggatcctgaatttcattaagacctggtcccaggggtttccaggaggcgttgatgtgtctgaggtgaaggaagtgtacctcgacctcgttaagaagggtgtgcagttccccccatcagaggccgaggcggaaaccgctcggcaagaaacggcacagatctctagcaacccacctacttccgtgcctaccgccccggctctatcctcagttatcgctccaaaaaactccacagtgaccctcgtgccagagcagatcggcaagctccattcagagttggatatggtgaaaatgaacgtgagagtcatgagtgctatccttatggagaacacaccaggatctgaaaatcacgaggacatcgaactgcttcaaaagctctacaaaacgggccgcgaaatgcaggagagaatcatggatctactcgtggtcgtggaaaacgaggatgtgacagtggaattgattcaagttaatgaggatctgaacaacgcgatcctaggatatgagcggtttacccggaatcaacagcgaatcttagaacaaaacaagaatcagaaggaggcgacaaacacaacttccgagccatcggctccatcacaggacctcctggatctcagtccctccccgaggatgcctcgtgcaacgctgggggaactgaacaccatgaacaaccagctgtccggcctcaacttttccctgcccagctctgacgtcacaaacaacctgaagccttccttacatccacaaatgaacttattagccctggaaaatactgagattcccccctttgcacaaagaactagccagaacctaactagttcccacgcctatgacaacttcctcgagcattctaattctgtctttctgcagccggtgtccttgcagacaattgccgcggctccgtctaatcagagtcttccccctcttccgtccaaccacccagctatgaccaaaagcgatctgcagcctcctaattactacgaggttatggagttcgatccactggcccccgctgtcactactgaagcgatctatgaagaaattgatgcccaccagcataagggggctcaaaacgacggagactag

SEQ ID NO: 30773 - DNA, 1095 bp, Artificial Sequence
  Description of Artificial Sequence: Synthetic coding sequence
atgtgtgtgcaaaactgtgggccatcttttcaaagtcttatcgttaagaaagaattcgtgaaagaaaatttagtgaaactattgaatccacggtataatctcccactcgacattcaaaaccgcattctgaactttatcaagacatggtcccagggattcccggggggcgtcgacgtgtctgaggttaaagaggtgtatctagatctggtgaaaaaaggggttcaatttccgccatcagaggctgaagccgagacagcaaggcaagaaatcggaaagctccactccgagctggacatggtcaagatgaacgttagagtgatgtccgccatattgatggagaacacccctgggtctgagaaccatgaggacatcgaattgcttcagaagttgtataaaactggcagggagatgcaggagcgaatcatggatcttctggtggtagtagaaaacgaggatgtgaccgtagagctcatccaggttaacgaagacctgaacaacgctatcctgggctacgagcggttcacccgcaatcagcaacggatcctggaacaaaacaaaaaccagaaggaagccaccaacacaacatcagaaccaagcgctcccagccaggatctcctggacctgagtccaagtccccgcatgccacgggctacgctcggggaactgaacacgatgaacaaccaactgagcggcctcaacttttccttgccaagctccgacgttaccaataatcttaaacccagcttgcacccgcaaatgaatctcttggccctcgaaaacaccgaaatccccccatttgcgcagcgaacctctcagaatctgaccagctcccatgcctacgataattttctcgagcactcgaactccgtcttcttacagccagtgagcctgcaaacaatcgccgctgcaccttctaatcaaagtctcccacctctgcctagcaaccatccggctatgactaaatccgatctccagcctcctaactattacgaggtgatggaatttgacccactggcccccgccgtcacaaccgaggcaatttacgaagagattgacgcgcaccaacataagggcgcccagaacgacggcgactag

SEQ ID NO: 30774 - DNA, 1431 bp, Artificial Sequence
  Description of Artificial Sequence: Synthetic coding sequence
atggctttcggaaagtcccatcgagatccctatgctacttcagtgggacacctcatcgagaaggcaacttttgcgggagtgcagacagaagattggggacagttcatgcacatatgcgatatcataaatactacgcaggatgggcccaaagatgcggttaaagctttgaaaaaacgcatttctaaaaattacaaccataaggagatccagctgacgttgagtctaattgatatgtgtgtccagaactgtggcccttcctttcaatcactgattgttaagaaggagtttgtcaaagagaatttggttaagctccttaatccgcgttacaatctgcctctagacatacagaataggattttgaactttattaaaacgtggagtcaaggctttcctggaggggtggacgtgagcgaggtcaaggaggtgtacttggacctagtgaagaagggggtgcagttcccccctagtgaagcggaagcggaaacggctcgccaggaaactgctcagatttcgtctaacccgcccacatctgtgccaacagcccccgccctatcatcagtaatcgcccctaagaattccacggttacattagttcccgaacagatcgggaagctgcactcagagcttgacatggtcaagatgaacgttcgcgtgatgagcgctatcctgatggagaacacaccagggagcgagaaccatgaagatattgagctcctgcagaaactgtacaagactggccgggaaatgcaggagcggatcatggacttgctggtggtggtcgaaaatgaggacgtcactgtggagcttatccaggtgaacgaggacttaaataatgcaatccttggctacgaaagattcacaaggaaccagcagaggatcctggaacagaataagaatcagaaggaggctactaatacgacttctgagcccagcgccccttcccaggacctcttagacctgtcaccctctcctcggatgccccgagccacactgggtgaactcaataccatgaataaccagctgtccggtctcaacttctcactacccagctcagacgtcacgaacaacctgaaacccagcctccacccccagatgaatctcctggccctcgaaaacactgaaatacctcccttcgcccagaggacctcacagaacctcactagctcacacgcgtacgacaatttcttagagcactcgaactcagtgttcctccagcctgtcagcttgcagaccatcgcggccgctcccagcaaccagtctctgccacccctcccttcaaaccaccccgccatgaccaaatccgacctgcagcctcctaactactacgaagtgatggaatttgacccgctggcacccgcagtgacgaccgaggctatctacgaggaaattgatgcccaccaacataagggagctcagaacgacggggattag

SEQ ID NO: 30775 - DNA, 900 bp, Artificial Sequence
  Description of Artificial Sequence: Synthetic coding sequence
atgctagagagccacctgattatctattttcttctcgccgtgatccagtttctccttggtatatttaccaacgggatcattgtagtcgtgaatggaatcgatctaattaaacataggaagatggccccgctggatctgttgttatcttgcctcgccgtctctaggatctttctccagctctttatattctacgtgaacgtgatcgtaatcttcttcattgagtttattatgtgctctgcaaattgtgccatcctgctgtttataaatgaactggagttgtggttggctacctggctgggggtcttttattgcgctaaggtagcctccgtgagacacccactgttcatctggctaaagatgcgcattagcaagctggtgccctggatgattcttgggagcttactttacgtttctatgatttgtgttttccattccaagtacgccggatttatggtgccttacttcttgcgcaagtttttctctcaaaacgcaaccattcagaaagaagacaccctggctattcagatttttagctttgtcgcagagttctcagtcccactgttgatctttctgtttgcggtcctgctcctgattttctctttagggagacacaccaggcagatgagaaacaccgtggcagggtccagggtgccgggcaggggagcccccatctccgcgctactaagcatcttgtcatttctaatcctctacttcagtcactgcatgataaaggtgtttctgtcaagtctgaagttccatatccggcggtttatctttcttttttttatcttggtgataggcatttacccttccggtcacagtctgatactaattctgggcaatccaaaacttaaacaaaatgccaagaagtttctgctccattctaagtgctgccagtag

SEQ ID NO: 30776 - DNA, 924 bp, Artificial Sequence
  Description of Artificial Sequence: Synthetic coding sequence
atgctgcgcgtcgtggagggaatttttattttcgtcgtagtgtcagaatccgtttttggagtgcttggcaacgggtttattggcctggtgaactgcatcgactgcgctaaaaataagttgtccactattggcttcattttgacaggtctggccataagtaggatatttctgatttggatcattatcacagatggctttatccaaatattttcccccaacatctatgcttcaggcaatttaatagagtacatcagctatttttgggtgatagggaatcaaagtagtatgtggttcgcaacgtccttgagcattttttacttcctcaagatagccaattttagcaactatatcttcctctggctgaagagcaggactaacatggtcctgcctttcatgatcgtgtttctccttatcagtagtctcctgaatttcgcttatatagcaaaaatcctcaatgattacaagacaaagaatgacactgtttgggatttgaacatgtataaaagcgagtatttcatcaagcaaattctgctgaatctcggagtcatttttttcttcacattgtctttgattacgtgtatctttctgattattagtctgtggcggcacaatagacagatgcagagtaacgtgacgggactgagggattccaacaccgaggctcacgtaaaggccatgaaagtcttgatttcctttattatcctctttattttatacttcattggaatggctatcgagatatcttgctttactgttcgggaaaacaaacttttgctcatgtttgggatgactaccacggcaatctatccctggggccatagctttattctgatcctgggcaacagcaaactgaagcaggcaagtctacgggtactacaacaactgaaatgctgtgaaaaacgcaagaacctacgggtcacttag

SEQ ID NO: 30777 - DNA, 912 bp, Artificial Sequence
  Description of Artificial Sequence: Synthetic coding sequence
atggagagcgccctcccgtccattttcaccctcgtgattatcgctgaattcatcattggcaacctgtctaacggctttatcgtgctgatcaattgtattgactgggtgtcaaaacgggagctgtcaagcgtggataagctcctcattatcctcgctatctcgcgtatcggcttgatatgggaaatcctggtgtcctggttccttgctctgcactatctcgcgatattcgtctctggtacgggccttcggattatgatcttcagctggattgtgtctaaccacttcaatttgtggctcgctactatattcagtatattctacttacttaagattgcatccttctcttcaccagccttcctctacctgaagtggagggtgaataaggttatcttgatgatcctcctggggactctggtgttcctgttcctgaatctcatccagatcaatatgcacattaaggactggctggatcgctacgaacggaacaccacctggaatttttctatgtctgatttcgaaactttctccgtgagtgttaagttcactatgaccatgttcagcctaacaccatttaccgtggctttcatcagttttctgctgctgatatttagcttgcagaaacaccttcagaagatgcagctcaattacaaaggccatcgcgatcctcgcactaaggtgcacacaaatgcccttaagatagttatctctttcctcctgttttacgcgtccttcttcctgtgtgtcctgatttcctggatttcggagctttaccagaataccgttatctatatgctctgtgagacaatcggagtgttttccccatcttcccactccttcctccttatcctgggtaatgctaagttgcgacaggcgttcctattagtcgctgcgaaagtctgggctaaacgctag

SEQ ID NO: 30778 - DNA, 954 bp, Artificial Sequence
  Description of Artificial Sequence: Synthetic coding sequence
atgggcggcgtaatcaaaagcatcttcactttcgtgctgattgttgagttcatcatcggcaacctggggaactcttttatagctctcgtcaattgtatcgattgggtcaaagggcgtaagatttcttctgtggaccgcatcctgacagccctcgcgatttctcgaatatcactcgtttggctgatctttggttcgtggtgcgtgtctgtcttcttccctgccctgttcgctaccgaaaagatgtttcggatgttaaccaatatatggaccgtcattaatcatttttccgtgtggctggccaccggtctgggaacattctacttcctcaaaatcgccaatttctctaactcgatcttcctttacttgaaatggcgcgtgaagaaggtggtgttggtgctcctgctggtgaccagtgtatttctgtttttgaacatagcattaatcaatattcacataaatgcctcaatcaatggataccggaggaacaagacctgtagttctgactcttccaactttactaggttttccagccttattgtgctgacgtcaaccgtgtttatcttcatccctttcaccctgagtctcgccatgttcctccttctgatcttctccatgtggaagcataggaaaaagatgcagcacactgtgaagatatcaggcgacgcaagcactaaagcccacaggggcgtgaaatccgtgattactttctttctcctgtacgccatctttagtctatctttctttataagtgtgtggacctcagagcgactcgaagagaacttgattatcttaagccaggtgatgggaatggcctatccatcttgccactcatgcgtgctaattctgggaaacaagaaactccgccaagctagtctgagcgttctcctatggctcaggtacatgtttaaagacggggagccatccggccacaaagagttccgcgagtcctcctag

SEQ ID NO: 30779 - DNA, 1017 bp, Artificial Sequence
  Description of Artificial Sequence: Synthetic coding sequence
atgttgggcagatgcttcccgcccgacacaaaggaaaagcagcagctgcgcatgaccaagctctgcgatcccgcggaatctgaactgtccccattcttgatcaccttaatcctcgccgtactcctcgcggagtatctaattggtattatcgcaaatgggttcattatggccatccacgccgcggagtgggtacagaacaaggcagtatcgacctccggccgcatcctcgttttcctgtcagtctcaaggatagccttacagagcctgatgatgttagaaatcacaatctcctcaacctcccttagcttttattccgaagatgctgtgtactacgccttcaaaataagttttatctttctgaacttctgcagtctctggtttgcggcctggttgtcctttttttactttgtgaagattgccaatttcagctatccactgtttcttaagctccggtggagaataaccggactgattccatggctgctgtggctgtcggtgttcattagcttttctcatagtatgttctgtatcaatatttgcactgtctattgcaataactcttttcccattcatagctccaacagtacaaaaaaaacctacctcagcgagattaacgttgtcgggctggcattctttttcaacctgggcatcgttacacccctgattatgtttatcctgaccgctacattgctgatcctgtcactgaagaggcacacgctacatatgggatcgaacgccaccggcagcaacgaccccagtatggaggctcacatgggagcaattaaagctatctcctactttctgatcttatacatctttaatgcggtggccctttttatctatctctctaatatgttcgacatcaactcactttggaataacttgtgccagataattatggcagcctatccagcaagccattcaatccttctaattcaggacaaccccgggctaagaagagcttggaagcgtctgcagctccgattacacctgtacccaaaagaatggactctctag

SEQ ID NO: 30780 - DNA, 957 bp, Artificial Sequence
  Description of Artificial Sequence: Synthetic coding sequence
atggcggacaaggtgcagacgacattactgttcctcgctgttggagaattttcagtgggcattttaggaaatgcctttattgggcttgtgaattgtatggattgggtgaagaagcgaaagattgcctccatagacctgatcctgacatctctggccatatcgagaatatgcttgctgtgtgtgatcctgctcgattgctttattttggtgctgtatcctgatgtgtacgcaactggcaaagagatgcggattatcgacttcttctggacactgactaaccacttatctatttggtttgccacttgcttgtccatttactacttcttcaagattggaaacttctttcacccattgttcctgtggatgaagtggcgaatagatcgggtgatttcctggatactccttgggtgcgtggtgctgtctgtgtttatctcgttaccagccaccgagaacctgaacgcagatttccgcttctgcgttaaagctaaacgcaagactaatctcacttggtcttgtcgtgtgaacaagacacagcacgccagcacaaagctctttctcaatttggccacattgctccctttttgcgtatgtctgatgtcttttttcctgctgatcctttcattaaggcggcatatccgcagaatgcaactgagcgcaacagggtgcagagatccatcgactgaagcacacgtccgggcgctcaaggccgtaatttcgtttctccttctatttatagcttattacctttctttcctgatcgcaacttccagttatttcatgcctgaaactgaattggctgttatcttcggagagtccattgctctgatatacccttcttcacatagcttcattctcatactgggtaataacaagctgaggcacgcttcacttaaggtgatctggaaagtcatgtcaattctgaaaggaagaaaattccagcagcacaagcagatttag

SEQ ID NO: 30781 - DNA, 930 bp, Artificial Sequence
  Description of Artificial Sequence: Synthetic coding sequence
atgttctcgcccgccgataacatctttatcatactcattacgggggagttcatcctgggaatcctcgggaacggctatatcgccctggtgaactggatcgattggatcaagaagaaaaaaattagcacagtggattatattctgaccaatctggtgattgccagaatttgtctgatctctgtaatggtggtgaacggcatcgtgattgtgttgaaccccgatgtgtatactaagaacaagcaacagattgtgattttcactttctggacattcgcaaactacttgaacatgtggattacaacttgcctgaacgtgttttatttcctgaagattgcaagctctagccaccccctcttcctgtggctgaaatggaaaatagacatggtggtgcattggatcctgctcggctgtttcgctatcagtttgctggtgtcactgattgcagccatcgtgctcagctgtgattatcgtttccacgcaattgccaaacacaagagaaacattaccgaaatgttccacgtctccaaaattccctatttcgaacccctgactttgtttaacctgttcgccatcgtcccttttatcgttagccttatctcatttttcctgctggtgagaagcctctggagacacaccaaacagatcaaactttacgccacaggtagccgagacccttcaacagaggtgcatgtccgagccattaagaccatgacctccttcatttttttcttcttcctctactatatctcatccatactaatgacgttctcatatctcatgactaagtataagctggcagtcgagtttggcgagatcgctgcaattctgtatcctctcggtcacagtctgattttgattgtgctgaacaataaattgcggcagacattcgtccggatgcttacatgtcgtaaaattgcttgtatgatttag

SEQ ID NO: 30782 - DNA, 939 bp, Artificial Sequence
  Description of Artificial Sequence: Synthetic coding sequence
atgccgtcagcaatcgaggctatctacatcatcctgatcgctggcgaactgacaataggtatttgggggaacggatttattgtgcttgtgaactgtatagattggctgaaacgtagggacatcagcctgatcgacataattctgatctcactagctatctcaaggatctgtctattatgcgtgattagtctggatggattttttatgttactgttcccgggcacgtacgggaattcagtgttagtgagcattgtgaacgtggtgtggaccttcgctaataatagctccctgtggtttacctcgtgtctaagtatattctatctgctgaagatcgccaatattagtcaccctttcttcttctggttaaagctgaagatcaataaggtgatgctggccatcctcctgggctccttcctcatatcattgatcatttctgtccccaagaacgacgacatgtggtatcatctgttcaaggtcagccatgaggagaatattacgtggaagtttaaagtcagcaaaatccctggcacattcaagcagctgactcttaatctgggagtcatggtgccttttatactttgcttgataagcttcttcctgttactcttctctttagtccgccacactaaacaaatccggttacatgccaccgggttccgagatccatctaccgaagcccacatgagagccatcaaagctgttatcatcttcctcctgttgctcattgtatactaccctgtctttcttgtgatgaccagtagcgccctgattccacaggggaagctcgtcctgatgattggcgacatcgttacagttatcttcccaagcagccactcgttcatccttattatggggaatagcaaactgcgagaagcctttttgaagatgctgaggttcgttaaatgctttctgcgacgaaggaagccttttgttccttag

SEQ ID NO: 30783 - DNA, 3702 bp, Artificial Sequence
  Description of Artificial Sequence: Synthetic coding sequence
atgtggctctcccccgaggaggtgctggtagctaacgccctttgggtgaccgagcgcgcaaatccgttcttcgtactccagcgcagaaggggccacggtaggggtgggggtttgactgggctgctggtcgggactctggatgtggtgctcgattcatcggctagagtcgccccctaccgaatcctacaccaaacacaggatagtcaagtttactggaccgtcgcttgtggtagcagccgaaaagaaatcaccaagcactgggagtggctcgagaacaatcttctgcagacactgagcatttttgacagcgaggaagatataaccaccttcgtgaaagggaaaatccacgggatcatagccgaagaaaataaaaacttacagccccaaggggacgaagatcctggcaagttcaaagaagccgaactcaaaatgcgcaagcagtttgggatgcccgaaggtgagaagctcgtgaactactattcctgctcctactggaaaggccgagtgcctagacaaggctggctctatctgactgttaaccatttatgtttctatagcttcctgcttgggaaggaggtgtctctagtagtgcaatgggtggatattacaagattagaaaagaatgccaccctgctgtttccagaaagcattcgcgtcgatacgagagaccaggagctcttcttttcaatgttcttgaacatcggcgagacgtttaagctgatggagcagcttgccaatctcgctatgcgccagctcctggacagcgaggggtttttagaggataaagctcttccacgacccatcagacctcaccggaatatctccgcactgaagagagatctggacgcgcgggctaaaaatgagtgttaccgggcaaccttcaggctcccacgtgacgagcggctagatggacacactagctgcacactgtggaccccattcaacaaattacatatccctggccagatgttcatctctaataactatatttgttttgccagcaaggaagaggatgcatgccacctcataatcccccttcgggaagtgaccattgtggagaaggctgactccagtagcgtgctgccgtctcccctcagtataagcacaaagtccaaaatgacatttttattcgccaacctgaaggacagggattttctggtgcagaggattagcgattttttgcagaagaccccatccaaacagccgggtagcatcggatcacgtaaggcttctgtagtcgatccaagcactgagagtagcccagctccacaggaaggttcagaacagcctgctagccccgccagtccactgagcagcaggcagtctttctgtgcccaagaggcccccacagcctctcagggcttactcaaacttttccagaagaacagtccaatggaagatctgggcgccaagggggcaaaggaaaagatgaaagaggaatcctggcatatccacttcttcgaatacggccggggagtttgcatgtaccgaactgcgaagacgagggcgctggtcctgaagggaatacctgaaagtctgcgcggggagctctggcttctgttctccggcgcctggaacgaaatggtaacccatcctggctattatgctgagctcgtggagaaatccactggaaagtattctctggctactgaggaaatcgaaagggacctgcatcgctctatgcccgaacatccagccttccagaatgaacttgggatagctgcgttgcgccgggtcctcacagcctacgccttcaggaatcctactattggctactgtcaggccatgaatatcgttacatccgtgctgctcctctatggttctgaggaagaagcgttctggctcctggtggcgctttgtgaacgcatgctcccagactactataatactcgcgtggtgggagctttagttgaccaaggcatcttcgaagagctcacacgcgactttctgccacagctgagtgagaaaatgcaggacctcggcgttatctctagtatcagcctgtcttggtttttgacattattcctttcagtgatgccctttgaaagcgctgtggtcatcgtggattgctttttctacgaaggaatcaaggttatcctccaggtggccctcgccgtcctcgatgctaacatggagcagctgttaggctgttccgacgaaggagaagctatgacaatgctcgggcggtacctggataacgttgtcaacaaacaaagcgttagcccgcccatcccgcacctgcgggcgttactgtcttctagcgacgatccaccagccgaggttgatatcttcgaactcctaaaagtaagttatgaaaagttcagttcccttcgggccgaggatatcgaacaaatgcgatttaaacagagattgaaagtaatccagtctttagaggacacggctaagcgctccgttgttagggctataccagtggatatcgggttcagcattgaggagcttgaagatctttacatggtttttaaagctaagcacctggcatcccagtactggggctgttcgcggacaatggcaggccgccgcgatcctagcctgccatatttggagcagtataggatagatgccagccagttcagggaacttttcgcatctctgacgccctgggcttgtgggagtcacacacccctcctcgctggacgcatgtttcgactgctggatgaaaataaggacagtctgattaactttaaggaatttgttacaggcatgtccgggatgtaccatggagatctgacggaaaagttgaaagtgctctataaattgcatctcccgcccgccctgtccccagaagaagccgagtccgcgctagaggcggcccactatttcacggaggactcaagctcagaggaagccttgccacaagaggaacaggagggctccggcagcgaggaacggggagaggaaaaggggacgtcttctcccgactacaggcattacttgagaatgtgggcaaaggagaaggaggcacagaaggaaaccataaaagacctcccaaagatgaaccaggagcagtttatcgagctctgtaaaacactttataatatgttttctgaagaccctatggagcaggatctgtaccatgccatagctactgttgcctctctgttattacggattggtgaggtgggaaaaaaattctctgcaagaaccggtcgaaaacccagagactgtgcaacagaagaagatgagccccctgccccagagcttcaccaggatgcagcaagggagttgcagcctccagccgctggggaccctcaggccaaggcgggaggagacacccatctcggtaaggccccccaggaaagccaagtggttgttgaggggggctcaggggaaggccagggctcacctagccagctacttagcgatgacgagaccaaggatgacatgtccatgtcctcgtacagtgtggtctctaccgggagtctgcagtgcgaggatctggctgatgacactgtgctcgttggtggggaagcttgttctcccaccgccagaataggtggtacagtcgatactgactggtgcatttccttcgagcaaatcctggcatccattctcaccgagagtgtcctggttaacttctttgagaaacgagtggacattggattgaaaattaaggatcaaaagaaagttgaacgtcaatttagcaccgcttcagaccacgaacagcctggggtttcaggatag

SEQ ID NO: 30784 - DNA, 3753 bp, Artificial Sequence
  Description of Artificial Sequence: Synthetic coding sequence
atgtggctttcaccggaggaggtgctggtggcgaatgccctgtgggtgaccgagcgcgccaaccccttctttgtgctgcagcggcgccgggggcatggcaggggagggggcctcacaggattgctcgtgggaacattggacgtggtgctcgattccagtgcgcgggtcgccccttacagaatattacaccagacccaagactcccaggtatactggacagtagcctgcggatcttcccgaaaggaaataacaaagcactgggagtggctagagaacaatttactccagaccctatcaatattcgattcagaagaagatattacaacgtttgtgaaaggcaagatccatgggattattgccgaagaaaataaaaatctccagccccagggggatgaagaccctgggaagtttaaagaagctgaactcaagatgcggaagcagttcgggatgccagaaggcgaaaaactcgtgaactattattcgtgctcttactggaaaggtcgagtccctaggcaaggttggctctacctcacggtgaatcacctgtgcttctacagcttcttgctcgggaaggaggtcagcttagtggtgcagtgggtcgacattactagattggagaaaaacgccacgctgctgtttcccgagagcattagggtggacactcgcgatcaggagctgttttttagcatgttcctgaacattggcgagacattcaagcttatggagcaactggccaacctcgcaatgcggcagctgctggattctgagggattcctggaggacaaggccctgccacgccccatcaggccccataggaacatatcggcactgaaaagagacctcgatgctcgagccaagaacgagtgctatcgggcaacgttccggctgcccagagatgagcgtctcgatggccacaccagttgtacgctgtggactccatttaacaaactgcacatcccaggacagatgttcatttcaaacaactatatttgtttcgcatccaaagaagaggacgcctgtcaccttatcatccctctgagagaagtgactattgtggagaaagccgacagctcaagtgtattaccctctcccctgtccataagtacaaaatcaaagatgactttcctatttgccaacctgaaagacagggacttcctggtccagcgaatctccgactttctgcagaaaaccccgagtaaacagccaggctccatcggcagcaggaaggcatctgtggtcgacccctcgacagaaagtagcccagctccacaggagggctctgagcagcctgcgtctcccgctagtcccctgtcctctcggcagagcttctgcgcacaggaggcacccacagcctcccaaggcttgttgaagttgttccagaaaaactccccaatggaggacctaggagcgaagggggccaaggaaaaaatgaaagaagagtcatggcacattcatttttttgaatatggccgcggcgtgtgcatgtatcggaccgccaagacacgggctctggtcctgaagggaatcccagagtccctgcgcggcgagttgtggctgctgtttagcggggcctggaatgagatggtcacccaccccgggtactatgccgaactggtcgaaaagtctaccgggaaatattctctggccactgaagaaatcgaacgagaccttcaccgaagcatgccagaacaccccgccttccagaatgaactcggaatcgccgccctgcgcagagtgttgactgcctatgcttttaggaaccctaccataggttactgtcaagcaatgaatatagtaacgtcagtgttgcttctgtatgggtcagaagaggaggccttctggctactagtggctctgtgtgagaggatgctccctgactactacaacacccgagtggtaggggctctggttgaccagggcattttcgaagagctgacaagagatttcttgcctcaattatccgagaagatgcaagatcttggggtgatcagttctatcagcctttcttggtttttgacattgttcttgagcgtcatgccatttgagagcgctgtggtgatcgtggactgttttttttacgaaggcattaaagtgatccttcaagtagctcttgccgtgttagatgcaaatatggagcagctactggggtgcagcgacgagggagaggccatgactatgcttggccgctacctggataatgtagttaacaaacagtccgtgagtcctcctatcccacaccttagagccttgctgagcagcagcgatgatccaccagccgaggtcgatatattcgagctgttgaaagttagttacgaaaaattttctagccttcgggccgaagatatcgaacagatgcggttcaagcaacgcctgaaggtgatccagtcgctcgaggacactgcaaagcggagcgtcgttagagctatacctgtggacattggcttctcgatagaggagctggaagacctttacatggttttcaaagctaaacatctcgctagtcagtactgggggtgcagtcgtacaatggctggccgccgggacccttcactgccgtacttggaacagtaccggattgacgcgtctcagttccgtgaattgtttgcatccctgaccccctgggcctgtggaagccacacaccactcctcgcaggtcgcatgtttcgcctactggatgagaacaaggacagtctgattaatttcaaggaatttgtaacaggaatgagtggtatgtaccatggagatctgacagaaaaactaaaagtactttacaagctccacctgccgccagctctttcaccggaggaggcggaatctgcattggaggccgctcattattttactgaggactctagcagcgaggccagccccttagcgagtgacctggatctgtttttgccctgggaagcacaggaagccctgccccaggaggaacaggagggttctggatcagaagaacggggagaagagaagggcacgagttcgccagactatcggcactatctccgcatgtgggccaaagagaaggaagcgcagaaggaaaccataaaagaccttcctaagatgaaccaggaacaatttatagagctatgtaaaaccctctacaacatgttctccgaggatcccatggagcaggatctctaccacgctatagcgacggtcgctagcctactgctgcgaatcggagaggtcggcaagaaattttccgcccggacaggacggaagccacgcgactgcgccaccgaagaggatgagcctccagctccagaattacaccaggacgccgctcgagagcttcagccacccgccgctggagacccccaggctaaagctgggggagacacgcatctaggcaaggctccacaggaatcacaagttgtcgtggagggtggctcaggagaaggtcagggatcaccttcacaactgttaagcgacgacgaaaccaaggacgatatgtctatgtcatcatactccgtagtgagcactggtagtttgcagtgtgaggacctcgctgacgacacggtgctcgtgggcggggaggcatgctcccctaccgcccgaatcggtggtacggtagacactgattggtgcataagcttcgagcagatacttgcgtcaatcctgactgaatctgtcctcgtcaattttttcgaaaaaagagtggacattgggctcaaaatcaaagatcagaaaaaggtggagcggcagttctctaccgcttctgatcacgaacagccaggagtgtctggctag

SEQ ID NO: 30785 - DNA, 1176 bp, Artificial Sequence
  Description of Artificial Sequence: Synthetic coding sequence
atggccgggcggagagatcctagtctcccctatttggagcagtacaggattgacgcctctcagttccgtgagctcttcgccagcctgactccatgggcatgcggctcccacaccccacttctggcaggtcggatgttccggttgcttgacgaaaataaggacagtcttataaactttaaagaatttgtgactggaatgtccgggatgtaccatggagaccttaccgagaaactcaaagtcctgtacaagttacacctaccccccgccctgtcacctgaggaagcagaatccgccctggaggcagcccactattttaccgaggacagctccagcgaggaagccctccctcaggaagaacaggagggttccggatccgaggagcgcggggaggagaagggcacttcaagccccgattaccgccactacttgagaatgtgggctaaagaaaaggaggcacaaaaagagacgataaaggatctgcccaagatgaaccaggagcaatttatcgaattgtgcaaaacgctctacaatatgttctctgaagacccaatggaacaggacctctaccatgcaatcgccaccgtggctagcctgttactgcgcatcggcgaagtaggcaagaagttctcagcgagaacgggccgcaaaccccgggattgtgccacagaagaagatgagccgcctgctcctgagctgcatcaggacgcagcccgagaacttcaacctcctgctgctggtgatcctcaagctaaagccggcggggatacacaccttggcaaagcacctcaggagagccaggtagtggtggagggcggctcgggtgaaggtcagggatcaccgtctcagctgctgtctgacgacgaaacaaaggatgatatgtccatgtcaagctactctgtcgtgtcgacggggagcctgcagtgtgaagatctcgccgatgacacggtcctggtcggaggagaagcctgttcacctactgcccgcattggtgggactgtggacacagattggtgcatctcattcgaacagatcttggcttcaattttaaccgagtctgtgctagtaaattttttcgagaaaagggtcgacatcgggttgaagatcaaggaccaaaaaaaggtcgagagacagttctccactgctagcgaccacgagcagcccggcgtgtccggatag

SEQ ID NO: 30786 - DNA, 975 bp, Artificial Sequence
  Description of Artificial Sequence: Synthetic coding sequence
atgggcgacctgctgccccgggcctggccaggtgccggatgtactgagacgcagactacaagccagggcccacaggagctcgccgtacccacagcggaatgttattcatgttcattctatttctgcgtgtgtccagaggctctgcctcaagaagagcaagaaggcagcggctcagaagaacggggggaggaaaagggtaccagctcccctgattacagacattacctcagaatgtgggccaaggagaaggaggcacagaaagaaaccataaaagacctcccaaagatgaatcaggagcagttcatcgagctctgcaaaaccttgtataatatgttttctgaggatcctatggaacaggatttgtaccacgccattgctactgtcgcatcactgctactgcgcatcggagaggtggggaagaagtttagcgcccggacagggcgcaagccaagggactgcgccaccgaggaggacgagcccccggctcctgaactgcatcaggatgctgccagggagttgcagccacctgccgctggcgaccctcaggccaaggccggtggcgacacccacctggggaaggcacctcaggaatctcaggtcgtcgtagaggggggatcaggcgagggacagggaagcccaagtcaactgctgtctgatgatgagaccaaggatgacatgtctatgtcaagctactccgtcgtatccaccggcagtctgcagtgtgaggaccttgccgatgacacagtgctggtgggaggagaagcctgttctccgacagccagaatcggagggacagtcgatacagactggtgcatttctttcgaacaaatcctcgcgagcattttgacggaaagcgttctcgttaacttcttcgagaaacgagtagatattggactcaaaatcaaggaccaaaagaaggttgagaggcagttctcgaccgcttccgatcatgagcagcctggcgtgagtggatag

SEQ ID NO: 30787 - DNA, 1137 bp, Artificial Sequence
  Description of Artificial Sequence: Synthetic coding sequence
atgtcaaaggaaccattgatcctttggctaatgatcgaattttggtggctgtatttaacccctgtcaccagtgaaaccgttgtaactgaggtgctagggcacagggtgaccctgccctgcctatattcttcatggagccacaatagtaattccatgtgttggggaaaggaccagtgcccctatagcgggtgcaaagaggccctgattaggactgacggtatgagagtaacttctagaaaaagcgcaaaatacagactgcaaggaaccattccgcggggcgatgtgtcgctgaccattctgaacccttccgagtccgacagtggggtctactgttgcagaatagaagtgcccggctggttcaatgatgtcaaaatcaacgtgcggctgaatcttcagcgggcatcgactaccacacaccgcaccgctactactactactagacggaccacaaccacctcgcctaccacaactcggcagatgaccacaacacctgcagctttgcccaccaccgtagtgaccacccccgacctcaccacgggcactcctctacagatgacaaccattgcggtgttcaccaccgccaacacttgtctctctcttaccccttcaacattgcccgaggaggcaaccggcctgctgacacccgagccctccaaggaggggccgatcttaaccgcggagtccgagactgtgcttccgtcagattcctggagctctgtggagtccacttctgcagataccgttttgctcacctcaaaggaatctaaggtctgggacctgccttccacttcgcacgtctcaatgtggaaaacgtctgactctgtgagttctcctcagcccggcgcttctgacaccgccgtgccggagcagaacaaaacgactaaaaccggccaaatggacgggatccccatgagtatgaagaacgaaatgccgatttctcagctcctcatgattatcgcaccttcacttggctttgtcctgttcgcattgttcgtggcttttttgttgcgtggaaagttgatggaaacttactgcagccagaagcacaccagactggactacatcggtgactctaaaaatgttttgaacgatgtgcagcatggccgagaggacgaggatggcctcttcactttatag

SEQ ID NO: 30788 - DNA, 1053 bp, Artificial Sequence
  Description of Artificial Sequence: Synthetic coding sequence
atgtctaaggagcccctgatcctctggttgatgatcgagttttggtggttgtaccttacacctgtgacaagtgaaacagtggtgacggaggtactgggtcatagagtgactttgccttgcctctatagttcatggagtcacaactccaattccatgtgttggggaaaagaccagtgtccttactctgggtgcaaggaagctctgattcgcaccgacggaatgcgcgtaactagccgcaaatccgctaaatatcgacttcagggtacgattccaaggggtgacgtgtcgttgaccattcttaacccctccgaatcagattcaggggtgtattgctgtcgaattgaggtgcctggatggttcaacgacgtcaagatcaatgtacgcctcaacctgcaacgcgcgagtacgacaacgcacaggacggccacaacgacaacacgcaggaccaccaccacgtcccccaccacgacaaggcagatgactacaacacccgctgccctccccaccactgtggttacaacacccgatctcacaaccggaacccccctccagatgactaccattgctgtcttcacgaccgctaacacctgcttgtccctgacaccgtctactcttcccgaggaagccaccggccttctcaccccagaaccaagcaaggagggtcccattctgacggcagaatcagagacagtactgccatcagattcctggtccagcgtggagagcacctcagctgataccgttctgctgacaagtaaagccagtgacacagcggtgccggagcagaataagacaactaaaacagggcaaatggatggaatcccaatgtcaatgaagaacgagatgccaatttcccagctgctcatgatcatcgcaccatccctcggtttcgtgctttttgccctttttgtggcattcctgctgcgcgggaagctgatggagacgtactgctcccagaaacacacccggttagactacatcggggattccaaaaatgttctcaacgacgtgcagcatggcagagaggacgaagacgggctcttcaccctctag

SEQ ID NO: 30789 - DNA, 3504 bp, Artificial Sequence
  Description of Artificial Sequence: Synthetic coding sequence
atgcccaacagcgttctttgggccgtcgatcttttcggacgtgtttatactttgtctaccgcaggacagtactgggagatgtgcaaggactctcagctcgagttcaaacgagtctccgccactacacagtgttgctgggggatcgcatgtgacaaccaggtctacgtttacgtgtgtgcatccgacgtcccgattagacgccgcgaagaagcctacgaaaaccagaggtggaaccccatggggggtttttgtgagaagctgttgctgagcgaccgctggggctggagtgacgtgagcgggctacagcataggcccctagatagggtggctctgccaagtccacactgggaatgggagtccgactggtacgtggacgagaactttgggggagaacccacggagaagggcgggtggacatacgccattgattttccagcaacctataccaaggataagaagtggaattcctgcgtacgtaggcgcaagtggattaggtaccgaagatacaagtcccgagatatctgggctaagattcccagtaaggatgaccccaaagagttacccgatccttttaatgacctgtcggtaggtggttgggagatcaccgaagagccggtggggaggctgtccgtgtgggcagtttcgctgcagggcaaggtgtggtaccgcgaagatgtgtcccactctaatcctgagggctcttcatggtcactcttggacacccctggcgaggttgtccagatcagctgcggacctcatgatcttttatgggccacgctctgggagggccaagctttagtaagagagggcatcaacaggtcgaaccccaagggatcctcgtggagtatcgtggaaccgcctggatccgaaaacggtgttatgcatataagtgtaggggtatccgtggtttgggctgtgacaaaggattggaaggtctggttccgacgaggagtgaactcccataacccctgcgggacttcatggattgagatggttggcgagatgacaatggtcaatgtcggcatgaacgatcaagtttggggtataggatgtgaagaccgagctgtttatttcaggcaaggggtgaccccatccgagttgtccgggaaaacctggaaggccattatcgccgctcgggagtgcgatcgtagtcatagcgggagcagtagctcgctgctttctgcaggctgtttctttggagatgaagtgcgcggttctggtgaaagcgccccatcggacactgatgcatcctcggaagttgaacgccctggcccggggcagattcttccagcagagcccctcgacgacagtaagaatgccactggaaactccgcaagtgggctgggagctggccggacagcggaggatacagttgaagatgcgtgtccggcagagggatctagagaggctaggcccaatactcaccccggccccgcacctacaccggctgaattgccttggactaatatcgatctgaaagaagccaaaaaagtcccctctcactcagctgccgggttccctgaaacaacttccctgtcttcactcggcctgctcccactgggcctggaagagccctacggtgtagacgaccaccctctttgggcctgggtctctggaggaggctgtgttgtagaagcttgcgcgatgcccagatggttcactgttcaggccgcaggacttagcagtagcgtgcacatgctgagtcttagcattacccccgcccaaaccgcagcttggaggaagcagatattccaacaattgaccgaacgaacaaagcgcgaactggaaaattttcgccattatgagcaggcagtcgagcaatccgtgtgggttaagactggcgccttgcagtggtggtgtgattggaagccccacaagtgggtggacgtcagactggctcttgagcagttcacaggccacgatggggtgagagacagcattctgtttatctactatgtggttcatgaagagaagaaatatatccacatattcttgaacgaggtagtggcccttgtgcccgtactgaatgaaactaaacatagctttgccctgtatactccggaaaggactcggcagaggtggcccgttcgcctcgccgcggcaactgagcaggacatgaatgactggttagccctgctgtccctctcgtgttgtgagtcccgcaaggtacagggacggccctccccccaggcaatttggtcaatcacctgtaagggcgacatattcgtctctgagccaagtcctgatctggaggcccatgaacaccccctgccttgcgaccagatgttttggcggcagatggggggacacttgcgtatggtcgaggctaacagtcggggcgtggtttggggcatcggatacgaccataccgcctgggtctataccggcggctacggcggcggctgctttcaagggctggcgtcatccacatccaatatctacacccagtccgacgtaaagtgcgtgcacatttatgagaaccagcgatggaacccagtcacaggttacacctccagccgcggactgccgaccgaccgctatatgtggagcgacgcctccggcctgcaggagtgcaccaaggcaggcactaagcccccttccctgcagtgggcctgggttagtgactggttcgtggattttagcgtgccgggcggcactgatcaggaggggtggcagtacgcgtctgactttccggcatcgtatcacgggtcgaagaccatgaaggacttcgttcggaggagatgctgggcgagaaaatgtaagttggtaacttcaggcccttggttggaagtgccacccatagcactgcgtgacgtgtccatcattcccgaaagccccggtgcagaaggaagcggccattccattgctctgtgggccgtgagtgacaaaggggacgtcctctgcaggctgggtgtgtccgagctaaacccggcaggcagctcctggctacacgtgggaaccgatcagccctttgcttcgatatcaatcggtgcgtgttaccaagtgtgggctgtcgccagagacggctccgctttttaccggggcagcgtgtacccgtcccagcccgctggagactgttggtaccacatcccatcccccccacgacagcgtctcaaacaagtgagcgccggccagacttcagtttacgcacttgacgagaacggcaatctgtggtatagacagggcatcacaccatcctatcctcagggcagctcctgggagcacgtatcaaataatgtctgccgggtttctgttggtcccctggatcaggtctgggtgattgctaacaaggttcagggaagccattccctttcgaggggaactgtatgccacaggactggagtccagccgcacgaacctaaaggacatggatgggattatgggatcggtggcggttgggatcatatttctgtcagggctaatgcaacaagggctcctcgcagctcgtcccaggagcaggaacctagcgcgccaccagaagctcacggaccagtttgctgctag

SEQ ID NO: 30790 - DNA, 306 bp, Artificial Sequence
  Description of Artificial Sequence: Synthetic coding sequence
atgccaaattctgtgctgtgggccgtcgatctgttcgggcgggtgtataccctgtcaacggctggacaatattgggaaatgtgcaaagatagccagcttgaatttaaacgcgtctccgccacaacgcaatgctgctgggggatagcctgcgataaccaagtgtatgtttatgtctgcgcaagtgatgttccaattcgccgaagagaggaagcctacgagaatcagcgatggaatccaatgggcgggttttgtgaaaagctcctactgtctgatcgttgggggtggtctgacgtttctgggttgtag

SEQ ID NO: 30791 - DNA, 3498 bp, Artificial Sequence
  Description of Artificial Sequence: Synthetic coding sequence
atgcccaatagcgtgttgtgggcagttgacctctttggacgtgtgtacactctctccacagctggccagtattgggaaatgtgcaaggacagtcaactggagttcaaacgggtcagtgctaccacacaatgctgctggggtatcgcgtgcgataaccaggtttatgtctatgtgtgtgcaagtgacgtccccatcaggcgtagggaggaggcctacgagaaccaaaggtggaacccaatgggtggtttctgtgaaaaacttctgctgtcagatcgttggggatggtctgacgtgtccggcctgcagcacaggccgctggaccgggtagcactgccctctccacattgggaatgggagtctgactggtatgttgatgagaacttcgggggcgaacctacagaaaagggagggtggacctatgcgatcgatttcccagcaacatacaccaaagataaaaaatggaactcttgcgtgagacgtcgaaaatggattagatatcgaaggtataaatctcgggatatctgggccaagatcccatctaaggacgatcccaaagaattgcccgaccccttcaacgaccttagcgtcggaggctgggagatcacagaggagcctgttggaaggctctccgtttgggcggtgtctttacaaggtaaggtttggtatcgtgaggacgtaagtcacagtaaccctgagggaagttcttggagtttgttggacacgccaggtgaagttgttcagatcagctgcggtccacacgacctactgtgggccaccctgtgggaaggccaggccttggtccgcgagggcatcaaccgcagtaatcccaaggggagtagctggagcattgtcgagcctccggggtcagaaaacggagtcatgcatattagtgtgggagtgtcagttgtgtgggctgtaacaaaggattggaaggtgtggtttcgcagaggagttaattctcataacccttgcggcacctcatggatcgaaatggtcggagaaatgaccatggttaatgtcgggatgaacgatcaggtctggggtataggatgcgaggatagagctgtatatttccggcaaggcgttacccccagcgaacttagcgggaagacatggaaggcgataatagccgctcgggaatgtgacaggtcccactctgggagtagtagttccctgctttcggcaggttgtttcttcggcgacgaagtgcgagggtctggagaaagtgccccttcagataccgacgcttcttctgaagtggaacgacctggtccgggccagatcctcccagccgagccccttgacgacagtaaaaacgccactgggaactcagcgagcggactgggagccggacggacagcagaagacaccgtggaagatgcttgtcctgccgaaggctctcgcgaggccagacctaacacacacccaggtccagctcccactccagcagagctcccttggaccaatatagatttgaaagaggccaagaaggtgccatcacactccgcagctggattccctgaaacaacctccctgtcatctctgggcttgttgccacttgggctggaggagccctatggtgttgacgaccatcccctttgggcctgggtttctgggggcggatgcgtcgttgaggcctgtgctatgccgaggtggttcacggtgcaagccggtctgtccagtagcgttcacatgctctctctatcgattaccccagcacaaactgccgcgtggcgaaagcagattttccagcagcttaccgagcgcacaaagcgggaactggaaaactttcgccactatgaacaggctgtggagcagtctgtgtgggtgaagacaggcgcactgcaatggtggtgtgactggaaaccacataaatgggtcgacgtcaggctcgccttagaacaattcaccggtcatgatggcgtgagggactccattctgttcatttattatgtggtgcacgaggagaaaaagtacattcacatattcctcaatgaggtagtggcattggttccagtgctgaacgagacaaaacactcatttgcgttgtacactcccgaacgcaccagacaacgctggccagttaggctcgctgcagccacagagcaggacatgaatgactggctcgcgctgctgtccctcagctgctgcgagtctaggaaagtccagggacgaccatcacctcaagcgatttggtcgatcacttgtaagggggacattttcgtcagcgaaccttctccagacctggaggcacacgaacacccactgccctgtgaccagatgttttggcgacaaatgggggggcacttgcggatggtggaggctaacagtaggggcgttgtgtggggcatcgggtatgaccacacagcttgggtatataccggggggtatgggggcggctgctttcagggcctcgcctctagcacctccaacatatatacccaatctgacgtcaaatgcgtacatatctatgaaaaccagaggtggaatccagtcacagggtataccagcaggggactccccaccgaccggtacatgtggtcggacgcttcagggctgcaggaatgtaccaaagcagggaccaagccaccaagcttgcaatgggcgtgggtttccgactggttcgtcgatttttctgtgcctggcggtaccgaccaggagggatggcagtatgcgagcgactttcccgcatcttatcacggttccaaaaccatgaaagactttgttagacgtcgctgttgggcaagaaaatgcaaactggtcacgtcaggcccctggctggaagtcccccccatagccctgagagacgtgagtattattccagagtcccccggggccgagggctccggtcattccattgctctctgggcggtgtctgacaagggagacgtgctgtgtcgtttaggagtaagtgaacttaatcctgcgggcagcagttggctccatgtcggcacggaccagcccttcgctagcatttccatcggggcttgttaccaagtttgggccgtcgcgagagacggctccgccttctaccgggggagcgtttatccttcccagccggccggcgattgctggtatcatatcccctcccctccaaggcagaggcttaaacaagtctccgcaggccaaacctctgtgtacgcactggacgaaaacggcaatctgtggtataggcagggtatcaccccctcttatcctcagggaagcagctgggagcacgtgtcaaataacgtctgcagagtaagcgtaggcccactcgaccaagtgtgggtgatcgcaaataaagttcagggctctcactccctcagccgaggcactgtgtgccatcgcactggggtgcagccacacgaacccaagggccatggatgggattatggtattggggggggttgggaccatatcagtgtccgcgccaatgccactcgtgctccgcgaagttccagccaagagcaggagccatccgcgccccccgaggcccatggtccagtttgttgttag

SEQ ID NO: 30792 - DNA, 2331 bp, Artificial Sequence
  Description of Artificial Sequence: Synthetic coding sequence
atgggtggattctgtgagaagttactgctgtctgacaggtggggttggtcagacgtctctgggctccagcatcgcccccttgaccgcgtcgccctgccttccccgcattgggagtgggagagtgactggtatgtggatgaaaatttcggaggcgaaccaaccgagaagggtggctggacttatgccattgattttccggctacttacaccaaggataaaaagtggaacagctgcgtgagaaggcggaaatggatccgttacagaagatacaagagtcgggacatatgggcgaagatccccagtaaagatgatcccaaagagctgcctgaccctttcaatgacttgtccgttgggggttgggagatcacagaggagccggtggggcgtctgtctgtgtgggcagtatcattgcaaggaaaagtgttgtgcccctgcctggccagccaagtttggtatagagaggatgtatcccattctaatcctgagggaagctcctggagcctgctcgacacccctggcgaagttgtccagatctcatgtggccctcacgatttgctttgggccaccctgtgggagggccaggcgttggtgcgggaaggaatcaaccgcagcaacccaaaaggaagctcttggagcatcgtggagccccctggctctgagaacggagtcatgcatatttccgtcggggtgtcagtggtctgggcagtgacgaaagactggaaagtgtggttccgcaggggagtcaactcccacaacccctgtggcacgtcctggattgagatggtgggcgagatgaccatggtgaatgtcggcatgaacgaccaggtctgggggataggttgtgaggatcgcgccgtatattttagacaaggagtcactccatcggaactaagtgggaaaacttggaaggcgataatcgctgcacgcgagtgcgacaggagtcactctggctcatcaagctccttgctgtctgcgggttgttttttcggagacgaagtgcgcggaagtggggaaagtgcccccagtgacaccgacgccagcagcgaggtggagcggcctggaccagggcagatactgcccgccgagcctctcgatgacagcaaaaacgccaccggcaacagcgcaagcggcctgggagctgggcgaaccgctgaggacaccgtggaagacgcctgtcccgccgaaggatcaagagaagcacgcccaaatacgcaccccggtccagcccctacccccgccgagttaccgtggaccaatatagacctgaaagaggcaaaaaaggttccgagtcacagtgccgcgggtttccctgagacgacctctctgtccagcctaggattgctgccattgggccttgaagaaccgtacggagtggacgaccaccccctttgggcatgggtatccggggggggttgcgtcgtagaagcctgtgctatgcccaggtggtttacagtgcaggcagggctgtcctcctcggtgcacatgctctctctgtccatcacccccgcccagactgcggcctggagaaaacaaattttccaacagttaaccgagaggactaagcgtgagcttgagaacttccgacactacgaacaggcagtggaacagagtgtatgggtgaaaacgggtgccttacagtggtggtgcgactggaagccccataagtgggtcgatgtgcggttggccctcgaacagtttacaggacacgatggtgtcagagattccattctgttcatttattacgtggtgcacgaggagaaaaagtatatccatatttttcttaacgaggtcgtcgcactggttcctgtgttgaacgagaccaagcatagctttgctttgtacacccctgagcgcacaaggcagaggtggcctgtccgactcgccgcagctaccgaacaggatatgaacgattggctggccctgctgagcctcagttgttgcgaaagtcgtaaagtacagggccgtccctctccacaagccatatggtccatcacatgcaaaggagatatcttcgtttccgagccaagtcccgacctcgaagctcatgagcaccctctgccttgcgatcagatgttttggcgacagatgggaggacacctccggatggtggaggccaactcaaggggtgtggtatggggaatcgggtatgatcacactgcatgggtgtacactgggggctacggagggggatgctttcaggggcttgcgagttccacctccaatatatacacgcagagcgatgtgaagtgcgtgcatatctatgagaatcagcgctggaatcccgtgacaggctacacctcttcccgggatcgtatatccccctgctggtag

SEQ ID NO: 30793 - DNA, 627 bp, Artificial Sequence
  Description of Artificial Sequence: Synthetic coding sequence
atgccccctaagaaagacgttccagtgaagaagcccgctgggccgagtatttccaaacccgcagccaaaccggcagctgccggagcccctcctgcaaagacaaaagccgagcctgccgtgccccaggccccgcagaaaacccaggaacctcctgtagacctgtcaaaggtggttatcgaattcaataaagaccagctcgaggaattcaaggaagcctttgagttgtttgaccgcgtgggcgatggaaaaattctgtacagccagtgcggtgacgttatgcgcgccctggggcagaatccgaccaatgccgaggtcttgaaggtgttgggcaacccaaagagtgacgagctgaagtctagacgagtggacttcgagacctttctaccaatgttgcaggccgtagccaagaacaggggtcagggcacatatgaggactatttagagggcttcagggttttcgacaaagaaggaaatggcaaggtgatgggggccgagcttcgtcacgtgttgactaccttgggtgagaaaatgaccgaggaagaagttgaaactgtcttggctggccatgaggattcgaacggatgcataaactacgaagccttcctgaagcatattctgtccgtgtag

SEQ ID NO: 30794 - DNA, 2790 bp, Artificial Sequence
  Description of Artificial Sequence: Synthetic coding sequence
atgacaaaaaaacgaaagaggcagcacgatttccagaaagttaagctaaaggtgggtaaaaagaagcccaagctgcagaacgcaacaccaacaaacttcaaaacaaaaactatccaccttccagagcagttaaaggaggacgggaccctgccaaccaataacaggaaattgaacatcaaggacctgctcagtcagatgcatcattataacgccggggttaagcaatcggctttgcttggcttgaaggatcttcttagccagtatccttttatcatcgatgcccatttgagcaacatcttgagtgaggttaccgctgtgttcacggataaggacgctaacgtacgactggctgccgtccagctgttgcaatttctcgcacctaagatccgggccgagcaaatatcaccgttcttccctctcgtcagtgcacacctcagcagcgcaatgacgcatatcactgaagggatccaggaagactctctgaaagtgttagatattctgctggagcagtacccggctctgattacaggacgcagcagtatcctgcttaaaaatttcgtcgagctcatatcccaccaacagctgagcaaggggctgattaacagagatcgttcccagtcctggatactatcagtgaaccctaacagaaggctcacttctcaacagtggcgcttgaaagtgctcgtcagactgtccaagtttctccaggctttggctgatggtagcagtcggctgcgcgagagcgaagggctccaggagcagaaagagaacccccatgccacaagtaacagcatttttatcaactggaaagaacatgcgaatgatcagcagcacatccaggtgtacgagaatggcggatctcagcccaacgtatccagccaattccgcttgaggtatctggtgggaggactgagcggcgtggacgaaggtctctccagtactgagaatcttaaggggttcatcgagatcattatacccctactcattgagtgttgggtggaggcagttcccccccagctcgccactcctgtgggcaacgggatcgagcgcgaacctctgcaagtgatgcagcaggtcctaaacatcatttccctcctgtggaagctgtcaaagcagcaagacgagacccataagttggaatcttggctgcgaaaaaattatctgatagacttcaagcaccacttcatgagtcgcttcccttatgtcctgaaagagatcaccaagcacaaacgtaaggaacccaacaagagcatcaagcattgcaccgtgttgtctaataatatagatcatctcctcctgaacttaactctgtcagatattatggtgagccttgcaaatgcttctaccctgcagaaggactgttcatggattgagatgatccgtaaattcgtgacagaaaccctggaggacggatcacgtctgaactctaaacagctgaaccggctcttaggagtgagctggcgactgatgcagatccagccaaaccgagaagacaccgaaactctcatcaaggcagtatacactctataccaacagagggggctgatcctgccagttcgaacgctgctccttaaattcttcagcaaaatctaccagacggaggaactcaggagttgtaggttccggtaccgttccaaggtgcttagcagatggctggccggactgccattacaactggcccatctgggatctcggaatcccgagttgtcgacccagctaattgacatcatacacactgccgccgccagagccaataaagagctactgaaatcgctgcaggccactgcgctgcggatttacgacccccaagaaggggctgtcgtcgtgctgcctgccgactctcaacaacgccttgtgcagcttgtctacttcttgcccagcctcccggccgaccttctgtcgaggctctcccggtgctgtatcatgggccggctctcatcctccctggccgccatgctgatcgggatattgcacatgcggtccagcttttcgggttggaaatacagcgctaaggactggctgatgagtgatgtggattatttcagctttctgttctctaccctgaccggattctcgaaggaggagttgacatggttgcagagcttacgcggggtcccccacgtgatccagacccagctctctccagtgctgttatatttaaccgacctcgatcagttcttacaccattgggatgtgacggaggctgtctttcacagcctgctggttatcccagcaagatcacaaaattttgatatcctacagtctgccataagcaaacacctcgtaggcttaaccgtcattccggactctacagctgggtgcgtcttcggggttatatgtaagctcctcgatcatacatgcgttgtgtccgaaacactattaccttttctcgccagctgttgctacagcttgctatacttcttgctaacaattgagaagggagaagctgagcacctcagaaagagagacaaactgtggggcgtctgcgtgtctatcctggcccttctgcccagagtgcttaggcttatgctacagagcctcagggtcaaccgcgtgggccctgaggagctgcccgtggttggacaactgctgcgtctcctgttgcagcacgccccgctgaggacacacatgctgacaaacgcaatcttggtgcaacaaattattaagaatattaccacgctgaagtccggaagtgttcaggaacagtggctgaccgatcttcattattgttttaacgtgtacattacgggacacccacagggccccagtgccctggccacagtttattag

SEQ ID NO: 30795 - DNA, 516 bp, Artificial Sequence
  Description of Artificial Sequence: Synthetic coding sequence
atgcaacaggtgctgaatatcatatcactgctgtggaagctatctaagcagcaggatgagactcataagctggagtcatggctccggaaaaattatctgatagactttaagcaccacttcatgtctcgcttcccctatgtgctgaaggagataacaaaacacaagagaaaagaacccaataaatctattaaacattgcacggtgctctccaataatattgaccatctgctcctgaatttgactctaagcgatataatggttagtctcgccaatgcctccacactgcagaaagattgcagttggatagagatgataaggaagttcgtgaccgaaactctcgaagatggttctaggcttaacagtaagcaactgaaccgactgttaggagtctcttggagactcatgcagatacagcctaatcgggaagataccgagaccctgattaaagccgtgtacactttataccagcagaggggtctgatactcccagtgaggaccctgttgctcaaattctag

SEQ ID NO: 30796 - DNA, 2394 bp, Artificial Sequence
  Description of Artificial Sequence: Synthetic coding sequence
atgacaaaaaagcggaagcggcagcacgattttcagaaggttaaactgaaggttggcaagaagaagcccaagttgcagaatgccacaccgacgaactttaaaacaaagaccatacatctgcctgagcagttaaaggaggatggaacgctacccactaacaataggaagctaaacatcaaggatttattgagccagatgcaccactacaacgccggagtcaagcagtccgctctcctgggcctgaaagacctgctgagccagttcttggcacctaagattcgggccgaacaaattagccctttttttcctttggccctggcggatgggtcctcaagactgcgcgaatcagaaggactccaagaacaaaaggaaaacccacacgctaccagtaatagcatcttcataaactggaaggaacatgccaatgaccagcagcatatccaagtttatgaaaatggcgggtcccaaccaaatgtgagctcccagttccgcctgcgctacctggtcggcggcctgagcggcgtcgatgaaggcctgtccagtacagaaaacttaaagggttttatagagattatcatccccctcctcatcgagtgctgggtggaggccgttcctccccagttggcgacccctgttggcaatggtattgagcgggagcctctgcaggtgatgcaacaggtgcttaatattataagtctgctctggaaactgtcaaaacagcaggatgaaactcacaaattagagtcttggctgaggaagaattacctcatcgatttcaaacaccacttcatgagtaggtttccctatgtgctgaaagagatcactaagcacaaaagaaaagagccaaacaagagtattaaacactgtacggtgctgagcaataatatcgatcatctgctcctgaatctgactctttctgacataatggtaagcctggcgaacgcctcaactttgcagaaagactgtagctggattgaaatgattcgcaagtttgtgaccgaaaccctggaagacggaagccggctgaacagcaagcaattgaaccggctgcttggggtgagctggcggctgatgcagatacagcctaatagggaagataccgagacgctcatcaaggccgtgtacactctctaccagcagcgaggacttattctccctgtgagaacgctcctgcttaagtttttcagtaagatttaccaaacagaagaactccgatcgtgccggtttcggtaccggtctaaagtgttgagtcgctggctggccggtttgccccttcagctagctcacctggggagtagaaatcctgagctctcaacccagttgatcgatattatccacaccgctgctgcaagggccaataaggagctgctgaaatctctgcaggctactgcgctgaggatttacgatccccaggagggcgccgtggtcgtgctccctgccgactcccagcaaagactagtgcagctggtatactttctcccctctctgcccgccgacctgctttcgaggttgagccgctgttgcattatggggcgtctttccagcagcctggccgcgatgttgatcggcattctgcatatgaggagtagcttttctgggtggaaatatagtgcgaaggattggctgatgagtgacgtggattacttttccttcctttttagcactctaactggcttctcaaaggaggaacttacctggctccagagcctgcgaggcgttcctcatgtgatacagactcagctcagcccggtgctgctctaccttaccgatctggatcaatttctccaccattgggatgtaaccgaagctgtttttcattcattgcttgtgatacctgcgcgatctcagaactttgacatcctgcagagcgctatttccaagcacctcgtaggccttaccgtgattccggattccaccgccggctgtgtcttcggcgtcatttgtaagctcctcgatcatacatgtgtggtctcagagacccttctgccatttttggcgagttgctgctattcacttctgtatttcctgctgactattgagaagggcgaggccgagcatctacggaagagggacaagctctggggggtttgcgtgtctattctcgcactgctcccgcgcgtcctacgcctcatgttgcaatctctcagagtcaaccgggttggtcctgaggagctcccagtggtcggtcagcttctgcggcttctcctccaacacgcccctctcagaacccacatgctgaccaacgccatcctggtgcagcaaattataaaaaatatcaccacactgaaaagcggcagcgtgcaagagcagtggctgactgatttacattactgcttcaatgtgtacatcacaggacacccccaaggaccttcagccttagcaactgtatattag

SEQ ID NO: 30797 - DNA, 2742 bp, Artificial Sequence
  Description of Artificial Sequence: Synthetic coding sequence
atgtcacggatgaccaagaaaagaaagcggcagcatgacttccagaaagtgaaactaaaggtggggaagaaaaagcccaagctccagaacgccacccctactaatttcaaaactaagacaattcaccttcccgaacaactgaaggaggatggtacgttgccaacgaataataggaaactgaatatcaaggatctgctgtctcaaatgcaccattacaatgccggcgttaagcagagcgccttactcgggcttaaagatctcctaagccagtatcctttcatcatagacgcccacctgagcaacatccttagtgaggtcacagctgtttttaccgataaggatgctaacgtacgtctggctgctgtgcaactgttgcaatttctagcgccaaagatccgtgcggagcagattagccctttctttccactggtctccgcccatctgtcatccgccatgacacatatcacagaggggattcaggaagactcccttaaagtgctagacatcctgcttgaacagtaccccgccttaatcaccggccgttctagtattctgctcaagaactttgttgaactgatatcccaccagcaattatcaaagggcctaattaacagggaccgcagccagtcttggattttgtccgtgaatcctaacagaagactcacgtctcagcagtggaggctcaaggttctagtgcgcttgtcaaagtttctgcaggcattggccgatgggtcttctcgactccgtgagtcagagggcctgcaggaacaaaaagagaaccctcatgctacttctaacagtatctttattaattggaaggagcacgcgaacgatcagcagcacattcaagtatatgaaaatgggggcagtcagccaaatgtatcctcacagttccgactgcggtatctagttgggggcttgtccggagtggacgagggcctgagctcgactgagaatctgaagggtttcatcgagatcataattcccttacttattgaatgctgggtggaagccgtgcccccacagcttgccaccccggtcggcaatggtattgaaagggaaccactccaagttatgcagcaagtcctgaacattatttccctgctctggaagctgtccaagcagcaagacgagacacataagctggagtcgtggctgaggaagaactacctgatcgactttaaacaccactttatgtctaggttcccgtatgtgctcaaagagattaccaagcacaaacgcaaggaacctaataaatctattaaacattgtaccgtgctgtccaataacatcgaccatcttctccttaatctcactttatctgacatcatggtcagtctcgctaatgcaagcaccctgcagaaggattgttcttggatcgagatgatccggaaatttgtcaccgagactttagaagacgggagtcggttgaatagcaagcagctgaataggctgctcggggtttcttggagattgatgcagatccaacccaatcgcgaggacaccgagaccctcataaaagctgtgtacacactgtaccagcagcgcggccttatattgcccgtaagaactctgttactgaaattcttctctaaaatataccaaaccgaagaactgaggagctgtaggttccggtatagaagcaaggtgttgtctagatggttggcgggactgcccttgcagctcgcccacctcgggtcccgcaacccagagttgtcaacacagctgatcgacatcattcacaccgcagccgccagagccaataaagaacttctgaaatctctgcaggctactgctctgagaatctacgatccacaggagggtgctgtggtagtactgccagcggatagccaacaaagactcgtgcagcttgtctactttctcccaagtctccccgctgaccttcttagcaggcttagtcggtgttgtattatgggcaggctgagttcaagcttagcagccatgctgattggcatcctgcatatgcgctcttcgttttctggatggaaatactctgctaaagactggcttatgtctgatgtggactacttctctttcctttttagcacgctaactgggttttcgaaagaggaactcacgtggctgcagagcctgagaggcgtcccccacgttattcagacacagctgtccccagtgctgctatatctgaccgatcttgatcaatttttacaccattgggatgtgacagaggcagtctttcactcccttctggtaattccagctaggtcccaaaactttgacattctccagtccgccattagtaaacatttagtgggtcttactgtcattcccgactcaacagctggctgcgtttttggggtgatctgtaagctccttgaccatacttgtgtggtctccgaaacactactcccatttctagcgagctgctgttactctcttctttacttcctacttacgatagagaagggggaggcagagcacctgagaaagagattaatgctccagtcgctccgcgtcaaccgcgttggtccggaagaactgccagtggtggggcagctcctccggttactgctccagcacgctcctctgcggactcacatgctaactaatgctatcttagttcagcagattattaaaaatatcaccaccctcaagagcggctctgtgcaggagcagtggctcacggacctgcactattgcttcaatgtatacataacggggcacccacagggcccttctgccctggctacagtttattag

SEQ ID NO: 30798 - DNA, 1302 bp, Artificial Sequence
  Description of Artificial Sequence: Synthetic coding sequence
atgcatcactataacgccggggtgaagcaatctgctcttctgggtttaaaggatcttctgtcccaatatccgttcattatcgacgcccatttgagtaatattctcagcgaggtaaccgctgtgtttactgacaaggatgctaacgtccggctagcagccgtgcagctgcttcagtttttggcccctaaaatccgcgcagaacagatcagccctttctttccactggtgtccgcccacctgtccagtgctatgacacatatcacagagggcatccaggaagacagtctcaaggtgctggacattctcttagagcaatatccggcgctgatcaccggacggtcctctattctactcaagaatttcgtggaactgatttcacaccagcagttgtccaaaggcttgattaatcgcgaccgctctcagtcgtggatcctttcagtgaatcctaatagaagacttacatcacagcagtggcggttaaaggttttggtccggttatctaaattcctacaggcgcttgcggacggttccagcaggctgcgagaatcagaggggctccaggagcagaaggaaaacccacatgccacatcaaattcaatttttattaattggaaagaacatgccaacgaccagcaacatatccaggtctacgaaaacggcgggagccaacccaacgtcagctcccagttccgactgcggtacttggtaggcggtttgtccggagtagacgagggattgagcagtactgaaaatctgaaaggtttcatcgaaatcataattccgctactcattgagtgctgggttgaagctgtaccaccacagttagccactccagtagggaacggaatagagagggagcctcttcaggtcatgcaacaggtgctgaacatcatatccttgctttggaagttgtctaaacaacaagatgagacacacaagctggaatcatggcttagaaagaactacctgattgactttaagcaccacttcatgtctaggtttccgtatgtgctgaaggaaattaccaagcataagagaaaagaacctaataagtcaatcaagcattgcactgtgctatctaataatatcgatcatctgctgctcaacctgactctcagtgatattatggtgagcctggctaacgcgagcaccctgcaaaaggactgcagctggatcgaaatgatccgaaagttcgtgactgagacactggaagacggctctcgcctcaacagcaagcaactcaaccgcctgctcggcgtgtcttggcgcctcatgcagatccagcctaatagggggcggtag

SEQ ID NO: 30799 - DNA, 3405 bp, Artificial Sequence
  Description of Artificial Sequence: Synthetic coding sequence
atgaccagcctttatggtcgccacgccgaaaagacgacagacatgccaaagccaagtgcgcctaaggtgcacgtgcagagatcagtttccagggacaccatcgctatccacttttctgcctcgggcgaggaagaggaggaagaagaggaggaatttcgtgagtacttcgaggaaggactggacgatcagtccatcgtgacaggtctcgaggctaaggaagacctctatttagagcctcaggtagggcacgacccagccggacctgcagccagtccggtactcgctgatggactgtccgtgagccaggctcctgccatcctgccagtttccaaaaacactgtcaaactattggagagtccagttcccgcagctcaggtactgtctaccgtccctctcgctgtgtctccaggctcgtcaagctcaggtcctctcgcttccagcccctccgtgagcagtctgtcagagcagaaaacatcctcctcgtctccactgtcttcgccttccaaaagccccatcctgagcagtagcgcatcaaccagcacactctcctccgccaagccgttcatgagcctggtgaagtctctgagcacagaggtagaaccgaaggaatccccacatcctgcaaggcacaggcacctgatgaagaccttggtaaagtcactcagcacggatacatcccgccaggaaagcgacactgtgtcttacaaaccgccagatagcaagctgaatctgcaccttttcaaacagtttacccagcccaggaacactggcggagattcgaagactgcaccttcatcccctctgacctctccctccgatacacggtcattttttaaggtgcccgaaatggaggctaaaattgaagacacaaaaagacggctgtctgaagtaatttacgagcccttccaactgctgtccaaaattataggggaagagagcggatcgcacagacccaaggccctgagctcttccgctagtgagctgtcaaatcttagcagcctgaacggccaccttgagtccaataacaactactccatcaaggaagaggagtgcgatagtgagggggacggatatggctcagattctaatattccacgcagtgaccatcctaaatccacaggcgaaccaactagggaaattgaacttaagagttctcagggctcctccctaaaggatctcggcctgaaaacctcaagtttagtactcgagaaatgctctttgagcgcgcttgtgagcaaggaggatgaagaattttgcgagctatatactgaggacttcgacttggaaactgaaggtgagagcaaagtggacaaactgtcagacattcccctgaaaccggaagtactggctgaagacggagtggtccttgactctgaggatgaggtcgacagcgctgtgcaacaccccgagctccctgtgaagaccctaggattctttatcatgtgcgtgtacgtgtatctcatcttgccccttccacattatgtatctggtctgttccttggcatcgggctggggttcatgacagctgtatgcgtgatatggttttttaccccaccatccgcgcataagtatcataaattacataagaatctgaggcactggaataccaggtccctggatatcaaggaacccgagatccttaaggggtggatgaacgagatctataattacgaccccgaaacctaccatgcaactctgacccattctgtcttcgtgaggttggagggcgggaccctccgcctgagtaagcccaacaagaacatttctcgccgggctagctataatgagcccaaacctgaggtgacctacatcagtcaaaaaatctacgacctcagtgactctaaaatttacctcgtacccaagacgctagccaggaaacgcatctggaacaaaaaatacccgatttgcattgagctgggtcagcaggacgatttcatgtccaaagctcagacagataaagagacatccgaggagaaaccgcctgcagagggttccgaggatccaaagaaaccccctcgaccccaggagggcacacgctcatctcagcgtgatcagattctgtatttattcgggcgcactggccgggaaaaggaggagtggttcaggagatttatattggctagtaagctaaagtccgagatcaaaaagtcatctggggtctccgggggtaagccagcaccagtgtttctggctccaggcctgctccctgcccacagccggcacaactccccgtccggccacttgacacactcaagatcttcaagcaaagggagcgtcgaggaaattatgtctcagcccaaacagaaggagctggccgggtcagtgcgacagaagatgctcctggactattcagtttacatgggaagatgtgtgccccaggagagtcggtcccctcagagaagcccgttgcagagcgcagagtcctcccctacagctggcaaaaagctccctgaagtccccccctcagaggaagaggagcaggaggcctgggtgaacgcactgcttggccgcatcttctgggactttttaggcgagaaatactggtcggacctcgtgagtaaaaagatccaaatgaagctcagcaagattaaactgccgtatttcatgaatgagctgactcttactgaactggatatgggggttgccgtccccaaaattctgcaggctttcaaaccttatgttgaccaccaaggactctggatcgacctggagatgtcgtataacggctcattcctcatgactttagaaacaaaaatgaacttaaccaaacttggaaaggagcccctcgtcgaagccctgaaagtgggggaaatcggcaaagagggatgcagacccagggctttctgccttgcagacagcgatgaagaaagttcttctgcaggatcttccgaagaagatgacgccccagaaccttccggaggcgataagcaactcctgccaggggccgagggatatgtggggggacatcgaaccagtaaaatcatgaggtttgttgacaaaatcactaaatcgaaatattttcagaaggctacggagaccgagttcataaaaaaaaagatcgaagaagtgtctaacacgcctttgctcctgaccgtggaggtgcaagaatgtcggggtactctggccgtgaacatcccccctccaccgaccgacagagtctggtatgggttccgtaagcctccccacgttgagttgaaggcgcggccaaaattgggagagcgggaagttaccctggtacatgtcaccgactggatcgagaaaaagctggagcaggaatttcaaaaagtgtttgtgatgcctaacatggacgatgtgtatattactatcatgcatagtgctatggacccacggtcgacctcatgccttctgaaggaccccccagtggaagctgccgatcaaccgtag

SEQ ID NO: 30800 - DNA, 591 bp, Artificial Sequence
  Description of Artificial Sequence: Synthetic coding sequence
atgtggttcatgtatctattgtcgtggctcagtctttttatccaggtcgctttcataaccttggccgtcgccgccggactttactacctagctgagctcatcgaggaatacaccgttgccactagtcgcataataaaatacatgatctggttctcgacagccgtgctgattggcctgtatgtgtttgaaaggttcccaaccagcatgatcggcgttggcctattcactaacctggtctacttcggccttcttcagaccttcccctttattatgctgaccagccctaattttatactgtcctgtgggcttgtcgtggtcaatcactaccttgccttccagttcttcgccgaagagtattacccgttctccgaggtcctggcctactttacattctgtctgtggattattccctttgccttttttgtctcgctgtctgcgggagagaacgtgttgccctctacgatgcagcccggggacgatgtagtctcaaattacttcacaaagggcaagaggggaaaaaggcttggaattctggtggtcttttccttcatcaaagaggcaatcttaccatcccggcagaagatctattag

SEQ ID NO: 30801 - DNA, 1233 bp, Artificial Sequence
  Description of Artificial Sequence: Synthetic coding sequence
atggttctgaaagccgagcatacacggtccccaagcgccaccctccctagtaatgtgccatcttgtagaagcctgtcctcgtctgaggacggtccttccggcccatctagcctagccgatggtgggcttgcccacaatctacaggattccgttcgccaccgtattctgtatctgagtgaacagttaagggtggagaaagcttccagagacggcaacactgtcagttatctcaagctggtgagcaaggcggaccggcaccaggtgccgcacatacaacaggcattcgagaaagtcaatcagcgagctagtgccacgatagctcagatcgagcatcggctccaccagtgccaccagcagctgcaggaattggaagagggctgccggcctgagggcctgttgcttatggccgagtctgatcccgcgaattgcgaacctcctagcgagaaggctttgctgtctgagccacctgagccagggggagaggacgggcccgttaatttaccccatgcatccaggccatttattctggaatcaaggtttcaaagtctccagcagggcacatgtctggagacggaggacgtagctcagcagcagaacctgctgctacagaaagtcaaagccgaactggaagaggctaagcgattccacatctctttgcaggaatcctaccactcgctaaaagaaaggagtctcaccgacctgcagttattgctagagtcgctgcaggaggaaaaatgcagacaagctctgatggaagaacaggtaaacggaagactacagggacagcttaacgaaatctataacctcaaacacaatctggcctgttccgaggaacggatggcatacttgtcttatgaacgggcaaaagaaatctgggagatcaccgagaccttcaagtctcgaatctctaagctcgagatgctacagcaagtgacccagctcgaggccgctgaacacctccaatcaaggccaccgcaaatgcttttcaaatttctctctccccgactgagtctagctaccgttctgcttgttttcgtgtcaacactatgtgcttgtcctagcagcctgatatctagcagattgtgtacctgcactatgctgatgcttattggcctgggtgtcctcgcatggcagcggtggagggcgatccccgccacagattggcaggaatgggtcccttctcgctgccgcctgtacagcaaagattccggcccccccgccgacggcccctag

SEQ ID NO: 30802 - DNA, 1233 bp, Artificial Sequence
  Description of Artificial Sequence: Synthetic coding sequence
atggtgctgaaagctgaacacaccaggagcccatccgccacgctccccagtaacgtgccctcttgtaggagtttgtcttcttctgaggacggtcccagcggcccgtccagtctcgcagacgggggtctggcacacaacttgcaggattcggtgcggcaccgcatcctgtaccttagtgaacagctgcgcgttgagaaggcaagccgcgacgggaatactgtctcttatcttaaactcgtgtctaaggcagaccggcaccaagtgccccatatccaacaagcatttgagaaggtgaaccagcgggcttcagcgactatcgcccagattgagcatcggctgcatcaatgtcaccagcagctgcaagaactggaggaaggatgtaggcctgagggattgctgctaatggcagagtcggatccagcgaattgtgagccacctagtgaaaaggcactgctgtctgaaccccctgagcccggcggggaggatggccctgtaaatctgccacacgcctcaaggccatttatcttagaatcaagatttcagtcgcttcagcagggaacatgcctagagacggaggatgttgcccaacagcagaacctgctactgcaaaaggtgaaggctgaacttgaggaggcaaaacggttccacatcagcctccaagaatcctaccactccctgaaagagagatcactgacagacctgcaactcttgttagagagcctgcaagaggaaaagtgccggcaggcactgatggaagagcaagtcaatggtcggctgcagggtcagctgaatgagatctacaacctaaagcacaatcttgcttgctccgaggagagaatggcgtatctctcctatgagcgggccaaagagatttgggaaatcaccgagacatttaagtcccgcattagtaaactcgaaatgttacagcaggtgacacagttagaagcagctgagcatctgcagagccgcccaccacagatgctattcaaattcttgagccctcgcttgtccctagcgacagtccttctagtgtttgtgtccacactctgcgcctgtccaagcagcctcatctcatcccgactgtgcacctgcacaatgttgatgctcattggactgggagttttagcttggcaacggtggcgggctataccggccaccgattggcaggagtgggtaccatcaagatgtagactctacagcaaagactcgggtccaccagctgatggaccctag

SEQ ID NO: 30803 - DNA, 1068 bp, Artificial Sequence
  Description of Artificial Sequence: Synthetic coding sequence
atggaagagggagagaggtccccactgctgtcacaggaaaccgctggccagaaacctttgtcagttcatcggcctcctaccagtggatgcctggggcccgtgccacgtgaggaccaggctgaagcctgggggtgttcatgctgtcctcctgaaacaaaacatcaggccttgtccggtacccccaagaagggaccagccccatccctcagcccgggctcatcatgtgtgaaatatctcatctttctgagcaactttccgtttagcctgctaggcctcctggcgttagccattggcctgtggggtttagctgtgaaggggtccctgggcagcgaccttggaggacccttacctgccgaccctatgctcggattagcactgggtggtctcgtcgtaagtgccgtgtccttggctggatatttgggtgctctatgtgagaacacatgtctgttacgcgggttctccggaggaatccttgcattcctggttctagaagcagtcgctggggcactcgtggttgctctctggggacccctgcaggatagcctcgagcacacgcttagggtggccatcgcccactaccaggacgatccagatcttagatttctgcttgaccaggtccagctgggattgcgatgttgcggagccgcctcataccaggattggcaacagaacctctacttcaactgttcgtctccaggcgtgcaggcctgctctttgccagcttcctgctgtatcgaccctcgggaggatggagcctctgttaatgatcagtgtggcttcggtgttttgcggctcgacgctgatgctgctcagagggtcgtttatctcgaggggtgcggccctccactgcgtcgctggctgagagctaatctggccgcctcgggtggatacgccattgccgtggtgctcctccagggagccgagcttctgttagctgctcgtcttttaggtgccctggcagcaagaagaggcgccgcttatggaccaggtgcgagaggcgaagatcgcgccggacctcagagtccttctccgggagcaccccctgccgctaaacccgcccgcggctag

SEQ ID NO: 30804 - DNA, 708 bp, Artificial Sequence
  Description of Artificial Sequence: Synthetic coding sequence
atggaagaaggagagagatcgcctttgctttcccaggaaacagccggccaaaagcctttatccgtgcatagaccgcccaccagcggttgtctggggcctgttcctcgtgaagatcaagcagaggcatgggggtgttcgtgctgtcctccagagacgaaacatcaggctctgtctgggactccaaagaagggacctgctccaagtctctccccaggcagtagctgtgtgaaatatctgatcttcctatccaacttcccattctctctactgggtctgctagcgctggctatcggcctgtggggcctggctgtaaaaggcagcttgggcagcgatctcggggggccgctccctgctgaccctatgctcgggctggccttaggcggcctggtcgtgagtgcggtcagtctggctggctacctcggagccctgtgcgaaaacacatgtctgttaagaggctttagcggcgggatcctggccttcctggtgctcgaagcagtcgctggcgccctggttgtagccctttggggcccgcttcaggattcgttggaacacactttaagagtggcaattgcccattaccaagacgacccggacctccggtttctactcgaccaagtgcagttgggcttgagatgctgcggggctgcttcctatcaagactggcaacagaatctgtattgcctttcaagcccatgtagcagccagtag

SEQ ID NO: 30805 - DNA, 762 bp, Artificial Sequence
  Description of Artificial Sequence: Synthetic coding sequence
atggcccattataagaccgaacaggatgattggcttatcatatatttgaagtatctgctgtttgtgttcaacttctttttttgggtcggcggggccgctgtgctcgctgtgggcatttggaccctcgtggaaaagagtggctacctgagcgtgcttgcctcgtctaccttcgccgcttccgcttacatactcatctttgctggcgttctcgtgatggtgaccgggttcttgggctttggggccattctgtgggaacggaaaggctgtcttagtacatacttctgcctgctgttagtgatctttttagtcgagctcgtggctggcgtgcttgctcacgtgtattatcagaggctatctgacgaactgaagcagcatctgaataggactctggccgaaaattatgggcagccaggggccacacaaattaccgcctcggtggaccggctgcagcaagacttcaaatgttgtggatctaactcctcagctgactggcagcattcaacatatattctgcttagggaggcagagggtcgacaggttcccgattcttgttgtaaaactgtcgtggtacgctgcgggcagagagcccaccctagcaatatttataaggtcgagggtggttgtttaacaaagctcgagcagtttctggctgaccaccttcttctgatgggggctgtcgggataggggtcgcctgtctgcagatctgcggtatggtactcacatgttgcctgcaccagcgtctacagcggcatttttactag

SEQ ID NO: 30806 - DNA, 732 bp, Artificial Sequence
  Description of Artificial Sequence: Synthetic coding sequence
atgcgtagtggcggggggcgcaacgcctgggatactagaggcgcttgcgagcaggtcgggggagctgccgtgttggccgtgggcatctggactctagttgagaaatcaggttacctgtccgtactcgcctcatctactttcgctgccagcgcatatatcctgatctttgcgggggtattggtcatggttacaggcttcctgggatttggagcaatcctgtgggagcggaagggatgtctgagcacctacttttgtctgctgctggtaatcttcctggtcgagctggtcgcaggtgttctggctcacgtttactatcagcgtctgtctgacgagttaaaacagcacctcaaccgcactctcgcagagaactatggtcagccaggggcaactcagatcaccgcatccgtagaccggctgcagcaagacttcaaatgttgtggtagcaacagctccgccgattggcaacattcaacatacatccttcttagagaagctgagggaagacaagtgcccgactcttgttgtaagacggtagtggttcggtgtggacagagagctcaccccagcaacatctacaaagttgaggggggatgccttactaagctggaacagtttctcgctgatcatctgttactgatgggggccgtagggattggtgttgcatgtctacagatatgcggaatggtgctgacctgctgtttgcatcagcggctgcagcggcacttttactag

SEQ ID NO: 30807 - DNA, 762 bp, Artificial Sequence
  Description of Artificial Sequence: Synthetic coding sequence
atggctcactataaaaccgagcaggatgactggctcataatttacctcaaatatctcttgttcgtgtttaacttcttcttttgggtgggcggggccgccgtgttggcggtcggcatttggacactggtagagaagtccggctatctctctgtcttggcgagttccacatttgctgcctccgcctatatcctgatctttgcaggggtgctggtcatggtaactggattccttggcttcggagcaattttgtgggagcggaagggttgcctgagtacatacttttgcctgctgctggtgatcttcctcgtggagctggtagctggcgtgctcgctcacgtctattatcagcgcctaagcgatgaactgaaacaacatctgaaccgcaccctcgccgagaactacggtcagcccggcgccacccagataactgcttccgttgataggcttcagcaggacttcaagtgttgcggatccaattcttcagccgactggcagcattccacttatatcctgctacgggaggctgaaggtcgccaggtgccagactcctgctgtaaaacagtcgtggtcagatgtgggcagagggctcacccctccaatatttacaaggtggagggtggctgccttacaaagttggagcagttcctggccgatcacttgctactgatgggagctgtgggcataggcgttgcatgtttacagatatgcgggatggtgcttacctgctgcctgcaccaacgcctccaaaggcacttttactag

SEQ ID NO: 30808 - DNA, 642 bp, Artificial Sequence
  Description of Artificial Sequence: Synthetic coding sequence
atgcactactataggtacagcaatgccaaggtgagttgctggtataagtacctgctgtttagctataatatcattttttggttggccggcgttgtgtttctcggggtggggctgtgggcttggtccgagaagggcgtactttcggatctcaccaaggtgacacgcatgcatgggatcgacccagtggtgctagtcctgatggtgggggtcgtcatgtttactttaggtttcgctggttgcgtaggtgcccttagagaaaacatctgcctcttgaactttaatcagtgttgtggcgcttatgggcccgaagactgggacctgaacgtctactttaactgttccggggcttcatactcgagagagaaatgcggcgtcccgttcagctgctgcgtgccagaccctgctcagaaggtggtgaacacgcagtgcgggtacgatgtacggattcagttgaaatccaagtgggacgaaagcatcttcaccaaagggtgcatccaggccctcgaatcatggttaccacggaatatatacattgtcgctggcgtgttcattgccatctcactcctgcaaatttttgggattttcctagcacggaccctcatctctgacattgaggccgtgaaagcaggacatcatttttag

SEQ ID NO: 30809 - DNA, 813 bp, Artificial Sequence
  Description of Artificial Sequence: Synthetic coding sequence
atgcattattacagatatagcaacgccaaagtatcctgttggtataagtatcttcttttcagctacaatatcattttttggctggccggagtggtttttttaggcgtgggactgtgggcttggtctgaaaagggggtgttgtcggacctaacgaaagtgaccagaatgcatggaatcgacccagtggtactcgtgttaatggtgggggtcgtgatgttcaccctgggattcgccggctgcgtcggggctcttcgggagaatatatgcctgctgaatttcttttgtggcacaatcgttctgatcttctttctggagctggcagttgcagtgttagcttttctgttccaggactgggtacgcgatcgttttagagaatttttcgagagcaatattaaaagctaccgcgacgacatcgacctgcagaatttgattgacagtttgcagaaggccaatcaatgttgcggcgcctatggccccgaggattgggatctgaatgtctattttaactgttctggagctagctactctagggaaaagtgcggagtcccttttagctgctgtgtccctgatcctgctcagaaggtggtgaatacccagtgcggttatgacgtgaggatccagcttaagtcaaagtgggatgagtccatcttcacaaaggggtgcatccaggcattggaatcatggttacccaggaacatatacatcgtggctggagtgtttatcgctattagccttttgcagattttcggtatctttctggctaggacattaatcagcgatatcgaagccgtcaaggcaggtcaccatttttag

SEQ ID NO: 30810 - DNA, 672 bp, Artificial Sequence
  Description of Artificial Sequence: Synthetic coding sequence
atggagcgcaaagtgctgccatgcttcttatgcctgttccagggcgtactgtctgacttgacaaaggtgactaggatgcatggcatcgatccagtggttcttgttcttatggttggcgttgtcatgttcaccctgggctttgcaggctgcgtgggcgctttgcgggaaaacatatgcctgctgaactttttctgcggaaccatagtgttgatcttcttccttgagctggccgtggcagtgctggcgttcctttttcaggactgggtgagggaccgctttcgcgagttctttgaaagcaacattaagtcgtatcgcgacgatatcgacctgcagaacttgatcgactctctgcaaaaagcaaatcaatgctgcggggcttatggaccagaagattgggacctcaatgtgtacttcaactgctcaggagcctcctattctcgcgaaaaatgtggagtacccttctcatgctgcgttcccgaccctgcacagaaagttgtgaacacccagtgcgggtacgacgtgaggatacagcttaaatcaaaatgggacgaatccatcttcactaagggctgcatccaggcattggagagttggcttccacggaatatttatatagtggcaggggtgttcattgcaatttcactccttcaaatctttgggatctttctgtag

SEQ ID NO: 30811 - DNA, 813 bp, Artificial Sequence
  Description of Artificial Sequence: Synthetic coding sequence
atgcactactaccgctatagcaatgctaaggtgtcttgttggtacaaataccttctcttctcctacaatattattttttggctggcaggagttgtgtttctgggcgttggcttatgggcctggtccgagaaaggtgtgctctctgacctgacaaaggtgaccaggatgcatgggattgaccccgtggtgcttgtgctgatggttggtgtagttatgtttacactcggcttcgccgggtgtgtcggggcactgcgagaaaacatatgtctgctgaactttttctgtggtacaatagtgctgattttctttctggaattagccgtggcggttctggctttcttgttccaggattgggttagagatcgcttccgggagttttttgaaagcaacatcaagtcttatcgcgacgacatcgatctacagaacttgattgatagtctgcagaaggctaatcagtgttgtggggcttatggccctgaggattgggaccttaacgtctatttcaattgctctggtgcatcttacagccgcgaaaaatgcggggtaccatttagctgctgcgtgcccgatcctgcacagaaagtcgttaacacgcaatgcggttacgacgtcaggatccagctgaaatctaaatgggacgagagcatttttaccaagggctgcattcaagctctggagagttggctacccagaaatatctacatagtcgctggcgtgttcattgctataagtctcctccagatatttggaatattcttagccagaaccttaatctccgacatcgaggccgtgaaagccggccaccacttttag

SEQ ID NO: 30812 - DNA, 450 bp, Artificial Sequence
  Description of Artificial Sequence: Synthetic coding sequence
atgcactactatagatactccaacgccaaagtctcgtgttggtacaagtatctgttgttctcctacaatatcatcttctggttggcgggggttgtgttccttggagtcggcctgtgggcctggagcgaaaagggagtcttgagtgatctgacgaaggtcaccaggatgcatgggatagaccctgtggttctggtgcacccactctcgggctcctgccagcggtactttagctgtcccgtgttcctgagcctcgcattcctgtcgcatcctaaaaacctgcctcggccgtatgggagcttgccgttcttcccacgacagcttctgatctgggccgtgtgtacaccctccttcgcacccccaactatgcctcacgtggctgagagttgcctgtcccaactgtctaccttagctttcttctccctctgctcaacccgccactgcacctcttag

SEQ ID NO: 30813 - DNA, 762 bp, Artificial Sequence
  Description of Artificial Sequence: Synthetic coding sequence
atgcattactatagatatagtaacgccaaggtcagctgctggtacaagtacctgctgttttcttacaatataattttttggggcgtcctgtctgacttaaccaaggtcacccgaatgcatggaatcgaccccgtagtacttgtcctgatggttggcgtggttatgttcaccctcggattcgccggatgcgtgggagcattgcgggaaaacatctgcctgctgaatttcttctgcggtaccatcgtactaatcttcttcctagagttggcagtcgcagtgctggcatttttgttccaagactgggtgcgcgaccgctttagggagttttttgagtccaatattaagtcttaccgggatgatatagatttgcaaaatttaatcgacagccttcagaaagccaatcagtgttgcggcgcttatggacctgaggactgggatttgaacgtctacttcaactgcagcggagcatcatattctagggagaaatgtggagtccccttctcttgttgtgtacccgaccctgctcagaaggtggtcaacacccagtgcggctacgacgtccgaattcagttaaaatctaaatgggatgaaagtatctttactaaagggtgcatacaagccttagaatcatggctaccccgtaacatatacatcgtcgctggagtgttcatcgcaataagcctgctgcaaatcttcgggatcttcctggccaggacgctgataagcgacatcgaagccgtgaaagcggggcatcacttttag

SEQ ID NO: 30814 - DNA, 813 bp, Artificial Sequence
  Description of Artificial Sequence: Synthetic coding sequence
atgcactactataggtattccaatgccaaggttagctgctggtacaaatatttattgttttcttataacattattttctggcttgccggagttgtgtttctgggtgtcggcctgtgggcctggagtgagaaaggtgtgcttagcgacttaaccaaggtaactcggatgcatggtatagatcctgtggttctagtgcttatggtgggcgtggtaatgttcactctcggctttgccggctgcgtcggcgcgcttcgtgaaaatatctgtctcttgaatttcttctgtggaaccatagtgctgatttttttcctggagctggctgttgctgttctggctttcctgtttcaagattgggttagggacaggttccgagagttctttgagtctaacattaagagttacagagacgatatcgacctgcagaatttgattgatagcctgcaaaaagctaatcagtgttgcggagcttatggccctgaagactgggatctgaacgtgtactttaattgttccggcgcatcttactctcgggaaaaatgtggcgtgcctttcagctgttgcgtgccagaccccgcacaaaaggtggtcaacactcagtgtgggtacgacgtgcgaattcagctgaaatccaagtgggacgagtcaatcttcacgaagggctgcatccaggccctggagtcctggctgccaaggaacatttacatagtggctggagtgtttatcgctatttcactcctgcagatcttcggtatttttctggctaggaccttgatttctgacattgaagccgtcaaggcagggcaccacttttag

SEQ ID NO: 30815 - DNA, 444 bp, Artificial Sequence
  Description of Artificial Sequence: Synthetic coding sequence
atgcattattataggtattctaatgctaaagtgtcatgctggtacaagtaccttctcttcagctataacatcatcttttggaatcagtgctgtggtgcctacgggcccgaggactgggatttgaatgtctacttcaactgtagcggagccagctacagccgagaaaaatgcggggtgcccttcagttgctgcgtcccagatccagcccagaaagtcgtcaatacccaatgcggttatgacgtacgcatacaactcaaatctaagtgggacgaatctatttttacgaagggatgtatccaggctctggagagctggctccctaggaacatttacatcgtggctggcgtgtttattgctattagcctgttgcaaatcttcggcatttttttggcccgaaccctaatttccgacatagaggcagttaaagccggacatcatttctag

SEQ ID NO: 30816 - DNA, 738 bp, Artificial Sequence
  Description of Artificial Sequence: Synthetic coding sequence
atggcagagatccacaccccttatagcagcctcaagaagctgctaagcctcctgaacgggttcgtggccgtgagtggaattattctagttggtttaggcataggaggaaagtgcggcggtgcgtctcttaccaatgtcctggggctgagtagcgcttatctcctgcatgtgggaaacctgtgccttgtaatgggatgcataactgtgcttcttgggtgcgcagggtggtacggcgctactaaggaatcacgggggactctgctgttctgtattctttcaatggttattgtgctgatcatggaggtgacagcagccaccgtggtcctactgtttttccctatagttggcgacgtggctctcgagcacacatttgttactctcaggaaaaactatcgcggatataatgagcccgatgattatagcacacagtggaacttggtgatggaaaagctgaagtgttgcggggtaaacaattacactgatttttccggaagtagcttcgagatgacaaccggccatacatatccgcggtcttgttgtaagagcattggcagcgtttcttgcgacggccgcgatgttagcccaaacgtaattcaccagaaagggtgcttccataagctcctcaaaataacaaagacacagagttttactctgagtgggagctccctcggcgctgctgtcatacagagatggggcagcagatacgtggctcaagccggcctggagctcctagcatag

SEQ ID NO: 30817 - DNA, 483 bp, Artificial Sequence
  Description of Artificial Sequence: Synthetic coding sequence
atggctgagatccatacaccatactcatcactgaagaagctactgtcacttctaaacggattcgtggcagtgagcggcataattctggtgggactgggcataggcggcaaatgtggcggcgctagtttgactaatgtcctcggcctttccagcgcctacttactgcacgtcggcaatctgtgtctcgtaatgggttgcataacagtccttcttggatgcgctggttggtatggtgcaacgaaggagtccaggggcaccttgctgttctgcattctgagcatggttattgtgttgataatggaagttaccgccgcaaccgtggtgttgctgtttttccccatagttggagacgttgcacttgagcacacctttgttacactgaggaaaaattatcggggatacaacgagcccgatgattatagtacacaatggaatctagtgatggaaaaaggcctttctaagtattttttcagctcactctag

SEQ ID NO: 30818 - DNA, 999 bp, Artificial Sequence
  Description of Artificial Sequence: Synthetic coding sequence
atgccaggaaagcatcagcactttcaggagccggaggttggatgctgtgggaaatactttttgtttggttttaacatcgtgttctgggtgttaggagctctgttcctcgcaatcggcctatgggcctggggggagaagggagtcctgagcaacatctcagcccttaccgatctgggcgggttggatcccgtgtggctttttgtcgtagtcggtggcgttatgtctgtgctgggtttcgcagggtgcatcggagctctaagagaaaataccttccttctgaagttcttcagtgtgtttctcggcttgattttttttttggagctcgccaccgggatccttgcatttgtgtttaaagactggattcgtgaccagctgaacctgtttattaacaacaacgtgaaagcctaccgggacgacatagacctgcagaacctgatcgacttcgcacaggagtactggagctgctgcggagccagaggccctaacgactggaacctcaacatttatttcaactgtaccgacctcaacccatccagagagcggtgcggcgtgcccttcagctgttgcgtgcgcgaccccgcggaggatgtcttaaacacacagtgcggttatgatgtgcgcctcaagctggttaggggcgagctggagcagcaaggatttatccatacaaaaggctgtgtgggccagtttgagaagtggctccaggacaatcttattgtggtagctggcgtctttatgggaatcgctctcttgcaaattttcggaatttgtttggcccagaacctagtctccgacatcaaggcagtcaaggcaaactggtccaaatggaatgacgattttgagaatcactggctaactcccaccatctcggaggtcctgagcacggcaggcccccagcaaaatagtcttactggtgcgcccggtccagcccccccgtcacggcatgtattcttcggtctcggcggtctctacccagagccaacgttcaagaactggtag

SEQ ID NO: 30819 - DNA, 801 bp, Artificial Sequence
  Description of Artificial Sequence: Synthetic coding sequence
atgccaggcaaacaccagcacttccaggagcccgaggtgggctgctgcgggaaatattttctgtttggcttcaacattgttttttgggtcctaggtgcccttttcctcgccattggactgtgggcatggggagagaagggagtcctgtcaaacatctctgctttaaccgacctgggggggctcgaccccgtgtggctcttcgtcgtcgtgggtggagtgatgtcagtcctgggatttgccggctgcattggcgctctgcgagagaatactttccttctcaaattcttttctgtgtttttggggctcatcttttttttggagctggctacagggatcctggcctttgtgtttaaagactggatccgggatcagctgaacttgttcattaacaacaatgtcaaggcataccgcgacgatatcgacctgcagaatctgattgactttgcccaggagtattggtcctgttgcggggcccgcgggcccaatgactggaacctgaatatctatttcaattgcaccgacctgaatccttccagggagaggtgtggggttccattctcctgctgtgtcagagatcccgccgaagatgtgctgaacactcagtgcggttatgacgtcaggctgaaacttgtgaggggagagctggagcagcaggggttcatccacacaaaggggtgcgtgggccagttcgagaaatggctgcaggacaatcttatagtcgtggccggtgtgttcatgggaattgcactcttgcaaatctttgggatttgcctagctcagaatttggagcaaatggaatag

SEQ ID NO: 30820 - DNA, 990 bp, Artificial Sequence
  Description of Artificial Sequence: Synthetic coding sequence
atgcccggtaagcaccagcatttccaggagccagaagtggggtgttgtggcaaatatttcttgttcggattcaatattgtgttttgggtgctgggtgcgctgttcctggctatcggactgtgggcctggggcgaaaagggtgttttgtcaaatattagtgccctcaccgatctgggtggactagatccagtttggctgttcgtggtcgttggcggtgtgatgagtgttctgggatttgcaggatgtatcggagcactgcgggaaaacactttcctgctcaagtttttttctgttttcctcgggctgatctttttccttgaactggctacggggatactggcctttgtgttcaaggactggatccgggaccagctaaatctttttataaacaataacgttaaggcatatagggacgatatcgatctgcagaacctaatcgacttcgcccaagagtactggtcctgttgcggggcgcggggccccaacgattggaatttaaatatttacttcaactgtaccgacctcaacccgtctcgcgagcgatgcggggtcccgtttagctgttgtgtgcgcgatccagcggaggacgtgcttaacacacagtgcgggtacgatgtcaggcttaaactggagctggagcagcagggctttattcatactaaagggtgtgtcggccagttcgaaaagtggctgcaagataaccttatcgtggtggccggcgtgttcatgggaattgcccttcttcagatctttggcatctgcctggcccaaaacctggtctccgacattaaagccgtgaaggctaactggtccaaatggaacgatgactttgaaaatcactggcttacccctacgatctcagaggtactgtctactgcaggaccccaacagaatagtttgactggtgccccaggccctgctcccccatccaggcatgtcttcttcggattaggcggcctgtacccagagcccacgtttaagaattggtag

SEQ ID NO: 30821 - DNA, 792 bp, Artificial Sequence
  Description of Artificial Sequence: Synthetic coding sequence
atgccgggtaagcaccagcacttccaagagcccgaggtgggttgctgtggtaaatacttcctgttcggttttaacatcgtgttctgggtgttgggagctttattcctagcgatcggactatgggcctggggagagaaaggagtgttaagcaacatcagtgcactcacagatctcgggggcctggatccagtgtggttatttgtcgtagtcggcggagtgatgtctgtcctcggctttgctgggtgtattggagctttgagagagaacacatttctgcttaaatttttcagcgttttccttggactgatatttttcctggaactcgccacggggatcttagcattcgtatttaaagactggatccgagaccaactgaatttattcattaacaataacgtcaaggcatatagggatgatattgacttacagaatttgattgactttgcacaagaatactggtcttgttgcggagccagaggaccaaacgattggaatctgaacatatacttcaattgcactgacctgaacccttctagagagaggtgcggtgtgcccttttcatgctgcgtgcgagaccccgctgaagacgtactgaacacccagtgtggttacgatgtgaggctcaagctcgagctcgaacagcagggctttatacacaccaaagggtgtgtcgggcagttcgagaagtggctgcaggataacctaattgttgtggcaggtgtgttcatgggaatcgctcttttacagatcttcggaatatgtctcgcccagaacttggaacagatggaatag

SEQ ID NO: 30822 - DNA, 747 bp, Artificial Sequence
  Description of Artificial Sequence: Synthetic coding sequence
atggagggggattgcttgagctgcatgaagtacctgatgtttgtatttaacttttttattttcctcggtggagcctgcctgctggcaattggcatctgggtgatggtggatcccaccggttttcgggaaatcgttgcagccaatcccttgctactgactggggcttacatcctgctggctatgggggggctgctattcctgctcggtttcctgggttgttgtggagcggtgcgagaaaacaagtgtctgcttctcttttttttcctgtttatcttaatcatctttcttgcggaactgagtgcagctatccttgcctttatcttccgggagaatcttacccgtgagttttttacaaaggaattgactaaacactaccaaggtaataacgatacagatgtgttttctgcaacatggaattccgtcatgatcacgttcgggtgttgtggggtaaacggccctgaagacttcaagttcgcatctgtgtttagactgctgacactggacagcgaagaggtaccagaggcctgttgcagaagagagccccagtcgcgagacggcgtcctgctctcacgagaggaatgcttgcttggccggtcgctctttctgaataaacaaggttgctacacggttatcttgaatacatttgaaacctacgtatatctggctggggcgctggcgataggcgttctcgcgattgagcttttcgccatgatatttgccatgtgtctcttcagggggatccagtag

SEQ ID NO: 30823 - DNA, 816 bp, Artificial Sequence
  Description of Artificial Sequence: Synthetic coding sequence
tgatggtccacaatggaaggcgactgtctatcctgtatgaagtacctgatgtttgtgttcaatttctttatttttctggggggggcctgtctcctggcaattgggatctgggtgatggtggatccaacgggcttccgagagattgtagctgcaaaccctctgctgttgaccggcgcatatattttgttggctatgggggggctcctattccttctcggattcctcggctgttgcggcgcggtgagggagaacaagtgcctgctgctcttcttttttctcttcatcttaattattttcctggccgagctctcggcagcaatactcgcgtttatttttcgcgagaatctgacccgtgaattcttcaccaaagagctcactaaacattatcaagggaataacgacaccgacgtgttcagtgccacgtggaattccgtgatgatcacttttggatgctgtggcgtcaacggccccgaggatttcaagtttgcctccgtgttccggctgctgacattggactccgaggaggtgcctgaggcttgctgcagacgcgaaccacagtctagggacggagtactcctgtcccgtgaggagtgcttacttggtcgaagcttatttctgaacaaacaaggttgttataccgtgattctgaacacttttgagacctatgtctacctcgccggagcactagctataggcgtactagcgatcgaggaagagcgagcccatagcgtgtcacaagccactggcattctctaccagcttcctgccagcccacaggcttttcagtcaccaggcactctgggggccactgcgtag

SEQ ID NO: 30824 - DNA, 747 bp, Artificial Sequence
  Description of Artificial Sequence: Synthetic coding sequence
atggaaggcgactgcctttcatgtatgaaatatcttatgtttgtgtttaacttttttatcttcctgggcggagcctgtctgttggctatcggtatctgggtgatggttgatcccacagggttccgcgagattgtggccgccaatccccttctccttactggcgcctatatcttactggccatgggaggcctcctgttcctgttagggtttctcggctgttgtggtgccgtccgcgaaaataaatgtctgctgttgttcttctttctgttcattctgatcatttttctcgcagaactgtctgcagcaattttggcgtttattttccgcgaaaacctgacccgagagttttttacaaaggagctgactaaacattaccaaggaaacaatgatacagacgtttttagcgccacctggaactcagtcatgataactttcggctgctgcggggtcaatgggcccgaagatttcaagtttgcttcggtcttccggctactgacactggactcagaggaggtcccagaggcatgctgtaggcgtgagcctcaaagccgggacggcgtgctgctgagtcgtgaggaatgtctcctaggaagatcgttatttttgaataaacaggggtgctacaccgttattctcaacacattcgagacatacgtgtatttggccggtgccctggccatcggcgtacttgcaattgagttgtttgctatgatattcgccatgtgtctgttcagaggcatccagtag

SEQ ID NO: 30825 - DNA, 240 bp, Artificial Sequence
  Description of Artificial Sequence: Synthetic coding sequence
atggagggagactgtctttcctgcatgaagtatctcatgtttgtctttaacttctttatatttctgggcggtgcttgtctgctcgctatagggatttgggtgatggtcgaccctacagggttccgcgagattgtggccgccaatcctctccttctgactggcgcctacatcctcctggccatgggagggctcctgtttttgttgggattccttgggtgctgtggcgccgtccgcgagtag

SEQ ID NO: 30826 - DNA, 441 bp, Artificial Sequence
  Description of Artificial Sequence: Synthetic coding sequence
atggagggggactgcctaagctgcatgaaatacttgatgtttgtatttaatttctttatctttctgggcggtgcctgtcttttggccattggaatctgggtaatggtggacccgacggggtttcgtgaaatagtggccgcgaacccgctcttgctgaccggcgcatacatcttgctggcgatgggtggactgctcttcctcctgggattcttggggtgttgcggcgccgtcagagagaataagtgcctgctcttattcttcttcttgtttattcttattatcttcctggccgagctgagtgccgcaattctagcttttatctttcgcgaaaacctgacacgcgagttcttcaccaaggaactcacaaagcattaccagggtaataatgataccgacgtcttcagcgctacatggaactcagtgatgattactgtatcctag

SEQ ID NO: 30827 - DNA, 852 bp, Artificial Sequence
  Description of Artificial Sequence: Synthetic coding sequence
atggcccggaggcctcgggcacctgcagcctcaggggaggagtttagtttcgttagtccactcgttaagtatttgttatttttcttcaacatgctattctgggtgatcagcatggtcatggtggcagtgggggtatatgccaggctgatgaaacacgcagaggctgcactcgcttgcctcgcagtggatcccgccatcttacttatcgtcgttggagttctcatgttcctacttaccttttgcggatgcatcggctctctgagagaaaatatctgcctgctgcagaccttctctctgtgcctgactgccgtgttcttgctccagcttgctgctggtattctcggctttgtgtttagcgataaagcaagaggtaaggttagtgagataataaataatgccatcgtacactatcgcgatgacctggaccttcagaatctgatcgattttggacaaaagaagttttcttgctgcggtggaatctcatataaagactggtctcagaacatgtactttaactgctcagaggataatcccagcagagagcgctgctctgtgccatatagctgttgcctgcccacccctgatcaagccgtgattaatactatgtgcggacagggaatgcaggcattcgattacctggaggcctccaaggtgatctatacaaatggatgtatcgacaaacttgtgaattggattcacagtaacctttttttgctaggtggcgtggcactcggcctggcaatcccacagctcgtgggtatccttctctctcagattttggtgaaccagattaaggaccagatcaaattgcagctttataaccagcagcaccgcgcagacccttggtactag

SEQ ID NO: 30828 - DNA, 1338 bp, Artificial Sequence
  Description of Artificial Sequence: Synthetic coding sequence
atggctgaatatgatcttacaacacgcatcgcccacttcttggatcgccatttagtcttcccgttgttggaattcctgtctgtgaaagaaatctacaatgaaaaggagttgctacagggcaagctggatctgctgtccgacacaaatatggtggacttcgcaatggatgtctacaaaaatctgtactcagacgacattccacacgctctccgcgaaaagcggactaccgtggtggctcaactcaagcagctgcaggctgaaacagaacccattgtaaagatgttcgaggacccagaaactacccgccagatgcaatccacacgcgatggacgaatgctctttgactaccttgcagacaagcatggttttagacaggagtacctggacaccctttacaggtatgccaagttccagtacgagtgtgggaactactccggggctgcagaatacttgtatttctttcgcgtgctcgtgccggcaactgatcgcaatgcgctttcgtcactctggggcaagcttgcctcggaaatacttatgcagaactgggatgcagccatggaagaccttactcgcctgaaagaaacaatcgacaataatagcgtttccagccccctccaaagcctgcaacagagaacctggttgatacactggagcctgtttgtgttcttcaatcaccctaagggcagagataatattatcgacttattcctgtaccagccccaatatctgaacgccatccagactatgtgcccacatatcttgcgctaccttacgaccgctgttattacgaacaaagacgtcaggaaaaggcggcaagttttgaaagacctcgttaaggtgatccaacaggaatcttacacatataaggatcccatcacagagtttgtggagtgtctctacgtgaatttcgactttgacggcgcccaaaagaagctccgggagtgcgagtctgtcctcgtcaatgacttcttcctggtggcgtgccttgaagatttcatcgaaaatgcccggttgtttatctttgagacattttgccgcatccaccagtgcattagtatcaatatgctggccgacaagttaaacatgactcccgaagaggcggagcgatggatagtaaacctgatccggaacgcacgtttagatgccaagatcgactctaaactcgggcacgtggtgatgggcaataacgcagtgtcaccatatcaacaggtcatagaaaagaccaaatccctgtcttttcgcagccagatgctagcaatgaatattgagaagaaactcaaccagaactctcggtctgaagcacctaattgggccacccaggatagcggcttttattag

SEQ ID NO: 30829 - DNA, 5586 bp, Artificial Sequence
  Description of Artificial Sequence: Synthetic coding sequence
atgttaaaagccgttctcaagaaatcaagagaaggcggaaaagggggcaagaaagaagccgggagcgattttggcccggagactagtcctgtcctacacttggatcactcagccgactcaccagtgtcaagtttgcctacggcggaggacacctatcgggtgtctctcgccaagggtgtgtccatgtcacttccgtcctcccctctactgccccgccaaagccatcttgtccagtcaagagtgaacaagaagagtcccggcccagttcggaagcctaagtacgtcgaaagcccccgggttcccggtgacgctgtcatcatgcctttccgggaagtggccaagcctacggaacccgacgagcatgaagcaaaagctgacaacgagccttcgtgcagccccgctgcacaggaactgctcacaaggcttgggttcctgctgggcgagggaattccctctgccacccatattacaattgaggacaagaacgagaccatgtgcaccgccctgtcacaagggatctccccgtgttctacactaacctcatctactgcttcaccttccaccgatagcccatgcagcactttaaacagctgcgtgagcaagacggccgccaataagagtccctgtgaaacaatcagcagcccatcctccacccttgaaagcaaagactccggtattatagctacaataactagctcctcagaaaatgacgaccgctcggggagttctctggagtggaataaggatggcaatttgcggttgggggttcagaaaggggtgctgcatgaccgaagggctgacaattgctctcccgtagccgaagaggagacaaccgggagcgccgagtctaccctccccaaggccgagtcgagcgctggcgacgggcctgtcccttactcccagggcagcagcagtctgataatgccccggcccaatagcgtggctgcgaccagcagtactaagcttgaggatttgtcctatcttgatgggcagagaaacgcaccgctcagaacctctatccggttgccctggcacaacacggcaggcggccgcgcacaggaggtaaaggcaagattcgctccctataagcctcaggacattctgttgaagccgttgctgttcgaggtcccatctattacaacggactctgtttttgttggtcgtgactggctgtttcaccaaatcgaggaaaatctccgcaataccgagctggctgagaacaggggtgccgttgtggtgggaaacgtgggttttggtaaaaccgctatcatctctaaactggtcgcgctgagctgccacggttcaagaatgagacaaatcgcaagcaattcccccggcagctcccctaagacatccgatcccactcaggacttgcatttcacaccgctgttgagtcctagtagttccacgagcgctagctctacagccaaaactcctttggggagcataagcgcagaaaatcagaggcctagggaggatgctgtgaagtatctggcttctaaggtggtggcctaccattattgtcaggccgataatacatacacgtgcctggttcctgaatttgtgcacagcatcgccgccctgctgtgtcgatcccaccagctggccgcctatcgggacctgttaattaaggagccccagctgcagagcatgttaagtctgcgaagctgcgtgcaggatccagtagccgcgtttaaaagaggtgtgctggagcctctgacaaacctaagaaatgaacagaaaatcccggaggaggaatacattattcttatcgatggcctgaacgaggcagagttccacaaacctgactatggcgacaccctgtcttcatttatcacaaagatcatcagtaagttccccgcctggcttaagctgatcgtcaccgtgcgtgctaatttccaagagattatctccgcactgccctttgtcaaattatctctggacgattttccagacaataaggacatccattcagatctgcacgcttacgtgcagcaccgtgtgcatagtagtcaggacatcctgtctaatatatctctgaacggcaaggcagatgccaccctgattggaaaagtgtcctcacacctcgttctcaggagcctagggtcttacctgtatctgaaactcactcttgacctgttccagcgaggtcacttagtgattaaatccgcatcgtacaaagtggttcctgtgagtctgtccgaactgtacctgctgcaatgtaatatgaagtttatgacacaatctgcttttgaaagagccctccctatactgaacgtcgccctcgcatcccttcatcccatgacagatgagcagatcttccaggcgatcaacgcaggccatatacaaggggagcagggctgggaagacttccagcagcgcatggacgcattatcatgtttcctgatcaaacgccgcgacaagacacgcatgttttgccacccatcttttagagaatggcttgtttggagggcagatggcgagaataccgcttttctgtgtgaacctaggaatggacatgccctgttagccttcatgttttctagacaggaaggtaaactgaacagacagcaaactatggagctgggccaccatattctgaaggcccatatcttcaagggcctcagtaaaaagaccggtatcagtagttctcatctgcaggccctctggattggttattccactgagggactatcagccgcccttgcctcgctcaggaatttgtacacccctaacgtgaaagttagcaggctgctgatcctgggaggggccaacgtcaattatcgaacagaggtgctcaacaacgctcccattctgtgcgttcagtcacacctgggccatgaggaagtggtgaccctcctcctcgagtttggagcctgcctggacgggacaagcgagaacggaatgactgccctatgctacgccgccgcagctgggcacatgaagctggtctgtctattgacaaaaaaaggagtgcgggttgatcacctggacaagaagggtcagtgtgccctagttcacagcgccctccgtgggcatggcgacatcttgcagtacctgctcacctgtgagtggtccccaggtcctccccagcctggaactctgcggaaatctcacgcacttcagcaagcactcactgccgccgccagcatgggccactctagtgtggtccagtgcctgttgggcatggaaaaggaacacgaagtcgaagttaatggtaccgacacactgtggggtgagaccgcccttacagccgccgccggcagaggcaaactggaggtgtgtgaactgctgctcgggcatggtgctgccgtgtcacgcacgaacaggagaggcgttccgccactgttttgcgccgccaggcaaggccactggcaaatcgtcagattgcttctggaaagggggtgtgacgtaaatctatctgataagcaggggcggactcccctcatggtggcagcctgcgagggtcaccttagcactgtagagttcctgctgtccaaaggcgcggctctcagctccctggataaagagggactcagcgctctttcctgggcctgtctgaaaggtcaccgggcggtggttcagtacctggttgaggaaggtgcagcaattgatcagaccgataaaaacggcaggacacccctggacctggctgcattttacggtgacgccgagaccgtgctctatctcgtagaaaagggcgcagttattgaacacgtggaccacagcggaatgcgcccgctggatcgcgcgatcggctgccgaaataccagtgtggttgttgcattgttacgcaagggcgccaaacttgggaacgccgcctgggcaatggccaccagcaagcccgatattctcataattcttcttcaaaagcttatggaagaaggtaatgtgatgtataagaagggaaagatgaaggaggcagcgcagcggtaccagtacgctctgcggaagtttcccagagagggcttcggtgaggatatgaggccctttaatgaactgagagtgagtctctacctcaacctgagccgatgcaggaggaagaccaacgacttcggcatggccgaagaatttgcttctaaagccctggaacttaaaccgaagtcttacgaggccttctacgcaagggcaagggctaaacggaattctagacagtttgtggccgcccttgctgatctgcaagaagcggtaaagctgtgtcccacaaatcaggaggtgaaacgactgcttgctcgtgtggaagaggagtgtaagcagctgcaaagatcacagcagcagaagcagcagggacctttgcctgccccactgaatgatagcgagaatgaggaagatacacctactcctggcttaagcgaccattttcattcggaggagacagaggaggaagagaccagccctcaagaggaatcagtaagtcccacacctcgctcacagccaagctcctcagtaccaagctcctatatccggaaccttcaggagggcctccagagcaagggtaggcctgtaagccctcaaagccgggctggcataggtaagtcgctcagagagccagtcgcacagcccggcttgctattgcaaccctctaagcaggcccaaattgtaaagacttcacagcatcttggttcaggacaaagcgccgtgcgaaacgggtcaatgaaagtacaaatttcctcccagaatcccccccccagtcctatgccgggccgaatcgccgccacgccggccgggtcacgtactcaacatctggagggcactggtacctttaccaccagggccgggtgcggccactttggcgatcggctcggaccctcccagaatgttcgtcttcagtgcggcgagaacggcccagcccaccctctgccttctaaaacgaagactaccgagcgactgctaagccacagcagcgtggcagtggatgccgcccctcccaatcagggcggtctggctacctgctccgacgttcgccatccagcaagccttaccagctctgggtccagcggatcaccgtcctcgtcaattaagatgtcctccagtacctcaagcttgacaagtagcagtagctttagcgatgggtttaaagttcagggccctgacactcggatcaaggacaaggttgtgacccacgtgcagagcggtacagcagagcaccgccctaggaacaccccattcatgggcatcatggataaaactgcccggtttcaacagcagtctaaccccccatctaggtcttggcactgtccagctccagaagggctattgactaatacctcgtcggccgctggactccagagcgctaacacagaaaaaccttccctcatgcaggtgggcggatacaataatcaagcaaagacatgtagcgtcagcacgttatcggcttccgtgcataacggcgcacaggttaaggagctcgaggagtctaagtgccagatccccgtccatagccaggagaaccgaatcactaaaaccgtgagtcacctctaccaagaatccatttcgaagcaacaaccccatatcagcaatgaggcccatcggagccatctgacagcggccaaacctaaacgatcgttcattgagagtaacgtgtag

SEQ ID NO: 30830 - DNA, 5268 bp, Artificial Sequence
  Description of Artificial Sequence: Synthetic coding sequence
atgctaaaagcagtactgaagaagtcaagagagggtggcaagggaggcaagaaggaagccgggagtgacttcggccctgaaacatctcccgtgctgcacctggaccacagcgccgactcacctgtcagctccctccccaccgccgaagacacatatcgggtcagcttagcgaagggtgtgtcaatgtccctgccaagctcacctcttctccctcgacagagtcatcttgttcagagtcgggtcaacaaaaagtcacccggacctgtgcgaaaacctaaatacgtggagagcccgcgagtgcccggcgacgccgtaatcatgccatttagggaagtcgccaaacctacagagcctgatgaacatgctaccattacatctagttccgaaaacgatgatcgaagcggtagttcccttgaatggaataaagacggcaatctgagactcggcgtgcagaagggagtcttgcacgatcgccgggctgataattgtagtccggtagctgaagaggaaaccaccggatccgctgagtctaccctccctaaagcagaatcctcagctggagacggcccagttccctattctcagggatcgtctagtctcatcatgcctagaccaaattcggtcgccgcaacctctagtacaaagctggaggacctgagttatctagacggacaacggaatgcacctctgcggacatccatccgcctgccatggcataatactgccggagggcgagcacaggaggtaaaagctcggtttgctccatacaaaccgcaagacatcctgttgaaacccctcctcttcgaagtcccaagtataaccactgattccgttttcgtgggtcgagattggctgtttcatcagatcgaggaaaaccttagaaatactgagttagcagagaaccgaggagccgtggttgtgggcaacgtgggattcgggaaaacggctatcattagcaagctggtcgccctttcttgtcacggatctagaatgcgccagattgcatctaactcaccggggtcttcccccaagacaagtgaccccacccaagacctccatttcacgccccttctgagcccttccagtagcacttctgcctccagcaccgcaaaaacccccctgggttctatcagcgccgaaaatcagagacctagagaagacgccgtgaagtacctggcatccaaagtagtagcttatcattattgccaggcagataacacatatacttgcctggtcccagaatttgtccactccatagcggcgctgctgtgtcggtcccatcagctcgctgcttaccgagacctcctaattaaggaacctcagctacagtccatgctgagcctgcggagttgcgttcaggaccctgttgcggcttttaagcgcggtgtgcttgagccactgaccaacctgaggaacgagcagaagatacctgaagaggaatacattatactgatcgacgggctgaacgaggccgagtttcataaacccgattacggagacactctgtcttcttttattacaaaaattatttctaagtttcctgcctggctgaaactgatcgtgaccgtgagggcgaattttcaggagatcatctctgcattgcctttcgtaaagttgtccttggatgattttcccgacaataaggacatccacagcgatttacacgcctatgtgcagcatcgggtccactccagtcaagacatcctgagcaatattagtctgaatggaaaggcggacgcaacattaatcggaaaggtatccagccacttggttctgagatcactggggtcctatttgtacctgaaactgactctggacctcttccaacgaggacaccttgtaatcaagtccgcctcctataaagtggttcccgtgtcacttagcgagctttacctgctgcaatgtaacatgaagtttatgactcagagcgcctttgagcgggcacttcctatcttgaatgtcgctcttgcttccctgcatccgatgaccgacgagcagatttttcaagcgattaacgccggccacatacaaggagaacaaggctgggaggacttccagcagcggatggacgccctcagttgttttttgataaaacgtcgggacaaaactaggatgttttgtcatcctagcttccgcgagtggcttgtgtggagggcagacggcgagaataccgcatttctttgcgaacccaggaatggccacgcattgttggcatttatgttctcgcggcaggagggcaaactcaaccggcagcaaacaatggagttaggccaccacatcctgaaggcgcacatctttaaaggcttgtctaagaaaacggggatcagctcgtcccaccttcaggctctatggattggctacagcacagaaggactgtctgcagctctagcctcgctcaggaacctatatactcccaatgtgaaagtgtccagacttttaatactgggcggggcaaatgtcaactatcgaaccgaggtgctcaacaacgcccccatcctctgcgtgcagagccaccttggacatgaagaagttgtaacgctgcttttagagtttggagcctgtctcgacgggactagcgaaaatggcatgaccgccctatgctatgccgccgccgctgggcacatgaagctggtgtgccttctgacgaagaagggagtgagggtggaccatctggacaaaaaagggcagtgtgccctggtccactccgcactgcggggtcacggggatatcctccagtaccttctgacatgcgaatggtcccctggcccgccccagccaggtacactgcggaaatcccacgcacttcaacaggccctaacagcagcagcatccatgggtcattcatccgtagtgcaatgcctcctgggcatggaaaaagagcatgaagtggaagtcaacggcactgacactctgtggggtgagaccgccttgacagcagccgctggaagaggcaagctggaggtctgtgaactcctgctgggtcatggtgccgctgtgtctagaaccaatagacggggcgtacccccccttttttgcgcagctcgccagggccactggcagattgttaggcttctcctcgaaaggggctgtgatgtgaatttgagtgacaagcagggaaggaccccattgatggtggccgcttgcgagggacacctcagtacagtcgaattcctgctgtccaaaggcgctgcactatcctcccttgacaaggaaggcctgtccgcgctcagctgggcctgcttgaagggtcatcgggctgtggtacagtatctggtggaagagggtgccgccatagaccaaactgacaaaaatggtcgtacacccctggatttagccgcattctatggagatgctgagactgtcctgtaccttgtggagaaaggtgctgtcatcgagcatgtggaccactctggtatgcgtccactggaccgcgcgatcggttgccggaacacatctgttgtggtcgccctgctgcggaagggcgcaaaactggggaacgctgcctgggccatggctacaagcaagcccgatatcctgattattttgttacaaaaactcatggaagaaggaaacgtgatgtacaagaaggggaagatgaaagaggccgctcagcggtaccaatacgcactgcggaaattccctcgggaggggttcggcgaggatatgcgtccttttaacgaactgcgcgtttctctctacttgaacctgtcccggtgtcgacggaaaaccaacgatttcggaatggcggaggagttcgcctccaaggcactcgagctgaagcccaaaagctatgaggctttttatgctagagccagggcaaagcggaactccaggcagttcgtcgcggccttggccgaccttcaggaagccgtcaaactctgccccacaaaccaggaggtaaagcggctactcgctcgggttgaagaggaatgcaaacagctgcagcgatcgcagcagcagaagcaacagggcccattgcccgcaccactgaatgattccgagaacgaagaggacactccaactcccggcctgtccgaccatttccactctgaagaaaccgaagaggaggagacatcaccccaagaggaatccgtgtcccctaccccgcgttctcagccctcctcaagcgtccccagttcttacatccgcaatctgcaggagggattacagtcaaagggccgtccagtttccccccagtcgagggccggtatagggaaatctttgcgggagcctgtggctcagccaggtctgctcttgcagccttctaaacaggctcagatcgtcaagacctcccagcacctggggtccggtcaatccgcagtccgcaacggctctatgaaggtgcagataagctcacagaatccccctccctcacccatgccaggcagaattgctgccacccccgcaggcagcaggactcaacatctcgagggaaccggcacatttacgacgcgagcagggtgtggacattttggcgatcgcctgggcccgagtcagaatgtacggctgcagtgcggcgaaaatggccctgctcatcccttgccttcaaaaaccaagaccaccgaaaggttgctgagccactctagcgtggcagtggacgctgcgccccctaaccagggtggactagccacttgctcagatgtgagacacccggcatcactgacaagctctgggagttccggatccccctcctcttcaataaaaatgtcgagtagcacaagttccctgacctccagctcttcctttagcgacggcttcaaagttcagggcccagatacacgcatcaaggataaggtggtcacccatgtacagagtgggaccgcagagcaccgtccacgaaatactccatttatgggaattatggacaaaactgcgcgttttcagcagcagtctaaccccccgtctcggtcttggcactgccccgcacccgaggggctgctcaccaacaccagtagcgccgcagggttgcagtccgcaaatactgagaagccttctctgatgcaagtagggggatataataaccaggcaaaaacctgttcagtgtcaacccttagcgcatccgtacacaatggggcccaggttaaggagttggaagagtccaagtgccagattcccgtgcactcccaagagaaccggataacaaagaccgtttcacacctgtaccaggaatcaatttcaaagcagcagccccacatctccaatgaggcccataggtctcacttgactgcagctaaacctaagagatcattcatcgaatccaacgtctag

SEQ ID NO: 30831 - DNA, 2139 bp, Artificial Sequence
  Description of Artificial Sequence: Synthetic coding sequence
atggcccagagctctcctcaacttgacattcaggtcctgcacgatctgaggcagaggtttccggagattcccgaaggcgtggtttcacagtgtatgcttcagaacaataataacctggaggcttgctgtcgagccctaagtcaagagagctcaaaatacctctacatggagtatcattccccagatgataaccggatgaatcgcaatcgccttttgcacattaacctggggatccactcgccatcgtcctaccatcctggcgatggggctcagttgaacggaggccgcactctcgtgcactcgtcttccgacgggcacattgacccacagcatgccgccggcaagcaacttatctgcctcgtacaggagcctcactcggcccccgcagtggttgcagccacccccaactacaacccctttttcatgaatgaacaaaacagatcagccgccaccccaccatcccagccccctcagcagcccagcagcatgcagacaggcatgaatccgagcgccatgcaggggccctcccctcctcccccaccgccctcctacatgcacatcccgaggtatagcacaaacccaattacggtcaccgtatcacaaaacctgccctctggccagacagtcccgcgcgctctgcagattctaccgcaaatcccatctaatctctatggatctccaggctcaatttacatacgccaaactagccaatcttcgtctggccgtcaaaccccacaaagcacaccgtggcagtcgtctccccagggtccggttccccactacagccagcgcccgctgcccgtgtacccgcatcagcagaactaccaaccctcacagtactctcccaaacaacagcaaataccccagtccgcctaccactcaccgccgccctctcagtgcccctctcccttttctagccctcagcaccaggttcagccgagccaactaggacacatattcatgccaccttcgccctcaaccacgccccctcatccctaccagcagggtccaccaagttatcagaagcagggatcccatagtgttgcctacctcccttacacagcctcatctctcagcaagggatccatgaagaaaatcgagatcactgtcgagccgagccagcggccggggacagccattaaccggtccccttcacctatttcaaaccagccatcaccgtggaaccagcacagtctctacactgccacgactcccccctcaagctcgccatcccgtggcattagctcacagcctaagcccccattcagtgtgaacccagtgtatatcacctatactcagccaacaggaccgtcttgtaccccatctcccagccctcgcgttatccctaatccgactacagtgttcaaaataaccgtaggcagggccacaaccgagaacctgctgaatctcgtggaccaagaagaaagatccgctgcccctgaacccatacagcccatctcggtgattccaggctccgggggggagaagggcagtcacaaataccagcgtagctctagttcagggtcagatgactacgcttacactcaggccttgctgcttcatcagagagcaaggatggagaggcttgccaagcagctgaagctcgaaaaggaagagctcgaacggttgaaatcggaagtcaatggaatggagcatgatctgatgcaacggcgactccggagagtgtcttgtaccacggcgatcccaacacccgaggagatgacccgactcaggtccatgaacaggcagctgcagatcaatgtcgactgcacactgaaggaggttgatttgcttcagtcgcgcggaaactttgaccccaaagccatgaacaacttctatgataacatcgaacctgggccggtggtgccaccaaagccctccaagaaggatagctcagatccttgcaccattgaaagaaaagcacgaagaatttctgtcacatctaaagttcaggctgatatacacgatacacaggctgccgctgcagacgagcacagaactggaagcacacagagcccccgtactcagccccgagatgaggattatgagggggcaccttggaactgtgattcttgtacttttcttaaccaccccgccctgaaccgttgtgaacagtgtgaaatgccgcggtatacctag

SEQ ID NO: 30832 - DNA, 252 bp, Artificial Sequence
  Description of Artificial Sequence: Synthetic coding sequence
atggagcatgacctgatgcagagaagattacgccgtgtttcatgcacaactgcaatccccacacctgaggagatgaccaggctgcggtctatgaatcggcagctccagatcaacgttgattgcacgttgaaggaagttgatctgctccagtcacgagaggtgtattacagccggtccagcctgaaactgagcttcactcagctgacacgactagaaatggtgttcatcttctgtgggaagtacaccgactag

SEQ ID NO: 30833 - DNA, 2139 bp, Artificial Sequence
  Description of Artificial Sequence: Synthetic coding sequence
atggcccaatctagtccacagctggacatacaagtcctccacgatttgcggcagagatttcccgaaatcccagagggtgttgtttctcagtgtatgctgcaaaataacaataacctcgaggcatgttgccgggctctttcacaggaaagctccaaatacctgtacatggaataccactccccagatgacaacagaatgaatcggaataggctgcttcacatcaaccttggaatccactctcctagctcttaccatcctggcgacggggcccagttgaacggaggtcgtacccttgtgcactccagttctgatggccatattgaccctcagcacgcagccggcaagcagctgatttgtctagttcaggagccacattcggctcccgcggtcgtggccgctacacccaattataacccgttcttcatgaacgagcagaacagatccgccgccaccccccccagccagcctccccagcagcccagttccatgcaaacaggaatgaacccttcagccatgcagggtccctctccaccaccgcctccccccagctatatgcacatacctcgctattctaccaatccaattacagtcaccgtgtctcaaaacctcccctccgggcagactgttccaagggccctgcagatactgccccagataccaagtaacctatacgggtccccaggaagtatatatatcaggcagacttctcaaagctcttcagggcggcagaccccccaaagtaccccttggcagtcctcaccccagggtccggtccctcattattcccagaggcctctgcccgtctaccctcaccaacagaattaccagccatcccagtacagtccaaagcaacagcagatcccccagagtgcctaccattcgcctcctccgtcccagtgcccttcccctttcagcagccctcaacaccaggtgcagccatcccagctcgggcatatcttcatgcctccttcacccagtaccacccccccacacccataccagcaaggccctccaagttaccagaaacagggcagtcactctgtggcctacttgccctacactgcatccagcctgtcgaagggctccatgaagaagatcgagatcaccgtggagccatctcagcgtcctggcaccgccataaataggtctccctctccaatcagcaatcaaccgtccccatggaatcagcactctctgtacaccgcaaccactccaccctctagcagtccgtcaaggggaatctcctctcagcctaaaccaccgttctccgttaaccccgtgtacataacctacacccagccgaccggaccctcctgtaccccatctccaagcccacgcgtgatccccaatcctaccacagtctttaagataacagttggcagagcgacgaccgaaaacctgcttaacttggtcgaccaggaagagagaagcgcggccccagagccaatacagcccatctccgtgatccctgggtcaggcggagaaaaaggcagtcataaatatcagcgatcatctagtagcggcagcgatgactacgcctatacacaggctctcttgctgcaccagagggcccgcatggagagacttgccaagcagttgaagcttgagaaagaggaactggaacgactgaagtccgaggttaacgggatggaacatgacttaatgcagagacgtctgcgccgcgttagctgcacaacagctattcccaccccggaggagatgaccagattaagaagcatgaaccggcagctgcagattaacgtagattgcacgttaaaggaagtggatttgctgcaaagcagaggcaattttgacccaaaggccatgaataacttctacgacaatattgaacccgggccagtggttccccccaaacctagtaagaaggactcctccgacccttgcactattgagcgcaaagcgagaaggatatctgtgacgagtaaggtacaggcagacattcacgacacacaggccgcagccgctgacgagcataggaccgggtccacacaatcgcctaggacccagccgcgggatgaggattacgagggagctccatggaattgtgactcatgtacatttctgaaccaccctgcactgaaccgctgcgagcagtgcgaaatgccccggtatacgtag

SEQ ID NO: 30834 - DNA, 2055 bp, Artificial Sequence
  Description of Artificial Sequence: Synthetic coding sequence
atggcacagagttcgccacagctagacatccaggtgctccatgatctgcgccagaggttcccagagatcccagagggcgtcgtttcccagtgcatgctgcagaataacaacaatctggaggcttgctgtcgggcgctaagccaggaaagtagcaagtacctctatatggagtatcatagcccagacgacaataggatgaatagaaacaggctcttgcatatcaacttaggcatacatagcccgtcctcgtaccaccccggggacggggctcagctgaatgggggccgcacactggtccactccagcagtgacggacacatcgatccgcagcacgccgccggcaaacagctgatttgtctagtccaggagcctcattcagcacctgccgtggtggccgccacacctaactataaccctttctttatgaacgagcagaatcgttcagcagcaactcccccaagccaacccccacagcagccttcatctatgcagaccgggatgaacccctccgccatgcagggaccgtctcctccacctcccccaccatcatatatgcacattccacgctactctactaatccaatcaccgtgaccgtgtctcaaaacttgccatcaggacagactgtcccccgggcattacagatactgccacaaatcccttccaatctatatgggagtcctggctctatttatattagacagaccagccagagcagcagcggacggcagaccccccagagtaccccctggcagtctagccctcaagggcctgtccctcactacagccagcggcctctgccagtgtatcctcatcagcagaactaccaacctagccagtactcaccaaagcagcagcaaatcccgcagtctgcataccacagtccaccacctagccaatgcccaagcccctttagttcaccgcaacaccaggtccagccgtctcaactgggacatatattcatgccacctagtccaagcacaacacctcctcacccttatcagcagggtccacctagctaccagaagcaaggctctcacagcgtggcttatctgccgtacaccgcgtcctccttgtccaaaggctcaatgaagaagattgagatcacggtcgagcctagtcagagacctggaacagccatcaaccgatccccttctcctatatcaaaccaacccagtccttggaaccagcattctttgtacacggcaacaactccccctagctcttcaccttcgaggggaatttcaagccaaccaaagcccccgttctctgtgaaccccgtgtacataacctatacccagcctacgggtcccagctgtacaccatccccttctccacgcgtgattcccaaccccacaactgtgttcaagataaccgtgggccgcgctactactgaaaatttgctgaatctggtggaccaagaggaaagaagcgccgcaccggaacctatacagcctatcagtgtcatccctggcagcgggggagagaaaggctcccacaagtatcagcgatcaagttcgtcaggatctgacgattatgcttatacccaagcccttctgctccatcagagggcacgcatggaacgtctcgccaagcagcttaaactcgagaaagaggaactggaacgacttaaatccgaagtgaatgggatggaacacgaccttatgcagcggaggctgcggagagtcagctgcaccaccgccatcccaacccctgaagagatgactagattgcgcagcatgaaccgccagctacagatcaacgtagattgcacactcaaagaagttgacctccttcaaagtcgggactcttctgacccgtgcaccatcgaaaggaaagccaggcggattagcgtgacgagcaaggttcaagccgacatccatgatacccaggccgcagctgctgacgagcatcgaacagggtccactcagagccctagaacgcagccgcgggatgaggattacgaaggagcaccctggaactgtgacagctgtacctttctgaatcaccctgccttgaacagatgtgagcaatgcgagatgccccgctatacatag

SEQ ID NO: 30835 - DNA, 2139 bp, Artificial Sequence
  Description of Artificial Sequence: Synthetic coding sequence
atggcacagtctagccctcagcttgatatccaggtgctgcatgatctcaggcaaaggtttcccgaaattcccgaaggcgtggtttctcaatgcatgcttcagaacaacaataatttggaggcctgttgccgtgctctatcccaggaatctagcaagtatttatatatggagtaccacagtcccgacgacaaccgcatgaatcgcaatcggctcctccacatcaacttgggtatccactcaccatcgtcttaccaccctggggacggcgcgcagttgaatggtggaagaactctcgtgcattctagtagcgacggccacattgatcctcagcatgccgctggaaagcagttgatctgtttagtgcaggaaccacacagcgctccagccgtcgtggctgcaactcccaattacaatccatttttcatgaacgagcaaaatagatcagccgcgacgccgccaagtcagcccccccagcagcctagttctatgcagacaggtatgaatccttctgccatgcagggtcccagccctcccccccccccaccatcttatatgcacattccacgttacagcaccaatccgataaccgtgaccgtctcacagaacctgcccagcgggcagacagtgccacgcgctctccagatcctcccgcagatccccagcaacctgtatggctctcctgggtccatctacatccgacaaacctcgcagtcatcatcagggcgccagaccccacaaagtaccccttggcagagcagcccccaaggtcccgtgccccattattcccagcggccacttcccgtgtaccctcaccagcagaattaccagccgtctcagtatagccccaaacaacagcagattccccaaagcgcttatcacagtccacccccttcacagtgtccaagccctttttcaagtccacagcatcaggtgcaaccctcccagctggggcatatttttatgccaccctccccctcaaccacgcccccccatccctatcaacagggaccaccttcataccagaagcagggaagtcattcagtggcatatctgccatacaccgcctcctctttatccaaaggttcaatgaaaaaaatagagattactgtagagccatctcagcgacctgggactgctatcaaccggtctccatcccccatcagtaaccaaccctctccatggaatcagcattctctctatacggctactacaccaccgagcagtagtccgagtcggggcatctccagccagccaaaaccacctttcagtgtgaacccagtctatatcacctatactcagcccacaggtccctcttgtacaccctctcctagcccacgagtcatccccaacccaacaacagtcttcaagattacagttggccgggcgacaactgagaacctccttaatttggttgatcaggaggaaaggtctgccgccccagaacctatccagcctatcagcgtgatccctgggagcgggggcgaaaaagggtctcacaaataccagcgtagcagcagctcaggctctgacgattacgcatatacccaggcactactgctgcaccaaagggcccgtatggagcgcttggcgaaacagcttaagcttgagaaggaagagttggaaaggctgaaatctgaggtcaacggcatggagcacgatctgatgcagcgtcgtttacgccgagtctcttgtaccacggcaattcctactcccgaagagatgacacggctgaggagtatgaaccggcaacttcagattaatgtcgattgtaccttgaaggaggttgatctcctgcagagccgcggaaattttgatccgaaggcaatgaataacttttatgataacatcgagccaggccccgtcgtgccgcccaagccgtccaaaaaagactcatccgatccttgcacaatcgaacgaaaggctcgtagaatttccgtgacgagtaaggtccaggccgacatccatgacacccaggctgcagcagcagatgaacacagaactggaagcacgcaatctccacggactcagccacgtgatgaggattacgagggcgccccatggaactgcgattcttgcacctttctgaaccatcctgcactaaaccgttgtgagcaatgcgaaatgccaaggtacacttag

SEQ ID NO: 30836 - DNA, 723 bp, Artificial Sequence
  Description of Artificial Sequence: Synthetic coding sequence
atgcttaggtcatgcgcggcgaggctgagaacacttggagccctttgtctgcctcctgtggggagacgcttgcccggcagtgagccccggccagaattaaggagcttttcgtctgaggaggtcattctgaaggattgctctgtgcccaacccaagctggaacaaagacctgcgcctcttgtttgatcaatttatgaaaaaatgcgaagacggaagctggaagcgcttgccatcctacaagagaacccctaccgagtggattcaggattttaagacccatttcttggatcccaaactgatgaaggaagagcagatgagccaagcccagctgtttactaggtcttttgatgacggactgggattcgaatacgtgatgttttataatgacatagaaaaaagaatggtgtgcctttttcaggggggcccttatctggaaggcccgcccgggttcatccatggcggggcaatcgccacaatgatagatgcaaccgtcggcatgtgcgctatgatggccggagggattgtgatgacagccaacctcaatataaattataagaggccaataccactgtgttcggtcgtcatgatcaactctcagcttgacaaggtagaggggcgcaaattctttgtgagctgtaacgtccagtccgtggacgagaagactctgtactccgaggctacaagcttatttatcaaattgaatcctgctaagtcgctcacttag

SEQ ID NO: 30837 - DNA, 744 bp, Artificial Sequence
  Description of Artificial Sequence: Synthetic coding sequence
atgatccgccggtgtttccaggtggcggctaggctcggtcatcacaggggcctgctggaagccccaaggatcctccccaggctcaatccagctagcgccttcggatcaagcaccgatagtatgttcagtcggtttcttccggaaaaaactgacttgaaggactacgccctccccaacgcgagttggtgctccgatatgctatcgctctatcaggagttcctcgagaaaacaaagtctagtggatggatcaagctgccgtctttcaaatccaaccgggatcacattcgtgggctcaagcttccttcaggattagctgtctcctcagacaagggggactgtaggattttcacccggtgcattcaagtggaaggacagggatttgaatacgtcatcttctttcaacctacccagaagaagtctgtgtgcttgtttcagcccgggtcctatttagagggtcctcccggctttgctcacggtggctcgctggctgctatgatggatgagaccttctcaaaaactgccttcctggccggcgagggtctgtttactttgagtcttaatatccggttcaagaatctcattcctgtggactccctcgtggtcatggacgtcgagctggacaagatagaggatcagaagctgtacatgtcatgtatcgcgcactcccgcgatcagcagaccgtctatgctaagagcagcggagtcttcctgcagctccagctcgaagaggagtctccgcagtag

SEQ ID NO: 30838 - DNA, 5883 bp, Artificial Sequence
  Description of Artificial Sequence: Synthetic coding sequence
atggctcagcaagcagccgataaatacctgtatgtggataagaactttattaacaaccctctggctcaggctgattgggcagccaagaaactcgtttgggtgccaagcgacaaatccgggttcgaaccagcatcactcaaagaagaggttggtgaggaggcaatcgtcgagctcgtggaaaacgggaaaaaagtaaaggtgaataaagacgacattcagaaaatgaacccgcccaaatttagcaaggtcgaggacatggcagaactgacttgtttgaacgaggcctccgtcctgcacaatttgaaggaacgctattacagcggtctgatctatacatattcaggactgttttgtgtcgtgattaatccatacaagaatttgcctatttatagcgaagagattgtggagatgtacaaaggcaagaaacgccacgaaatgcctccacacatttacgccatcacagataccgcttatcggtctatgatgcaagaccgcgaggatcagtctatcctgtgtaccggcgaatctggggcaggaaagaccgaaaatactaagaaggtgattcagtatctggcatacgtcgcctcaagtcataaaagcaaaaaagatcagggagaactggaacggcagttattacaagcgaaccccatactcgaagccttcggaaatgctaagacagttaagaatgacaactccagtcgttttggtaagttcatacgcatcaatttcgacgtgaatggctatattgtgggcgccaacattgaaacatatctcttagaaaagagccgggcgattcggcaagctaaggaggagagaactttccacatcttttattatttactctcgggagccggagagcacctgaagacagaccttctactggagccctacaacaagtacaggttcctgtccaacgggcacgtcacaatcccggggcagcaagataaagacatgttccaagagacgatggaggccatgaggattatgggtattcccgaggaggaacagatgggcctgctgagagtgatcagcggagtcttacagttgggcaatattgtgttcaaaaaagagcgtaacactgaccaggcctctatgcctgataataccgcagcccagaaggtgtctcatctgctgggcatcaatgtcaccgacttcactagagggatcctgacgccgcgaattaaggtcggccgggattatgtccagaaagcccaaacaaaggagcaggctgactttgcgatcgaggccctagctaaagccacatacgaacgcatgttcaggtggcttgtgttgcgcattaacaaagcgctcgataaaacgaaacggcaaggcgcctcctttataggcatcttggatatagctggattcgagatcttcgatcttaattcgtttgagcagttgtgcatcaattatactaacgagaagttacagcagctttttaatcatactatgttcatcctggagcaggaggagtaccagcgcgaggggattgaatggaactttattgattttggcctcgacctacagccttgtatcgatttaatagagaagcccgctggccccccagggatcctcgcattgctggacgaggaatgctggttcccaaaggccacagacaagtccttcgtagagaaagttatgcaggagcagggaactcatccaaaattccaaaagcccaaacagctgaaagacaaagcagatttttgtattattcattacgccgggaaagttgattataaagccgacgaatggcttatgaagaatatggacccacttaacgacaacatcgcgacactgttacaccagagcagcgacaagtttgtgagtgaactgtggaaggatgtggaccgcattatcgggctggaccaggttgcagggatgagcgagactgccctgcccggtgcctttaagacaaggaaaggtatgttcagaacggtgggccaactgtataaggagcagctcgctaaattgatggcgacgctgcgtaacactaatccaaatttcgttagatgcataatacctaatcacgagaagaaggccggaaaactggacccccatctggtacttgatcagcttagatgtaacggagttctggaaggaataagaatatgtcgtcagggatttccaaaccgggtggtgtttcaggagttcagacaaaggtatgagattcttacacccaacagcattccaaaagggttcatggatggcaaacaagcctgtgtgctgatgatcaaagccttggaactggatagcaacctgtacagaattgggcagtcaaaggtatttttccgggccggcgtattagcccacctggaagaagaacgtgatctgaagattaccgacgtcatcattgggttccaagcttgctgcagaggatacctggcgagaaaagcctttgcaaagcggcaacagcagctgacagctatgaaggtgctgcagagaaattgcgccgcttatctcaagcttcgaaactggcaatggtggagactgtttactaaggtgaaacctctcttacaggtcagtagacaagaggaagaaatgatggccaaggaggaagagctggtgaaggtgcgcgaaaagcaactcgcggccgagaacaggctgaccgagatggagaccctgcaaagccagctgatggcagagaagctgcagctccaagaacagctgcaggcggaaaccgaactctgtgccgaggccgaggaacttcgcgcacgacttaccgccaagaagcaagagctggaggagatttgccacgatctcgaggccagggtggaggaggaggaagagcgctgtcaacacttgcaggctgaaaaaaagaaaatgcaacagaacatccaggagcttgaagagcagttggaggaggaggaatctgcaagacagaaactgcagttggagaaagttaccacagaagccaagttaaagaagctggaagaagagcagattatcctcgaggaccaaaattgcaagttggctaaggaaaagaaactgctggaggaccggattgctgagtttaccacaaacctaaccgaagaggaagagaagtccaaaagtctcgccaaattgaaaaataaacacgaagctatgattactgacctggaggaaaggttgaggcgagaagaaaagcaacggcaggaactggagaaaacacgacgaaagctggaaggcgactccaccgacttatcagaccaaatagccgagttacaggctcagattgcggagcttaagatgcagctcgccaaaaaagaggaggaactccaagccgcattggctagagttgaggaagaagccgcacagaaaaacatggcgctgaagaagatcagagaattggagagtcagatcagcgagctgcaagaggacctggagtcggagcgcgcttccaggaacaaagctgagaaacaaaagcgtgacttaggggaggagttagaggctctgaagacagaactcgaagacacgttagacagcactgctgcccagcaggaattgcgctccaagagagaacaggaggtgaacatcctgaaaaagaccttggaggaggaggcaaagactcatgaagcccagatacaggagatgcgacagaagcattcccaggctgtcgaggaacttgccgaacagctagagcagaccaaaagagtgaaagccaacctggagaaggctaaacagacactggagaacgagagaggagaactcgctaatgaggtgaaagtgctcctgcaaggaaaaggcgatagtgagcacaagagaaagaaagtggaggcccagcttcaagaactgcaggttaaatttaacgaaggggagcgcgtcaggactgaacttgccgacaaggtgactaagcttcaagttgagcttgacaacgtgaccgggctcttgtcccagtcagactctaaaagctcaaaactgaccaaggatttctccgcgttggaatctcagttgcaagatactcaggagctccttcaggaggaaaatcgccagaaactcagcctgtccacaaaactcaaacaggttgaggatgagaaaaattcatttcgggaacagctagaagaagaggaggaggccaaacataatcttgaaaagcagattgctaccttacatgcccaggtggccgatatgaagaagaagatggaagactctgtaggatgtctagaaacggctgaagaggtgaagcggaaattacaaaaggacttggaaggactgagccagcgtcacgaagaaaaggtcgctgcgtacgacaagctcgagaagacaaagaccagactgcagcaagagttggacgacttgctggtggacctggatcaccagaggcagtccgcatgcaacctagaaaagaaacaaaaaaagtttgatcagctgctggcggaagaaaagactattagcgccaagtatgctgaggaacgcgatcgcgccgaagctgaggctcgtgagaaggagaccaaagccctatcactagcccgggcccttgaagaggcgatggagcaaaaggcggaactcgaaaggctcaataaacaatttcgcacagagatggaggatttgatgagttcaaaagacgacgtaggcaagagcgttcatgaattggaaaagtctaagcgagccctggagcagcaagttgaagagatgaagacgcagctggaggaactagaggatgagctccaggctaccgaagatgccaagctgcgcctggaagtgaacctgcaggcaatgaaggctcagttcgagcgggatctacagggaagagatgaacaatccgaggagaagaaaaagcagttggtgcgccaggtgagggagatggaggccgagctcgaagacgagaggaagcagaggagtatggctgtggccgcaaggaagaagctggaaatggatcttaaggacttggaagcacatattgatagcgctaataagaacagggatgaggcaatcaagcagcttcgcaaactccaggcccagatgaaggactgtatgagggaactagacgacacaagggcttcacgcgaggagatccttgcacaggctaaggagaatgaaaagaagctcaaatcaatggaagcggagatgattcagctccaggaagaattagctgcagccgagcgagctaagcgacaggcacagcaggagcgtgacgagttggcggatgagatcgcgaacagttcgggtaaaggagccctcgccctggaagagaagaggcgtctggaggccaggatcgcgcaactggaggaagaactcgaagaagagcaaggcaacactgagttgattaacgatcggttgaaaaaggcaaacctgcaaatagaccagattaatacagatttgaacttagagagatcccacgcacagaagaatgagaatgctcgtcagcagttagagagacagaataaggagctgaaagtaaaactgcaggaaatggagggaacagttaagtccaaatataaagctagcatcaccgccctcgaagccaagatcgcccagctcgaggagcagctcgacaatgagaccaaggagagacaggctgcctgtaaacaggtcagaagaaccgaaaagaaacttaaagacgtgcttctgcaggttgatgatgaacgcagaaatgccgaacaatataaggaccaggctgataaagcctccactcggctgaagcagttgaaacgccagctggaggaggccgaggaggaagctcagcgagcaaacgcctccaggagaaagctccagcgagaattggaggacgctaccgagacggctgacgctatgaatcgggaagtcagttcattgaaaaataaattgaggcgaggcgatttgcccttcgtcgtaccaagaagaatggctaggaagggagccggagatggttctgacgaggaagtcgacgggaaagccgacggagcggaggccaaacctgcagagtag

SEQ ID NO: 30839 - DNA, 501 bp, Artificial Sequence
  Description of Artificial Sequence: Synthetic coding sequence
atggctcagcggctcctgttgcgccgctttttggcaagtgtgatctcccgcaaaccatcccagggccagtggccaccgttaacctctcgggctctgcaaactccacagtgtagtcccggaggccttactgtgaccccgaacccggcccgaaccatttacacaacaagaatctccctcacaacattcaatatccaagatggaccggattttcaagatcgcgttgtaaactccgaaacccccgtcgtggtggatttccatgctcaatggtgtggcccatgtaaaatcctcggccctcggcttgaaaaaatggtggcaaaacagcacggcaaggtagtcatggctaaagtggatattgacgaccacaccgatctggctatagagtacgaggtgtccgccgtgccgactgtgctcgctatgaaaaatggcgatgtcgttgacaaatttgttggaatcaaggacgaagatcaactggaagcgtttctgaagaaactcatcgggtag

SEQ ID NO: 30840 - DNA, 2877 bp, Artificial Sequence
  Description of Artificial Sequence: Synthetic coding sequence
atgtcagaatgcggggggagaggaggcggatctagctccagcgaagacgccgaagatgaaggcggcggcggcgggggaccagctggcagtgactgccttagttcttcccctaccctggcaacagcttccagcgccgggcggctgcgtcgcgggctgcggggcgcttttcttatggccagacagagacccgagctcctctgtggcgctgtagccttgggatgcgcgttactccttgccctgaagtttacatgttctcgagctaaggacgtgattattcccgctaagccacctgtgagcttcttctccctgaggagtcccgtcctggacctattccagggacaactggactacgccgaatatgtccgccgcgactccgaggtggtgctgctcttcttttacgctccttggtgcggacagtcgatcgcagcacgcgcagagatagagcaggcagcgtcaaggttatcagatcaggtgctgtttgtggccatcaactgctggtggaaccagggaaaatgccgaaagcagaagcacttcttttacttcccagttatctacctgtatcacagaagctttggccccatcgaatacaagggccccatgagcgccgtttatattgaaaaatttgtgaggcgagtgatgaagcccctgctttacataccttcacagtcagagttgctcgactttctttcaaactacgaaccgggcgtgctcggatactttgagttcagcggatctcctcaacctccaggttacctgacgttttttacctcagcgcttcactccctcaagaaggactatctggggaccgtgcgctttggtgtgatcactaataaacacctggctaagctggtatcactagtacattcgggctctgtttatctccaccgccacttcaacacctccttagtgtttccgcgcgaagtactgaattatacagctgagaatatctgcaaatgggctcttgaaaaccaagagacactgtttaggtggttaagaccccacggtgggaagtcactattgctgaataacgaactcaaaaagggaccggcgttgttcttattcattccatttaaccccctcgcagaatcgcacccattgattgatgagatcaccgaagttgctcttgagtacaacaattgtcacggcgaccaggttgtcgagcgcctgttacagcatttgagaagggtagacgctccagtcctcgagagcttagctctcgaagttcccgcacaactgccagaccctccaacgatcaccgcaagtccgtgttgcaatactgtggtgctcccgcaatggcatagtttttcgcgtactcataatgtctgcgagctgtgtgtgaatcagacatccgggggcatgaagcccagttccgtctcagttccacaatgcagcttttttgaaatggctgcagctctcgattccttttatctgaaggaacagaccttttaccacgtggctagcgattccattgaatgtagtaacttcctcactagttactcccctttctcttattacacggcatgctgtcgcacaatttcccgaggtgtttcaggattcatcgactccgaacaaggcgtgtttgaggcgccaacagtggctttctcatcattggagaaaaagtgtgaggtagacgctcctagcagtgtgccacatatcgaagagaacaggtacctgttccctgaggttgacatgaccagcaccaactttacagggctgtcctgtaggaccaataagaccttaaacatctacctgcttgactcaaatctgttctggctgtatgcagaaaggttgggcgcaccttcctcaacacaggtcaaggaatttgctgctatagtagatgtgaaggaagaatcacactatatcctcgatccaaagcaggctctgatgaaacttactttagagtcctttatacagaatttttccgtgctgtattctcccctcaaacgtcacctgatcgggagcggaagtgcccagttccccagccagcacctcattactgaggtgacaacggataccttctgggaagttgtgttgcagaagcaggacgtgctactgctatattatgccccttggtgtggattctgtccaagcctaaaccacatctttatccagctagcaaggaatctgccaatggacacctttactgttgctcgcatagacgtttctcagaatgacctcccgtgggagtttatggtggatcgattgcctaccgtgctgttttttccttgcaaccgaaaggaccttagcgtcaagtatcccgaagatgtgcccattactctgcccaatttattgcgcttcatactgcatcacagcgatcccgccagctcaccccagaatgtggccaatagtccaacaaaggagtgcctccagtctgaggctgttctacagcgggggcacataagccacctagagcgggagattcagaagctgagagccgagatcagctctctccaacgggcgcaggtgcaggtggaaagtcagctttcaagtgcccgccgggatgagcatagactgaggcagcagcagcgtgcactggaggaacagcacagcctactccacgctcacagcgagcaactccaggcactgtacgaacagaagacgagggagctgcaggaactggcaagaaaactccaggaactggcagacgctagcgaaaacctcctaacagagaacacctggctaaagattcttgtcgctaccatggagcgcaaattagagggacgggatggcgccgaatcactagcagcgcagcgtgaggtacatcccaagcagcccgaaccaagcgccactccacagctccccggttctagcccacccccggccaacgtgtccgcaacactcgttagtgagagaaacaaagagaaccgcacggattag

SEQ ID NO: 30841 - DNA, 2958 bp, Artificial Sequence
  Description of Artificial Sequence: Synthetic coding sequence
atgagcgaatgtggcgggcgggggggcgggtccagttcatcggaggacgcagaggatgagggcggaggcggaggcggacccgctggttccgactgtctgtcatccagtcccacattagctacggcctcctccgcaggtagattgcgccgtggactccgcggcgcttttttgatggcacggcagcggcctgaacttctgtgcggcgctgtggccttaggatgcgctttgctcctcgctctcaaatttacctgctctcgcgccaaggacgtgatcattcccgccaagccccccgtatcatttttctcacttaggtctccagtgttagacctgtttcagggccagctcgattatgctgagtatgtgagaagggattcagaggtcgtgctactctttttttatgcaccgtggtgcggtcagtctatagcagcaagagccgagatagaacaggcagcatcccgacttagtgatcaagtgctgtttgttgcaattaactgttggtggaaccagggcaaatgccgcaaacaaaagcactttttttactttcccgtaatttacttgtatcatcgctctttcggccctatcgaatacaaggggcccatgagcgccgtatacatcgaaaagttcgttaggagagtgatgaaacctctcctatatataccaagccaatccgagttgctggatttcttgtccaactatgagcccggagtcctggggtactttgaattttcaggatctccgcagccacccgggtacttgacctttttcacctctgccctccactcgctgaaaaaggccttggaatctactagtagcccgagagccttggttagcttcactggggaatggcacctggagactaaaatctatgttctggattatcttgggactgtcaggttcggtgttatcacaaataaacatctcgcaaaactcgtttctctggtgcactccggatccgtttacctccacagacatttcaatactagcctcgttttcccacgagaggtgctgaactacactgcggagaacatctgcaagtgggcactcgaaaaccaggagaccctttttaggtggcttaggcctcacgggggcaagagcctcctcttgaataatgagttgaaaaaaggccccgccctgtttttgttcatcccctttaatcctttagcggagtcccatcccctcatcgatgagatcaccgaagtggcactcgagtataataattgccatggcgaccaggtagttgagaggttgctgcaacacctcagaagagttgatgccccagtgctggagtcccttgcgctggaagtgcctgcccaactgcctgatcccccaacgataactgcctctccgtgctgtaataccgtggtgttacctcagtggcactccttcagtcggacacacaacgtttgtgagctctgtgtaaatcagacaagcggtgggatgaagccgtccagtgttagcgtccctcagtgctccttctttgagatggctgccgctctggactcattctacctcaaggagcagaccttctaccacgtcgcttccgacagcatcgagtgctccaatttcctgaccagctacagccccttttcatactatacagcatgttgtaggactatttccaggggggtttccgggttcatcgacagcgagcagggcgtcttcgaagccccaacagtggccttctcttctctcgagaagaagtgcgaggtcgatgcaccttcgtcagttccccatatagaggaaaatcgatatctgtttcctgaggtggatatgacttcaacgaactttacagggctgagttgcaggacgaataaaactcttaacatctaccttctggatagtaatcttttttggctgtatgccgagaggctaggagctccttccagcactcaggtaaaggagttcgccgctatcgtggatgtaaaggaggagagtcactacatcctggaccctaagcaagccttgatgaaactgacgctggagagtttcattcagaacttcagtgtgctctatagcccactcaaacgtcatctcatcggcagcggcagcgcacaatttcctagtcaacatctaattaccgaagtcaccacagacaccttttgggaggtggtgttgcagaaacaggatgtgctgttgctatactacgccccatggtgcggtttctgtccttcactcaatcacatattcattcagctggccagaaacctgcctatggatacgttcactgtagccagaatcgatgtgtcacaaaatgatttgccatgggagtttatggttgaccggctgcctactgtcctttttttcccatgcaaccggaaggatctgagcgtgaaataccctgaggatgttcccattaccttgccaaacctgctccgcttcatcttgcaccactcagatccggccagctctccccagaacgtcgctaacagcccaaccaaagagtgcttacagtccgaagcagtcctccagcgcgggcatatttctcacctcgaacgagaaatacagaagctgagggcggaaatcagctctcttcagcgtgctcaggtccaggtggagtcccagcttagcagcgcacgacgcgacgaacacaggttaaggcagcagcagcgggcacttgaggaacagcactcattattgcatgcccattccgaacagcttcaggctttatatgaacaaaaaacaagagagttgcaggaactcgctcgaaagttacaggagttagcagacgcttcagaaaatctgcttactgagaacacctggctgaaaattctggttgccacaatggaaaggaagctcgagggccgcgacggcgccgagtctcttgctgcacaacgggaggtgcaccccaaacagcctgagccaagcgctacgccgcagctgccaggttcatcccctcctcccgctaatgtgtccgcaacactggtgtctgaaaggaacaaggagaatcggacagattag

SEQ ID NO: 30842 - DNA, 666 bp, Artificial Sequence
  Description of Artificial Sequence: Synthetic coding sequence
atggctcgccaacggcctgaattactctgcggggcagtggccttgggttgcgctctactcctggccctcaagtttacttgctcacgcgcgaaggatgtaatcattcctgctaaaccacccgtttcttttttttcactgcggtctccagtcctggacctgtttcaggggcagctcgactacgctgagtacgtccgacgcgactccgaggtggtgctcctgttcttttacgcgccctggtgtggtcagagtatcgctgcaagggcagaaatcgagcaggccgcaagtcgactttcagaccaggttctatttgttgccattaactgttggtggaatcaaggtaagtgccggaagcagaaacactttttctacttccccgttatctacctctaccaccggtcctttggtcccatcgagtacaaggggcccatgtccgctgtctacattgagaagttcgtgagacgagtgatgaagcctctactttatatccctagccaatcagagttgctggactttctgtcaaattatgagcccggggtcctggggtactttgagtttagcggctctcctcagccccccggctatctcaccttcttcacatccgccttgcatagtcttaaaaaggacggagtcagcccctgccgtcccggctggtccgcagttgcctag

SEQ ID NO: 30843 - DNA, 1083 bp, Artificial Sequence
  Description of Artificial Sequence: Synthetic coding sequence
atggttccagcagccggccggcgccctccacgggtaatgagattattgggctggtggcaggtgctcttgtgggtgctgggtttgcctgtgaggggtgtcgaagttgccgaggagagtggccggctttggagcgaagagcagcctgcccaccccttgcaggtgggggcagtatacctaggtgaggaggagctgctacacgaccccatgggccaggaccgcgcagctgaggaagccaacgccgtgctgggactcgacactcagggcgatcacatggttatgctctcagtgattcctggagaggcggaggacaaagtcagctcggagcctagtggcgtaacatgtggtgctggtggagcagaggatagccggtgcaacgttcgtgaaagcctgttttcccttgatggcgcgggcgcccactttccagatagagaagaagagtattacacagaacctgaggttgccgagtctgatgccgcaccgaccgaagatagtaataatacagagtcgctaaaatcaccgaaggttaactgcgaggagcgcaacatcacaggcctggaaaattttaccctgaagattctgaatatgtcccaagatctgatggatttcttgaatcctaatggctcagactgcaccctggtgttattttacacaccctggtgcagattttctgcctccctggcccctcactttaattccctgccccgagcttttcctgcattacattttctggccttggacgctagccaacatagcagcctctctacaagattcggcactgtggccgtgcctaatattttactcttccagggagccaagccaatggctagattcaatcatacggatcgaaccctggagactctcaaaatattcatcttcaaccagacaggcatcgaagccaagaagaacgtggtggtcactcaggctgaccagatagggcctctgccgtctactttaataaaatccgtagactggctgcttgtgttttccctcttctttcttatatcatttattatgtacgccaccatccgcaccgagtctattcgctggttgattcccggacaagagcaggagcacgtggagtag

SEQ ID NO: 30844 - DNA, 1035 bp, Artificial Sequence
  Description of Artificial Sequence: Synthetic coding sequence
atggttccggctgccggccgcaggcctcccagggtcatgaggctgctgggctggtggcaagtgctgctgtgggttttgggcctgcccgtgcggggggttgaggtcgctgaggagagcggccggctgtggagcgaagaggaactattacacgatcctatgggacaggaccgagctgcagaagaggccaacgctgtactgggcttagacactcagggagatcacatggttatgctttccgtgattccaggggaggccgaagacaaggtttctagtgaaccttctggtgtgacttgcggcgctggcggcgctgaggattctcgctgcaatgtacgggagtctctgttctctctggacggggctggagcccatttcccagaccgcgaagaggaatattacacagaacccgaggtggcagagagtgacgcggcgcccaccgaggattctaacaacacagaaagcctcaaatcacctaaagttaactgcgaagaacggaatatcacagggctggaaaatttcacccttaagatcctaaacatgagtcaggatctgatggacttcctcaatcctaacggatccgactgcacattggtcctgttctataccccatggtgtcgattcagtgcctcccttgcaccacactttaactcccttccccgggcctttcccgccttacacttccttgcccttgatgccagtcagcattctagcttgtctacacgctttggaactgttgcagtgcctaacatcctgctcttccagggagcaaagccgatggcacgcttcaaccacactgaccggaccttggagacactaaaaatttttatttttaaccagactgggatagaggcgaaaaaaaatgtggtggtaacccaagctgatcagattgggcctctaccttctacactgattaagtcggtggactggctgctcgtgttctccctgttttttctgatcagttttatcatgtatgctaccatcagaacggaatccataaggtggctaatccctggccaggaacaggagcatgtcgaatag

SEQ ID NO: 30845 - DNA, 1014 bp, Artificial Sequence
  Description of Artificial Sequence: Synthetic coding sequence
atggaggctgggcaacaacgcgtggtcgaaaaagtggctgaagagtctgggcgcctctggtcagaagaacagcctgcacatcctttacaggtcggtgctgtttacctgggtgaagaggaacttcttcacgatcccatgggccaggaccgggccgctgaagaggctaacgccgtgctcgggctagacacccagggtgatcacatggtaatgctatccgtgatccccggcgaagctgaggataaggtgagctccgagccctctggtgtcacgtgcggcgccgggggggctgaggactcccggtgcaacgtgagagagtctctgttttctctggacggtgctggagctcactttccagatcgcgaggaagagtactacaccgaaccagaagtggccgaatcagacgcagctcccactgaggactccaacaataccgaatccctgaagagcccgaaagtgaactgcgaggagaggaatatcacggggcttgagaattttacactcaaaattctgaacatgagccaggatttaatggactttctaaatccaaatgggtcagattgcacacttgtactcttctacacaccctggtgtcggttctcagccagtctcgctcctcattttaattcactgccgcgtgcttttcctgcacttcacttccttgctctcgacgcttcacagcacagctcgctgtcaactcgattcggcacagtggctgtgcccaacatccttctgttccagggcgctaagccaatggcccgcttcaatcacacagacagaaccctagaaaccctgaaaatcttcatctttaatcaaaccggaatagaggctaagaagaacgttgtggtgacacaggcagatcagatcggccctctgcccagcacattgattaaatcggtcgattggctgctggtgttcagtctgtttttcctgattagctttattatgtacgccacaattagaactgagagcattcgctggctcatccctggccaagagcaagaacatgtagagtag

SEQ ID NO: 30846 - DNA, 1299 bp, Artificial Sequence
  Description of Artificial Sequence: Synthetic coding sequence
atgcctgccagacccgggaggctgttgccactgcttgccagaccagctgccctcaccgccttgctgttgctgttgttaggtcatggtggtggcgggaggtggggagcacgggcccaggaagcggctgcagctgccgcagatgggcctcctgctgctgatggggaggacggtcaagatccacactcgaaacacctctatactgccgacatgttcacacacggaatccagagcgcagcccactttgtgatgttcttcgctccttggtgcggacactgccagaggttacagcccacttggaacgacttgggcgacaaatataattcgatggaggatgcaaaggtctatgtggctaaagtggactgtactgctcactctgatgtgtgttcagcacagggggtacgcggctatcccacactaaagctcttcaaacccggccaggaggcggtcaagtatcaaggccccagggactttcagaccctggagaactggatgctccagacgttaaatgaggagccagtaacaccagagccagaggttgagcccccttcggcgcctgaactcaagcagggactatatgagttatccgctagcaatttcgagctgcacgtcgcccagggcgatcacttcattaaattctttgcaccatggtgtgggcactgcaaggctctggctcctacgtgggaacagcttgcactgggcctcgagcattccgagaccgtcaagatcggaaaggtggactgtacccagcactacgaactgtgcagcggtaatcaggtcagaggctaccccacactcctctggtttcgagacggaaagaaagttgatcagtataaagggaaacgagacctggaatcactccgcgagtacgtcgaatctcagctgcagagaacagagaccggggcgactgagactgtgacccctagcgaggcacccgtgctggccgcagaacctgaagccgataagggtacggtgctggccctcactgagaacaattttgatgataccattgcagagggaatcacgttcattaagttttatgccccgtggtgcggccattgcaagacactggccccaacatgggaagagctcagcaagaaagagttccccggactcgccggcgttaagatcgctgaggtggactgcactgctgagcggaacatctgttccaaatatagcgtgagagggtatcccacccttctgctgttccggggaggcaagaaggtgagcgagcactccgggggccgagatctcgattctttacatcggtttgttctaagtcaggcaaaagatgagctctag

SEQ ID NO: 30847 - DNA, 975 bp, Artificial Sequence
  Description of Artificial Sequence: Synthetic coding sequence
atggaagatgctaaggtttatgtggccaaagtggactgcactgcacactcagatgtgtgctctgcacagggggttcgcggttaccccaccctgaagctgttcaaaccaggtcaggaagccgtgaagtaccagggtcctagggatttccaaacactcgagaactggatgctgcagaccttgaatgaagagcccgtgacccctgagcccgaggtggagcccccaagcgctcctgaactgaaacagggcctgtacgagttatctgcgtcaaatttcgagctgcacgtggcacaaggtgaccactttataaaattctttgcaccttggtgcggccattgcaaggctctcgctcccacctgggaacagctcgcattagggctggagcactccgagaccgtcaaaatcggtaaagtggattgcacccagcattacgagttgtgcagcgggaatcaagtgagagggtaccccacactcctttggtttcgggacggtaagaaagtggaccagtataagggtaagcgcgatcttgagtccctgagggaatacgtcgagagtcagcttcagcgaacagaaaccggagcgaccgagacagtcaccccgagtgaggcacctgtgctagcagccgagcctgaggcagacaagggcacagtcctcgcccttactgaaaacaactttgatgataccatcgcggaagggataaccttcatcaagttttatgccccatggtgtggccactgcaagacgctggcacccacttgggaagagctctccaaaaaggaattccccggcctggcaggcgtgaagattgccgaagtcgactgcacagcggaaagaaatatctgtagtaagtatagtgttcgcggttatcccacattattgctgtttcgaggcggaaaaaaggtctctgaacacagcgggggccgggacctggattcgcttcatcggtttgttttaagtcaggctaaggacgagctgtag

SEQ ID NO: 30848 - DNA, 1083 bp, Artificial Sequence
  Description of Artificial Sequence: Synthetic coding sequence
atgactcagagcgtggacagtaatcggggcaataggaatgagaagagatgcgggcattgtcaacgactgcagccaacctggaacgacctgggggataagtacaactccatggaggacgccaaagtgtatgtcgccaaggtggattgtaccgcacacagtgatgtgtgtagcgcccagggcgtgcgcggctaccccactctgaagctatttaagcctggtcaggaggctgtgaaatatcagggaccccgcgatttccagactttggagaactggatgcttcagactcttaacgaggaacctgtgacccctgagcccgaagtcgaacccccaagtgcccccgaattgaagcaaggactttacgagcttagcgctagtaatttcgagctacacgttgcgcagggggaccacttcatcaagttctttgctccttggtgtggccactgtaaagccctggccccaacgtgggagcagctcgccctgggactggaacattccgaaacagtgaagattgggaaagttgactgcacccaacattatgagttgtgttcaggaaatcaggttagaggctaccccacactcctgtggtttcgagacggcaagaaggtggatcagtacaagggaaagcgggacctggaatcgctgcgcgagtatgtggagtcccaactgcagcgaacggaaacaggggcaaccgagactgtgactccctctgaagcgccagtgctggccgcagaaccagaggcagataagggaactgtactcgctttgactgagaataactttgacgatacgattgctgaagggattacctttattaagttctacgccccctggtgtgggcattgtaaaaccctggccccaacgtgggaggaactcagcaagaaggagtttcccggacttgccggggtgaaaattgcagaagtggattgcaccgcggaaagaaatatttgtagtaagtactcagtgcgcggatacccaacactgctgctcttcaggggcggaaagaaggtctcagagcacagcggcgggagagatcttgacagtctgcatcgattcgtgctgagtcaggcaaaagatgagttgtag

SEQ ID NO: 30849 - DNA, 843 bp, Artificial Sequence
  Description of Artificial Sequence: Synthetic coding sequence
atggccccctcaggttccctggctgtgccattagctgtcttggttttgctgctgtggggagcaccttggactcacggaagacgctcgaatgtgcgcgtgattacagatgagaactggcgggagttgttggagggggactggatgatagagttttacgccccatggtgccctgcgtgccagaacctgcagcctgagtgggagagctttgctgagtggggggaggatctagaagtgaatatcgctaaagtggacgtgacagagcagccggggctaagtgggcggttcatcatcaccgctctgcccacaatttaccactgtaaggacggcgagttccgtcgctatcaggggcccagaaccaagaaggactttattaattttattagcgataaggagtggaaaagcatcgagcctgtctcctcttggttcggtcctggtagcgtgctgatgtcttccatgtcagccctcttccagctgtccatgtggatccgcacctgtcataactattttatagaagatctgggcctgcctgtctggggctcttacactgtctttgctttggccacgctgttctctggactgttgctgggtctttgcatgatcttcgtggcagattgcctgtgcccttccaagcggaggcggccccagccatatccttatccatccaaaaagctactgtcagagagcgctcagccgcttaagaaagttgaagaggaacaggaagctgatgaggaggacgtatcagaagaggaagctgaatctaaggaaggtaccaataaggacttccctcagaacgcgatcagacagcgcagtcttggacccagcctcgctacagacaaatcttag

SEQ ID NO: 30850 - DNA, 891 bp, Artificial Sequence
  Description of Artificial Sequence: Synthetic coding sequence
atggctgtgttggctccccttatcgctctcgtttactcagtaccacgcttgagccgttggctggcccagccctactacctgctcagtgctctgctgagcgcagcttttctgttggtcaggaagcttccgcctctgtgccatggacttcccacccaacgggaggacgggaatccttgtgatttcgattggagagaggtagagattcttatgttcctgtctgccattgtcatgatgaagaaccgccgcagtataacagtggagcaacacatcgggaatatcttcatgttcagcaaggtggccaatactattctgttctttcgactcgacattcgcatgggactgctgtacattacactctgcattgtttttctcatgacatgcaagccgccactctacatggggcctgagtatattaaatacttcaacgataagactatagacgaggaactggagcgggacaaacgggttacttggatcgtggagttctttgctaattggagcaacgattgccaaagcttcgctccgatatacgcagatttgtccctgaaatacaattgcaccgggctgaattttggcaaggttgatgtaggcagatacacagacgtctccaccagatataaggtctcaacatcccccctgaccaagcagctgccaacactgattctctttcagggagggaaagaggctatgaggcgaccccagatcgataagaaagggcgagcagtgtcctggaccttcagcgaggagaacgttatccgggaatttaacttgaacgagctctatcagcgagcgaagaagctgtctaaggctggggataacataccagaggagcaacccgtcgcctccacacctactaccgtgagcgacggggagaataaaaaggataaatag

SEQ ID NO: 30851 - DNA, 777 bp, Artificial Sequence
  Description of Artificial Sequence: Synthetic coding sequence
atggcagtcctggcacccctcatcgcccttgtgtacagtgttcctcggctgtctcggtggctggcccagccttactatctgctgagcgctctgctgtccgcggcattcctgctcgtgaggaaacttcctccactgtgccacgggctgccgacacagagggaggatggcaatccttgcgactttgactggcgcgaggtcgaaattttgatgtttctatcggcaatcgttatgatgaagaataggcgctcaatgttcttgatgacttgcaaacctcccctgtatatggggcctgagtatatcaaatattttaacgataaaaccatcgacgaggaattagagagggacaagagggtcacttggattgtcgagttctttgctaattggtccaacgactgtcagagtttcgcacccatttacgcagacctgtcactcaagtacaattgtaccggactgaactttggcaaggttgacgtgggaagatacacagatgtcagcactagatacaaggtaagcacctctccccttacaaagcaactgcctacccttatactgttccaggggggaaaggaggctatgcggcgccctcagatagataaaaaaggccgcgcggtgagctggacttttagcgaggagaacgtgattcgtgagtttaacctcaacgaactttaccagagggccaagaagctgtctaaggcgggtgataatattccagaagaacagccagtcgcaagcacccccaccactgtctccgacggcgaaaacaaaaaagacaaatag

SEQ ID NO: 30852 - DNA, 1365 bp, Artificial Sequence
  Description of Artificial Sequence: Synthetic coding sequence
atggctgcctggaagtcttggaccgctctgaggctttgtgccacagtcgtggttctcgatatggtggtgtgtaagggatttgtcgaagaccttgatgaatccttcaaggaaaaccgaaacgatgatatttggctggtcgacttttatgctccatggtgtggtcactgtaagaaacttgagccgatctggaacgaagtgggattggagatgaaaagtatcggcagtcctgtgaaggtcggaaagatggatgccacgtcatattcatccatcgcctctgagttcggggtgcggggctacccaacaatcaaacttttgaaaggggatctagcatacaactaccgaggccctcggactaaggacgacataatcgagtttgctcaccgggtctctggtgcccttatccgccctctcccctctcagcagatgttcgaacacatgcagaaacggcatcgggttttttttgtatacgtgggtggcgagtctccactgaaggaaaagtatattgatgcggccagcgaactcattgtgtatacatatttcttcagcgcctctgaggaggtggtgcccgaatatgtaacgcttaaagaaatgccagcagttttagtgttcaaagacgagacctacttcgtatacgacgaatatgaggatggggatctatcctcctggatcaatcgggaacgcttccagaattatcttgctatggatgggtttctcttatatgagttgggtgacacgggaaagctagtcgctctggcagtcatcgacgagaagaatacttcagtagaacatacaaggcttaagagcattattcaagaagtcgccagagactacagggacttgttccacagggacttccaattcggccatatggacggcaacgattatattaacaccctcttgatggatgagttgaccgtgcctacggtcgtcgtgctgaatacttccaatcagcagtatttcctgctggataggcagataaaaaacgtggaagacatggttcagttcattaataatatcctggatgggactgtggaggcacagggtggagactcaattctgcagcgtctgaagaggattgtgttcgacgccaagtctaccatagtgagcatctttaagagcagcccactgatgggctgcttcctgtttggcctgcctcttggtgtgataagcatcatgtgctacggtatttataccgctgataccgatgggggctacatcgaagagagatatgaagtgtctaagagcgagaatgagaatcaggagcaaatcgaagagagcaaggaacaacaggaaccttctagcgggggatctgtcgtccccacggtgcaggaaccaaaggatgtcctcgaaaaaaagaaagactag

SEQ ID NO: 30853 - DNA, 594 bp, Artificial Sequence
  Description of Artificial Sequence: Synthetic coding sequence
atggctgcatggaaatcatggacagctctaaggctgtgtgccaccgtggtggtcctggatatggtcgtctgcaagggctttgtcgaagatctggatgagtcttttaaggagaatcggaatgatgacatatggcttgtggacttctacgcaccctggtgtggacactgcaaaaagctggaacctatctggaacgaggtaggattagagatgaagtcaattggctcccctgtcaaagtcgggaaaatggacgccacgagttattcgagcatcgcctccgagtttggcgttcggggctatccaacgattaaacttgcactaatccgccccctccctagccagcagatgttcgaacacatgcagaaacggcatcgcgtgttctttgtttatgtaggcggggagagccccctgaaagagaagtatattgatgccgcctctgaattaatcgtctacacatacttcttcagtgcttcagaagaggttgtccccgagtatgtcactctgaaagagatgcccgccgtgctcgtcttcaaggatgagacctatttcgtgtatgacgggaagtttcaaatttttaactcctgtaagacattttag

SEQ ID NO: 30854 - DNA, 1257 bp, Artificial Sequence
  Description of Artificial Sequence: Synthetic coding sequence
atggctgcttggaaaagctggacagccctgcggttgtgcgccacagttgtcgtcctagacatggtcgtgtgtaagggttttgtcgaggatttggatgaatccttcaaagaaaaccgcaatgatgacatctggctggttgacttctacgctccctggtgcggccactgcaagaaactagaacctatctggaatgaggtcggtttggaaatgaagagcatcgggtctcctgtaaaagtagggaagatggatgccacttcctacagttcaatcgcctcagagttcggtgtcagggggtaccccaccattaagctcttgaagggcgatcttgcgtacaattatcgtggtccgcgcaccaaagatgacattatcgagtttgcacaccgcgtttccggggccctgatccgaccactccccagccaacagatgtttgaacatatgcagaagaggcacagggtattctttgtctatgtggggggggagagcccactgaaagaaaaatacatcgatgcagccagtgagctcatcgtatacacttattttttttctgcttccgaggaggttgtgcccgaatatgtgacacttaaggagatgcctgccgtgcttgtttttaaggatgaaacttacttcgtgtatgatgaatacgaagacggcgatttgtcctcatggatcaaccgtgaacggttccaaaactacttagccatggatggatttctgctctatgagcttggggatacaggtaaactggtagctctggcagtgatagacgagaagaataccagtgtcgagcacactcgacttaagtccattattcaggaagtggcacgagattatcgcgacctgttccaccgagatttccagttcggacatatggacggcaatgactacattaacaccttgctgatggacgagttgacagtgccgactgtggttgtgctgaacacgagcaaccagcagtatttcttgcttgaccgccagattaagaatgtagaagatatggtacaattcataaataatatactcgatggaaccgttgaggcacagggaggcgacagcatccttcaaagactgaaacgaatcgtgttcgatgccaagtcaacgatcgttagtatattcaagtccagcccacttatggggtgcttcctttttgggctgcccctgggcgtgatttctataatgtgctatggcatatacaccgcagataccgatggggggtacatagaagaacggtacgaagtgagcaagaagaagaaaaagtag

SEQ ID NO: 30855 - DNA, 1050 bp, Artificial Sequence
  Description of Artificial Sequence: Synthetic coding sequence
atggccggcgggagatgtggccctcagttaacagccttgttggctgcttggatcgctgcagtggctgctacagcaggaccagaggaggctgccctccctcctgaacagagtcgggtgcagcccatgactgcttccaactggacactggtcatggagggcgagtggatgttaaagttctacgcaccgtggtgtccctcctgccagcagacggatagcgagtgggaggcctttgctaaaaatggggaaatcctccagattagcgtgggaaaagtcgacgtaatacaggagccgggtctgagtggtaggttttttgttaccacgctcccggctttttttcatgccaaggatgggattttccggcgataccgcggccccggaatcttcgaggatctacagaattacatcctggagaaaaagtggcaaagtgtggaacccctcaccggatggaagagccctgcctctttgacaatgagcggaatggccggcctgttctcgatttcagggaaaatctggcaccttcataactactttacagtcaccctagggataccagcttggtgtagttatgtgtttttcgtgattgccaccctggtgttcgggctgtttatgggcctcgtgctggtggttatctcagaatgcttttacgtgccgctgccaaggcatctcagcgagcgttctgagcagaatcggcgatctgaagaggctcatcgtgcagagcagttacaggacgctgaggaagaaaaagacgacagcaatgaggaggaaaataaggactcacttgttgatgacgaggaagaaaaggaagacttgggcgatgaggatgaggccgaggaggaagaggaggaggacaatctagccgctggggtagatgaggaacgctccgaggctaatgaccagggtccaccaggggaagatggcgtgaccagagaggaagtggaacccgaggaggctgaggaggggataagcgagcagccttgccctgctgacactgaagttgtggaggattctctgcggcagaggaaatctcagcatgccgacaagggactgtag

SEQ ID NO: 30856 - DNA, 1806 bp, Artificial Sequence
  Description of Artificial Sequence: Synthetic coding sequence
atggactggggaaccgaactgtgggaccagtttgaggtcctggaaagacacacccagtggggactggatcttctcgataggtatgtgaagttcgtgaaggagcgcacagaggtcgagcaggcgtacgccaagcagctccgcagcctcgtcaagaagtaccttccgaaacggccagccaaggacgacccggagtcaaaattctcacagcagcaaagctttgtgcagatcctgcaggaggttaacgactttgccggacagagagagctcgttgcagagaatctgagcgtgcgggtgtgtttagagctgacaaaatattctcaggagatgaagcaggagcgcaaaatgcacttccaggaagggaggcgggcccagcagcagttggaaaatggattcaaacagctggagaatagcaagcgcaagtttgagcgggattgccgcgaggcggagaaagccgcacagactgctgagcggttagaccaagacattaatgccactaaagcagatgtcgaaaaggcaaaacagcaggcacatctgaggagccacatggcggaagaatcaaaaaacgagtatgccgctcaactacaaaggttcaacagagatcaagctcatttctactttagccagatgcctcagattttcgataagctacaagacatggatgagcgtcgggccacccgtcttggcgcaggctatggactcctctcagaagctgagctggaagtggtacctatcatcgccaagtgccttgaagggatgaaagtggccgccaatgccgtggatccaaagaatgactcccatgtcctgattgagttgcacaagtccggattcgccagacctggtgatgtggagtttgaggacttttcccagcctatgaaccgcgcaccctccgatagcagcttaggcacgcctagtgacggccggccagagctgcgaggacctggcagatcaagaaccaagcgctggcccttcggtaaaaaaaacaagccacgaccccctcctctatctcctctcggcgggcccgtaccaagtgccctgcccaatgggccgcctagcccacgctctgggagagatcccctggccattttgtccgaaatttctaaaagtgtaaaaccccggctcgcttcctttcgatctctgaggggaagcaggggaaccgtcgtcacagaggacttcagtcatctgcctcctgaacagcaaagaaaaagactgcaacaacagttggaggagcgatcccgtgagctccagaaggaagtcgaccagcgcgaggctctgaagaagatgaaggatgtatatgagaaaaccccgcagatgggagaccccgcatctctggagccccagatcgcggaaactctgtcgaacatcgagagactgaagcttgaagtccagaaatatgaggcttggcttgctgaggctgagtccagagtgttaagtaatcgcggggactcactatcgagacatgcgaggcccccagatccgccggcttctgccccccctgatagttcgtccaactctgctagccaggacaccaaagaaagctcggaagaacctccctccgaggagtcacaggacacacccatctatactgagtttgacgaggatttcgaagaagaaccgactagtcccatcggccactgtgttgcaatctatcattttgaggggtcctcggaagggactatttcaatggctgaaggagaagacctgtcattgatggaagaagacaaaggagatgggtggacgcgagtgaggcgaaaagaaggtggagaaggatacgtacccactagctatctacgcgtgacgctgaattag

SEQ ID NO: 30857 - DNA, 1638 bp, Artificial Sequence
  Description of Artificial Sequence: Synthetic coding sequence
atggactggggcactgaactctgggaccagttcgaagtcctcgagcggcacacacagtggggcctggatctgctggacaggtacgtgaaatttgtcaaggaacgtaccgaggtggagcaggcctatgcgaagcagttacggtccctcgtgaagaaatacttgcccaaaaggcccgctaaggacgatccggaaagcaagttctcacagcagcagagctttgtgcagattcttcaggaggtgaatgacttcgcggggcagcgggagctcgtagctgagaacctgagtgtgagagtgtgcctggagctcactaaatattcacaggaaatgaaacaggagcgcaagatgcattttcaagaaggccgtcgggcccaacaacagttggagaatggcttcaagcagctggaaaactctaaacgaaaattcgagcgagattgccgtgaagcagaaaaggctgctcagacagccgaaaggctggaccaggacatcaacgccaccaaggccgacgtcgagaaagctaagcagcaggctcacttgaggagccatatggccgaggaaagtaagaatgaatatgcagcacagctccagcgattcaaccgcgatcaggctcacttctattttagtcagatgccccagatttttgacaaactccaagacatggacgaaagacgggccacccggctgggggctggttacggcctcttgtccgaggcagagcttgaggtcgtccccattatagctaaatgtctggaaggtatgaaggtcgcagccaacgcagtggatcccaagaatgactcccatgtactcatcgagttacacaaaagtggattcgccaggcctggcgacgtcgagtttgaagattttagtcagcccatgaatagggcccccagcgactctagcctcggcacgccttccgacggcagacccgaattgaggggacctggacgatctcgcacaaaacgatggcccttcggaaagaagaataagacagtagtgactgaagacttctcacacctcccccccgaacagcagcggaagaggctgcaacaacagctcgaggagagaagccgagagctccagaaggaggtcgaccaaagagaggccctgaaaaaaatgaaggacgtatatgaaaaaactccgcagatgggagatcccgcaagtctcgaaccccagatcgccgagactctatcaaatatcgaaaggttgaagctggaggtacagaaatacgaggcgtggctggcggaagctgagtcccgagtgctctcaaatcgaggcgattcattatccaggcacgccagaccccccgaccccccggcttccgcacctcctgactcatcctctaattctgcatcccaggacactaaggagtcctcagaggagcctcctagcgaagaatcacaagatacccctatctatacagaatttgatgaggacttcgaagaagaaccaactagccctattggacattgcgttgcaatttaccattttgagggcagctctgaagggactattagtatggcagagggcgaggatctctcactgatggaagaggacaagggggatggttggacccgcgtgcggcgcaaggaaggcggggaggggtatgttccaacaagctaccttagggtgaccctcaactag

SEQ ID NO: 30858 - DNA, 1782 bp, Artificial Sequence
  Description of Artificial Sequence: Synthetic coding sequence
atggattggggaacagaactttgggatcagttcgaagtgttggagagacatacccagtgggggctcgacctgcttgatcgctacgtcaagtttgtcaaggagcgcacagaagtggaacaggcgtatgccaagcagcttagatctctggttaagaagtacctgccgaaacgcccagcaaaggacgatcccgaatctaaattctcacagcaacagtcttttgtgcaaatcctgcaagaagtgaatgactttgcaggtcaaagagaacttgtagcggaaaatctgagcgtgagagtgtgtctggagctcacaaagtattcgcaggaaatgaaacaggaaaggaagatgcatttccaggaggggaggcgagcacaacagcaactagagaatggctttaagcagctcgaaaactccaaacggaagttcgaaagggattgtagggaggcagaaaaagccgcccagaccgcggagagactggatcaggatattaacgcaaccaaggccgatgtcgagaaggctaagcaacaggctcacttgaggtcccacatggcagaagagtccaagaatgagtacgccgcccagttgcagcgttttaacagggaccaggcccacttctattttagccagatgccacagattttcgacaagctgcaggacatggacgagaggcgagctaccagactcggggcaggatatgggcttctgagcgaggcggagctggaggtcgtgcccattattgctaagtgtctggagggtatgaaggtggcggcaaacgctgtcgacccgaagaacgactcccatgtcctaatagaactccataagtccggattcgccagacctggtgatgtggaatttgaagacttttctcagccaatgaaccgcgcaccgtctgacagttcacttggcacaccgagcgacggacgaccagaactgaggggtcctgggagatctcgcaccaaacgatggcctttcggaaaaaaaaataaaaccgtcgtcaccgaagacttttcacatctaccgcctgagcagcagagaaagcggcttcagcaacaattagaggaaaggtctagagagcttcagaaagaggttgaccagagagaagcattgaagaagatgaaggatgtctacgagaagacaccccagatgggagacccagcctcattggaacctcagatcgcggaaaccctatccaacattgagcggctgaaattagaggtgcagaaatatgaggcctggcttgcagaggccgagagtagggtgctgtctaaccgcggtgatagtctatcaagacacgccagaccccccgacccccccgcttccgctccaccagattcctctagcaacagtgcatctcaggatacaaaggaaagttcagaggagccacctagtgaggagtctcaggatacacccatatacaccgagtttgacgaggactttgaggaagagccaacgtccccaattggccattgtgtcgctatttaccatttcgaagacttagggccccctccaccgccctcccagggcccagcccgcgctctctccctctggccgagggtaaagaccagtgtactgtggaaaaaaaccaaggggacggcggggccgggctctggaggcaaaagagaggcacgtgctacctgcccaccaccaacatccgagtctcggtctattgagccatgccagcgccgagaggagggtgggtgtcgcctgctcttgttaggtcacggggagccccaagacttatgcaccctgtttctgactccttggctgagacttcggcctgtctag

SEQ ID NO: 30859 - DNA, 1299 bp, Artificial Sequence
  Description of Artificial Sequence: Synthetic coding sequence
atggatgaggccgtgggtgacctcaaacaggccctgccatgcgtggccgagagtcctaccgttcatgtggaagtacaccagcgtggctccagcacagcgaagaaggaggatattaatctctctgttcgtaagctgctaaataggcataatattgtgtttggggactatacatggaccgaattcgacgagcctttcctgacaagaaacgtgcagagcgtgagcattatcgacaccgagctgaaggttaaggacagtcaacctatcgacctaagcgcttgtaccgtggctctgcatatttttcaactgaatgaggatggaccttcctcggaaaacttggaagaggaaactgagaacatcatcgctgccaatcattgggtcctgcccgcagctgaattccacggcctgtgggactcgctagtgtacgacgtggaggtgaaatcacacctgctggattatgtgatgacaaccttactgtttagcgataagaacgtgaactccaatttgataacctggaatcgggtggttctgttacacgggccaccaggaacaggcaagacatccctctgtaaggcccttgctcaaaagctaaccatccggctatcaagtcgttacaggtacggacaactgattgagatcaatagtcatagcctgttctcaaaatggttctcggaatctggcaagctggtgacaaagatgttccagaaaatacaggatctaatcgatgataaagacgctcttgtgttcgtgctgatcgatgaggtcgaatccctgaccgcagcccgaaacgcatgcagagcaggaaccgaaccatctgacgcaataagagtggtcaacgccgttcttactcagattgaccagataaaacgacatagtaacgtggtaattctgacgacctcgaacattacggagaagatcgacgttgcgtttgttgatagggctgatataaaacaatacatcggaccaccttccgcggccgctatcttcaaaatatacctgagttgtctggaggaactgatgaaatgccagatcatatatcctcgccagcagttgctgacgctccgggagctagagatgatagggttcatagagaataatgtgtccaagcttagtctgctcttaaacgacatcagcaggaagtcggagggcctgagtggccgggtgctccggaagttgcctttcctcgcacacgccctgtacgtccaagcacctaccgtaacaatagaaggatttcttcaggccctgtcattggccgtggataagcagttcgaagagcgcaagaaattggccgcttatatctag

SEQ ID NO: 30860 - DNA, 591 bp, Artificial Sequence
  Description of Artificial Sequence: Synthetic coding sequence
atggatgaggccgtcggcgatctgaaacaggcccttccatgtgtcgccgaaagccctactgtccatgtggaggtgcatcagagggggagttccacggcgaaaaaggaggacatcaacttaagtgtgcggaagctcctgaacagacacaacatcgtgttcggtgactacacgtggactgaattcgatgagccattcctgacgaggaacgtgcagagcgtaagcattatcgacactgagctgaaggtcaaggactcccagcccatcgatctgtccgcttgtacagtcgccctccacatctttcagctgaatgaggacggtccatccagtgaaaacctggaggaagaaacggaaaatatcatagcagccaaccactgggtgctgccagcggccgagttccatggcttatgggactccctggtctacgatgtggaagttaagagtcatctgctggattacgtcatgactactctgctgttttctgataagaacgtcaactccaatctgataacaatcgagggatttctgcaagccctgtcactggctgtggacaagcagtttgaggagagaaaaaagctggctgcatatatttag

SEQ ID NO: 30861 - DNA, 744 bp, Artificial Sequence
  Description of Artificial Sequence: Synthetic coding sequence
atgccccgccttctccatccagcgctgcctctactgctgggcgctacacttaccttcagggccttacgccgggctctgtgtcgtctgcctctccccgttcatgtcagagccgaccccctccgcacgtggcgctggcataacttactggtttccttcgcccattctatcgtctcggggatctgggcactgctgtgcgtgtggcagacacccgacatgctcgtagagattgagaccgcctggagcctgagtggttacttgttggtttgcttcagcgccggatattttattcacgacacagttgatattgtcgcaagtgggcagaccagggcatcttgggaatacctggtgcaccatgtgatggctatgggtgcgttttttagcgggattttctggagtagctttgtcggaggaggtgtccttaccctgcttgtagaggtgtccaatattttcttaaccatcaggatgatgatgaagatctcaaatgcccaggatcatctgctgtatcgtgtcaacaaatacgtgaatctcgtaatgtatttcctcttccgcctcgccccgcaggcctaccttactcactttttcctaaggtatgtaaatcagcggaccttgggcaccttcttgttaggcattctgctgatgttggatgtcatgatcattatctatttctctagattgctcagatctgacttttgccctgaacacgtacctaagaagcagcacaaggacaagttccttacggagtag

SEQ ID NO: 30862 - DNA, 603 bp, Artificial Sequence
  Description of Artificial Sequence: Synthetic coding sequence
atgggatatagtgctgtgcccaagtgccccccaaggggcagagggagggatagcgtgtggcagactccagacatgctggtcgaaattgagactgcttggtctttgtccggctacctgctggtgtgtttttctgcaggctatttcattcatgacaccgtggatatcgtagcatcaggccagactagggcctcctgggagtacttggtgcatcacgttatggctatgggcgctttcttttcgggaatcttctggtcttcctttgtgggcggtggcgtcttgacgctccttgtggaggtttctaatattttcctgacaataaggatgatgatgaaaattagcaacgcccaggaccacctgctgtatagggtgaacaagtatgtgaatctggtcatgtattttttgtttagactggctcctcaggcctatctgactcacttttttctcagatacgtcaatcagcgtacactgggaactttcttgctcggaatcctactgatgctggacgtcatgattattatctacttctcaagactgctaagatccgacttctgtccagaacacgtgcctaagaaacagcataaagacaaattcttgaccgagtag

SEQ ID NO: 30863 - DNA, 624 bp, Artificial Sequence
  Description of Artificial Sequence: Synthetic coding sequence
atggcagcagcttggcctagcggcccctccgcccccgaagccgttacagcaagattggttggggtgttgtggttcgtgtctgttactactggaccttggggcgccgtggctacaagcgcagggggggaggagtccctaaaatgcgaagatctgaaggtggggcagtacatctgcaaggatccaaagataaatgacgcaacccaggagcctgtgaactgcacaaactataccgcacacgtaagctgctttccagcccccaacattacatgcaaagatagttccggcaatgagacccacttcacaggaaacgaagttggcttcttcaagcctatctcatgtcgaaatgtgaatgggtattcatacaaagtcgcagtggccctgtccctattcctgggatggctgggcgccgaccggttttatctgggctatccagcactcggcctgctcaaattctgcactgtgggtttttgtggtatcggctcgttaatagattttattttgataagtatgcaaatcgtcggtccctcagacggatcatcttacatcatcgactactacgggacccgtctgacgaggctatctattaccaatgagacattccgcaagactcaactgtatccctag

SEQ ID NO: 30864 - DNA, 561 bp, Artificial Sequence
  Description of Artificial Sequence: Synthetic coding sequence
atggccgccgcctggccgtctggcccttccgctccagaggctgtcactgctcgattggtcggcgtgctgtggtttgtatctgtcacaacgggtccttggggcgcagtcgctaccagcgctggcggagaagagagtcttaagtgtgaggatttgaaagtaggccaatatatttgcaaggaccccaagatcaatgacgccacacaggaacccgttaattgtaccaactataccgctcatgtgtcatgtttccctgcccctaacatcacatgcaaagactcatctggaaatgaaacacacttcactggcaatgaagtaggcttctttaaacccatctcatgcagaaatgtcaacggttactcatacaaggtagccgtcgcattatcactgttcctaggctggctgggagctgatcggttctacctcggatatccagcacttgggaaggaaacagtgactcgcgaggtgaagggtttcactgagtcaaggggatttccacttttctgcgacatattcgtcgttatcatcttcgtgctctggattggaaaactgtcacgtgattag

SEQ ID NO: 30865 - DNA, 531 bp, Artificial Sequence
  Description of Artificial Sequence: Synthetic coding sequence
atggcagcagcatggccctcaggcccctccgctcccgaagctgttacggctaggctggtgggcgttctatggttcgtgtccgtgaccacgggcccttggggggctgtcgctaccagcgcagggggtgaggaatcactgaaatgcgaagacctgaaggtgggccaatatatctgtaaagatcccaagatcaacgatgctacgcaagagcccgtcaattgcaccaactacacagcacacgtgagctgcttcccagcacccaacataacttgcaaagattcctccggcaatgagactcacttcacaggcaacgaggtcggcttttttaaacctattagctgcagaaatgtcaacggctatagttataaggtagccgtcgcactgtccttattccttgggtggctgggcgctgataggttctacctaggatatcctgcactcgggctcctgaaattttgcacagtcggcttttgcggaatcggaagcctgatcgattttattctcatcagtatgcaggtatctttttccatttag

SEQ ID NO: 30866 - DNA, 810 bp, Artificial Sequence
  Description of Artificial Sequence: Synthetic coding sequence
atgcacatcctgaaggggtccccaaacgtgattccaagggcccacggtcagaaaaacacccgacgcgatggtacaggactttatcccatgaggggtccctttaagaatttagcccttctaccattttctctccctttgctgggtggtgggggctccggtagcggcgagaaagtcagtgtgagcaaaatggcagccgcttggcctagcggaccgtcagccccagaagcagtcaccgcccggctggttggcgtcctgtggtttgtttctgtaaccacgggaccgtggggcgccgtcgctacgtccgccgggggggaagagtccctgaaatgtgaggacctgaaggttggccagtacatctgcaaagatcccaagattaacgacgccacacaagaaccggtcaattgcacgaactatactgctcatgtgtcttgcttccccgcccccaatatcacctgcaaggactcttcagggaatgaaacccactttacagggaatgaggttgggtttttcaaacccatatcatgcagaaacgtgaacgggtacagctataaggtggctgttgcgctgtccctgttcctaggctggctgggagccgatcggttttatctcgggtaccccgccctgggtttgctcaagttctgcaccgtgggtttctgcgggatcggaagcctcattgactttatcctaataagcatgcagattgttgggccaagtgacggtagcagctatatcatagattactacgggacccgtctgacaaggctctcgatcaccaacgaaacatttcgcaaaacccagctttacccttag

SEQ ID NO: 30867 - DNA, 516 bp, Artificial Sequence
  Description of Artificial Sequence: Synthetic coding sequence
atgaaaaagtgtcttctacctgtcctgatcacatgcatgcagacagcgatttgcaaggacaggatgatgatgattatgattctcctcgtgaattataggccagatgaatttatcgaatgcgaagacccagtcgatcacgttggcaatgcaacagcctctcaggagctgggttacggttgccttaagtttggcggccaggcttacagcgacgtggagcatacttcagtccaatgccacgccctggatggaatcgagtgcgcctctccccgtacgttcctgagagagaataagccttgcatcaagtacactggccattactttatcaccaccctgttatatagcttcttcctcgggtgctttggtgtcgataggttttgtctgggccatactggtactgcagtggggaaattactcacactagggggactaggtatttggtggtttgtagacctgattctactgatcacaggaggactgatgccatctgacggaagtaactggtgtacagtctattag

SEQ ID NO: 30868 - DNA, 516 bp, Artificial Sequence
  Description of Artificial Sequence: Synthetic coding sequence
atgaagaagtgcctgttaccggtcttgattacatgtatgcagaccgccatttgtaaagataggatgatgatgatcatgattttgcttgtcaactacagacctgatgaattcatcgagtgtgaggaccccgtggatcatgtgggaaatgctactgcctctcaggagctcggctacggctgcctgaaatttgggggccaggcctacagtgacgtggagcacacttctgtccaatgtcacgccctcgatgggatcgagtgtgcctccccacgcacctttcttagagagaataagccatgcattaagtacaccggacattatttcattacaacacttctttactccttcttccttgggtgcttcggcgtagacaggttttgcttggggcatacagggaccgcggttggaaagttgttaacactaggcgggctgggcatatggtggtttgtggatctcattctccttatcaccggtgggcttatgcccagcgacggttctaactggtgtactgtttactag

SEQ ID NO: 30869 - DNA, 645 bp, Artificial Sequence
  Description of Artificial Sequence: Synthetic coding sequence
atggtgctcggtggctgccctgtatcttatcttctgctgtgcggtcaggccgctttactgcttggtaacttattgttgcttcactgtgtgtcccgttcccactcccagaacgctaccgcagagccggaattaacgagcgccggagcagctcagcccgagggacctggaggggcagctagttgggagtacggcgacccccatagtcccgtgatcttgtgtagttacctgcctgatgagtttatcgaatgcgaggatccagtggaccacgtcggaaatgctaccgcatcccaggaacttggctatggttgcttgaaattcggtggccaggcctactctgatgtggaacataccagtgtgcaatgtcacgccttggacgggatcgagtgtgcttcaccccggacttttctccgagaaaataagccctgcattaaatacacaggccattacttcattaccactctgctttactctttctttttaggatgctttggtgtggataggttttgcctgggacacacaggcacagccgtcggcaagctcttaaccctgggcggcctggggatttggtggtttgtggatctgatccttttaatcaccggcggtctgatgccctccgacggttcaaactggtgcacagtctactag

SEQ ID NO: 30870 - DNA, 516 bp, Artificial Sequence
  Description of Artificial Sequence: Synthetic coding sequence
atgaagaaatgcctgctgccagtcttgattacctgtatgcagaccgccatctgcaaagatcgcatgatgatgattatgatcctgttagttaactaccggcctgacgagttcatcgagtgtgaggacccagtagatcatgtgggtaatgccacagcatctcaggaactgggctatgggtgtctgaagttcggagggcaagcgtattccgacgtggagcacactagcgtgcaatgtcacgcattagatggtatcgagtgcgcctcacctagaaccttcctaagggagaataagccatgcataaaatacaccggccactattttattacaaccctgctgtactctttctttcttggatgttttggtgtagatagattttgccttggacacactggaaccgctgtcggcaagctcctgaccctgggaggactgggcatctggtggttcgtggacttgattctgctcatcaccggtgggctcatgccttcagacggtagcaattggtgtacagtgtactag

SEQ ID NO: 30871 - DNA, 192 bp, Artificial Sequence
  Description of Artificial Sequence: Synthetic coding sequence
atgaagaaatgtctgctacctgtacttataacttgcatgcaaactgcaatctgcaaggatcggatgatgatgatcatgattcttttagtcaattatcgcccagacgagttcatcgagtgtgaagatcccgtcgaccatgtgggcaacgccaccgcctctcaggagctcggctacggctgcttaaaagtttag

SEQ ID NO: 30872 - DNA, 138 bp, Artificial Sequence
  Description of Artificial Sequence: Synthetic coding sequence
atgaagaagtgtctactacctgtgttgatcacatgcatgcagaccgccatctgcaaagaccgcatgatgatgataatgattctactggtgaactatcggcctgacgagtttattgagtgcgaggacccagtcgattag

SEQ ID NO: 30873 - DNA, 366 bp, Artificial Sequence
  Description of Artificial Sequence: Synthetic coding sequence
atgaagaaatgcctgctacctgtgcttattacatgcatgcagacggctatctgtaaagataggatgatgatgattatgatcttgttagtcaactacaggccggatgagtttattgaatgtgaggacccagtggatcatgtgggtaatgccacagcgtctcaggagctggggtatgggtgcctgaaatttggcggccaagcatatagcgacgtggaacacacctcggtccaatgtcatgctcttgacggaatagagtgtgccagccctaggaccttcttaagagagaacaagccctgcatcaaatacacaggtcactattttatcacaaccctgctctattcgttcttcctgggctgtttcggatag

SEQ ID NO: 30874 - DNA, 1215 bp, Artificial Sequence
  Description of Artificial Sequence: Synthetic coding sequence
atgcctagaccgggatctgcacagcggtgggcagcagtggcaggtcggtggggctgtcgactgcttgctctgctcctcctcgtgccaggccccgggggagcatctgaaatcacatttgagcttccggacaatgctaagcaatgtttttacgaggacattgcccagggtactaagtgtactctcgaatttcaggttattactggcggtcattacgacgtggattgccgcctagaagatccggacggcaaagtcctctacaaggaaatgaagaaacagtacgatagctttacgtttacagcgagtaaaaacggtacatacaaattttgtttctcgaacgagttttccacctttactcacaagacagtttacttcgattttcaggtaggggaggatccacccctgtttcctagtgagaacagagtgtctgcccttacacaaatggagtccgcatgcgtctctatccacgaagcactgaagtccgtgattgattatcagacccacttcagattgagagaggcacaaggacggagtagggcggaagacttgaacacacgggtggcatactggcactctgtggacacttctcccggttaccatgagtcggacagcaaaaaaagcgaggacctgtcactctgcaatgtggcagagcatagcaataccaccgagggacccaccggcaagcaggagggggcacaaagcgtcgaggagatgttcgaggaagaggccgaggaggaagtcttcctcaaatttgtaattctgcatgctgaggacgataccgacgaagctctgagagtacagaacttgttacaggacgatttcggaataaaacccgggatcatcttcgccgagatgccttgcgggaggcagcaccttcagaacctggatgacgctgtcaacggttccgcttggactatcttgctcctaacagaaaattttttgcgcgacacatggtgtaactttcagttctacacgtccttaatgaattccgtgaataggcaacacaaatacaattccgttatccccatgaggcctttgaataaccctctcccacgcgagcgcacaccatttgcactgcagacaattaacgcactggaggaagagtcgagaggctttccaacccaggtagagagaattttccaggagtcagtttataagacgcagcaaaccatttggaaggagacaaggaatatggtgcaacggcaattcatcgcctag

SEQ ID NO: 30875 - DNA, 567 bp, Artificial Sequence
  Description of Artificial Sequence: Synthetic coding sequence
atgcctcgcccgggatctgcgcagaggtgggccgccgttgccgggcgttggggatgtcgcctgctggccctgctgctgttggtccctggacccggcggagcgtccgaaataaccttcgaactgcctgacaatgccaagcagtgcttttatgaagacattgcccaaggcacaaagtgtaccctggaattccaggtcattacaggcggtcactatgacgttgattgcagactggaagaccccgatggcaaggtgctgtataaggagatgaaaaagcagtacgacagtttcacattcaccgcttctaagaacggaacctacaagttctgcttttccaacgaattctccaccttcacccataagactgtctattttgattttcaggtcggtgaagatccaccccttttcccaagcgagaaccgcgtctccgcccttacccaaatggagtccgcttgtgttagtatccacgaggctctcaagagtgtgattgactaccagacccacttccgccttagggaggcccagggtaggtctagggcagaagatctcaacacccgtgtagcctattag

SEQ ID NO: 30876 - DNA, 375 bp, Artificial Sequence
  Description of Artificial Sequence: Synthetic coding sequence
atgccagttcggggcccagacgtggaggcctattgcctcagatgcgagtgtaagtacgaggaacggtcctctgtcaccataaaggtgaccataattatttatctgagcattctgggtctccttctgctctatatggtgtacctcactctggtggagcccatattgaaaagacggctcttcggacacgctcaattaatccagagcgatgacgacattggggaccatcagccattcgccaatgctcacgacgtcttggccaggagccggagtagagcaaacgttttgaacaaggttgaatatgcgcagcagcggtggaagctgcaggtccaagagcagcggaagtccgtgttcgaccgacatgtagtgctgtcatag

SEQ ID NO: 30877 - DNA, 375 bp, Artificial Sequence
  Description of Artificial Sequence: Synthetic coding sequence
atgccagtcagggggccagatgtcgaggcttactgcttgcggtgtgaatgtaagtatgaagaacgctctagcgtgacgattaaggtcacaataatcatttatttgtctatcttgggattgctcctgctgtacatggtctatctgactctcgtggagccaatcctgaaaagaagattgttcggtcacgcacagcttatacagtccgacgacgatatcggcgaccatcaaccattcgctaacgctcacgacgtgctcgcacggtcaaggagccgggccaacgtgctgaataaagtggagtacgcacagcagaggtggaagctgcaggtccaagaacagcgcaaaagtgtttttgaccgccatgtggtcctgtcttag

SEQ ID NO: 30878 - DNA, 597 bp, Artificial Sequence
  Description of Artificial Sequence: Synthetic coding sequence
atggcaaccctgtggggcggtctactgagactcggctccttgttgagcctgtcctgcttggctctatccgtgctgctgctagctcagctgagcgatgcggctaagaattttgaggatgtacggtgtaaatgcatctgccctccttataaggagaactccggacacatctacaataaaaacatatcgcagaaggattgtgactgccttcacgtagtggaacccatgcctgtgcgaggacccgacgtcgaggcctactgccttcggtgtgaatgcaaatatgaagaaaggtcttcagtgactattaaggttaccattatcatttacctgagtatcctcggcctgctcctcctgtacatggtgtatctgaccctcgtagaaccaatcctgaagagacggcttttcggccatgctcagcttattcagtcagacgacgacatcggcgaccaccagcccttcgccaatgcccacgatgtcctggcccgatctcggtctcgagcgaatgttttgaacaaagtcgaatacgctcagcagcgctggaagctccaggtgcaggaacagagaaagtccgtgtttgacaggcacgttgtgctgtcttag

SEQ ID NO: 30879 - DNA, 318 bp, Artificial Sequence
  Description of Artificial Sequence: Synthetic coding sequence
atgtatcggcctgtcatggctagctgcacttcagtatcactgtggatgattgcacttcttgtattcggagtcctggcgatcttcgggataaccatcggcctgctcgtccactttcttgccgttgccaaccggatctacttctatcagggctccttcaagatgttggatattccctacaactctaattacgagcgggaaaccagtcctgaaaataactacctctcccagattctggaaaccaggtggctgatgcatttcaaagtcctggcttttacggataatattagctttctcaagagctcccactggtgtaagtag

SEQ ID NO: 30880 - DNA, 1413 bp, Artificial Sequence
  Description of Artificial Sequence: Synthetic coding sequence
atgcccggctttgattacaagttcctagaaaagccgaaacgccgactactatgcccattatgcggcaaacctatgcgggagccggttcaggttagcacttgtggccacagattttgcgatacctgtctgcaggagttcctctctgagggcgttttcaaatgcccagaagatcagctcccactggactatgcaaagatttacccggatccagaactggaggtccaagtgctgggccttccaatcagatgtatccacagcgaggaggggtgtcggtggtccgggccccttagacacctacaggggcacctgaatacatgcagttttaatgtgattccctgccccaaccggtgtcctatgaagctttcccggcgagacctgccagctcacttgcaacacgactgtccaaagaggcggctgaaatgtgaattttgtgggtgcgatttcagcggcgaggcatacgagtctcacgaggggatgtgccctcaggagagtgtgtattgcgaaaataagtgtggagcaagaatgatgcgacgtctgctggcgcagcacgccacttctgaatgtcccaagcgaacccagccatgtacatattgtaccaaagagttcgtttttgatacaattcagtcccaccagtatcaatgcccccggctccccgtggcctgccccaaccagtgcggagtgggcacagtagcacgcgaggacttacctgggcatctgaaggatagttgcaacactgccttagttctttgcccctttaaagattctggctgtaagcaccggtgccccaaactggctatggctaggcacgttgaagagtctgtgaaaccccatcttgccatgatgtgtgccttggtaagtcgccagaggcaggagctccaggaactgcgaagagaactggaagaactcagtgtgggaagtgacggcgttttaatctggaagatcggcagctacggtagacggctccaagaggccaaggctaaaccaaacctggagtgctttagtccagccttctatacacataaatatggttataagctgcaagtctcggcctttttaaacggaaatggctctggggagggtacgcacctttccctctacatccgagtacttcctggcgccttcgacaaccttctggaatggccattcgctaggagagtgacattctccctcctggatcagtccgacccagggctcgcgaagccgcagcatgtcaccgagactttccaccctgaccccaactggaaaaactttcagaaacctgggacctggagaggcagccttgacgagtcttcactggggtttggatatcctaaattcatcagccatcaggacatccgaaagagaaattatgtccgggacgacgcagtgttcataagagctgccgtggagctgcctcgaaagattctgagttag

SEQ ID NO: 30881 - DNA, 588 bp, Artificial Sequence
  Description of Artificial Sequence: Synthetic coding sequence
atgcccggtttcgactacaaatttttggaaaaacccaaacgcaggctgctgtgccctctgtgtggtaagccaatgagggaaccggtacaggtctcaacctgcggccatcgattctgcgacacctgtttgcaagaatttctctccgaaggcgttttcaaatgcccagaagatcagctcccactcgattatgctaaaatctaccccgaccccgaactggaggtccaagtcttaggcttgcccattaggtgcattcatagcgaagagggatgccggtggagtggaccactgcgtcacttacagggacatctgaacacatgcagctttaatgtcataccttgcccaaatcgctgccccatgaagctaagccgaagggacctgccagcacacttgcagcacgattgccctaagcgcaggctgaaatgtgagttttgtggttgtgatttttctggcgaagcctacgaaagctcactaggtttcggataccctaagttcatatcccaccaagatatccgcaagcgtaattacgtgcgtgacgatgccgttttcatccgtgcagccgtggagcttcctagaaagatcctcagttag

SEQ ID NO: 30882 - DNA, 504 bp, Artificial Sequence
  Description of Artificial Sequence: Synthetic coding sequence
atgcctggctttgattacaaatttctcgagaagcccaagaggaggctgctctgccccctttgcggcaaacctatgagagaaccagtgcaggtatcaacttgtggacatcggttctgcgatacctgcctgcaggtcagtgccttcttaaatggaaacggcagtggcgaggggacacatctgagcttgtacattcgagtcctgcccggagccttcgataatttgttggaatggccgttcgccaggcgcgtcacattctccctgctggaccagtccgaccctgggctggcaaagccccagcacgtaaccgagacgttccatccggacccaaattggaagaatttccagaagcctggaacgtggaggggctcactggatgaaagttctctgggtttcggctatcccaagtttatatctcatcaagacatcaggaagaggaactacgtcagagacgacgccgttttcattcgggccgccgtggagcttccccgaaaaatcctgagctag

SEQ ID NO: 30883 - DNA, 435 bp, Artificial Sequence
  Description of Artificial Sequence: Synthetic coding sequence
atgcctgggtttgattacaagttccttgagaagcccaaacgcaggctgctgtgtcctctttgcgggaagcccatgagggaaccggtacaggtgagcacatgcggccacaggttttgtgatacatgtctccaagaattcctgagtgaaggggtgttcaagtggccttttgccagacgcgtgaccttttcgcttctggatcagtctgatccaggactggcaaaaccacaacacgtgacggaaacattccatccggacccaaattggaaaaattttcagaaaccagggacatggcgcggatccctagacgagtcctctctggggtttgggtatccaaaattcatctcgcatcaggacatcaggaaacgcaactacgtccgggacgacgccgtatttataagggccgctgtagagctgcctcgcaagatcttgtcatag

SEQ ID NO: 30884 - DNA, 549 bp, Artificial Sequence
  Description of Artificial Sequence: Synthetic coding sequence
atgcctggtttcgactacaagttcctggagaaaccgaaacgccggttgttatgtccgttatgcgggaaacccatgcgggaacccgttcaggtaagtacgtgcggccatcgtttctgtgacacgtgcctgcaggaatttttgtcagaaggagtatttaagtgtccagaggaccagctccccctggactacgccaaattcccacacccttacccgcagatatatcccgaccctgagctggaggttcaagtcttaggcttgcccatccggtgcatccactctgaggaggggtgccggtggtcaggacccctccggcacttgcagggacatttgaacacctgctcctttaatgtcataccttgtcccaaccgctgccccatgaaactctccaggcgcgatctgccagctcacctgcaacacgactgccccaaacgtcgtctgaaatgtgagttttgtggctgcgacttttcgggcgaagcttatgagtctcatgaaggaatgtgtccacaggaatcagtgtattgcgagaacaaatgcggggcccggatgtag

SEQ ID NO: 30885 - DNA, 1179 bp, Artificial Sequence
  Description of Artificial Sequence: Synthetic coding sequence
atgcctggattcgattacaagttcctggagaaaccaaagcgacgacttctgtgtcccctgtgtggcaaacctatgcgtgaaccagtgcaagtttcaacatgtgggcacagattctgtgatacatgtctgcaggagtttctttcagagggtgtctttaagtgcccagaggaccagctcccactcgattacgccaaaatttacccagaccctgaactcgaggtacaggtgctcggcctgccaattcgctgtattcactcagaagaagggtgtcggtggtcaggacccctgcgccacttacagggtcacctgaatacgtgtagcttcaacgtcattccatgcccgaatcggtgcccaatgaaactgtctagacgcgacctgcccgcccacctacagcatgactgcccaaagcggcggctgaagtgtgagttttgtggatgcgacttctcgggcgaagcctatgaatcacatgaaggtatgtgcccgcaagaaagcgtttattgcgagaataaatgtggagcccgaatgatgcggcgccttttagcccaacacgctacaagtgagtgccctaaacgaacacagccatgtacatactgcaccaaggagttcgttttcgataccatccagagccaccaatatcaatgcccacgactgcccgtggcatgccccaaccagtgtggggtcggcacagtggcccgagaggaccttcccgggcacctgaaagacagttgcaatactgccctggtgttatgcccatttaaggatagcgggtgtaaacacaggtgcccaaagctcgctatggccaggcatgtggaagagtctgtaaaacctcacctggccatgatgtgcgcccttgtgagccgacagaggcaggaactccaggaactaagacgtgagcttgaagagttgtcagttggcagcgatggggttcttatttggaaaattggttcctacggtcggagattgcaggaggctaaggctaaacccaacttggagtgtttctcccccgctttctacacgcacaaatatggctacaagttacaggtctcagcgtttcttaacgggaatggatccggtgaaggtacccatctcagcttgtacatccgggtcttgcccggcgcattcgacaacctattagagtggcctttcgcccgcagggttaccttctcactgctgggctag

SEQ ID NO: 30886 - DNA, 597 bp, Artificial Sequence
  Description of Artificial Sequence: Synthetic coding sequence
atgcctggattcgattataagtttctcgaaaagccaaagcggcgcttactgtgtcctctatgcggaaagcctatgcgagaaccggtccaggtctctacgtgcggtcaccggttttgtgatacttgcctccaggagtttctgtctgagggcgtttttaagtgtcccgaggatcagcttcctctcgattacgcaaaaatttacccggatccagaattggaggttcaagtgttaggtctgcctattagatgtatacacagtgaggaaggctgcagatggtctggacccctccgccacttgcaggggcacctgaacacatgctcattcaacgtgattccctgtcctaacaggtgtccaatgaaactatcccgaagggacctacccgcacacctgcaacatgactgccccaaacgccgcctgaagtgcgagttctgcggctgcgacttctctggagaagcttacgagtctcatgaaagtagcctgggtttcggctatcccaagtttatctcacatcaggacatacggaagcggaattatgtgcgggatgacgcggtgttcattcgggctgccgttgagctccctcgcaagatcctgtcttag

SEQ ID NO: 30887 - DNA, 2436 bp, Artificial Sequence
  Description of Artificial Sequence: Synthetic coding sequence
atgagactgattaggaacatctacattttctgttccatagtgatgacagctgagggggacgcgccagaattacccgaagagagagaattaatgactaattgtagtaacatgtccctcagaaaggtccccgccgacctgacaccagctactacaactctcgatctgtcttacaacctcttgtttcagctccagtcgagcgacttccactccgtctctaagctccgcgttctgatcctttgtcacaacaggattcaacagctcgacttgaagaccttcgagttcaacaaagaattgaggtacctcgacctgagtaataacaggctgaaaagcgtgacatggtacctgcttgccggactgaggtatctggatctatcctttaatgatttcgatactatgcctatctgcgaggaagcgggcaatatgtcacacttagaaatacttgggttatctggcgccaaaatccaaaagtccgattttcagaagatagcccacctccacctgaacactgtcttcctgggatttcgaaccctccctcattacgaggaaggcagtcttcctatccttaatacaaccaaactgcatatagtgctacctatggacactaatttctgggtcctccttcgcgatggaatcaaaacctcaaaaatcttggagatgactaatattgatgggaaatcccagtttgtgtcgtacgaaatgcagcggaacctttccctcgaaaatgcaaagacctctgtgctcctactcaataaggtagacctgttgtgggacgatctctttctaatccttcagttcgtatggcacacaagcgttgagcacttccaaatcaggaacgtgacatttggaggtaaggcatacctcgatcacaattctttcgactactccaatacggtcatgcggaccatcaagcttgagcatgtacacttcagagtattttacattcagcaggacaaaatctacctcctgctcaccaagatggatatcgagaatctgaccatctccaacgcgcaaatgccacatatgcttttccctaattaccccacaaaatttcagtacctaaactttgccaataatattttaacggacgagctgttcaaaagaacaatacagttgccacacctgaagacacttatattgaatgggaataagctagaaactttgagcctggtctcatgcttcgcgaacaatacaccactcgagcatcttgacttatcccagaatctgctgcagcacaagaatgacgaaaattgctcgtggcccgagacagtcgtgaatatgaacttgagctacaacaagctttccgattccgtcttccggtgtctcccgaagagtattcagatccttgacctgaataacaatcagatccagaccgtaccaaaagagacgattcatctgatggcgctgagggagttaaacatagctttcaacttcctcaccgatttaccgggatgctctcatttctccagacttagtgtcctcaatatagaaatgaactttattctgtcaccatctcttgacttcgtccaatcatgccaggaggtaaaaacgttgaacgccggcagaaatccattccgatgcacttgtgaattgaaaaatttcatccagctcgagacatactcagaggtgatgatggtcggctggagcgatagctacacctgtgaataccccctgaaccttcgcggcacacgtctgaaggatgtccacctgcacgagcttagctgcaatactgctctgctgatagttacaatcgtggtgatcatgctcgtactgggactggccgtcgccttctgctgtttgcattttgacttgccctggtatcttcgcatgctcggacagtgcactcagacatggcatcgtgtcaggaagactacgcaggagcaacttaaacgtaatgtcaggtttcacgcctttatatcttattctgaacacgacagtttgtgggttaagaatgagctgatccccaatcttgagaaggaagatgggtctattctaatatgtctgtatgaaagctattttgacccgggaaagagcattagcgagaatattgtctctttcatagagaagtcctacaagtcaattttcgtgctcagccctaacttcgttcagaacgaatggtgccactacgaattctacttcgcacatcacaatctgtttcatgagaactcagatcacataatcctgatcttactggaacccatccccttttattgcatccctactcgatatcataagctcaaggccttgctggagaaaaaagcctacctggaatggcctaaggatagacgcaagtgcggattattctgggctaatcttagagccgcaatcaacgttaatgttcttgccaccagagagatgtatgaactgcagacttttactgagctcaatgaggagtcgaggggaagcacgatttcattaatgaggaccgattgtctttag

SEQ ID NO: 30888 - DNA, 2436 bp, Artificial Sequence
  Description of Artificial Sequence: Synthetic coding sequence
atgaggctgataaggaatatctacatcttctgttcaatagtgatgaccgccgagggcgacgctccagaacttcctgaagagagagagctgatgacgaattgctccaatatgtccctccggaaggttcctgccgatttgacccccgcaacaactaccttggacctttcgtacaacctcctgtttcagctccagtcctctgacttccactccgtctctaagctccgagtcctgatactctgccacaaccgcatacagcagctggatctgaagactttcgagtttaacaaagagctcagatatcttgacctcagcaataaccgcctcaagagcgtaacctggtacttgcttgccgggctgagatacttggatctgagtttcaacgatttcgacacgatgccaatttgtgaggaggctggaaacatgtcccaccttgagatactgggacttagtggagccaagatccagaagtctgatttccagaagattgcccacctacatcttaataccgtgtttttggggttcagaaccctgccacactatgaggaaggctccctgcctatcctcaataccaccaagctgcacattgtacttcctatggataccaatttctgggtgcttctccgcgacggaataaagacatccaaaatattggaaatgaccaacatagacggcaaaagtcaatttgtgtcatacgaaatgcagcggaacttatcactggagaacgctaaaacaagcgttctgctgctgaataaggttgacctgctatgggacgacctttttctcattttgcaatttgtctggcacaccagcgttgagcatttccagatccgcaatgtcacattcggcggcaaggcatatcttgatcataatagctttgattatagcaacactgtcatgaggaccattaagctggagcacgtgcattttcgggttttctatatacagcaggataaaatttaccttcttctgactaaaatggatatcgaaaacttgactatcagcaatgcacaaatgcctcatatgctatttcccaactacccaaccaaattccagtatctaaacttcgcaaataatattttaacagacgaactgttcaagcgaactatccaactgccgcatctgaagacgctgattctcaacggaaacaagctggagaccctctctctggtctcatgctttgcaaacaataccccattagaacatcttgacctctctcagaatttacttcagcacaagaatgacgaaaattgttcgtggcctgagaccgtggtaaatatgaacctgtcatataataagctgtcggactcagtgttccgctgtctgcccaaatctattcagatcctcgatctcaataataatcagatccagaccgtccccaaagagactattcatctaatggcgctgcgcgaactcaatatcgcttttaacttcctcaccgatctgcccggttgctcacactttagtcggctgtctgtgctgaatatcgaaatgaatttcatcctgagcccatcactggatttcgtgcagtcctgtcaggaggtgaaaacattaaatgccggccgcaacccctttcgctgtacctgtgagttaaaaaacttcattcaactggaaacttattctgaggtcatgatggtcggctggtctgattcatatacctgcgagtaccctctgaacttgcgaggcactcgattgaaagacgtgcatctgcacgaactgagctgtaatacagctctgctgattgtgactattgttgtcataatgctggttctcggtttagccgtggcattttgctgcctgcattttgacctcccgtggtacctgagaatgctcgggcagtgtacccagacctggcacagggtgagaaagaccacacaggagcagctgaagcggaacgtaaggttccacgcctttatttcctattctgagcatgactcactgtgggtgaagaacgaactcatcccaaatcttgaaaaggaggatgggtcaattctgatttgtctgtatgagtcctattttgaccctggcaaatccatttccgaaaacatagtaagcttcatcgaaaagagttataagagcatcttcgtcctctcaccaaacttcgtgcagaacgaatggtgtcattacgagttctactttgctcatcacaacctgttccacgaaaattctgatcatattatcctgatcctcttggagccgatccccttttattgcattcctacccgttaccacaaacttaaagctcttctggaaaagaaggcctatctggaatggcccaaagatcgtagaaagtgtggactattctgggccaacctgcgggcggcaatcaatgtcaacgtgctcgctactcgggagatgtacgagctgcagacctttactgagctcaacgaggaaagccgaggatctactatatccctcatgcgtacagattgtttgtag

SEQ ID NO: 30889 - DNA, 2436 bp, Artificial Sequence
  Description of Artificial Sequence: Synthetic coding sequence
atgaggttaattagaaatatctacattttctgcagcattgtgatgaccgcggaaggagacgcccctgagttaccagaagagcgagaactgatgactaattgcagcaacatgtccttacgtaaagtccctgcggatttgacgcctgccacaactacattggatctctcctacaatctcctgtttcagcttcagagctccgattttcactctgtaagtaagttaagagtcctgatactctgccacaataggatccaacagttggacctgaaaaccttcgagttcaataaggagctgcgttacctggacctttccaataatcgtctgaagtcagtcacttggtatttgctggcgggcctgcgatatctggatctgtcgttcaatgatttcgacaccatgccaatctgcgaagaggccggtaatatgagccatctggaaattctggggctttcaggcgcaaagatacaaaaatccgatttccagaaaatcgcgcatctgcacttgaacacagtgttcctaggttttcggacccttccgcattacgaagagggcagcctacccattctgaacaccaccaaactccacattgtactgcctatggataccaacttctgggttctgctgcgcgacgggattaagacgagcaagatcttagagatgacaaacattgacggaaagagccagttcgtgagctacgaaatgcagagaaacctttctctggagaatgctaagacatcggtgttgctgctgaataaggtcgacctgctgtgggatgatcttttccttattctccagttcgtctggcatacctccgtggaacacttccagatccgaaatgtaacatttggaggcaaggcatatctcgaccataattccttcgattactctaacaccgttatgcgcactattaagctcgaacatgtgcacttcagggtcttctatattcagcaggataagatttatctgctgttgaccaaaatggatatcgagaatctaaccatttctaatgctcaaatgccccatatgttgttcccaaattaccccacaaagttccaatacttgaactttgcaaataacattctgaccgacgaactattcaaacgtacgattcagctgcctcatttgaagactcttattctcaacggtaacaaactggaaacactgagtctggtatcatgcttcgctaataacacacctcttgaacatttggacttgtctcagaacctgcttcagcataagaacgatgaaaactgcagctggcccgagacggtggtgaatatgaatctctcctataataaactgagtgattccgtttttagatgcctgcctaaaagcattcagatcctggatttgaacaacaatcagattcagaccgtccccaaagaaacaatccatcttatggcactgagagagctgaacatcgcgttcaattttttgacagacctcccaggatgctcccacttttcgagactctctgtgctgaatatcgagatgaacttcatactctccccctcactggacttcgtccagagctgtcaggaggtgaaaacactgaacgccggtagaaacccattccggtgcacctgcgagcttaagaactttatacagctagaaacctactccgaggttatgatggtggggtggtccgatagctatacttgtgaatacccactgaatctgagaggcactaggctaaaagacgtccatctccacgaactttcctgtaacaccgctctgctaattgtcaccatcgtcgtgataatgttagtgcttggacttgcagttgctttctgctgcttacactttgatctgccttggtatctccgaatgctgggacagtgtacccagacatggcaccgtgtgagaaaaacgacacaggaacaactgaagcggaacgtcaggtttcatgctttcataagctattctgaacacgattctctatgggttaaaaacgaactgatcccgaatctcgagaaagaagacgggtcgattcttatctgcctttatgagtcttatttcgatccagggaagtctatttcagaaaacatcgtgagtttcattgaaaaatcatataagtcaatatttgttttgtctccaaactttgtccagaatgaatggtgccactacgagttctacttcgctcaccataatctgttccatgagaattctgaccacatcatattgattctactggagcccatccccttttactgtattcctacccggtaccataaattaaaagctctgctggaaaagaaagcctacctggaatggcccaaagataggcgaaaatgcggtctgttttgggcaaacctgagagccgccattaacgtgaatgtgctggcgactcgggagatgtatgaactgcagacctttacagagttgaacgaggagtcgcggggcagcaccatctccctaatgcgaactgactgtctgtag

SEQ ID NO: 30890 - DNA, 2436 bp, Artificial Sequence
  Description of Artificial Sequence: Synthetic coding sequence
atgagattgataagaaatatttatatcttttgttccattgtgatgacagccgaaggcgacgcacctgagctgccagaggagagggagcttatgaccaattgtagtaatatgtccttgagaaaggtgcccgccgatctgaccccagcgaccaccacattagacctttcgtataacctgctgtttcaattacaatctagcgatttccactccgtgtcgaagctgcgggtgctaattctctgccataaccggatacagcagttagatttgaaaacattcgagtttaataaggaactgcggtatctagatcttagcaacaaccgcctcaagtccgtcacgtggtatcttttggccggcctgcgctacctcgatctttccttcaatgacttcgacactatgccaatctgcgaggaggcggggaacatgtcgcaccttgaaattctgggcctgtccggggccaaaatccaaaagtccgattttcagaaaattgcgcacttgcatttaaataccgtatttctgggttttaggaccctaccccactatgaagaaggctccctgcctatcctcaacacaacgaagctccacatcgtgcttcctatggacaccaacttttgggtgttactccgcgatgggattaaaacttctaaaatcctcgagatgaccaacatcgatggcaagagtcaatttgtcagctatgagatgcagcggaatctgagcctggagaatgcaaagacgtctgtgcttctccttaataaagtcgacctcctgtgggatgatttgtttctcatactccagttcgtttggcatacctcagtggagcactttcagattaggaatgtgacgttcggcggtaaggcctatctggatcacaatagctttgactatagcaataccgtgatgagaaccattaagctggagcatgttcacttccgcgtgttttacattcagcaagacaaaatatatctgctgctgactaaaatggatatcgaaaatcttacgatctccaacgcgcagatgccccacatgctgttccccaattaccccacgaagttccagtatctaaactttgcgaacaacattctcaccgatgagctgttcaagagaactattcaactgccacacctcaagacactgattctgaacggcaacaagctcgagaccctttcgcttgtatcctgctttgccaacaacacacccctggagcaccttgacctctcacagaatttactccagcataaaaacgacgaaaattgcagttggcccgaaactgtggtgaatatgaacctttcctacaataaactgagcgatagtgtctttcgctgtctccctaaatctatacaaatactcgatttgaacaataaccaaatccaaactgtgcccaaggagaccattcatctgatggctcttcgtgagctcaatattgcattcaattttcttacagacttgcccggttgtagtcacttctcacgcctgagtgtgctcaacattgaaatgaattttatcctgtctccttcactagatttcgtgcagtcctgccaggaagtaaaaactctgaatgccggacgaaaccctttcagatgcacttgcgagcttaaaaattttattcagctggaaacctattcagaggtaatgatggttggctggtctgattcttatacatgcgaataccccctcaaccttcgcggcaccagactgaaggacgtgcatctgcatgaattatcctgcaatactgccctcttaattgtgactatcgtcgtaataatgttagtcctgggactcgctgttgcattctgttgtttgcattttgacctcccatggtacctgcgcatgttaggtcagtgtactcagacgtggcaccgagtgagaaagacaacccaggagcagctcaagcgcaacgtcaggtttcatgcatttataagttactctgagcacgacagcctgtgggtcaagaatgagctgattcctaacctggagaaggaggatgggtccatcttaatttgtctgtatgagagctatttcgaccccgggaagagcatatctgaaaacattgtctcttttatcgagaagagttataaatccattttcgtgttgagcccaaactttgtccaaaatgagtggtgtcattatgagttttactttgctcaccacaacctgttccatgagaattctgaccacatcatcttgattctgctagaacccatcccgttctactgcataccaaccaggtatcacaagctgaaagccctgctggaaaagaaggcttatcttgagtggcctaaagatcggagaaagtgcggattgttctgggctaatcttcgcgccgctattaacgtgaacgtccttgcaactagagagatgtacgagctgcagacatttacagagttgaacgaagagtctcggggcagcacaatcagcctcatgagaacagattgtctgtag

SEQ ID NO: 30891 - DNA, 1215 bp, Artificial Sequence
  Description of Artificial Sequence: Synthetic coding sequence
atgccacggccaggatcggcccagaggtgggccgcagtggctggcagatggggttgtcgactgcttgccctactgctcctcgtgccaggaccaggaggtgcctccgaaattacctttgagcttcccgataatgcaaaacaatgtttttacgaagacatcgcccaagggacaaagtgtaccctcgagtttcaggtcatcacaggtggccactatgacgtcgactgcaggctggaagatccagacggaaaagtgttgtacaaggagatgaaaaagcagtatgattcctttaccttcacagcaagtaaaaacggcacttacaagttctgcttctctaacgagttttccacatttactcataagacagtgtacttcgactttcaggttggcgaagaccctcctctctttcccagcgagaaccgcgtatctgcactcacacagatggagtccgcctgcgtttccattcacgaagctctgaagtccgttatcgactaccaaacccacttcaggctgcgggaagcccagggcagaagccgagcagaagatttaaacacacgggtggcctattggcacagcgttgacacctcaccaggctaccacgagtccgacagcaaaaagtctgaggatctgagcctgtgcaatgtggcagaacactccaatacaaccgagggccctaccggaaagcaggagggtgcacagtcagttgaagagatgttcgaagaggaggcggaggaagaagtttttctgaagtttgtgatcctacatgcggaggacgataccgacgaggctcttagagtccagaaccttttgcaggacgatttcggtattaagcctgggattatttttgcagagatgccttgcggaaggcagcatctccaaaatttggatgatgctgtaaacggttctgcctggaccatattactgctaaccgaaaatttcctccgagatacctggtgcaatttccagttctatacatctctgatgaatagcgtgaataggcagcataagtataactctgtgattccgatgcggcccctgaataatccactgcccagagaacgtactccattcgccttgcagaccataaacgctctcgaggaggagtcccgcggttttccaactcaagtcgaaaggattttccaggaatccgtgtacaagactcagcagacgatctggaaagaaactcgaaatatggtgcagcgccagttcattgcttag

SEQ ID NO: 30892 - DNA, 708 bp, Artificial Sequence
  Description of Artificial Sequence: Synthetic coding sequence
atggggataggcaagtccaagatcaactcgtgcccattgtccctctcctggggaaagcgccattcagttgatacgtcaccaggttaccacgagtctgattcaaagaagtccgaagatctttccctgtgtaatgtagctgagcacagcaacaccaccgaggggcctactggaaagcaggaaggagcccagtctgtggaagagatgtttgaagaagaagcagaggaggaggtctttctcaagtttgtcattttgcacgcagaggatgacaccgacgaggctctccgggtgcagaatcttttacaagacgattttggcattaaacctggtataatcttcgcggagatgccttgcgggaggcaacatctacaaaatcttgacgatgccgtcaatggtagtgcctggacgatactcctcctcacagagaatttcctccgggatacttggtgcaacttccagttctacactagcctaatgaactccgtcaatcgtcagcataaatacaactctgtaatccccatgagacccctaaataacccgcttccaagggagaggactccttttgcacttcaaaccataaacgcgctcgaagaagagtctagaggattccccacccaagttgaaaggattttccaggagtccgtgtataaaacccagcaaacgatctggaaagagacccgaaatatggtgcagaggcagttcatcgcttag

SEQ ID NO: 30893 - DNA, 1137 bp, Artificial Sequence
  Description of Artificial Sequence: Synthetic coding sequence
atggctggggacggaagacgggcagaggcagtgcgtgaaggatggggcgtgtacgtcactccgcgggcacctatccgggaagggaggggacgcctggccccgcagaacgggggcagttccgacgctcctgcatacagaacccctccttcccgtcaaggccgtagggaggtgaggttttctgacgagccacccgaagtgtatggtgactttgagccccttgtcgccaaggagagaagtcctgtggggaaaagaacgcgtttggaggagttcagatccgacagtgccaaagaagaagttagggaaagcgcttattacctgagaagcaggcagcggcgacagcccaggcctcaggaaacagaggagatgaagacaagacggaccactcggctccagcagcaacactcagagcaacccccattgcagcctagtcctgtgatgactcgaagaggcctgcgcgactcacattcaagcgaggaggacgaggccagttcccagactgacctgtcacagaccatcagcaagaaaaccgtcaggtcgatccaggaggcacctgtcagcgaggatctagtgattcggctcagacggccgccactcaggtacccgcggtatgaggccaccagcgtccagcagaaagtgaactttagtgaagagggtgagactgaggaggatgatcaagacagcagccacagctcagttacaacagtgaaagcaagatcccgggacagtgatgagagcggcgataaaacgactcggagtagctctcagtatattgagtctttttggcagtcatctcagagccagaatttcacagcgcatgacaagcagccaagcgtgctgtccaaagggagtacattgatcttttataagtattgtgaccacgagaatgccgctttcaaggacgtcgcacttgtcctcaccgttctattggaagaggagacccttggtactagcttagggctgaaggaagtggaggaaaaagtccgggacttcctgaaggtcaagtttactaacagtaacacaccaaattcttacaaccatatggaccccgataagttaaatgggctgtggtcccggatctcacacttagtacttcctgtgcagcctgagaatgcccttaaacggggcatctgtctctag

SEQ ID NO: 30894 - DNA, 1752 bp, Artificial Sequence
  Description of Artificial Sequence: Synthetic coding sequence
atggctggtgacggacggcgggctgaagccgtgcgagagggctggggtgtgtacgtgacaccacgagcgccaattcgcgaaggccgtggccgccttgcccctcagaacggaggttcttctgatgcccccgcatacaggactcccccgtcgcggcagggaaggcgcgaggtgcgattcagtgacgagcctccagaggtctacggggacttcgagccattggtagcaaaggaaagatctccagtgggaaaaaggacgcggctggaggagttcagaagtgatagtgcaaaagaggaggtcagagaatcagcctattatctgagatcacggcaacggaggcaaccaagaccacaagaaactgaagagatgaaaaccaggcgtacgacacgcctgcagcaacaacatagcgaacaaccacctcttcaaccctcaccagtcatgacccgccgggggcttagggacagtcatagttctgaagaggatgaggcttcgtctcagacagaccttagccagactatttccaaaaagaccgtccgttcaatccaggaggctccagtttccgaagatctagttatcaggttgagaaggcccccattgagataccccaggtacgaggcgacttccgtgcagcagaaggtgaattttagtgaggaaggtgagactgaagaagatgaccaggactcatcgcactcatctgtgaccacagtcaaagctagatctagagatagcgatgagtctggagacaaaaccacacgcagctcctcccagtacatagagtctttctggcagagctcccagagccagaactttacagcccacgacaaacagcctagcgtgcttagtagcggataccagaagacccctcaagaatgggccccgcaaacagccagaatccgaacccgtatgcagaatgacagcatattgaaaagcgaactggggaatcaatctccttctacttcgtctcgacaagtgaccggacaaccacagaatgcttctttcgtgaaaaggaaccgttggtggctcctgccactcatcgccgccctggcgtccggatctttttggttcttcagcacccccgaagtggagaccactgccgtgcaggagtttcagaaccaaatgaatcagttaaaaaacaagtatcagggtcaagatgagaaactgtggaaacggtcccagacttttctggaaaaacacctaaactcttcacatccaaggtcacaaccagcgattcttctgcttaccgctgcccgtgatgctgaagaggctctgcgatgcttgtccgagcagatagcagacgcatatagctcttttaggtctgtgagggccatccgcatcgacgggaccgacaaagccacgcaggattcagataccgttaagctggaagttgaccaagagttaagcaacggattcaagaacgggcagaacgctgcggtagtacacagatttgaaagctttcccgctggcagcacgttgatattttataagtattgcgatcatgaaaatgcagcgttcaaggacgtcgccttagtactgaccgttctccttgaggaggaaactctggggacatctctgggactgaaagaggttgaggaaaaagtgagagactttcttaaggtcaaattcactaatagtaatacgcccaattcttacaatcatatggacccagacaagcttaacggactgtggtcccgcatatcacacctggttctgcccgtccagcctgagaacgcgctcaaacgcggaatctgcctatag

SEQ ID NO: 30895 - DNA, 1413 bp, Artificial Sequence
  Description of Artificial Sequence: Synthetic coding sequence
atggccgacagtgggctaagagagccacaggaagactcccagaaagatttggagaatgaccctagcgtgaacagccaggcccaagagaccaccatcatcgctagcaacgctgaggaggctgaaatcctccatagcgcttgcggtctcagcaaggaccatcaggaagtagagacagagggccctgaaagcgccgacacaggggacaagtcagaatccccagacgaagctaatgtaggcaagcaccccaaggacaagacagaggatgagaacaaacagtctttcctggacggcggaaagggacatcacctaccaagtgaaaatttgggaaaagagccgctcgatcccgaccctagtcattcccccagtgataaagtaggcagggcagacgctcacctgggatctagtagtgtcgctctacccaaggaggcatctgacggcactggcgcatctcaggaaccacctactacggactcacaggaagcacagagccctggtcacagtagtgccggacaggagggggaggataccttgcggcgccgcctcctggcccccgaggccggatctcatccccaacagacgcagaagctggaagagatcaaggaaaatgctcaggacacgatgcggcaaattaacaaaaaggggttttggagctacggacccgtgatcctggtggtcttggtagtagccgtggtggcgagcagtgtgaactcgtactatagctctccagcgcaacaggtgccaaaaaatccagcgctggaagccttcctggcccagttctcccagctagaggataaattccctggacagtctagcttcctctggcagcgcggtcggaagttcctgcagaagcatctgaatgctagcaaccctaccgaacctgcaaccattatcttcacggcggccagagaaggtcgggagaccctgaagtgcctgagccaccacgtggcagacgcatacacatcgtctcagaaagtgtctcccatccagatcgatggagcaggccgaacctggcaggactctgacacggttaagctgctcgtggacctggaactatcgtacggattcgagaatggacagaaagccgcagtagtgcaccactttgagtcatttccagccggctcgacgcttattttctacaagtattgcgaccacgagaacgctgcatttaaagatgtcgctcttgttctgaccgtgctccttgaggaggagaccttggaagcttccgtcgggccacgcgagacagaagagaaggttcgcgacctgctatgggctaaattcacaaactcagatacccccacatcatttaatcacatggactcagacaagttgtcaggcctttggtccagaattagtcacctcgtcctgccagtgcaaccggtctcttccatcgaggagcaaggttgccttttctag

SEQ ID NO: 30896 - DNA, 1014 bp, Artificial Sequence
  Description of Artificial Sequence: Synthetic coding sequence
atgcgggccgtgttcatccagggagccgaggaacatccagctgctttttgctatcaggtgaatggatcctgtcctcggactgtgcacacactaggcatccagttggttatctaccttgcttgcgcagcaggcatgttgatcattgtcctgggcaacgtgtttgtggccttcgctgtgtcatattttaaggccctccatacacctaccaattttttgctcttaagcctagccctggcggacatgttcctgggactgctcgtgttgcccttatcaactatccgctctgtcgagtcttgttggttttttggcgacttcctctgtaggcttcatacctacctggatacacttttttgtttaacgtccatctttcatctctgttttatctccatcgataggcactgcgccatttgcgaccctctcttatatccttccaaattcacagtgagagtggccttgcgctacatcctggctggatggggggttcccgctgcctacacatccctattcctctatacagacgtcgtggaaacaagactctcccagtggctggaggagatgccttgtgtgggcagctgtcagctgctgctgaacaagttctggggatggcttaacttccccctgttctttgtgccttgtctgataatgatttccctctacgttaagatttttgtggtggcaactaggcaggcccagcaaatcaccaccctctctaaatcccttgctggagcagccaagcacgagcgcaaagctgcgaaaactttaggcatcgccgtgggcatctatctcctgtgttggttacctttcacgatcgatacgatggtggactctcttttgcatttcatcacgccgccgctcgttttcgacatattcatttggttcgcatacttcaacagtgcctgcaacccaataatctatgtgttttcttaccagtggttccggaaggccctgaagctgacgctgagtcagaaagttttctctcctcagacccggacggttgacctctaccaggagtag

SEQ ID NO: 30897 - DNA, 1029 bp, Artificial Sequence
  Description of Artificial Sequence: Synthetic coding sequence
atgacctctaatttcagccagcccgtagtccaattatgctacgaggatgtcaatgggagctgtatcgaaaccccttatagcccaggatcacgggtgattttgtacactgctttttctttcgggtccttgctggctgtctttggcaacttattggtgatgactagcgtgctgcatttcaaacaactccacagccccaccaatttcctgattgcctcactcgcatgcgccgactttctggtgggggtgacagttatgctcttttcgatggtgaggaccgtggaatcgtgctggtactttggcgcgaaattttgcaccctgcatagttgctgcgacgtggccttttgttactcctccgtgctgcatctctgctttatatgcatagacagatatattgttgtgacagaccccttagtgtacgccacaaagttcaccgtgtcagtttcaggcatttgtatctccgttagttggattctgccgttaacctactctggtgcagtcttctatactggcgtgaacgatgatggactagaggagctggttagcgcacttaattgtgttggcggatgccaaatcattgtgagccagggctgggtcctcattgatttcctgctgttttttatccctaccttggtgatgatcattctgtactccaagatctttctgattgccaaacagcaggccatcaagatcgagactacatctagcaaagtggagtcatcatccgagtcctacaaaattcgggtggccaaaagggagcggaaagctgctaagacactaggtgtaacagttctcgcctttgtgatatcttggctgccgtacacagttgacatcttaattgacgcctttatgggctttctaacgcctgcctacatatacgagatctgctgttggagcgcctactataactcagcgatgaatccattaatctacgcattgttttacccttggttcaggaaggcaattaaactgatccttagtggagacgtcctgaaggcaagcagcagcaccatctccctatttctggagtag

SEQ ID NO: 30898 - DNA, 3780 bp, Artificial Sequence
  Description of Artificial Sequence: Synthetic coding sequence
atggatgccagcgaggagcccttgccacccgtgatctataccatggaaaacaagcccatcgtgacctgcgctggggatcagaatctgttcacatccgtttatcccactctgagccagcagctgccccgcgagcccatggagtggagaaggagctacggccgtgctccaaaaatgatccacctggaatctaacttcgtgcagttcaaagaagagctcttgcccaaggagggaaataaagcactattgacatttccattccttcatatctactggactgagtgttgcgataccgaggtatataaagcaacggtcaaagacgatctcacaaaatggcagaacgtgctgaaagcacattccagtgtggactggttgattgtgatcgttgagaacgatgccaaaaagaaaaataaaaccaatattttacctcgcacctcgattgtggataagattcgcaatgacttctgcaataaacagtctgaccgctgcgtagtcctgtctgacccgcttaaggactcttccagaacacaagaatcttggaacgccttcctcaccaagttgcggactctgctcctgatgtcgtttacaaaaaacctcggtaaattcgaagacgacatgcggacgctgagggaaaaacggacagaacccggatggtctttttgcgagtacttcatggtacaagaggagctcgcattcgtgttcgagatgctccaacagttcgaagatgctttggttcagtacgatgagctggacgcacttttctcccaatatgtagtgaattttggtgccggcgatggagcaaattggctaaccttcttttgccagcccgtaaagagctggaatggcttaatcctgcgaaaaccaatcgacatggagaaaagggaatcaattcaacggcgggaggccacactactagacctccgctcttacctgtttagtcggcagtgcaccctattgttattccttcagaggccatgggaggttgcccaacgggcgttggagttattacacaattgcgtgcaggaactcaaactgctggaggttagtgttcctccgggcgctttggactgttgggtcttcctgagctgccttgaggttctgcaaaggatcgaggggtgttgcgatagggcccaaatcgacagcaacatagctcacacagtagggctgtggagctacgcgactgagaaactgaaatccctgggctacttatgcggtttggtctctgaaaagggcccgaacagtgaagacctgaaccgcaccgtagacctattagcagggctcggggctgagcggccagagactgcaaatactgcgcagagcccctataaaaagctcaaagaagccctgtcttcagtggaggcatttgagaagcattatctcgacttgtctcatgcgacaatcgagatgtatactagcatagggaggattcgcagcgccaagtttgtgggcaaagatttggctgagttctacatgaggaaaaaggcgccccagaaggctgagatttacttgcaaggggcgttgaagaactacctggctgagggctgggctctcccgattacccacacccgcaaacaattggccgagtgccagaagcatctggggcagattgagaattacttacagacttctagcctgttggcctcagaccaccacttgactgaggaggagcggaaacatttctgccaggagatcttggacttcgcttcgcagcccagcgacagtcccgggcacaagattgtgctgccaatgcactccttcgcccagctgcgggatctgcacttcgatccatctaatgctgtcgttcatgtgggaggagtgctatgtgtcgaaatcacaatgtactctcagatgccagttcccgtccacgtagagcaaatagtggtgaacgttcacttcagcattgaaaaaaattcgtataggaagacagctgagtggctgaccaagcacaagaccagcaatggaatcataaacttccctccagagaccgccccgtttccagtgtctcaaaatagcctgcccgctctggaactctatgagatgtttgagcggagtccctctgacaattcattgaatactacgggtatcatttgtaggaacgtacatatgctgctcaggcggcaggaaagctccagcagtctcgaaatgcccagtggagtggcactggaggagggggcacacgtgctgcgatgttcccacgtcacacttgaaccaggggccaaccagatcacatttcgcacgcaggccaaggagccagggacttacactctccgacagctgtgcgcatctgttgggagcgtatggttcgtgttgcctcacatctacccgattgtccaatacgacgtctactcacaagaaccgcaactgcatgtagagcctctcgctgattctctgctcgccggcattccccaaagggtaaaattcaccgtgacgaccggccactataccataaagaatggagattcgctgcagctgtctaatgccgaggctatgctaattttgtgtcaagcagagtcgcgagccgtcgtgtattccaacacccgggaacagagttcggaggccgcattacgaatacagagctccgataaggtcacttcaatctccctgccagtcgctcccgcgtaccatgtcatcgaattcgagctcgaggtgcttagcctcccatctgcacctgctctgggcggcgagtctgatatgctaggtatggcagaaccccaccggaaacataaagacaaacagagaactgggagatgcatggttactactgaccacaaggtcagcattgattgtccttggagcatatactccactgtaatcgcccttaccttcagcgtgcctttccgcactactcactctttactgtcatcaggcacgaggaagtacgttcaggtttgtgtgcaaaacctgtccgagctggatttccagttgagcgattcctaccttgtggacactggagattctactgatctgcagcttgtgccactgaacacacaatcccagcagcctatttacagtaagcagtctgtgtttttcgtctgggagctgaagtggaccgaagagccgcctccctccctccactgtaggttctcagtgggattctcccctgcctccgaggaacagttgagcatatcccttaaaccatacacatacgagtttaaggttgagaacttctttactttgtacaacgtgaaggccgaaatctttccccctagcgggatggaatactgcaggaccggcagcctttgttccctggaagtgttgattactcggctgagcgacctcttagaagtggacaaggatgaggccctgacagagtccgacgaacatttctcgactaaactcatgtacgaggttgtggataatagttccaactgggccgtgtgtgggaaatcgtgcggcgtgatctcaatgcccgtggccgcacgggccacacacagggttcatatggaggtgatgcctctttttgcgggctacctcccactgcccgacgtacgtctatttaagtacctgccacaccatagcgcgcattcctcacagctggacgccgacagctggatcgagaatgattccctcagcgtcgataagcacggggatgaccagcccgattcgtcttcacttaaaagccgtggttctgtgcactcagcttgctcaagcgagcataagggactcccgatgccaaggctccaagccctacccgcaggtcaagtctttaatagcagcagcggcacccaggtattagtgattccatcccaggatgatcatgtgttggaggttagcgtaacctag

SEQ ID NO: 30899 - DNA, 1173 bp, Artificial Sequence
  Description of Artificial Sequence: Synthetic coding sequence
atgctcattttatgtcaagcagagagccgagccgtggtctatagcaacaccagggcaccagccttgggcggtgaatcagacatgctgggaatggcagagccgcatcggaaacacaaagacaagcagcgcaccgggcggtgcatggtgactacagaccataaggtgagtattgattgcccttggagcatctacagtactgtgattgcattaactttctctgtcccatttcgtaccacacattctctgctgtcctccggcacgaggaagtacgttcaggtgtgcgttcaaaatctctctgagctcgactttcagctgtctgactcatacctggtggataccggggactccaccgacctccagcttgtacctttaaacacccagtcccaacagccgatatactccaaacagagtgttttctttgtctgggagctgaagtggaccgaagagcccccaccatcactgcactgcaggttttccgtcgggtttagtcccgcctcagaggagcagctctccatcagcctcaagccgtatacctacgagttcaaggtagagaactttttcaccctgtataacgtgaaagcggagatcttcccaccctctggcatggagtactgtagaaccggttccctttgttcactggaggtgctcatcactcgcctatccgacctgctcgaggtcgataaggatgaggctctcacggagtcagacgaacacttctcgaccaagctcatgtatgaagttgtcgataactcatctaattgggccgtgtgtggaaaatcttgtggcgtgatttctatgccggtggcagcacgggccacacaccgcgttcatatggaggtgatgcctctgtttgctggctaccttccgttaccagacgtccgccttttcaagtatctcccacaccacagcgcacacagctcacaactggacgctgattcatggatcgagaatgattctttaagcgtagataaacacggcgacgaccaacccgatagtagctctctcaaaagtcgcgggagtgtacactctgcttgctcttctgagcacaagggactgcctatgccacggttgcaggccttgcctgctggacaggtctttaacagttcgtcaggtacccaggtactggtgatcccgtcccaggatgaccatgttctggaggtatcggtgacatag

SEQ ID NO: 30900 - DNA, 423 bp, Artificial Sequence
  Description of Artificial Sequence: Synthetic coding sequence
atgagcggttcattttatttcgtgatcgtcgggcaccatgataatccggtctttgagatggaattcctccctgccgggaaggctgaaagtaaagatgatcaccgccaccttaaccaatttatcgctcacgcagctctcgacctcgtggatgaaaacatgtggctgtccaataatatgtatcttaagacggtggacaagttcaacgagtggtttgtcagcgcgttcgtgacggcgggtcatatgcggtttatcatgctacacgacatcaggcaagaggatggaatcaagaacttctttactgacgtgtacgacctctacattaagttctccatgaaccccttttacgagcccaattcaccaattaggtcatctgcctttgatagaaaggtgcagttcctcggcaagaaacaccttctcagttag

SEQ ID NO: 30901 - DNA, 567 bp, Artificial Sequence
  Description of Artificial Sequence: Synthetic coding sequence
atggaggcacgatttactaggggcaaatctgccctgctggagagagctctggcccggcctagaacagaggtctcactctcggcctttgctctactctttagcgaacttgtacaacactgccaaagtagagtgttctccgtggccgagctccagagtaggctcgctgctttgggtcgacaagtgggagcgcgcgtgctggatgccctggtggctcgcgagaagggagccaggcgggagacaaaggtgctgggggcactcctgttcgttaaaggcgctgtgtggaaggctttgttcggaaaggaagccgataaactcgagcaggccaacgatgacgcccgtacattctacattatcgagcgcgagcctctgataaacacttacatttctgttcccaaagagaactctacgcttaactgcgcttcgtttaccgctgggatcgtggaagccgtcttgacgcacagcggcttccctgctaaggtgaccgcccactggcacaagggcaccacactcatgatcaaatttgaagaagccgtgatagcccgtgaccgcgccctggagggtagatag

SEQ ID NO: 30902 - DNA, 567 bp, Artificial Sequence
  Description of Artificial Sequence: Synthetic coding sequence
atggaagcgagatttacccgaggtaagtcagctttactggaaagagctctagcaagacccaggacggaggtatccttgtccgcattcgctctcttattttcagagcttgtccagcactgccagtcacgcgtgttctccgtggccgaactgcaatcgaggctcgccgccctgggcaggcaggtcggggcacgcgttctggatgctctggtggcgagagagaagggcgctagaagagaaacgaaggttttaggcgctttgctgttcgtgaaaggcgctgtgtggaaagctcttttcggaaaagaagccgacaaactcgaacaggccaacgacgatgcaagaaccttttacataatagaaagggaacccctaatcaacacctacatctctgttcctaaggaaaattcaacactaaactgcgcatcatttaccgctggtattgtcgaagctgtgctgacacatagtggatttccggcaaaagtgactgcccactggcacaaaggcaccaccctaatgatcaagtttgaggaggctgtgattgctcgggacagagcccttgaagggaggtag

SEQ ID NO: 30903 - DNA, 567 bp, Artificial Sequence
  Description of Artificial Sequence: Synthetic coding sequence
atggaagccagattcaccagaggtaaaagcgctctgttagagagagccctggcgaggccgcggacagaggtcagtttgtctgccttcgccttactcttctcagaattggtccaacactgccagagccgcgtgttcagtgttgctgaactgcagtctcggctggctgccctgggccgacaggtgggggctcgggtcctggacgcgctggtcgccagggagaagggcgcccggcgggagactaaggtcctgggagccctgttgtttgttaagggggcggtctggaaggcgctgttcgggaaagaggcagacaaattagaacaagcgaatgacgacgcacggacattttacattatcgagagagaaccactcatcaatacttacatcagtgtacccaaagagaactccacactgaattgtgctagtttcaccgccggaatcgtagaggccgttctgacccatagcggctttcccgccaaggttacagctcattggcacaagggcacgactctaatgatcaagtttgaagaagccgtcatagcgcgagatcgtgcgctagagggcagatag

SEQ ID NO: 30904 - DNA, 522 bp, Artificial Sequence
  Description of Artificial Sequence: Synthetic coding sequence
atggctgacaccgtgctgtttgaatttctacacacagagatggtggccgaactttgggctcacgacccagacccgggccctggtgtcagcgcaggcttgagaggcgaggaagcgggcgccaccaaaggtcagaaaatgtccctgtcggtgctggaaggtatgggcttccgggttggccaggccctcggtgaacgcttgccaagggaaaccctggcttttcgggaggagttggatgttctgaaattcctgtgtaaagacctgtgggtcgctgtgtttcagaagcagatggactcactccggacaaaccatcaaggtacatatgtgctccaagacaacagcttcccactgctcttgcctatggccagtggattacagtacttggaagaagctccaaaatttctggcgttcacatgcgggcttctgagaggcgcgttgtacaccttagggattgaatccgtggtcacagcaagcgtcgctgccctgcccgtgtgcaaattccaggtcgttattcctaagagctag

SEQ ID NO: 30905 - DNA, 480 bp, Artificial Sequence
  Description of Artificial Sequence: Synthetic coding sequence
atggccgatactgttctctttgaattccttcatacagagatggtagctgaattgtgggcacacgatcccgatcccggccccgggggccaaaaaatgagcctatcagtcctggaaggcatgggatttagagtggggcaagcccttggtgagaggttgcccagagagaccctagcttttcgtgaggaactggatgtcttgaagtttttgtgtaaggacctgtgggttgctgttttccagaaacagatggacagcctccgcactaaccatcaggggacttatgtgctgcaggataacagttttccgctgctgctgccaatggcgtcgggattgcagtatctcgaagaggctcccaagtttcttgcgttcacctgcggactgctaaggggagcactatatacactgggaatcgagtctgtggtgacagcctccgtagccgcactgcctgtttgtaagtttcaggtggtcatcccaaagtcctag

SEQ ID NO: 30906 - DNA, 342 bp, Artificial Sequence
  Description of Artificial Sequence: Synthetic coding sequence
atggcagacaccgttctctttgaattcttacacacagaaatggtggccgaactttgggctcatgaccccgatccagggcccggggccgcccccggggacgcaggcctacaggggggagcaggctgccctcaggtactcgttcagaggccagtcggtgggggcgttccagaagccgatggccagcccgctcatcaatcacctggggacctcaggccagcgcgccagcaactccccccacccccacccgatggcctgtggccagctgtcagcggtggatctacccaggttccaggcctacatctgagaccaccagcgcggcgccccctataccctggtcattag

SEQ ID NO: 30907 - DNA, 477 bp, Artificial Sequence
  Description of Artificial Sequence: Synthetic coding sequence
atggctgatgaggcgctatttctcttactgcacaacgagatggtctcgggcgtttacaagagcgcagaacaaggcgaagtggaaaacggacggtgtataacaaaactcgaaaatatgggctttcgggttggccaaggcttaatcgagaggtttacaaaggacacggctcgcttcaaggacgagcttgacatcatgaagttcatttgtaaggatttctggacaactgtcttcaagaagcagattgacaatcttagaactaaccatcagggtatatatgtcctccaggacaacaaatttcgcctcctaacccagatgtctgccgggaagcagtacttagagcacgcctccaaatatttggcctttacctgcggactaattcggggcggcctgagcaatctcggcatcaaaagcatcgttaccgctgaggtgtcatcaatgcccgcgtgcaagttccaggtgatgatccagaaactgtag

SEQ ID NO: 30908 - DNA, 393 bp, Artificial Sequence
  Description of Artificial Sequence: Synthetic coding sequence
atggctgatgaggctctctttctactgttgcataacgagatggtcagtggagtgtacaagagtgcagaacaaggcgaggtagaaaacggaaggtgcattactaagcttgaaaacatgggctttcgtgttggacaaggtctcattgaaagatttactaaagacaccgcaaggttcaaggacgagctggatatcatgaagttcatctgtaaggacttttggacaactgtattcaagaaacagatcgataacctccgcaccaaccatcagtatctcgcgttcacctgtgggcttatacggggcggactgtctaacctggggattaagtcaattgttaccgccgaggtttcttctatgccagcttgcaagtttcaggtgatgattcagaagttatag

SEQ ID NO: 30909 - DNA, 1092 bp, Artificial Sequence
  Description of Artificial Sequence: Synthetic coding sequence
atgttcaaacggcacaagagtctagccagcgagcgcaaaagggctctgctttcgcaaagagctacccggtttatcttgaaagacgacatgcggaacttccattttctgtctaagctggttcttagcgccggcccattgcgaccgacacccgccgtcaaacacagcaagactacacatttcgagattgaaattttcgacgcacagacacgaaaacaaatctgtatcctggataaagtcacccagagctccacgattcatgatgtcaaacagaagttccacaaggcgtgccctaagtggtatcccagtcgcgtgggcctacagctggagtgcgggggtccgtttctgaaagactatatcactatccagtccatcgcagccagttcaatcgtcacgttgtacgccaccgacctgggacagcaggtatcctggacaaccgtcttcctcgccgaatatactggccccctcctgatctatctgctcttttatctgagaattccttgtatttacgacgggaaggagagcgcccgacggttacgacatcccgtagtccacctggcttgtttctgtcactgcattcactatatacgatatctcctcgaaacactgttcgtccataaggtgtcggcaggacacacccctttaaagaaccttattatgagttgcgcattttattgggggttcacctcgtggattgcctattatataaatcatcctctgtacactccacctagtttcggaaatcgacaaattacggtgtccgcgattaattttctgatttgcgaggccggaaaccactttatcaacgtcatgctgtcacaccccaaccataccggcaacaatgcctgtttcccctcccccaattataatcccttcacgtggatgttcttcttagtgtcctgtccaaactatacatacgagatcggctcatggatcagtttcactgtaatgacccagacactgcccgtgggcatcttcaccctgctgatgtccatccagatgagcctgtgggctcaaaaaaagcacaaaatttacctcaggaagttcaattcttacatccatcgcaagagcgccatgatccccttcatactgtag

SEQ ID NO: 30910 - DNA, 2262 bp, Artificial Sequence
  Description of Artificial Sequence: Synthetic coding sequence
atggctgcagggtccaccaccttacatgctgtggagaagttacaagtacggctggccacaaaaacggaaccaaagaaattagaaaagtacctccaaaagctgtccgccttgcctatgaccgcggacattctggctgaaacaggaatcagaaaaacagtgaaacggctccggaaacaccaacatgtaggcgactttgcacgggacctggccgctaggtggaaaaagttggtgctggttgaccgaaacacaagaccagggccacaggacccggaggagagcgcttctagacagaggtttggagaggctcttcaagaccaagaaaaagcctggggctttccagagaacgccacagcccctcgcagtccgtcccacagcccagaacataggcgaacagcacgtagaacaccacctgggcagcaacgcccacaccccaggtctcacagcagagaaccccgtgctgagcgaaaatgtcctagaatcgcccctgcggactctggacgctatcgagcaagccctacccggacagcgcctctccgaatgccagagggacctgaacccgccgcccctggaaaacaacccgggaggggccacacacatgcggcccagggaggcccacttctctgcccgggctgtcagggacagccacagggaaaagccgtggtgagtcacagtaagggccacaaatcttctcgccaggagaagcgcccactgtgtgcccagggtgactggcacagtcccaccctgataagagaaaaatcatgtggcgcttgtttgcgcgaagagacacctcggatgccctcctgggcatccgcgcgggaccgtcaaccttcagactttaagacggataaggagggaggtcaggccgggtccggtcagagggtgcccgctttggaagaggcaccagattctcatcagaagagacctcagcacagccactctaataaaaaacgcccttcccttgacggacgggacccaggtaacggcactcatggcttaagtcccgaagagaaagagcagctaagcaacgacagagagactcaggaaggcaagcctcctactgctcacctcgatagaacttcagtgagttctctgagtgaagtggaggaggtggatatggccgaggaatttgaacaacctactctcagctgcgagaagtacctcacatatgatcagctgaggaaacaaaagaagaaaacgggtaagagtgccacaacggctctaggcgacaagcaacgtaaggccaatgagtctaaaggcactcgggaatcctgggactcagccaagaagctgcccccagtgcaggaatcacagtctgagcgcctgcaagccgcaggcgcggatagtgccggccctaagaccgtcccgtcgcacgtgttcagcgagctgtgggacctctctgaagcctggatgcaagctaactatgatcctctatcagattctgattctatgacctcccaggccaaacccgaggcactgagcagccccaagtttcgggaggaggccgcatttcctggacgccgtgtcaatgctaagatgccagtttactctggaagcaggccagcctgtcaacttcaggtgcccacactccgccagcagtgtgcacaagtactgaggaacaaccctgatgccctttcagatgtgggggaggtgccttactgggtactggagcctgttctggagggctggcggcctgaccagctgtatagaagaaagaaagataatcacgcgctagtgcgtgagacagatgaattgaggaggaaccactgttttcaggactttaaggaagagaagccccaggagaacaagacatggagagaacaatatctgcggctccccgacgcacccgaacagcggcttcgcgtgatgaccaccaacatcaggtcagctaggggtaataatcctaatggtcgagaagctaagatgatttgctttaagagtgtggcaaaaactccatatgatacctcacggcgtcaagaaaaaagcgcgggtgatgcagatcccgagaacggagagataaaacccgctagtaagccagcaggaagctctcatacaccttcaagccagagttccagcggcggcggtcgagacagttccagctcaatcttgcgctggctacccgagaaaagggccaatccctgcctgagctctagcaatgagcatgctgcccctgctgctaagacgcgtaaacaagcagctaaaaaggtggcgcctctgatggccaaggccatccgcgattacaagcgccggttcagccgacgctag

SEQ ID NO: 30911 - DNA, 1641 bp, Artificial Sequence
  Description of Artificial Sequence: Synthetic coding sequence
atggctgccggaagcaccacattgcgggctgttgggaagttacaagtcaggctcgccacgaagaccgagccaaagaagctggagaaatacctgcagaagctgagcgccctgcctatgacggcagacatcctagcagaaactggaattaggaagaccgttaaaagactaaggaaacaccagcacgtgggcgattttgccagagacctagctgcccgttggaagaaacttgtcctcgttgatcgcaacactggtcctgaccctcaggaccctgaggaaagcgcctctcggcagagatttggcgaggctctccaggaaagagagaaggcgtggggtttcccagagaatgcaaccgccccacgtagcccaagtcactctccagaacacagacgcactgccagacgcaccccaccaggacagcaacggccccatcctcggtctcctagccgggaaccaagggcggaaagaaaaagacctcggatggcccctgcagacagcggacctcaccgcgatccccctaccagaactgcccctcttccaatgcccgagggaccagaaccagccgtccctggagagcagccaggccgggggcacgcgcacgcagcacaagggggaccactactgggccaaggatgtcagggacaaccacagggagaggccgtgggatctcattccaaaggacataaaagctctagaggtgcttctgcacagaagagtcccccagtccaggagtctcaaagtgagcgtctacaggccgccggggccgattccgccggccccaagacggtaccatcccacgtttttagtgagctgtgggacccttcggaggcgtggatgcaggcaaattacgatctgctgtccgctttcgaggcaatgacctcccaagccaatcccgaagcgctgtcagctcctgcgctacaggaggaagctgcatttcctggacgaagagtgaacgcgaaaatgccagtttacagcggcagtagacctgcctgtcagctgcaggtacctactctccgccagcaatgcttaagggttccccgaaataacccagacgctctcggcgacgtggagggggtcccatactctgtgctcgaacctgtgttggagggatggacccctgaccagctttacagaactgaaaaagataacgctgcgcttgcacgagaaactgatgaattatggcgtatccactgtctgcaagacttcaaggaggagaagccgcaggaacatgagtcttggagagagctgtacttgaggttgagggatgctagggagcagaggctgagggtggtaaccaccaaaattcgtagcgccagggagaacaaacccagtggccgccagacaaagatgatctgtttcaattccgttgctaaaacgccttacgatgcgtcaagaagacaggaaaagtcagcaggggcagctgatccaggaaacggagaaatggaaccagctcctaaacccgcgggcagctcccaagcccctagtggactcggcgatggagatggaggatcagtatctggaggaggcagttccaatagacacgcggctccagcagacaaaaccagaaagcaggcagcgaaaaaagttgctcccttgatggccaaagccattagggactataagggcagattctctagaaggtag

SEQ ID NO: 30912 - DNA, 1641 bp, Artificial Sequence
  Description of Artificial Sequence: Synthetic coding sequence
atggccgcaggcagcactacgctgagggctgttggaaaattgcaggtgcgcctcgccacaaaaaccgaaccaaagaaactagaaaagtacctccagaagctatcagctctcccgatgacggcggatattctcgcagagactggaatacgtaagaccgtaaaaagacttaggaagcaccagcatgtcggggacttcgctagggatctcgctgcgaggtggaagaagcttgtcctcgtcgacagaaataccgggccggatccccaggatcccgaagaaagcgcctctcgccagcgcttcggtgaggctctgcaggaacgtgaaaaggcctggggattcccggaaaacgccacagccccacgttccccatctcactcaccagagcaccgccgcacagccagacgaacccccccaggccaacagcgccctcatccgagatcaccaagcagggaacctcgagccgagcgcaaaagaccaaggatggcgccagctgacagtggccctcaccgcgaccctcccacccggaccgcccccctgcctatgccagaggggcccgagcccgcagttccaggagagcagccggggcgggggcatgctcatgcagctcagggaggccccctgcttggacaaggttgtcaaggtcagccccagggagaggctgtgggctcacattcaaagggacacaaaagttcaagaggggcctcagcccagaagtctcctccagtacaagagtctcagagtgaacgactgcaggcggccggagccgacagcgccggccctaaaaccgtcccttctcatgtgttctcagaactatgggacccctccgaggcttggatgcaggcgaactacgacctgctctctgcttttgaagccatgacgtcacaggctaacccggaggcgctgtcagctcctaccctccaggaggaagcagccttcccaggacgacgcgttaatgctaagatgccagtctattcggggtccaggcccgcttgccaattgcaagtgccaacactgcgacagcaatgcctgcgcgttcccagaaacaatcctgacgcgctgggtgacgtggaaggggtgccctacagcgtgctggagcctgtcttggagggctggaccccagaccagccttaccggactgaaaaagataacgcggccttagctagggaaacagacgaactatggagaattcattgcctgcaggacttcaaagaggagaagccccaggagcatgagtcctggagggagctatacctccgtcttagggatgcccgggaacagcgtctaagggtggtcactaccaaaattaggagcgccagggagaacaagccgtccggccgacagacaaaaatgatatgttttaactccgtcgcaaagacaccttacgatgcgtccagacggcaggaaaagtctgctggtgctgctgatcctgggaatggcgaaatggagccggcgccaaagccagccggatctagtcaagcccctagtgggttgggggacggagacggcggctccgtgtcagggggagggtcgagtaacagacatgcggcacctgcagataagactcggaagcaagctgcaaaaaaagtagctcctctgatggctaaggccatcagggattataagggccgattctcaagacgctag

SEQ ID NO: 30913 - DNA, 1083 bp, Artificial Sequence
  Description of Artificial Sequence: Synthetic coding sequence
atgagcggcagcgtcctttttactgcgggtgagcgatggagatgtttcctaacgccctcccggagcagtctgtactgggccctccacaacttttgctgtaggaagaaatccaccactcccaagaagattaccccaaacgtcactttttgtgacgagaacgcaaaggaacctgagaacgccctcgataaacttttctccagcgagcaacaagcatctatcttgcatgtgttaaacactgcatcaactaaggaattggaggctttcaggttgctacgcgggaggcgatcgataaacattgtcgagcatcgagaaaacttcggcccttttcagaacctggagtccctgatgaatgttcctttgttcaagtacaagtctaccgttcaggtgtgtaattcaatcctgtgtcctaagacagggagggaaaaacgcaaatcaccagagaaccgttttcttaggaaactgttgaaacccgatatcgagagagagagactgaaagcggttaacagcatcataagtatagtctttggtacacgaaggattgcatgggcccacctggatcgtaaactgaccgtactggattggcaacagtccgatcgctggtccctcatgcgtggcatttacagtagttcggtatatctagaagagattagcagtatcatatctaagatgcccaaggcagatttttacgtgctggagaagacgggtttgtcaatacagaatagcagcctgtttcccatcctcctacactttcatataatggaggctatgctctatgccctgcttaataaaacattcgcccaggacggccagcatcaggtgctcagcatgaatcgcaacgctgtagggaagcacttcgaactgatgatcggggacagccgcacgtctggcaaggagcttgtcaagcagttcctcttcgactccattctaaaagccgatccccgcgttttcttcccttccgataaaattgtccattatagacagatgttcctctcaactgaactccagagagtggaggagctgtacgatagcctgctccaggccatcgccttctatgaactcgctgtctttgatagccaaccctag

SEQ ID NO: 30914 - DNA, 1083 bp, Artificial Sequence
  Description of Artificial Sequence: Synthetic coding sequence
atgtctgggtccgttctgtttactgccggcgagaggtggcgatgctttctaacaccaagccggtcatctttgtactgggctctgcacaacttctgttgccgaaagaagagtacgacccccaagaagatcacaccaaatgtgaccttttgtgacgagaacgctaaggaacctgagaacgccctggacaaattgttcagctcagaacagcaggcgtccatcctgcatgtcctcaacactgcttccacgaaagaacttgaagcattcagattactgagaggcagacgcagtatcaacattgtagaacatcgagagaacttcggcccattccagaatctcgaatccctgatgaacgtgcccctgtttaaatataagagtacagttcaggtctgtaacagtatcttgtgtccaaagacaggaagggagaagagaaagtctcctgaaaacagattcctgcgaaagctgctcaagccagatattgagcgcgagaggctcaaggcagtcaactctatcatctcaatcgtgttcggaacacgtaggatcgcctgggcacatctcgatagaaagctgacagtcctggattggcagcagagcgacaggtggtccttaatgcgcggcatatatagttcctccgtgtacttagaggagatctcttcaataatctctaaaatgccaaaggccgatttttacgtactggagaagaccggactcagcatacagaatagcagtctttttcccatcttactgcatttccatattatggaagcaatgctatatgcccttctgaataagacttttgctcaggatggccagcaccaagtactgtcaatgaaccgcaacgccgtaggtaagcacttcgagctcatgatcggtgattctagaaccagtgggaaagaactggtgaaacagttcctgtttgatagcattttaaaggcagatccgcgcgtattctttccctccgataagatcgtgcactatcggcagatgtttttaagtacggagctgcaacgggtggaagaactgtatgactctctgttgcaggccatcgctttctacgagctagcggtattcgactcacagccctag

SEQ ID NO: 30915 - DNA, 546 bp, Artificial Sequence
  Description of Artificial Sequence: Synthetic coding sequence
atgtccggctcagtcctgtttacagctggggagcggtggagatgctttctaaccccgtcccggtcgtcgctgtattgggccctgcacaacttttgttgccggaagaaaagcacgacgcccaaaaaaatcactcccaatgtgacattctgtgatgagaacgctaaggagcctgagaacgctttggataagctttttagttctgagcagcaggcttctatactgcacgtgctgaataccgcctcgactaaagagctggaggccttccggctgttgaggggaaggcggtctatcaacatcgtagagcatcgcgagaatttcgggcctttccagaacctggagtccctcatgaatgtgccactctttaagtataagagcaccgtccaggtttgtaactccatattgtgtccgaaaaccggccgggagaaacgcaagagccctgaaaatcgattcctgcgaaaattattgaagccagacatagaaagagagcgcctgaaggtgtattcttcatgcctactttactgcctgatatttgagaacctactatag

SEQ ID NO: 30916 - DNA, 1191 bp, Artificial Sequence
  Description of Artificial Sequence: Synthetic coding sequence
atgtggatccccgtggtagggttaccacgccggctgaggctcagcgccttagctggagccggacgattctgtattcttggatcagaggcggctactcgcaagcatctgcccgcacgcaaccattgcgggctttcagatagctccccccaactgtggccggagcccgactttcgcaacccacccaggaaggcatctaaagccagtttggacttcaaacggtatgttactgatcggagactagcagaaaccttagctcagatctatctcggaaaaccttctaggcctccccatttactgttggaatgtaaccctgggccaggaatcctgactcaggcgcttctggaagctggagcgaaggtggtcgctcttgagtctgacaaaaccttcatcccacacctggaaagtttaggaaaaaacctggatggtaagctgcgggtgatacactgcgactttttcaagctcgacccgcgcagcgggggagtcattaagcctccagctatgagctcgcggggactgtttaagaacctgggaatcgaagctgtgccatggacagccgatatcccattaaaggtggtcggcatgttcccaagtcgtggggagaagcgggcactgtggaaactggcttacgatctttattcttgtacgtctatttacaaatttggacgcattgaagtgaacatgttcatcggggagaaagaatttcagaagctgatggccgatcctgggaacccagatctttaccatgtgttgagcgttatttggcagcttgcttgtgaaattaaggtgttgcacatggagccttggtcaagtttcgacatttatacacgcaaggggcccctcgaaaatcccaagcgcagggagctgcttgaccagttgcagcagaaactctacctgatacagatgatccctaggcagaatttattcacaaaaaatcttaccccaatgaactacaacattttctttcatctgctgaaacactgcttcggaaggcggagcgctacagtgatcgatcatctccggtctttaacccctcttgacgcccgcgacattctcatgcaaataggcaaacaggaggatgagaaggtcgttaacatgcacccccaggatttcaagaccttgttcgagacaatcgaacggagcaaggattgtgcatataagtggctctatgatgagacattggaagacaggtag

SEQ ID NO: 30917 - DNA, 414 bp, Artificial Sequence
  Description of Artificial Sequence: Synthetic coding sequence
atgtggatcccggtcgtgggcctgccaagacggctgcggctgtccgctctcgctggtgcagggagattttgcatactgggctctgaggcggcaacccggaagcacctgcctgcgagaaaccactgtggactctccgattccagtccccagttatggcctgaacccgacttccgaaatccgccccggaaggctagtaaagcaagcctggatttcaagcgttacgtcacagataggcgcctggccgaaacgctcgcccagatttacttgggaaaaccatcccgacccccacatttgttgctggaatgcaacccaggacctgggattttgacacaggctctgctcgaagctggagccaaagttgtcgctctagaatccgacaagacctttatcccgcacctggagacatccctgtag

SEQ ID NO: 30918 - DNA, 1896 bp, Artificial Sequence
  Description of Artificial Sequence: Synthetic coding sequence
atggccgcccatctcgtgaaacgatgcacctgtctcctcagggaggcggcacggcaagcccccgccatggcgcctgtgggccgcctcagacttgcctgggtggcccacaagacactgacatcttctgctacaagccccatatctcacttgccaggtagtttaatggagccagtggaaaaggagagagcgagcaccccttacatcgaaaagcaggtggatcatcttatcaaaaaggcaacccgcccggaagagctacttgagctactaggaggaagtcacgatcttgactcgaatcaggccgctatggtgcttatcaggctgtcacatctgctctccgagaaacccgaagataaggggttactgatacaggacgcccactttcaccagctgctgtgtctgttgaattcccagatcgcaagcgtgtggcacggtacgctgagcaagctgctgggaagcctgtacgctcttggcataccaaaagcatccaaagagcttcagtctgtcgaacaggaggttagatggaggatgcgcaaactcaagtacaagcacctggcttttttggccgaaagctgtgccactctgagccaagagcaacattcacaggaactcctggcggagttgctgacacacctggagcgaagatggaccgagatcgaggactcccatacccttgtgacagttatgatgaaggtcggccacctgagtgaaccactgatgaatagactcgaggacaaatgccttgaactcgtagaacactttggtccaaatgagctaaggaaagtgctcgtgatgttagccgcccagagtcggagaagcgtgccattgctgagagccatttcttaccacttggtgcaaaagccattctcccttactaaagatgtgctgctggatgtggcatacgcctacgggaaattgagtttccaccagacccaggtgtcacaaaggctggcaacagacctcctgagtttgatgccgagcctgactagcggtgaggtggcgcattgtgcaaagtccttcgcactcctaaagtggttaagtttgccattgttcgaagcattcgcgcagcacgttctgaatagagcgcaggacataactcttccccacctctgctccgtgctcctggccttcgcgaggctcaacttccatccagaccaggaagaccagttcttctcactggtccacgagaagctcggaagcgaattgccaggtctggaaccggccctccaagtggatctggtttgggccttgtgtgtgctgcaacaagctagagaagctgaattgcaggccgtattgcaccctgagtttcacatccagtttctcggcggaaagagtcagaaagatcagaacacctttcagaagctgcttcatataaatgcgactgccctactggaatacccggagtatagtggtcctctgcttccggcttctgcagtggcccctggaccctcagccctggatcgtaaggtcacccctctacagaaagagcttcaggagacattgaagggtctgctgggctccgctgacaaaggtagcctggaggtagccacccaatacggctgggtcctggatgccgaggttctcctcgacagtgacggcgagtttctgcctgtccgcgattttgtggccccacacctcgctcagcctacaggcagccagagcccacctcctggatccaagaggctcgccttcctgcggtgggaattcccaaattttaactcgagatctaaggacctattgggtcgttttgtgctggcacgtcggcacattgtggccgccgggtttctgatcgtcgacgtccccttctatgagtggctggagttgaagtcggagtggcagaagggcgcctatttgaaggacaagatgcggaaagctgttgccgaagagctggccaagtag

SEQ ID NO: 30919 - DNA, 1566 bp, Artificial Sequence
  Description of Artificial Sequence: Synthetic coding sequence
atggcagcccatctggtcaaaaggtgtacgtgcttgttgagggaggctgccaggcaggcccctgccatggcccccgtcgggcgccttagactcgcctgggttgctcacaagaccttgacttcctccgccacatctcctatctctcacttgcctggttctttgatggagcccgtggaaaaagaacgggcttctacaccatacattgagaaacaggttgaccatctgatcaagaaagcaacacgtccagaggagttacttgaactcttgggtggctcgcacgatctggattctaaccaggctgctatggtgcttatcagactgtcccatctgctgtcggaaaagcccgaagataagggactacttatccaagatgctcattttcaccagctgctttgtttgttaaactctcaaattgctagtgtgtggcatggaactttgtccaagctacttggaagcctctatgcactgggcattccaaaggccagtaaggaactccaaagcgttgaacaggaggttcgctggcggatgcggaaactgaaatacaagcacctagctttcctagctgagtcttgcgcaacactctcccaagaacagcattcccaggaactattggcagagctcctcacccatctggagagacggtggaccgagattgaagactcccacaccctcgtgacggtcatgatgaaggtggggcatctgtctgagcctctcatgaacagactggaagacaaacacgtattgaatagggcccaagacattaccctccctcacttgtgctccgtgctgctcgccttcgcccggctgaactttcaccctgatcaagaagaccagttctttagcctggtgcacgaaaaattaggttcagagctacccggcctcgagccggctctccaggtcgacctcgtttgggctctgtgtgtactgcagcaggctagggaggctgagctacaggccgtgttacatcctgagtttcatatccagttcctaggagggaaatcccagaaggatcagaacacttttcagaagcttctccatattaacgccacagcccttttggaatatcccgaatattctgggccattgctaccagcctcagccgtagcccccggcccttcggccctcgacaggaaggtcacacctctgcaaaaggaactgcaggaaactctcaagggtctgctagggagcgctgacaagggatccctagaagtggccacacagtatggctgggtgctggacgccgaggtgctcctggactccgacggtgagtttctgcctgtgcgggacttcgtcgctccacacctggcccaacctacgggatcacagtccccaccacccggaagcaagcgactggctttcttgcggtgggagtttcctaactttaatagccgatccaaagaccttcttggaagattcgtactagcaaggaggcacatagtagctgctggtttcttaatcgtggatgttcctttctatgagtggctggaactgaagagtgagtggcagaaaggtgcgtatctcaaagataaaatgcgcaaagcagtagctgaggaattggccaaatag

SEQ ID NO: 30920 - DNA, 1566 bp, Artificial Sequence
  Description of Artificial Sequence: Synthetic coding sequence
atggccgcgcatctggtcaagaggtgcacttgtctcctgagggaagctgcacgtcaggcccctgccatggccccagtcgggcggctgcgtctagcatgggtggcccacaaaacacttacgagtagtgcgacttcgcccatttcacacctcccaggtagcctgatggagcctgttgaaaaagaaagagccagtaccccttatatcgagaaacaggtggaccacctaattaaaaaagccacaagacccgaggagttgctggaacttctcggcggctcacacgatctggatagcaatcaggcagctatggtcctgatccgcctgagtcacctgctatcagaaaaacccgaggataagggcctgctgattcaagatgctcactttcatcagctcctgtgtctgctaaacagccagattgcttccgtgtggcacggcaccctttcaaagctgctaggtagtctgtatgctctgggtatccccaaagcttcaaaagagttgcagtcagtcgaacaggaagtgcggtggaggatgcgcaagttaaagtataagcaccttgcattcctggctgaatcctgtgccacactgtcccaggagcagcattcgcaggagctactggccgaattacttacacaccttgagcgtcggtggaccgagatcgaagactcccacactctggtgacagtcatgatgaaggtcggccacctgtcagaacccttgatgaaccgcctggaagataaacatgtgctgaacagggcccaagatatcactctgcctcacctttgttcagtcctgctagcctttgcaagactaaattttcaccccgaccaagaggaccagttcttctccctggtgcatgaaaaactgggtagtgagttaccaggtctggaacccgccctgcaggtcgacctggtttgggcgctctgcgtcctccagcaagcccgtgaagccgagttgcaagccgtcctgcaccctgagttccatatccagtttctgggaggtaaatcccagaaggatcagaacacttttcagaagctccttcatatcaacgcaactgctctccttgaatacccagagtatagtggacctttactaccagcatctgccgtagcccccggtccttccgcactggataggaaagtgacccccctccaaaaggagctgcaggagaccttaaaagggttactgggctcagccgataagggttccctggaggtggcaactcagtatggttgggtgttggacgccgaggttctgcttgattctgatggggaattcctgcctgtgagagacttcgtggctcctcaccttgcccagcctacgggatcccagtccccaccccctggttccaagagactagctttcctccggtgggaatttccaaactttaactcccgtagcaaggatctgctggggagattcgttctggctcgaaggcacatagttgccgcaggcttcctgattgtggatgtacccttctatgagtggctcgaactcaagagcgagtggcaaaagggcgcttacttgaaggataaaatgagaaaagccgtggctgaggaactggcaaagtag

SEQ ID NO: 30921 - DNA, 387 bp, Artificial Sequence
  Description of Artificial Sequence: Synthetic coding sequence
atggctgcccacctagtgaaaaggtgtacttgcttgctgcgagaggccgccaggcaggcgcctgcgatggcacccgtcgggcgcctgaggctggcctgggtggctcacaagaccctaacatccagtgcaacttccccgatcagtcatctacctggtagcttaatggaaccagtggaaaaagagcgcgcatctaccccctatatcgaaaaacaggtcgaccatctgatcaaaaaagccacacgccctgaagagctgctagaacttctgggagggtcccacgatctggactccaaccaagctgctatggtcctgatcaggctgagtcacctgctgagtgaaaaaccggaagacaaaggactgttgattcaggatgcccacttccactag

SEQ ID NO: 30922 - DNA, 357 bp, Artificial Sequence
  Description of Artificial Sequence: Synthetic coding sequence
atggccgcccatcttgtgaaacgctgcacctgtctcctgagggaggccgcaagacaggctccagccatggcgccagttgggaggctgagattggcctgggtggctcacaagactttaacaagcagcgccactagcccgatctcccatctgcctggatcactgatggagccagtcgagaaagagcgcgcttccaccccctatattgagaaacaagtggatcatctgatcaagaaggcaacacgccctgaagaactcttggagctactcggcgggtctcacgacctcgatagcaaccaggcggctatggtgctgattaggctgtctcacctgctatctgaaaagccggaggacaaatag

SEQ ID NO: 30923 - DNA, 1896 bp, Artificial Sequence
  Description of Artificial Sequence: Synthetic coding sequence
atggccgctcatcttgtcaaaaggtgcacatgtctactccgtgaagcagccagacaggcacctgcgatggctccggtgggccgccttagattagcctgggtggctcacaaaacactcacctcaagtgccacaagcccgatctcccatctacccggcagcctcatggagcctgtggagaaggagagggcttccactccttatatcgaaaaacaggtcgaccaccttatcaaaaaggcgactcggcctgaggagctgttagagttacttggcgggtctcatgacctggactccaatcaagccgctatggtgcttattcggctgagtcatctgcttagcgagaaaccggaagacaaggggctgctgatacaagacgcacacttccaccagttgctgtgtctgctgaacagccagatcgctagcgtgtggcacggtacactgagcaaactgctgggatctttgtatgctctggggattccgaaggcctctaaagaattacagtccgtggagcaggaagtccggtggaggatgcgtaaactcaagtacaagcatttggcttttctggccgaatcttgtgccaccctgtcccaagagcagcactcccaggaactattggccgagctcctgacacatctcgaaagacggtggaccgagattgaagactcacatactttggtaactgttatgatgaaggtcgggcaccttagcgaacctctgatgaatcgactggaggacaagtgtctggaacttgtggagcacttcggacccaatgaacttcgtaaagtgcttgtgatgctggcagcccagtcccgcagaagcgtgccgttgctacgtgccattagctatcacttagtccagaagcctttctcactaacaaaagacgttctcttggacgttgcctatgcctatgggaaactgtcgtttcaccagacccaggtcagccagcgcttagcaaccgatttactcagcctaatgcccagccttacttccggtgaggttgcccactgcgcgaaaagcttcgcgctgcttaaatggctcagcctgcccctctttgaagcctttgcccaacacgtcctgaatagagcccaggacatcaccttgccccacctgtgcagcgtattactggctttcgctcgcctcaacttccatcccgaccaggaggaccaattcttcagcctggtacatgagaagctgggcagcgaactgcctggcctggaacctgccctgcaggtggacctggtgtgggcactttgcgtgctccagcaggccagggaggccgagctgcaagcagtccttcaccccgagtttcatattcaattcctgggagggaagagccagaaagatcagaatacttttcagaaactgttgcatatcaatgctacggccttgctcgagtatcccgaatacagtggacctttgctgcctgcaagcgctgtggcccctggcccgtcagcattggaccggaaagtgacacctctccagaaggagcttcaagagacactgaaaggactgttgggatcagccgataaaggctccttggaagttgcaacccagtacggttgggtgcttgatgctgaagtcctcctcgacagtgacggagagtttctaccagtgcgggattttgtcgctccgcatctcgcccagcctaccggaagccagagtccgccgccaggaagcaaacgcctcgctttcctgcgatgggagtttccgaattttaattcaagatcaaaagacctgctcgggcggtttgttctcgctcggcggcatatcgttgcggcagggtttttgatcgttgatgtccccttttacgaatggctcgagctcaagtcagagtggcagaagggagcttacttgaaggacaagatgaggaaggccgtggctgaagagctggctaagtag

SEQ ID NO: 30924 - DNA, 312 bp, Artificial Sequence
  Description of Artificial Sequence: Synthetic coding sequence
atggcagctcatttggttaagcgctgcacatgcctactgagagaggccgcgcgccaggcacccgccatggcccctgtgggacgtcttcgactggcctgggtcgcccataagaccctgactagcagcgccacatctccaattagtcacctgcctggttcccttatggagcctgttgagaaagagcgcgctagtaccccttatattgagaagcaggttgatcacttgattaaaaaagcaaccagacctgaagaactgctcgagcttctcggcggaagccacgatctagactccaatcaagcggctatggtatag

SEQ ID NO: 30925 - DNA, 2547 bp, Artificial Sequence
  Description of Artificial Sequence: Synthetic coding sequence
atggagggatctccgtcactgcgccgaatgacagtgatgagagaaaagggtaggcgccaggctgtgcgcggtccagcattcatgttcaacgatcggggaacgtcccttactgctgaagaggagagattcctggacgccgccgaatatgggaatatacccgtcgtgcgaaagatgcttgaagagagtaagaccctcaatgtgaactgtgtcgattacatgggtcaaaacgccctgcagctcgctgtcgggaacgagcacctggaggtcaccgagctcctgctaaagaaagaaaatcttgccaggattggtgatgccctgctgctggcaatctcaaaggggtacgtgagaattgtcgaggcaattctgaaccatccagggttcgccgcctccaagagattgaccctgtctccttgcgaacaggaacttcaggatgatgatttttacgcatacgatgaagatggaaccagattttcccctgacatcactcccatcattctggccgcacactgtcagaagtacgaagtagttcacatgctattaatgaagggggctcggatcgaaagaccccacgactatttttgcaaatgcggagactgtatggaaaaacagagacatgattctttttcccacagcagaagcagaattaatgcttataaaggccttgcttccccagcttacctttcactgtcttccgaggatcctgtgcttactgcacttgagttgagcaacgaattggcgaagctggcgaatatcgaaaaagagttcaagaacgattaccgcaagctgtctatgcaatgcaaagatttcgttgtgggcgtgcttgatctgtgccgggattctgaggaagtggaagcaatcctcaatggggacctggagagcgcggagcccctcgaagttcaccggcataaagccagtctcagtagagtgaaactggccataaaatacgaagtgaagaagtttgtggcccaccccaattgccaacagcagctattgactatctggtacgagaacttatccgggctgagggagcagaccatcgccatcaaatgtctggtggttctggtcgtggccttggggctgccctttctggcaataggctattggatcgctccttgcagccgtttgggtaagattctgagatccccctttatgaagttcgtggctcacgctgcctcatttattatcttcctaggccttttggtcttcaacgctagtgaccggttcgaggggattaccaccctgcccaacatcacagtgaccgactaccctaagcaaatctttcgcgtcaaaactacccaatttacatggaccgagatgctgattatggtgtgggtgctgggaatgatgtggtctgaatgcaaagaattgtggctagaaggccctagggagtacatcctccagctctggaacgtactggacttcggtatgctatcaatcttcattgccgccttcaccgccaggttcctagcattcctgcaggccaccaaggcccagcagtacgtggacagttacgtgcaggaatccgacttatccgaagtgactctgcctcccgaaatacagtacttcacctacgcacgcgacaagtggttgcctagtgatcctcagattatcagtgaagggctgtatgcaattgctgtcgtattatctttctctaggatagcttatatcttgcccgcgaacgagtcctttggtccactccagatatccctcggccgcacagtgaaggatatctttaaattcatggtgctattcattatggtgttctttgctttcatgatcgggatgttcattctgtatagctattacctaggagcgaaggtcaacgcagcattcaccaccgtggaagaatctttcaaaacattgttctggagcatttttggcctgagcgaggttacatcagtggtgcttaagtatgatcacaaattcattgagaacatcgggtatgtgctctacgggatctataatgtgacgatggtcgtcgtgctactcaatatgttaattgccatgattaactcatcctatcaggagatagaggatgattcagatgtcgagtggaagtttgcacgatcaaagctctggctgagctattttgatgacggcaagaccctgcctccccctttctccttggtcccttctcccaagtcttttgtctactttataatgagaattgtgaacttccccaagtgtcggagaagacggctacagaaagatatcgaaatgggcatgggaaattctaagagtcggctcaatctctttactcagtccaatagccgagtattcgagagccattcgtttaattccatactcaatcaacctacacgctatcagcagatcatgaagagattgatcaagaggtacgttctgaaagctcaggtagacaaagagaacgatgaggtaaatgagggtgaattgaaggaaatcaagcaggacatcagttctctaaggtatgagctgctggaagataagagccaggctacagaggagctcgctatattaatccataagctgtctgagaagcttaatccgtcaatgctgcgctgtgaatag

SEQ ID NO: 30926 - DNA, 2766 bp, Artificial Sequence
  Description of Artificial Sequence: Synthetic coding sequence
atgtcaactaaggtccggaaatgtaaagaacaggcacgcgtgacctttcccgctcctgaggaggaggaagatgagggggaggacgagggagctgaaccccaacgacgccggcgcggatggcgaggggtgaacggtgggttagaaccaagatctgcaccgtcccaaagagagcctcatggttactgtcctcccccatttagccacggacctgatttaagtatggaagggagcccatccttacggcgcatgacggtgatgagggagaaggggaggcgccaggctgtacgcgggcctgctttcatgttcaacgacagaggtacttctctgaccgccgaagaagagaggttcctcgatgccgccgaatacggcaatataccagtcgttcgtaagatgttggaagaaagtaagactctcaatgtcaactgcgtggactacatgggccaaaatgcacttcagctggctgtcggaaacgaacaccttgaggtgacagaactgctgctgaagaaggaaaacctggcacgaatcggggacgccctgctcctcgccatatctaagggctacgtacgcattgtggaagccatcctgaatcatccaggattcgcagcttcaaaacgtcttacacttagtccctgtgaacaggagctgcaggacgatgacttttacgcatatgacgaggacgggacacgcttctcacccgacataactccgatcatccttgccgcccattgccaaaaatatgaggtggtgcatatgctgctgatgaagggggcccgtatcgagcgcccacacgactacttctgtaagtgcggcgactgtatggaaaaacagcggcatgatagctttagtcattcccgatctcgcatcaatgcttacaaaggactggcctcacccgcttacctctctttgtcttctgaagatcccgtgctgacggcactggagctgtctaacgagttagcaaaactggctaatatagagaaggaatttaagaacgactaccggaaactctccatgcagtgtaaggatttcgttgtgggcgtcttggacctgtgcagagattccgaagaggttgaagctatcttgaacggagatctagagtcagcggagcccctggaggtgcaccgccacaaggcatcgctctcccgggtaaagttagcaattaaatacgaagtcaagaagttcgtcgcgcacccaaattgtcagcaacagttactcacaatctggtatgagaatttatcaggattgcgagagcaaacaatcgcgatcaaatgcctagtagtcctagtggtcgccctcgggttaccctttctggccatcggctactggatcgcgccttgtagtcggctgggtaagattttacggagccccttcatgaaatttgtggctcatgctgcaagtttcattattttcttgggtctattggtcttcaatgcttcggaccgcttcgaaggcattaccacgctgccaaatatcactgtcactgactacccaaaacagatctttagggtgaaaaccacccagttcacttggacagagatgttaattatggtgtgggtgctcggaatgatgtggagtgaatgcaaggagttgtggctggaagggcccagggagtacattctacagttgtggaacgtcttggatttcggcatgctctctattttcatagctgccttcactgcccgtttcctggcattcctgcaggctacaaaggcacagcagtacgtagattcctatgtgcaggagtcggacctctctgaagtcaccctgcctcccgagattcagtacttcacatacgccagggacaagtggttaccaagcgacccccaaattatctctgaaggattgtacgcgattgcagtggtcttaagtttcagcagaattgcttacatccttcccgctaacgagtcttttggcccccttcagataagcctaggaaggaccgtcaaagacatattcaaatttatggtgcttttcattatggtgttctttgcttttatgattggcatgtttatcctctactcatactacttgggcgccaaagtaaatgccgcgttcacaacagtggaagaatccttcaagactctcttctggagcatcttcgggctgagcgaagtcacctcagttgttcttaagtatgatcacaagtttattgaaaatattgggtatgtgctttacggtatctacaacgtaaccatggtcgtggtgctgttgaacatgctgatcgccatgataaactcctcataccaggagattgaggacgactccgatgtcgaatggaagtttgcccgaagcaaactctggcttagttatttcgatgacggtaaaacgctcccgccacccttcagcctggtcccaagcccaaagtctttcgtgtacttcatcatgaggatagtgaacttccccaaatgccggagacggaggctgcagaaggacatagagatgggaatgggaaacagcaaatcccgactgaacctgtttacacagagcaacagtagagtcttcgaaagtcactcttttaatagcatcctcaatcagcccacaagataccaacaaatcatgaagcgcctgataaaacgatacgtcctgaaggcacaggtggataaagagaatgacgaggtgaacgagggtgagctcaaggagatcaagcaagatatcagcagtctgagatatgagttgcttgaagacaagtcccaagcaacggaggaactcgcaattcttattcacaagctgtcagaaaagctgaacccctcgatgctgagatgcgagtag

SEQ ID NO: 30927 - DNA, 282 bp, Artificial Sequence
  Description of Artificial Sequence: Synthetic coding sequence
atggaagggagtccatcactcagaaggatgaccgttatgcgggagaagggcaggaggcaagcagtgagaggacccgcatttatgtttaacgaccgcgggacttcattgaccgctgaggaagagcgattcttggatgccgctgagtatgggaatatcccagtggtccgaaagatgttggaagagtccaagacgctcaatgtaaactgcgttgactacatgggacagaacgcactgcaactcgccgtaggcaacgagcacttggaggtgacggaactgctctag

SEQ ID NO: 30928 - DNA, 2382 bp, Artificial Sequence
  Description of Artificial Sequence: Synthetic coding sequence
atggagggatctccgagcctgaggagaatgacagtgatgcgcgagaaggggcggaggcaggctgtcaggggtcccgcttttatgtttaacgataggggcacctccctgacggctgaggaagaacgcttcctggacgccgcagaatacggtaacatccctgtggttcgtaagatgctggaagaatccaaaacgctgaacgtcaattgtgtggattatatggggcagaacgctctacagctagcagtcggcaacgagcatttggaggtcacagaattgcttctgaaaaaggagaatctggcccgcattggtgatgccttgctcctggccatttctaaaggctacgtgagaatcgtcgaagctatcctgaatcaccccggattcgccgcaagcaagcgccttacactatcaccttgcgagcaggagctccaagacgacgacttttacgcgtacgacgaagacggaacgcggtttagccctgacataactccgatcatactcgctgcgcactgtcaaaaatacgaggttgtccacatgctgctgatgaagggagcacgcattgaacgcccccatgactacttctgcaaatgcggggattgtatggagaaacagcgacacgattcgttctcccacagtcgctcccgcattaatgcctataaaggcctcgcatcccccgcatacctttccctatcgagcgaggacccagttcttaccgcgctcgaactcagtaacgaactcgctaagctggcgaatatcgagaaagaattcaagaacgattatagaaagctaagcatgcagtgcaaagatttcgtcgtgggtgtgctggacctgtgtagagactctgaggaagttgaggctatactcaacggagacctggagtcagctgaacccctggaagtgcaccgtcataaggccagcctgagtagagtcaagctggccattaagtacgaggtaaaaaagctggggaagattcttagaagtccctttatgaaatttgttgcccacgctgcctcgtttattatatttctgggactgctggtttttaacgcttccgaccgcttcgaaggtataacaacactaccaaacatcaccgtgacagactacccaaaacaaatcttcagagtaaagaccacgcaattcacatggaccgagatgctaattatggtatgggtgctcggtatgatgtggtcagagtgtaaggagctgtggctggaagggccccgggagtatatcctgcaactttggaacgttcttgactttggtatgctttctattttcatcgcagccttcacagcaaggttcctcgcctttctccaggctacgaaggctcagcagtacgtagactcctatgtccaggaatctgatctgtccgaagtcaccctgccccccgagatacagtacttcacctacgctagagacaaatggctaccatccgatccccagattattagcgagggactgtacgctatcgcagtagtactgtccttctcccggatagcatatattctgccggccaatgaaagtttcgggccactgcagatcagtttgggaagaacagtgaaagacattttcaagtttatggtgttattcattatggtgtttttcgcttttatgatcggaatgtttatcttatacagctattatttaggggctaaggtgaatgcagcttttacgaccgttgaggagagttttaaaacactcttttggagtatctttggactcagcgaggtcacatctgtggttctcaagtatgatcacaaatttatcgagaatatagggtacgtgctctacgggatctacaacgtaaccatggtggttgtgctcctcaatatgcttattgctatgattaactcaagctaccaggaaatcgaggacgattcagacgtcgagtggaagttcgccaggagcaagctctggctcagctacttcgacgacgggaaaacactgccacctcctttctccctcgtaccttccccaaaatcattcgtatactttatcatgcgcatcgtgaactttcctaagtgccggaggaggcgactgcagaaggacatagaaatggggatgggcaacagtaaatcacggctgaacctcttcacccaatcaaatagtcgcgtcttcgagagccattccttcaactccattttgaaccaaccgacacgatatcagcagatcatgaagagattaattaaaaggtacgtgctgaaggcacaggtcgataaagagaacgacgaagttaacgaaggcgaactgaaggagatcaagcaagacatttcttccctgcggtatgagttgttggaagataagtcgcaggccactgaagagcttgccatcctgatccataaactatctgagaagctcaatccaagtatgctgaggtgcgaatag

SEQ ID NO: 30929 - DNA, 747 bp, Artificial Sequence
  Description of Artificial Sequence: Synthetic coding sequence
atgatttgcacgttcctgagggccgtccagtacacagagaaattgcatcgctcttctgccaagcggttgctgctgccttacatagtgctgaacaaggcttgcttgaaaactgagccgagtctaagatgtgggcttcagtatcagaagaaaaccctgcgccctagatgcatcctcggagttacacagaagacaatctggacccaaggacctagccccaggaaggccaaggaagacggatccaagcaggtgtccgtgcataggtctcagcgagggggcacagctgttcccacctctcagaaggtgaaagaagccggccgcgatttcacctacctgattgtggtgttattcggaatatctattaccggcggactgttctatactatattcaaggaactctttagttctagtagcccctctaaaatctatgggagggcattggagaaatgtagatcacaccctgaggtgatcggcgtctttggggaatccgtgaagggttacggggaagtaacgagacgagggcggcgacagcatgtgcggttcaccgaatatgtgaaagacggtctgaaacacacgtgcgttaaattttacatcgaaggttctgagccaggcaagcaagggaccgtttacgctcaagtgaaagagaaccctggctctggcgaatatgacttccgttatatcttcgtggaaattgagtcatacccccgtaggacgataattattgaggacaacagatcccaggacgactag

SEQ ID NO: 30930 - DNA, 405 bp, Artificial Sequence
  Description of Artificial Sequence: Synthetic coding sequence
atggagggcggaggtggcagtggaaataagacaactggcggactggccggattcttcggtgcgggtggtgccgggtactcacatgccgacctggcgggcgtgccactgacgggaatgaaccctctgtcgccctatttgaacgtggacccgcggtatttagtccaggacaccgatgaattcatacttccaacaggagctaataagacacggggccgattcgaactcgccttcttcacaatcggaggctgctgtatgaccggcgccttgtgggcaaatacacttggcagtctcgctctcctctactccgcgtttggggtgatcattgaaaaaacacgtggagccgaggatgaccttaataccgtcgccgccgggactatgaccgggatgctctataaatgtacctag

SEQ ID NO: 30931 - DNA, 516 bp, Artificial Sequence
  Description of Artificial Sequence: Synthetic coding sequence
atggagggtggaggcggtagcggaaacaaaaccaccggaggacttgcaggcttcttcggtgccgggggcgccggatactcacatgctgatcttgccggcgtgcccctcacaggcatgaaccccctatctccatatctgaatgtcgacccccgctatttagtgcaggacactgatgagttcatcctgcccacgggagccaacaagaccagagggagattcgagttggccttctttactatcggcgggtgctgcatgaccggggcagctttcggtgcaatgaatggtctgagactggggctgaaagagacccagaacatggcctggtctaaacccaggaacgtgcagatccttaacatggttacgaggcagggcgccctgtgggctaatacccttgggtcactggccctcttgtactctgcattcggtgttataattgagaagactcgtggcgccgaagacgatttgaacaccgtggccgcgggcaccatgacaggtatgctctacaagtgcacctag

SEQ ID NO: 30932 - DNA, 450 bp, Artificial Sequence
  Description of Artificial Sequence: Synthetic coding sequence
atgacaggcgccgcatttggcgctatgaatggactgcgcttgggccttaaggaaacccagaatatggcttggtccaaaccgcggaacgtccagatcttaaacatggtcacccgccagggcgcactgtgggcaaacacattgggatcattggcactgctgtatagcgcattcggggtgatcatcgagaaaacccgtggagccgaagatgatctgaatacagtggctgctgggactatgactggcatgctctacaagtgcacagccagtgcaagccagggagccggtatcgctgatggcgtgtctttcacccaatgctctatgttgccacgcctcgaatgttctggagtgatcagcgcttcctataacctgcatcttcccgccgcttgcctgggcttaccgaaatgtagggactgctctctgtgcccggctgctacgccatctgggaagtag

SEQ ID NO: 30933 - DNA, 372 bp, Artificial Sequence
  Description of Artificial Sequence: Synthetic coding sequence
atggaaggcggcggtggatctgggaacaagaccacagggggactcgcaggcttttttggtgctggaggcgcaggctacagccacgcggaccttgctggggtgcctttaactgggatgaatcccttaagcccatatctcaacgtggatccaaggtatttggtgcaggataccgacgaattcattctcccaacaggagccaacaagacacggggccggtttgagcttgcatttttcaccataggcgggtgctgcatgacggcgctgctatactcagcctttggagtcatcatagagaagaccagaggagcagaagatgacctgaacacagtagcggcaggtactatgaccggaatgctctataaatgtacctag

SEQ ID NO: 30934 - DNA, 1371 bp, Artificial Sequence
  Description of Artificial Sequence: Synthetic coding sequence
atggcctctgcgctgagcttaggcaataagtgtgatcccttcctaagatgtgtgttgtgcagaggtggaggagctctgcaggggcccaggggcagaggacccgatgatttcgagtcacagcttagccctccgggcagcgcaaggaggttggtgagatcaaagagagcttgtgggaacccacctgacgcctttggtctatctagggcgagcgtgcaccctcctttgcctcgagtgtcaatcggatgctccagcggtccaggacgagcaaagagagagcgcgtgggtggcgccgcttggcggcagcgaaagatggctgcttccgctgcagtctttagccggctgagaagtggtttgcggctcggctcccgaggcctgtgtacacgcctcgccacccccccgcgcagagcaccagatcaagcagccgagatcggcagtagggggagtacaaaagctcagggtccacagcagcagcctggtagtgaggggccatcatacgcgaaaaaagtcgcattgtggcttgctgggctcctgggggcaggggggacagtaagcgtcgtatatatttttggaaataatccggtcgacgagaatggtgcaaagatacctgacgagtttgataatgaccccatccttgttcagcagcttagacggacttataaatacttcaaggactatagacaaatgataatcgagcccacatctccctgcctgctgccggacccattacaagaaccctactatcaaccaccgtatactctcgtcctcgaactgaccggagttttgctgcaccctgagtggtcattggctaccggctggcgatttaaaaaaaggcctggaatcgaaactctctttcagcagttagctccattgtatgaaatagttatctttacctcggaaactggtatgacagccttccctcttattgatagtgttgacccacatggcttcatctcctatagacttttcagggatgctacccgttacatggatggtcaccacgtcaaggacataagctgcctgaatcgggacccagctcgggttgtggtcgtcgattgcaaaaaggaagcattccgcctgcagccatacaatggtgtggccctcagaccatgggatggaaatagcgacgatcgggtcctactcgatctgagcgcatttcttaaaacaatcgctctgaacggcgtggaagatgtccggaccgtcctcgagcattacgccctggaggacgacccccttgcggcgttcaagcaaagacagagcaggcttgaacaggaagagcaacagcgcctggccgagctatctaagtcaaacaagcagaatctcttccttggaagtctgacttctaggctgtggcctagatcaaaacaaccttag

SEQ ID NO: 30935 - DNA, 723 bp, Artificial Sequence
  Description of Artificial Sequence: Synthetic coding sequence
atggttccacgtttcctgatgagcagtacgatgatgatcatcgaaccaacctccccctgcctactgcccgacccgcttcaggagccttattatcagccaccatacaccctcgtgcttgaactgacaggcgttctccttcatccagaatggagtctggccacaggttggagatttaaaaagaggcccggaatagaaacgctgttccagcagcttgcacccctgtacgaaatcgtaatcttcacatcggagaccggtatgaccgccttccccctgattgatagcgtggacccccatggattcatatcctaccgcctgtttagagatgcgaccaggtatatggacgggcaccacgtcaaagatatatcatgcctgaatagagatcctgccagggtagtagtggtcgattgcaagaaggaggcattccgactgcagccttacaacggcgtcgctttgagaccctgggatgggaatagcgatgatcgagtgttgttagacttaagcgccttcctgaaaacaatcgcgctgaacggcgtggaggatgtccgcactgtactggagcactatgctctggaagatgatcccctggccgcgttcaagcaacggcagagtagactcgagcaggaggagcagcagcggctggcagaactttcaaagtctaataagcagaatttatttctaggcagtcttacatcaagactgtggcctcggagtaagcaaccgtag

SEQ ID NO: 30936 - DNA, 252 bp, Artificial Sequence
  Description of Artificial Sequence: Synthetic coding sequence
atggctgagctgggggaagccgacgaggctgagctgcagagactggtcgcagccgagcaacagaaggcccagtttactgcccaggtgcaccattttatggaactgtgttgggataagtgcgtggagaagccgggcaaccggctggattcacgaactgaaaattgcttgagttcatgcgtagatcgttttatagatacgaccctcgccattaccagcagattcgctcagattgtccaaaaaggcggtcagtag

SEQ ID NO: 30937 - DNA, 297 bp, Artificial Sequence
  Description of Artificial Sequence: Synthetic coding sequence
atgcgcaagcatagctgtaggaaggtggcaagcctacggcgtaccatggccgaacttggcgaggccgatgaggcagaactgcagaggctcgtggcggccgaacagcagaaagcgcagtttaccgctcaagtgcaccacttcatggagttatgttgggataagtgtgtcgagaaacccggaaatcggctggactcacgcacagagaactgtctcagctcgtgcgtcgatcgtttcattgacacaactctcgcaatcacctcaagattcgcgcaaattgtgcagaaaggggggcaatag

SEQ ID NO: 30938 - DNA, 858 bp, Artificial Sequence
  Description of Artificial Sequence: Synthetic coding sequence
atggaggttccgccccctgctccaaggtctttcctgtgtcgggcactgtgcctatttccaagagtgttcgccgctgaggcagtgacggccgactccgaggtgctggaggagaggcagaagcggttgccctacgtccctgagccatactacccggagagtggctgggatagactgcgggaactgttcggtaaggacgaacagcagagaataagcaaagaccttgccaacatttgcaagaccgcagccaccgctggcatcattgggtgggtatacggaggcatacctgcattcatccatgctaagcagcagtacatcgaacagagtcaagctgagatttaccacaaccgatttgatgccgtgcagtccgcacatcgagccgctacacgtggttttatccgatacggatggcgatgggggtggcgaacagccgtgtttgttactattttcaacacggtgaatacatccctgaatgtgtatcgcaacaaggatgcactcagccacttcgttatcgccggagccgtcacgggaagtttgttcagaatcaatgtggggttaaggggcctggtggccgggggcatcataggggcgctgctcgggactcctgtaggaggattactgatggcatttcaaaagtatagtggtgagaccgtacaggaaaggaagcaaaaagacagaaaagctctgcatgagctgaagctcgaggagtggaagggtcgtctgcaagtcacagaacacctgcccgagaagattgaatcttcactgcaggaggacgagcccgagaacgacgccaaaaaaatcgaggccctcttgaacctccctcgcaaccctagtgtgatcgacaagcaagataaagattag

SEQ ID NO: 30939 - DNA, 438 bp, Artificial Sequence
  Description of Artificial Sequence: Synthetic coding sequence
atggtgggccgcaacagtgccatcgcagcaggggtttgcggcgccttgtttatcggttactgtatctactttgatcggaagcgcagatctgaccctaacttcaagaatcgcctacgggagcggagaaagaaacagaagcttgccaaggagcgagccgggctcagcaagctgcccgatctgaaggacgccgaggccgtgcaaaaattctttcttgaggagattcagttgggagaagaattgcttgcacaaggcgaatacgaaaaaggcgtcgaccatctcacgaacgcaattgccgtgtgcggtcaaccacagcagctgttacaagttctgcaacaaaccctgcccccaccagtcttccagatgttgctgactaaacttccaactatatcccagaggatcgtaagcgcccaaagccttgcagaggatgacgttgaatag

SEQ ID NO: 30940 - DNA, 459 bp, Artificial Sequence
  Description of Artificial Sequence: Synthetic coding sequence
atgcctagcgtgcgatcccttctaagactcctggctgccgctgctgcctgtggggcgttcgcatttctaggctactgcatttacctgaatcgaaagaggaggggagatcccgcctttaagaggcgactaagagacaagcggcgtgctgaacctcaaaaggccgaggaacaagggacacagctctgggaccccaccaaaaacaagaaactgcaggaactatttttacaggaagtgcgcatgggagagttgtggctgagtcggggcgaacatcgtatggggatacagcacctcggaaacgccctcctggtatgtgaacagccccgggaacttcttaaagtgttcaagcacaccttgccaccgaaggtgtttgaaatgcttctccacaagatccctctgatttgccagcagttcgaggctgacatgaatgagcaggattgtctggaagacgaccccgactag

SEQ ID NO: 30941 - DNA, 930 bp, Artificial Sequence
  Description of Artificial Sequence: Synthetic coding sequence
atggcccctaaattccctgattctgtcgaagaactgcgggcagctggcaatgaatcgtttcgaaatgggcagtacgctgaagcctccgcgctttacggcagggccctccgcgtgctgcaggcccaaggcagctccgatcccgaggaagaatctgtgttgtactctaacagagcagcctgccatctgaaagacggcaattgtagagactgtatcaaagattgcacttctgctctggctctcgtccccttttcaatcaagcccctcttacgacgtgcgagcgcgtacgaagccctggaaaaatacccgatggcctatgtggactacaagacagtgctgcagatcgacgataacgttacctcagcagtggagggcatcaaccgcatgacgagagcactcatggattccctggggcctgagtggcgattaaaactcccatccattcccctggtgcctgtatctgcccagaagaggtggaactccctcccgagcgagaaccacaaagagatggctaaaagcaaatctaaggagacaaccgctacgaagaatcgggtccccagtgccggagatgtcgagaaggcgcgcgttctgaaggaagaggggaacgagttggtgaaaaaggggaatcataaaaaggctatcgaaaaatactctgagtctcttctgtgctcaaatctggaatccgctacgtactcaaacagggccctctgctatctagttctcaaacagtataccgaagcagtgaaggattgcaccgaagcccttaaactggatgggaagaatgttaaagcattttatcgcagggcgcaggctcataaagccctgaaggactacaagagcagcttcgccgacatttcgaatctgctgcagatcgagcctagaaacggccccgcgcagaagttgcgccaggaggtgaagcaaaatctgcactag

SEQ ID NO: 30942 - DNA, 927 bp, Artificial Sequence
  Description of Artificial Sequence: Synthetic coding sequence
atgggcaacacccttggcctggctcccatgggaaccctcccacgacgatctcccaggagggaagaacccctgccaaacccaggatcgttcgacgagctccaccgcttatgtaaggatgtcttccccgcccaaatggaaggagtcaagctagtcgtgaataaggttctcagttcacattttcaagtcgcccacacaatccatatgtccgcgctcggccttccgggatatcatctgcacgccgcgtacgccggcgattggcagctttctccaaccgaagtatttcctactgtggtcggcgacatggacagctcagggtctctcaacgcccaggtattgctcctcctggctgagcggttgcgggctaaggcagttttccaaacacagcaggcaaagttcctgacttggcagttcgacggcgagtatcgcggagatgactataccgcgactctgacactgggcaaccctgacctcattggggaatctgtcattatggtcgcccattttcttcagagcctgactcatagactggtactcgggggcgaactggtttaccacaggagacccggagaagagggcgccattctgacgctggccggaaaatacagtgccgtacactgggtggcaacgctaaatgtcggctcgggaggtgcacacgccagctattaccaccgcgcaaacgagcaggtgcaagtgggagtagagtttgaagccaataccagactccaggacaccaccttctctttcggttaccacctgactctgccccaggccaacatggtattccggggcctggtggattcaaactggtgtgtgggcgcagtcctggagaaaaagatgcccccactccctgtgaccctggctctcggcgcatttctcaatcattggcgcaaccggtttcactgtgggttctctatcaccgtcgggtag

SEQ ID NO: 30943 - DNA, 927 bp, Artificial Sequence
  Description of Artificial Sequence: Synthetic coding sequence
atgggtaacacactgggtctggctcctatgggaaccctgcctcggagatcacccaggagggaagaaccactgcctaatccaggcagcttcgacgaactgcaccgcctgtgtaaggacgtttttccagcacagatggaaggagtgaaacttgtggtgaacaaagtgctgagctcgcactttcaggtcgcccatacaatccacatgtctgccttgggcctgccgggttaccacttgcacgcagcatacgcaggcgattggcagctctcccccacagaggtttttcctacagtagtgggggatatggattctagcgggagtctgaacgcccaggtactgttgctcttggctgagcgtctccgggcaaaggccgtgtttcaaacccagcaggcaaaatttctgacatggcaatttgatggcgagtacagaggagacgactataccgcaactctcacccttggtaatcccgacctgatcggcgagtccgtcataatggtcgcccactttctgcagagcttgactcatcggctagttttgggaggcgaattagtgtatcaccgccggcctggcgaagaaggagcgattttgaccttggcaggcaagtacagcgccgtacactgggtggctaccttgaatgtcggatccggtggagctcatgcctcctattaccacagggcaaatgagcaggtgcaagtgggggtggaatttgaagccaacactcggctgcaggatacgaccttttctttcggataccatctaacattaccccaggctaatatggttttccggggcctcgtcgactccaattggtgcgtgggcgcagttttggaaaagaagatgccccctctcccagtaaccctggctctgggagcatttcttaatcattggagaaaccgcttccactgtggcttcagcattacagtcggctag

SEQ ID NO: 30944 - DNA, 633 bp, Artificial Sequence
  Description of Artificial Sequence: Synthetic coding sequence
atgtcctgcaccgtgtacgcgaaggtcgctcacactattcatatgtctgccttaggactccccggctaccatttacacgctgcttatgccggcgattggcagctgtcccctaccgaggtctttcccacagtcgttggggatatggactcctctgggagtttgaacgcacaggtgttgctcctgctggctgaacggctcagggccaaggccgtgttccaaacacagcaggctaagtttcttacgtggcagtttgatggcgagtacagaggcgacgactatactgccaccttgacactggccggaaagtacagtgcggtccactgggtcgctaccctcaatgtgggatccggtggggcccatgccagctattaccatcgcgccaatgagcaggtccaggtcggcgttgaatttgaggcaaacactcgcctgcaggatacaacattctctttcggctatcacctgacactcccccaggccaacatggtatttagggggctggtcgactctaattggtgcgtgggcgccgtcctcgagaaaaagatgccgccgttgcccgtaacgttggccttaggcgcttttctgaaccattggcgcaaccgctttcactgcgggttctccataaccgtcgggtag

SEQ ID NO: 30945 - DNA, 825 bp, Artificial Sequence
  Description of Artificial Sequence: Synthetic coding sequence
atggggaacacacttggcctcgctccgatgggaaccctgcctagaaggtcccctcgtcgcgaagagcctttgcccaacccaggtagtttcgacgagctccatcggctctgtaaggatgtgtttccagcgcagatggaaggggtgaaactggtggttaacaaagttttgagcagtcacttccaagtcgctcataccattcatatgagcgccctcggactccccggttatcatctccatgctgcttatgctggagactggcagctgagtcccacagagacgcaacaggccaagtttttgacatggcagtttgatggcgaatacagaggcgacgactatacagcaaccctgacattaggaaatcccgatttgataggcgaatcagtcatcatggtcgcccactttctccaaagtctgacccatcggctggtgttgggtggggaacttgtataccacaggaggcctggcgaggaaggtgccatactgaccctggcaggaaaatactccgccgtacattgggtggcaacgttgaacgtggggtccggaggggctcatgcatcttattaccatcgcgccaacgaacaagtgcaggtgggcgttgaattcgaggcgaacacaaggctccaggacaccaccttctcttttgggtatcatttgacactgccccaagccaatatggttttccgtggtctggtcgacagcaattggtgcgtgggcgcagtccttgagaagaaaatgccccctctgcctgtcaccctggccctgggcgcatttctcaaccactggcggaatcgtttccactgtggattttcgatcacagtgggctag

SEQ ID NO: 30946 - DNA, 156 bp, Artificial Sequence
  Description of Artificial Sequence: Synthetic coding sequence
atgttcaggatagaggggcttgctcctaagctggatccggaagaaatgaagcggaagatgagggaagatgtgatctcctcaatccgcaactttctgatttacgtggccttgctccgggtcacaccatttattctgaagaaacttgattctatttag

SEQ ID NO: 30947 - DNA, 258 bp, Artificial Sequence
  Description of Artificial Sequence: Synthetic coding sequence
atgttccgaattgaagggttagccccgaagttagacccggaggagatgaaacgcaagatgcgggaagacgtgattagcagcatcaggaattttcttatctacgttgccctgttgcgggtttcagagtgcctaccaggttgtgattgtgagacatctggggagcttacagacggccacccgctgactctccgaggccaccgtggcctgagaaccgaattgaacgctcccttcattctgaagaaactagatagcatatag

SEQ ID NO: 30948 - DNA, 279 bp, Artificial Sequence
  Description of Artificial Sequence: Synthetic coding sequence
atgtttaggatcgaaggactggcacccaaactagatcccgaagaaatgaaaagaaaaatgagggaggacgtcatttcttctatcaggaattttctgatatacgttgcacttcttcgggtgagtgagtgcctaccgggttgcgactgtgagacctctggcgagctgaccgacggtcaccctctgactctgaggggccacagagggctccgcaccgagctaaacggatctggagagcagggaggctgtgcactcaaggccacgggaatctgcgccgtatag

SEQ ID NO: 30949 - DNA, 225 bp, Artificial Sequence
  Description of Artificial Sequence: Synthetic coding sequence
atggcttcctccacagtgcctgtatccgcggcaggtagcgcgaacgaaactcccgaaataccagataacgtaggggattggctgcggggcgtttatcggtttgctacagacagaaatgattttcgtagaaacctgatcctcaatctaggattgttcgcagcgggagtctggttagcgagaaacctaagcgatatagatctgatggcccctcagcccggcgtctag

SEQ ID NO: 30950 - DNA, 225 bp, Artificial Sequence
  Description of Artificial Sequence: Synthetic coding sequence
atggcgtcgagcactgtccctgtcagcgctgcaggcagcgctaatgagacccccgaaatacccgacaatgttggtgactggcttcgcggcgtctatcggttcgccacagacaggaacgactttcgcaggaatcttattcttaatcttggtctgtttgctgctggggtgtggctggctagaaacctgagcgatattgacctcatggccccccaacctggggtgtag

SEQ ID NO: 30951 - DNA, 168 bp, Artificial Sequence
  Description of Artificial Sequence: Synthetic coding sequence
atggtcaagctatccaaggaagcaaaacagcggctccagcagttattcaagggctctcaattcgcaatacgctggggatttatcccacttgtgatctacctgggctttaagagaggagcggatccgggtatgcctgagccaactgtcctcagcctgttatggggatag

SEQ ID NO: 30952 - DNA, 1827 bp, Artificial Sequence
  Description of Artificial Sequence: Synthetic coding sequence
atggctgcctctaaaccagtcgaagctgctgtagtggcagccgcggtcccgtcatccggctccggtgtgggcgggggcggcaccgccggaccaggaaccgggggcttgcccaggtggcagctggcattggctgttggcgctcccctgcttctcggagccggcgcaatctacttatggagccggcagcagcgtagacgagaggcccgcggccggggagacgcttctggattgaagaggaattcggaacggaagacacccgaagggagagccagccccgcaccgggttccggtcaccccgaaggccctggcgcccatctagatatgaatagccttgatcgagcgcaagctgccaagaacaaggggaacaaatacttcaaggctggcaagtacgaacaagcaatccaatgttacactgaagcaattagcctgtgtcctactgaaaagaatgtggatctttcaaccttttaccagaatcgcgccgcagctttcgagcagctgcagaaatggaaggaggttgcgcaagattgtaccaaggcggtggaactcaaccctaagtacgttaaggccctattcaggcgtgcgaaagctcatgagaagttggataacaaaaaggagtgcctcgaagacgtgaccgcggtgtgtattctcgaaggcttccaaaaccaacagagtatgctgctcgccgataaggtgctgaaactcctggggaaagaaaaggccaaggaaaagtacaaaaatagggagccattgatgccctccccacaattcatcaaatcctatttctcttcctttacagatgatattatctctcagcccatgttgaaaggtgaaaagtccgacgaagacaaggacaaggagggcgaggccttggaggtcaaggagaactccgggtatctaaaggctaaacagtatatggaggaggagaactacgacaaaattatctcggaatgctcgaaagagattgatgctgaggggaagtacatggctgaagcactgctgttgagggctacattctaccttctaattggcaatgccaatgcagcaaaacctgacctggacaaggtcatctcacttaaggaagctaatgtcaagctgagagcgaatgctctcatcaaacgcggtagtatgtacatgcagcagcagcaacccctgttatccacccaagatttcaatatggctgcagacattgaccctcagaatgcagacgtgtaccatcaccgagggcagttgaaaatccttcttgaccaggttgaagaagccgtagcggatttcgacgagtgcataaggctgaggcccgagtctgccctcgcccaggcccagaagtgcttcgctttatatcgccaggcctacacaggaaacaacagttcccagatccaagctgcaatgaaaggttttgaagaagtgattaagaaatttcctcgctgcgcagagggttatgccctgtatgcccaggctctcaccgaccagcagcagtttggaaaggctgacgagatgtatgataagtgcatcgatctcgaaccagataacgccacaacctacgtgcacaaaggcctcctgcagctgcagtggaaacaggatctggatcggggactggagctcatttccaaggctattgagatcgacaacaagtgcgatttcgcgtacgagacaatggggacaattgaagtgcagaggggcaacatggagaaggctatagacatgttcaataaagctatcaatctcgcaaaatctgagatggaaatggcacacctctacagcctgtgtgatgccgcccatgcccaaaccgaggtggccaagaagtacgggctgaagccgccgaccctatag

SEQ ID NO: 30953 - DNA, 1506 bp, Artificial Sequence
  Description of Artificial Sequence: Synthetic coding sequence
atgaactctctggacagggcccaggccgccaagaacaaaggcaacaagtattttaaggctggcaagtatgagcaagccatccagtgttacactgaggccatttcgctgtgtcccaccgagaaaaacgtggacctgagcacgttctaccagaatcgagcagccgcatttgagcagttgcagaagtggaaggaagtggcgcaggattgcactaaagcagtggaattgaatccgaagtacgtgaaggccctgttccgaagagccaaggcgcacgaaaaattagacaataaaaaagaatgtctggaggacgtgacagccgtctgcattttggagggatttcagaaccagcagagcatgctgctagccgacaaagttctgaagttgctcgggaaggaaaaagcaaaggagaagtataaaaatcgcgaaccactgatgccaagccctcaattcataaaatcctatttctcgtcttttactgatgatatcatctcccaacctatgttgaagggcgagaagagcgatgaggacaaagacaaagagggggaagcgctggaggtaaaagagaattctgggtatctcaaagccaaacagtatatggaggaggagaactacgacaagatcatttccgaatgttccaaggagatcgatgctgaaggtaagtacatggcagaggctcttctgctgcgagccacattctatcttcttattggcaacgcgaatgccgcgaagccggacttggataaggtcattagcttgaaagaggctaacgtaaagctccgcgctaacgcgctgataaaaaggggatctatgtacatgcagcagcagcagccactgctgtccacccaagactttaacatggccgcggacattgaccctcagaacgctgacgtgtatcatcatcggggccagttaaaaatcttacttgatcaggtagaagaggccgtggcagactttgatgaatgtattcgactgagaccagagagcgccctcgcccaagcccagaaatgcttcgccctgtacagacaggcttacaccggcaacaacagctcccagatccaggccgccatgaagggattcgaagaagtgattaagaagttccctaggtgtgctgaaggctatgccttgtacgcacaggccctcaccgatcaacagcagtttgggaaggccgatgagatgtacgacaaatgtattgaccttgagcccgacaatgccacaacttatgtgcacaagggcttgttgcagcttcagtggaaacaggacctcgatcgtggacttgagctgatttccaaagccattgagatcgacaataagtgtgacttcgcctatgagactatggggacgatcgaagtccagcgcggtaacatggaaaaggctatcgacatgttcaataaagccatcaatctcgcgaaaagcgagatggagatggcccacttgtattccctgtgcgacgctgctcacgcgcagacggaggttgctaaaaaatacggcttgaagccccccaccctctag

SEQ ID NO: 30954 - DNA, 1125 bp, Artificial Sequence
  Description of Artificial Sequence: Synthetic coding sequence
atggcgatcaggaagaagtctacaaaaagcccccccgtcctaagccatgagttcgtactgcagaaccacgctgatatcgttagctgcgtagctatggttttccttcttggtttaatgttcgagataacagccaaagcctctatcatatttgtgaccctgcaatacaatgttaccctgccagcaaccgaggaacaggctactgagagcgtgtcactgtattactacgggatcaaggacctggctactgtgttcttctacatgctcgtggccatcattattcacgcagttatccaggagtatatgctagacaagattaacagaaggatgcatttttccaaaaccaaacactcgaagttcaacgagtctggtcagttgagtgccttctacttattcgcttgtgtttggggaacatttatcctgatctctgaaaattacatctccgacccgactattctgtggcgcgcctacccccataatcttatgaccttccagatgaagtttttttatatttcccaacttgcctattggttgcatgctttccccgaactgtacttccagaaaaccaagaaagaagatattcctcgacagttggtctatatcggcctttacctgttccatatcgcaggcgcatacctacttaatctgaaccacctgggtctcgtgcttttagtgctccactacttcgtcgagtttctgtttcacatttcaaggctcttctactttagcaatgagaagtaccaaaaaggattttctctgtgggccgtgttatttgttctcggccgactcttaaccttgatcctgagcgtcctgaccgtggggttcgggctggcccgcgccgaaaatcagaagctggatttctctacaggaaatttcaatgttttggccgtaagaatagccgtgctggcaagcatctgtgtgacccaggccttcatgatgtggaagtttatcaacttccagctgcggcgctggcgggagcacagcgcattccaggcgccagctgtgaagaaaaagcccacggttacaaagggtcggtcctccaagaaagggacagaaaacggtgtaaacggtaccctcacctccaacgtggcagacagccctaggaacaaaaaagaaaagtcctcttag

SEQ ID NO: 30955 - DNA, 1032 bp, Artificial Sequence
  Description of Artificial Sequence: Synthetic coding sequence
atggtctttctgcttggtctgatgtttgaaatcactgccaaagcttccatcatcttcgtgactcttcaatataatgtgactctcccagccacagaagaacaggccactgagtccgtctccttatactattatggcattaaagatttggcgacagtcttcttctacatgcttgtcgcaattataatccacgcggtgatccaagaatacatgctggataagataaacagacgtatgcattttagcaaaactaagcacagtaagtttaatgagtctggccaactgtcagctttttatctttttgcctgtgtgtggggtacgttcattctcatatccgagaactatatctctgacccaaccatactctggagagcgtatccacacaatctgatgacctttcagatgaagttcttttatatttcccagctggcatattggttacacgcattccccgagctgtattttcagaaaactaaaaaggaggatattccccgccaactggtctacatcggtctgtacctattccacatcgcgggcgcttacctgctgaacctcaatcacttaggcctggtccttctggtgctccactacttcgttgagtttcttttccatatctctcggctgttctacttcagtaatgagaaataccagaaaggtttctcactgtgggctgtgttatttgtgctggggcggctgctcaccctcatccttagcgtgctgacagtgggtttcgggcttgctagggccgagaaccagaagctagattttagtactgggaacttcaacgtgctggcggtgagaatcgcagttctcgctagcatctgcgtgacacaagcattcatgatgtggaaattcatcaactttcagctgcggcgatggcgtgaacattccgcctttcaagcacccgccgtcaagaagaaaccaacagtgactaaagggaggagttcgaagaaaggtacagaaaatggggtgaatggcactcttacgtccaatgtcgcagattcccctcggaataagaaggaaaagtcctcatag

SEQ ID NO: 30956 - DNA, 1110 bp, Artificial Sequence
  Description of Artificial Sequence: Synthetic coding sequence
atgggcctgcggaaaaaatcaaccaaaaatcctcccgtgctctcacaggaattcatccttcaaaatcatgcagacatcgtcagctgtgttggaatgttcttcctccttggacttgtcttcgaagggactgctgaagccagcattgtgttcctcaccctgcaacatagcgttgccgtgccagctgctgaagaacaggcaacgggctctaaatctctgtattactacggcgtgaaggatctggccactgtgttcttttacatgcttgtggccatcataatccacgccaccatccaggaatatgttctggacaaaataaacaagcgaatgcagtttactaaggctaagcagaataagttcaacgagtctggtcaattcagtgtattctactttttctcctgcatctggggtacctttattctcattagcgaaaactgcctgagtgacccaacgcttatctggaaagccagaccacatagtatgatgaccttccagatgaagttcttctatattagccagctcgcctactggtttcatgcctttccggagctgtactttcaaaaaacaaagaagcaagatattcctagacaactcgtttatatcggcctccatctgttccatattaccggtgcttatctgctctaccttaaccatttggggctgctgcttctcgtcctacattactttgtggagttgctttcacacatgtgtggacttttttatttctctgacgagaaatatcagaaaggcatcagcctgtgggcaattgtgtttattttgggtcgactggtgactctgatcgtctctgtattaactgtggggtttcacctcgcagggtcacagaatcgcaatcctgacgcactcaccgggaatgtgaacgtgcttgccgccaagatagctgtgctgagctcctcttgcactattcaggcctacgttacatggaacctgataaccctgtggctgcagagatgggtggaggattctaatatccaggcttcttgtatgaaaaagaagagatccagatctagcaaaaagcgaactgagaacggggtcggggtggagacatccaatagggtggactgcccaccaaagaggaaagagaaatccagctag

SEQ ID NO: 30957 - DNA, 1113 bp, Artificial Sequence
  Description of Artificial Sequence: Synthetic coding sequence
atggccttcaggcgacgtacaaagagctacccactgtttagccaggaattcgttatccacaatcatgctgatatcggattttgcctcgtcctatgtgtgctcattggcctgatgttcgaagtaaccgccaaaaccgcctttcttttcattttaccacaatataacatctcagtgcccaccgcagatagcgagactgtgcactaccactacggtccgaaagatctggtgactatcttattttatatttttattacaataatactccacgcggtagtgcaggaatatatcctggataaaatcagcaaaaggttgcatctgagcaaagttaaacattccaagtttaacgagtctggccagctggtagtcttccatttcacctccgtgatttggtgtttttacgtggttgtcaccgagggctatctgaccaatcctcggagtctgtgggaggattacccacacgtacaccttcctttccaagtaaagtttttttatctgtgccaactagcctactggcttcacgcgctgccagagctgtactttcaaaaggtacggaaggaggaaattccacggcagctgcagtacatctgtctgtacctagtgcacatagccggcgcctatctcctgaacctaagccgcttgggattgatacttttgttacttcaatactccaccgagttcctgtttcacactgctaggctgttctacttcgccgatgagaacaacgaaaagctgtttagtgcctgggctgctgtatttggagtgacacggttgttcatcctcacattagccgtactggccattggtttcggcctggccaggatggagaaccaggcgttcgatccagagaagggtaatttcaacactctcttctgtcgtctctgtgttctgctgctcgtatgcgccgcccaggcatggctaatgtggcgcttcattcactcccaactgcgccactggcgggaatactggaatgaacagtcagctaaacggagggtgcccgccacaccaaggctgcctgctcggctcattaagcgcgagagcggctaccatgagaacggagtggtcaaggctgaaaacggcacatcacctaggaccaaaaagttgaaaagcccatag

SEQ ID NO: 30958 - DNA, 513 bp, Artificial Sequence
  Description of Artificial Sequence: Synthetic coding sequence
atgcgactacagggtgctatcttcgttctgttacctcacttgggccccatccttgtgtggttatttacaagggatcacatgtcaggctggtgcgaagggccgagaatgctttcctggtgcccattctacaaggtgctgttgctggtccaaactgcgatttacagtgtggtgggctatgcgtcctacctagtttggaaagatctgggggggggcttaggatggcccctcgctctgcctcttgggctctatgctgttcagctgaccatttcttggacagttcttgtgctgtttttcacagttcacaaccctggactggccctgttgcacctgcttttgctctacgggctcgtggtctctacagctttgatttggcacccaatcaacaaactggctgccctgctgctgctaccttatctggcgtggctgacagtgacctcagccctcacctaccacttgtggcgggacagtctttgccctgtgcatcaaccgcaacctacagagaaatccgattag

SEQ ID NO: 30959 - DNA, 513 bp, Artificial Sequence
  Description of Artificial Sequence: Synthetic coding sequence
atgcggctgcagggggctatatttgtactactgccgcacctcggaccaatccttgtgtggctgttcactagagatcatatgagcggatggtgtgaaggtcctcgaatgctgtcttggtgtccattctacaaagttttactcctggtgcagacggctatttacagcgtggtgggctacgccagctatctggtctggaaagatctgggagggggacttggctggcccttggcgctgcctcttgggctgtacgccgtccagttaacaatctcatggaccgtgctggtactgttctttactgttcacaaccccggtcttgccctgctgcaccttctgctcctctacggactggttgtgtccaccgccttgatatggcatccaataaataagttagccgcgttgttgctgcttccatacttggcctggctcaccgtgacctctgctctcacctaccatctgtggagagattctctctgcccggtccaccagcctcagcccactgagaagagcgactag

SEQ ID NO: 30960 - DNA, 1047 bp, Artificial Sequence
  Description of Artificial Sequence: Synthetic coding sequence
atgagattgggtttgctttcagtggccctcctgtttgtcggaagtagtcacctctatagtgatcattattccccatcaggccgacaccgactgggcccttcccctgaacccgctgcatcctctcagcaagccgaggccgtgcggaaaaggctcagacggcgaagggagggcggagcacacgctgaggattgtggtactgcaccactgaaagatgtgctccagggttcacgcatcattggtggtaccgaggctcaagccggcgcctggccctgggttgtctccctccagatcaaatacggaagagtccttgtgcacgtgtgtggcggtacattggtaagggaacgctgggtgctgactgcggcccattgcacaaaggacgcaagtgatccgctcatgtggaccgctgttatcggtactaataatattcacggcaggtatccccataccaagaaaataaaaatcaaagctataatcattcacccaaacttcattcttgagtcgtatgtgaatgacatcgctctgtttcatcttaaaaaagccgtgaggtataacgattacatacagcctatttgtcttccctttgacgttttccagattctggatggtaataccaaatgcttcatctccggttggggcaggactaaagaagagggaaatgccaccaacatcctccaagacgctgaggtccattatatatcccgagagatgtgcaactctgagagatcttacgggggaatcattcctaatacttcattttgcgcgggagatgaagacggtgcctttgacacgtgtaggggcgactcaggtggacccttgatgtgttatctaccggaatataaaaggttcttcgtcatgggtatcacttcatacggccacggctgtgggaggcggggcttcccgggagtatacatagggccaagcttttatcagaagtggctcacagaacatttttttcacgcctcaactcaggggatattaacgataaacattctccgtggccaaatcttgatcgctctctgttttgtgatccttcttgccacaacttag

SEQ ID NO: 30961 - DNA, 606 bp, Artificial Sequence
  Description of Artificial Sequence: Synthetic coding sequence
atggggtctcggaagtgtggcggttgtctctcgtgcttactgattccactagccttatggtcaattattgtgaacatcctgctgtactttccaaacggccagacctcctacgccagctctaataagttgacaaattatgtctggtatttcgaaggcatatgcttctcagggatcatgatgctgatcgtaaccacagtgcttctcgttctagagaataacaacaactacaagtgctgtcagtctgaaaactgttctaagaagtacgtgactttgctctcaatcatattttcctctctcggcatcgcgttctcgggctactgcttggtcattagcgcccttggactggtgcaagggccttattgcaggacactggatgggtgggaatatgctttcgagggaactgcaggacgcttccttacagatagttccatctggattcaatgtctggagcctgctcatgtagttgaatggaatataatactattttccatccttattaccctgtccggcctgcaggttattatctgcctgatcagggtggtgatgcaactgtctaagatactgtgtggcagctactctgtcatcttccagcccggaataatttag

SEQ ID NO: 30962 - DNA, 606 bp, Artificial Sequence
  Description of Artificial Sequence: Synthetic coding sequence
atgggatctcgtaagtgtggagggtgcctctcctgcctcctgatcccgcttgccctttggtcgattatcgtcaacatactcctgtattttccaaacggccagaccagttatgcaagtagcaataagcttacaaattatgtgtggtactttgaaggcatctgcttttccggcatcatgatgctcattgttactaccgtgctgctggtgctggaaaacaataacaactataagtgttgtcagtcagaaaactgctccaagaagtacgtgacactcctttccataatctttagcagcctgggaatcgcatttagtggatattgtttggttatttccgccttggggttagttcaggggccctactgtaggacgttggacggatgggagtacgcttttgaggggaccgctggacggttcctgactgatagttcgatctggatccaatgcttggaaccagctcatgttgtcgagtggaacattatcctgttcagcattctgattaccttgtcaggcttgcaggtgataatttgcttaattcgtgtggtgatgcagctatctaagatcctctgcggcagttacagcgtgatcttccagccgggcatcatttag

SEQ ID NO: 30963 - DNA, 480 bp, Artificial Sequence
  Description of Artificial Sequence: Synthetic coding sequence
atgggtagcaggaaatgcggcggctgcttaagctgtctgctcatcccacttgcactgtggtccatcattgtcaatatcctgctctatttccccaatggtcaaaccagctacgccagctccaataagctgactaattatgtatggtatttcgaggggatatgtttctccggcattatgatgctgatcgtgactacagtgttactggtcctggagaataacaataactacaagtgctgtcagagcgaaaactgctcgaaaaagtacgtcactctcctttccattatctttagtagcctgggtatagcatttagtggatactgcctggtcatctccgccctgggactggtgcaggggccatactgtagaaccttggatgggtgggaatacgcctttgaaggaaccgccgggcgtttcctgactgatagttctatttggatccaatgcctagaacctgcacatgtagtagaatggaatatctag

SEQ ID NO: 30964 - DNA, 630 bp, Artificial Sequence
  Description of Artificial Sequence: Synthetic coding sequence
atggtgtcgtctccttgcactcaagcatcttcacgtacctgttcccgcatcctgggattatctctcggcaccgcggccctgttcgcggccggtgcaaatgtggctctcttactccccaattgggacgttacttatttgctacgggggctgttaggcaggcacgcaatgctaggcacagggctctggggcggtgggctgatggtgctcacggccgcaatcttgatctcccttatgggatggagatacggatgtttctcaaaatcggggctgtgtcgttctgtgctgacggctctactgagcggaggtttagcattgctaggggctctgatctgcttcgtgacttctggtgtggccttgaaggacgggccattctgtatgtttgacgtgtcttcgtttaaccagacacaagcttggaaatatggctacccattcaaggatctgcactctcgaaattatttgtatgatcgatccctgtggaattctgtgtgcctcgaacctagcgccgcagtggtttggcatgtctctcttttctctgctcttctgtgtatcagcctcttgcagcttcttctggtggtggtccacgtgattaacagcttattaggattgttctgctccctttgcgagaaatag

SEQ ID NO: 30965 - DNA, 630 bp, Artificial Sequence
  Description of Artificial Sequence: Synthetic coding sequence
atggtaagttctccttgcacacaggcctcttctcgtacatgcagccggattttaggcctctcattgggaacagctgcactattcgccgccggtgctaacgttgctcttctccttcccaattgggatgtgacttacctgctccgcggcttgttggggcggcacgctatgctgggaacaggtttatggggcgggggcctgatggttctcacagccgcgatcctgatcagtcttatggggtggaggtatggctgtttcagcaaatccgggttatgtcggagcgtgctgacagccctgctctcagggggcctggctttactgggcgcactgatctgttttgtgacctcaggagtggctctgaaagacggccctttctgcatgttcgacgtgtccagctttaaccagacccaagcttggaaatacgggtacccctttaaagatctacacagccggaattatttgtacgatcgctctctttggaactccgtgtgcctggagcccagtgcagcagttgtctggcatgtgtctttgttttcagccctgctatgcatctctctgctacaactactcctagtggtcgttcatgtgatcaacagcctgcttgggctgttttgctccctgtgcgagaaatag

SEQ ID NO: 30966 - DNA, 552 bp, Artificial Sequence
  Description of Artificial Sequence: Synthetic coding sequence
atggtctccagcccctgtacgcaggcttccagccggacatgcagccgcatcctgggtctgagcctgggaacagcagccctgtttgccgcaggggccaatgtcgctctcctcctccccaattgggatgtgacctatctgctgagagggctgctcggccgccatgctatgctgggtaccggcctctggggcggcggcctcatggtgctgacagcccttttgtcaggcggcctggcgttacttggcgctctgatatgcttcgtgactagcggcgtcgccttaaaagatggccctttttgcatgttcgatgtgtcttctttcaaccagacgcaggcatggaagtacgggtatcctttcaaggatcttcacagccgcaactacttatatgatcggtctctctggaattctgtttgtttagagccgagcgcggccgtagtatggcacgtgtcactcttctccgcgctgttgtgcatttctctactccaactgctgttggttgtcgtgcatgtgataaattcgctcctgggattgttttgctctctgtgcgaaaagtag

SEQ ID NO: 30967 - DNA, 690 bp, Artificial Sequence
  Description of Artificial Sequence: Synthetic coding sequence
atgacatgctgcgaaggctggacatcctgtaacgggttttcgctattggttctactgctactaggcgtggtcttgaatgcgattccactgattgtgtctcttgtggaggaagaccagttttcccagaatccaatcagctgcttcgagtggtggttcccaggaataattggcgccggtcttatggcaattcctgccaccaccatgagcctaacggcaagaaaacgcgcatgctgtaataaccgcaccggaatgttcttgagttctcttttctcagtgataacagtaatcggggctttgtattgtatgcttatcagcatccaggcgctcctgaaaggacctctgatgtgcaattccccaagcaacagtaatgcaaattgtgaattttcccttaaaaatatctctgacattcatcccgagtcctttaatctccagtggtttttcaacgactcgtgcgcacctccaacagggtttaacaaacccacctccaacgacaccatggcgtcaggatggagagcatcttcgttccactttgacagcgaggagaataagcacagactgatccacttctctgtgttcctcggcctgttgttggtgggaatcctcgaagtcctcttcggcctgagccagatcgtcatcgggttcctaggctgcttgtgcggagtatccaaacgacgcagccaaatcgtgtag

SEQ ID NO: 30968 - DNA, 45 bp, Artificial Sequence
  Description of Artificial Sequence: Synthetic coding sequence
atgacctgctgtgagggctggacgagttgcaacgggttcagttag

SEQ ID NO: 30969 - DNA, 1821 bp, Artificial Sequence
  Description of Artificial Sequence: Synthetic coding sequence
atgacagtggtgggaaacccccgttcttggtcttgccagtggctgcctattttaatacttcttcttggcactgggcatggacctggcgtagagggagtgacacactataaggctggggaccctgtgattctctatgtaaacaaagtagggccttatcataatccccaggagacctaccattactatcagcttcctgtgtgctgtccggaaaagatccggcataagtccctttccctcggagaagttcttgacggggatcgcatggctgaatccctgtacgaaattagatttagggagaacgtagaaaagcggatcttgtgtcacatgcagctctcaagtgctcaagtggagcagctgagacaggcaatcgaagagctgtattacttcgagtttgtggtggatgatcttcctatccgcggctttgtgggctacatggaggagagtgggtttttaccccatagtcacaaaattggactctggacccatttggattttcatttggaattccatggagacaggatcattttcgctaacgtgagtgtgagagacgtgaaaccccactcactggacgggctcaggcctgacgaatttctgggtctcactcacacatacagtgtgagatggagcgagacgagtgtcgagagacgcagcgacagaaggcggggggacgatggcgggtttttcccaagaactctggaaatccactggctgtccatcattaattcaatggttctggtcttcttactggtcggatttgtcgcagttatcttgatgcgcgtgttgcggaatgacttggcacgttataacctggacgaggagaccactagtgcaggaagtggtgatgacttcgatcagggtgataacggctggaaaatcatccacaccgacgtattccgctttcctccttaccgtggcctactgtgcgcagtgctgggagtgggggcccagttcctggcgctgggcaccgggatcatagtcatggcactcctcggcatgttcaacgtgcatagacacggtgctatcaactccgctgccatcttgctttatgcactaacctgttgcatctccgggtacgtgtcttctcacttctacaggcagataggcggggagagatgggtttggaacattattctcactacgtccctgttctcagtgcctttttttctgacatggtcggtggtgaatagtgtgcactgggctaatggctcgactcaggcactgcctgccacgacgatcctcctgctgctgactgtgtggctcctggttggattccccctgactgttatcggggggattttcggaaagaataatgcatctcccttcgatgccccatgcaggacaaagaacatcgcgcgggaaatccccccgcagccctggtataaatctactgtcatccatatgacagtcggcggctttttgccattctctgcaattagtgtggaactttactatattttcgccacagtctggggccgggaacagtacactctgtatggtatcctcttctttgtttttgcaatcttgctatcagtgggtgcttgcatctcaatcgcgctaacctacttccagctgagcggggaggattaccggtggtggtggcgtagcgtgttgtccgtcggctccaccggactgttcattttcttatatagcgtcttctattatgcgagacggagtaatatgtccggcgcggttcaaactgttgagttctttggatactcactgttaactggatacgtgttcttcctcatgctgggtacgatctcctttttctctagcctaaaattcatccgatatatatatgttaatcttaagatggattag

SEQ ID NO: 30970 - DNA, 1470 bp, Artificial Sequence
  Description of Artificial Sequence: Synthetic coding sequence
atgaccgtagtaggaaacccacggagttggagctgtcagtggctacccatccttatcttgctcctcggtaccggccacgggcctggggtggaaggcgtcacccattataaggctggagatcccgttatactgtacgtcaacaaggtgggcccataccacaacccgcaggagacctatcattattatcagctacccgtttgctgccctgaaaagatacgccataaaagtctgtccctgggtgaggtgctggacggggataggatggcagaatctctgtatgaaatccggttcagagagaatgttgagaagaggattctgtgccacatgcagctgtcatcagcccaggtcgagcagctgcgccaggccatcgaagagctctattactttgaatttgtggtggatgatctccccattagaggattcgttgggtatatggaggaatccggcttcctgcctcacagccacaagatcggcttgtggactcatctggatttccacctagaattccatggggatcgtatcatattcgctaacgtgtctgttcgagatgtcaagccccattcattggacggactgcgtccagacgaattcctggggctgacccatacatatagcgttcggtggtccgaaacgtcagtcgagcgacgttcagatcggcgacggggtgatgatggcggcttttttccccggacgttggaaattcactggttaagcattattaattccatggtgctcgtgtttctgctagtgggatttgtcgccgtgatcctaatgagagtcctgcgtaatgacctcgctcgctacaacctcgatgaagaaaccactagcgcagggtccggagacgattttgaccagggagacaatgggtggaagattatccatactgacgtcttccgatttccgccttaccgcggcctgctctgcgccgtgctgggcgtaggcgcacagtttctggccctcgggacgggaatcatcgtgatggctctccttgggatgtttaatgtgcacaggcacggcgcaatcaatagcgccgcgatcttgctgtacgccctcacatgttgtattagcgggtacgtttctagtcacttttaccggcagattggtggcgaacgctgggtatggaacataattcttacaacatccctcttctctgtgcctttcttcctgacgtggagcgtggtcaatagcgtccactgggctaatggatcaacccaagcgctgcccgccacgactatccttctgctgctgactgtttggctgctggtcggcttccctttgacagtcatcggggggatcttcggcaaaaacaacgctagtcctttcgatgcgccatgccgcaccaaaaacatcgccagggagatcccgccgcagccttggtataaatccacagtgattcatatgacagtcggcggattccttccattccgctatccgccgtttattccatggctgctactgagcggttcttag

SEQ ID NO: 30971 - DNA, 729 bp, Artificial Sequence
  Description of Artificial Sequence: Synthetic coding sequence
atgaccgtcgtcggcaatcctcggtcatggtcatgccaatggctgcccatactgatactcctcctgggtaccgggcatggacctggcgttgagggagttacccattacaaagcaggtgacccggttatcctctatgtcaataaagtcggtccttatcataaccctcaggagacatatcactactatcagctgcccgtgtgttgccctgagaagattcgtcacaaaagtctgagcctcggcgaggtcctcgacggagatcgcatggcagaatccctgtacgaaattcgcttccgggaaaatgttgagaaacggatactatgccacatgcagctaagcagcgcgcaagtggaacaactgcgccaggctatcgaagaactctactattttgaattcgttgtcgacgacttacccattagaggtttcgtgggatatatggaagagagcggcttcctgccccactcacacaagatcgggctctggacacatctcgatttccaccttgagttccacggggatcggataatttttgccaatgtctcagtccgggacgttaagccacacagcctggatgggttgaggcccgatgagttcctgggattgacacacacttattcagtccgctggagtgagaccagcgtggagaggaggtcagatcggaggcgcggagatgacggggggttcttccctagaacactggaaattcattggctgagcattatcaactcgtag

SEQ ID NO: 30972 - DNA, 633 bp, Artificial Sequence
  Description of Artificial Sequence: Synthetic coding sequence
atgacagtcgtgggaaatccacgatcatggagctgtcagtggttgccgattctgatcctgctgttgggtactggccacggccccggtgtggagggtgtcacacactataaggccggcgaccctgttatcctgtacgtcaataaggtgggcccttaccacaacccccaagagacgtaccactattatcaactcccagtgtgttgtccagagaagatacgtcataaatccctgtccttgggcgaggtcctggacggggatagaatggcagaatctctgtacgagattcgctttcgggaaaacgtggaaaagaggatactttgccatatgcagctttctagcgcccaggttgagcagttacgccaagccatcgaggagctgtactatttcgagtttgtcgtcgatgacctccccattagaggttttgtcggctacatggaagagagcggctttctgccgcactcacacaaaatcgggctgtggactcacctggacttccatctggagttccacggggatcgcatcatatttgcgaacgtatccgtgagggatgtaaagccccattctctcgacggactgcgacccgacgagttcctcggactgacccacacctactccgttcgctggagcgagtag

SEQ ID NO: 30973 - DNA, 906 bp, Artificial Sequence
  Description of Artificial Sequence: Synthetic coding sequence
atgacggtggtaggcaatccaaggtcttggagttgtcagtggctgcctatcctcatcctgctcctcggaaccggccatggcccaggagtagaaggcgtgacccactacaaagcaggtgatcccgtgatactctatgtaaacaaggtcggcccctaccataatccacaggaaacatatcattactaccaattgcctgtctgttgtccggagaagattcgacacaagtctctgtccctcggtgaagtgctcgatggggacaggatggctgagtcactgtacgaaataaggttccgggaaaatgttgaaaagcgcatcctgtgccacatgcagctatcaagtgcccaggtggagcagctgcgccaagccatagaagagctatactacttcgagtttgttgtggacgacttgcctattcgggggttcgttggctacatggaggagtccgggtttctcccacattcccacaagatcggcctgtggacccacctagacttccacctcgagttccacggggatagaataatattcgccaacgtcagcgtgagggacgtgaagccacacagcctggacggcctcagacccgacgaatttctcgggctcacccatacatactcagtaaggtggtccgaaacaagcgtcgagcgacggagcgataggcgccgcggtgacgacggaggttttttcccccggactctcgagattcattggctgtccatcattaattctatggtgctggtctttctcttggtgggatttgtggccgtgatactgatgagggtgttgcgtaacgatctggcaagatataacctggatgaggagaccaccagcgcaggtagcggagacgactttgaccagggagataacggatggaagattatccacacggatgtcttccggttcccctag

SEQ ID NO: 30974 - DNA, 774 bp, Artificial Sequence
  Description of Artificial Sequence: Synthetic coding sequence
atgaccgtcgtgggtaatccgcgtagctggtcctgtcagtggctgccaattctcatcctccttctgggcactggccatggcccaggagtggaaggtgttacacattacaaagctggcgatccagtaattttgtatgtgaacaaagttggcccataccacaatccgcaggagacctatcactattaccaacttccagtatgctgccctgaaaagatccggcacaaatctctctccctgggcgaggtgctggacggagacagaatggctgagtctctgtacgaaattagatttcgagaaaacgtcgaaaagcgaatcctttgccacatgcagctcagtagtgcacaggtggagcagctgcgccaggcgattgaagaactttactatttcgagttcgttgttgatgatctgcccatcaggggcttcgttgggtatatggaagaatccggttttttgccacactcccataaaattggtctatggacacacttggattttcatctggaatttcacggcgataggattatttttgctaatgtgtctgtccgtgatgtcaagccacattcgctcgatggtcttcgacccgacgagtttctggggcttacacacacatatagcgtaaggtggtccgaaacttctgttgaacggagaagcgataggcggaggggggacgacggcggtttcttcccgcgaacacttgaaatacattggctgagtattattaactcaatggttctggtattcttactcgtaggttttgtggcagtgatcctctag

SEQ ID NO: 30975 - DNA, 2448 bp, Artificial Sequence
  Description of Artificial Sequence: Synthetic coding sequence
atgtcgggactagggcgactgtttggcaagggcaagaaagaaaagggaccaaccccagaagaggccattcaaaagttgaaggagactgagaagatactcatcaagaaacaggagtttctggaacaaaagattcagcaagagttgcaaaccgcaaagaagtatggtaccaagaataaacgcgctgcactgcaagccctccgaaggaagaagagattcgaacagcagctggctcaaaccgacggcacgctgtcaactctggagtttcagcgggaagcaatagaaaacgctacgaccaacgcggaggtcctcagaacaatggagttagccgcccagtcaatgaagaaagcataccaggacatggacatagataaggttgacgaacttatgaccgatattaccgaacagcaggaggtggcacagcagatctcagacgctatctcccgcccaatgggatttggtgacgatgtagacgaggacgaactgcttgaagaactggaagaacttgagcaagaagagctggcacaggagctgctgaacgtgggcgacaaagaggaggagccctctgtgaagttgccgtcagtgccttctacacacttgcctgcaggtcctggctccacagcgctgcggatgaccgtagtcggcaacccccgcagctggagttgccaatggctcccaatattgatcctgctgttaggaaccggccatggcccgggtgtggaaggggtgactcactataaagctggggatccggtcatcctgtatgttaataaagtgggaccctaccataacccgcaggagacctatcattactatcaactaccagtatgttgcccagagaaaattaggcataagagcctgtcactgggggaagtgttggatggggaccgtatggccgaatcactttacgaaattcggttccgcgaaaacgtcgaaaagcggattctttgtcacatgcaactgtccagcgcccaagtggaacagcttcgtcaagccatcgaagaactgtattactttgaatttgttgtggacgatctgcctatcaggggttttgttggatacatggaggagtctggtttccttcctcatagtcataagatcggcctgtggactcatcttgacttccacctagagtttcacggcgatagaattatcttcgccaatgtatcagttagggacgtgaagccgcacagtctcgacggactcaggccggatgagttcttgggacttacacacacttattccgtgcgctggtctgagactagcgtggaacgccgaagtgaccgcagacgaggagatgatggaggattctttcctaggacactcgaaatccattggctttccattataaatagcatggtactcgtctttctgttagtggggttcgtcgcggtgattctcatgcgggtcctgaggaacgacttagcccgttacaacctcgatgaagagaccacctcagccgggtctggcgatgacttcgaccagggtgacaacgggtggaaaatcatccacacagacgtctttaggtttccaccgtacagaggactactgtgtgccgtgctcggagtgggcgcccagtttctggccctgggtaccggcatcatcgttatggcgttactggggatgttcaacgttcacaggcacggcgctataaattcagccgcgatacttttgtacgccctgacttgctgcatttccggttatgtgtcctcccacttttaccgacagataggtggcgagagatgggtctggaatatcatcctaacaacttctctgttttccgtgcctttctttttgacctggtcagtggttaattctgttcactgggctaatgggagtacacaggcactgcctgctaccacaattcttcttttactcaccgtgtggctacttgtgggtttccctctaacggttataggcggcattttcgggaaaaataacgcctcaccttttgacgcaccttgtcggacgaagaacattgcgagagaaatacctccacagccatggtacaagagcactgtaatccatatgaccgtgggaggtttcctcccttttagtgccatttcagtggagctctactacatcttcgcgacagtgtggggaagggagcagtatactctctatggaatattgttctttgtgttcgccattctgctgagcgtaggcgcgtgcatcagcatcgccctgacttacttccagctgagcggggaggactatcgatggtggtggagatctgttttatctgttgggtcaaccgggctgtttatctttctgtattcagtgttctactatgccagaagatcaaacatgtccggggctgtccagactgtagaatttttcggctattccttactcactggctacgtgttcttcttaatgctcgggactattagcttttttagttctctaaagtttatcaggtacatttatgtcaatttgaagatggactag

SEQ ID NO: 30976 - DNA, 2448 bp, Artificial Sequence
  Description of Artificial Sequence: Synthetic coding sequence
atgtctggcctaggaaggctgttcggaaagggaaagaaggaaaaaggaccaacccccgaggaagctattcaaaagctgaaggagaccgaaaagatcctgattaaaaagcaggaattcctcgagcagaagattcagcaggagctacagactgccaagaaatatggtacaaagaataaacgcgccgccctgcaagcccttagaaggaagaaaagattcgagcagcagttggctcaaaccgatggtaccctgagcacactcgaattccagcgggaagccattgaaaacgccactactaacgcggaagtcctgaggaccatggagttagccgcacagagcatgaagaaagcttatcaggacatggacatcgataaagtggatgaattaatgaccgatattactgaacaacaggaagtggctcagcagattagtgacgccatctcccgacctatgggctttggagacgacgtagacgaggacgagttgttagaggagctggaagagttggaacaggaggaactggcccaagaactactcaacgtgggtgacaaagaggaagagccgagcgtgaagctcccctccgtgccctctacccacttgccagccggccctggctccaccgcgctgcgcatgactgtcgtgggcaatcctcggtcttggtcatgtcagtggctgcccatcctaattctccttctcggaacaggccatggccctggcgtggaaggggtgactcactataaggctggagatcctgtgatcctgtatgtgaacaaggtgggcccttatcataacccccaggagacctatcactactaccaactaccagtgtgttgcccagagaagattcgacacaagtccctcagcctgggagaggtgttagatggcgataggatggccgagtccctctatgaaattcgattccgcgaaaatgtggaaaaacgcatcctctgtcatatgcagctgtctagcgcccaggttgaacaactgagacaggccatcgaggagttgtattattttgagtttgtcgttgatgacctgcccattcgtggatttgtcggatatatggaagaaagcggctttttgccccattcccacaaaataggcttgtggacccacttggactttcatctggaattccacggcgataggatcatttttgcgaatgtgtcagtgcgagatgttaagcctcatagcctggacggactgcgacctgatgagttcctgggcctgacacatacatactcagttaggtggagtgagaccagcgtcgaacggaggagcgacaggcggagaggtgacgatgggggttttttcccacggaccttggagatccactggctgtcaattatcaatagtatggtgctggtctttctgctagttggattcgtggctgtgattctcatgcgggtgctccgtaatgatctggctcgctataacctagacgaagagactacgagcgccggtagtggagacgacttcgaccaaggcgacaatgggtggaaaattatccacacggatgtattccgattcccaccttacaggggcctgctttgcgccgtcctgggggttggcgctcaatttctggctctggggactggaataatcgttatggcgctgctggggatgttcaatgtgcaccggcatggtgccatcaacagtgccgccattttgctgtacgcactcacctgttgcatcagcgggtacgtgtcctcacacttttaccgtcaaattgggggtgagcggtgggtttggaatataatcctcaccacttccctgttcagtgtgccattcttcttaacatggagcgtcgtaaactccgtccactgggctaatggctctacgcaggcactccctgcgaccaccattctcctactgctcacagtgtggctgcttgtgggattccccttgacagtgatagggggcatatttggcaaaaataacgcatccccctttgatgctccatgtcgtaccaagaatatagcacgagagatccccccccagccgtggtacaaatccaccgtgattcacatgacggtggggggtttcttacccttttctgcaatctctgtggagctgtactatatctttgccacagtatggggccgagagcaatacacactgtatggcatccttttcttcgtgttcgccattttgctgtccgtgggagcctgtatctccatcgcgcttacgtactttcaactaagtggtgaagattataggtggtggtggaggtcagtgttgtcagtgggctctactggcctgtttatcttcttatattcagtgttttattatgctagaagaagtaacatgtcaggagccgtgcagactgtcgaattttttgggtattccttgctgactggttacgtcttcttcctgatgcttggcacgatctcattcttctcgtctctgaagtttatccgctatatctatgtgaacctgaagatggattag

SEQ ID NO: 30977 - DNA, 1992 bp, Artificial Sequence
  Description of Artificial Sequence: Synthetic coding sequence
atgagtgccagactgccagtgttatccccaccccgctggccgcggctgctgctgttgagcctgctgttgctgggtgctgtccccggaccacggcgttccggagcattttacttaccagggctggctcctgtgaatttttgcgacgaggagaagaagagtgacgagtgtaaggcagaaatcgagttgttcgtcaaccggctagacagcgtggagtcagtccttccatacgagtacactgcctttgacttttgccaggcctcggagggcaagagacctagtgagaatctgggccaagtcctgttcggagaacgaattgaaccttcaccgtataaattcacgttcaataaaaaggaaacatgtaagctagtctgcacaaaaacataccacaccgagaaagctgaggacaagcaaaaactggagtttctgaaaaaaagcatgctgctgaactaccagcaccattggattgtcgataacatgccagttacctggtgttacgacgtagaggatgggcagagattttgtaatcctggttttcctattggctgctacatcactgacaaagggcatgccaaggacgcatgtgtgatctcctcagatttccacgagcgcgatacgttttacatcttcaaccatgtcgacattaagatttactaccacgtggtggagacgggttccatgggcgcaagattagtggcagctaagctggaacctaagagtttcaagcatacccatattgacaagcccgactgttcaggcccccccatggacatctctaacaaggcctcaggggaaatcaaaatcgcgtacacatacagtgtctccttcgaggaggacgataaaatccggtgggcttccaggtgggattacatattggagtccatgccgcatacccacatacagtggttttcaatcatgaacagcttggtgattgtcctctttctcagtggcatggtggcgatgattatgctgcgtacacttcataaggatattgctcggtacaatcagatggactcaactgaggacgcccaggaggaattcggctggaagttggttcatggcgatatttttcggccgccccgcaaaggcatgctgttatccgttttcctgggttccggtacccaaatacttataatgacgttcgtgactctctttttcgcctgtctcggctttctgtcccccgcaaacaggggggcactcatgacatgtgccgtagtgctgtgggttcttttgggaacgcccgccgggtatgtggcggcgcgcttttataagtccttcggcggagaaaagtggaagacgaatgtgcttctcacatctttcttgtgcccagggatcgttttcgctgacttttttatcatgaatcttattttgtggggagaaggcagttctgccgccatcccctttggcacactggtcgctatccttgctctgtggttctgcatttcagtacctctgacttttatcggtgcctatttcgggttcaagaagaatgctatcgagcaccccgtgagaacgaaccaaataccccgccagatcccagagcagtcattttacactaaaccactccccgggattattatgggagggattttgccattcggatgcatatttatccagctgttttttatcttgaactcgatctggagtcatcaaatgtactacatgttcggatttctgttcctggttttcataattctggtgataacgtgcagtgaggctaccatcctactctgctattttcacctttgtgccgaagactaccactggcagtggcggagtttcctgacctccggcttcaccgctgtttattttctgatttatgcagtgcactatttcttctcaaaattacaaataaccggtacagcttctacgatcctgtacttcggctatactatgataatggttttgatcttctttctgttcacgggtactattggtttttttgcatgtttctggttcgtgacaaaaatctatagtgtggttaaggttgattag

SEQ ID NO: 30978 - DNA, 1770 bp, Artificial Sequence
  Description of Artificial Sequence: Synthetic coding sequence
atgcgcccgctccccggcgccttaggagtcgccgccgcagctgcactgtggctgttattgttgctgctgccccgaactcgagcagatgagcatgagcacacataccaggacaaagaggaggttgtcctttggatgaatacagtgggcccatatcacaaccgacaggaaacttacaaatatttctccctgccgttttgtgtaggcagcaagaaatccataagccattatcacgaaaccctgggtgaagctctccagggagtggaactggagtttagcggactcgacatcaaattcaaagacgatgtcatgcccgccacctattgtgagattgacctggacaaagagaagcgcgatgccttcgtctacgctatcaaaaaccactactggtatcaaatgtacattgatgacttaccaatctggggaatagttggagaagcagacgagaacggtgaagactactacctctggacttacaagaagctcgaaattgggtttaatggtaacagaattgtggacgttaaccttacaagcgaggggaaggtcaaactcgtgcctaacacaaaaatccagatgtcttactccgtcaagtggaagaaaagcgatgttaagttcgaggacaggttcgataaatacctggatcctagcttctttcagcacagaatccactggttctccatctttaactccttcatgatggtgatctttctggtcggtctcgtgtccatgattctgatgaggacactgcgaaaagactacgcccgctacagcaaggaagaggaaatggatgacatggaccgggacctcggcgatgagtatgggtggaaacaggtgcacggggacgtctttaggcccagtagtcacccactcatattctcaagcttgatagggagcggatgccaaattttcgcggtcagtttaattgttataatcgttgccatgattgaagacctgtacactgaacgtgggagcatgttaagtacggccatcttcgtgtacgccgctacatcaccagtcaacgggtacttcggcggaagcctgtacgcgcgtcaggggggcagaaggtggataaagcagatgtttatcggcgccttcctaattcccgccatggtgtgcggcactgccttcttcatcaatttcattgctatctactaccatgccagtcgcgctattcctttcgggactatggtggctgtgtgctgtatctgtttctttgtgatcctgccactgaacctagtgggtaccattctcggaaggaatctcagcggtcagcccaatttcccttgtagggtaaacgcggtgccccggccaattcctgagaagaagtggttcatggaacccgccgtcattgtttgcctggggggcatccttccttttggcagcatttttatagagatgtattttatctttacaagcttctgggcttacaaaatctactatgtctacggcttcatgatgctggtcttagttattctgtgtatcgtgacagtgtgcgtcacaatcgtatgtacctactttcttctgaacgccgaagactaccgctggcaatggacatccttccttagtgccgcctctaccgcaatctatgtgtacatgtactctttttattactatttttttaaaacaaagatgtatgggcttttccagacctctttctatttcgggtatatggctgtgtttagcaccgcccttggaattatgtgcggagccattggatatatgggtaccagtgccttcgtgaggaagatttatacaaatgtcaagatagactag

SEQ ID NO: 30979 - DNA, 765 bp, Artificial Sequence
  Description of Artificial Sequence: Synthetic coding sequence
atgaacacagtgggaccttaccataatcgtcaggaaacctacaagtatttttccctgccattctgtgttggctcaaagaagtcaatctcacattatcacgagactctgggcgaggcactacaaggagtggagctcgagttctcaggtttggacattaagtttaaggacgacgtgatgccggcgacctactgtgaaattgatctcgataaggaaaaaagagatgctttcgtgtacgccattaaaaaccattactggtatcagatgtacattgacgacctgccgatctgggggatagttggcgaggccgatgagaatggagaagattactatctatggacctataaaaagcttgagatcggcttcaacgggaacagaatcgtcgatgtgaatttgaccagcgaaggaaaggtgaagcttgtccccaacacgaaaatccaaatgagctattccgttaagtggaagaaaagcgacgtgaagtttgaagataggttcgacaagtatctggatccaagtttctttcagcaccggatccactggtttagcatttttaactcctttatgatggttatattcctggtcggactcgtgagcatgatcctgatgaggaccttaagaaaggattatgcccggtatagcaaggaggaagaaatggacgacatggacagggatcttggcgatgagtacgggtggaaacaggtgcatggcgatgtgttccgaccctcttcacatcccctgatcttctcatcacttatcggttccggttag

SEQ ID NO: 30980 - DNA, 765 bp, Artificial Sequence
  Description of Artificial Sequence: Synthetic coding sequence
atggcctggcagggtctagtactggccgcctgccttctgatgtttcccagcacaactgcagattgcctctctagatgtagtttatgcgctgtaaagacacaggatggacccaaaccaattaaccccctgatttgctccctgcagtgtcaggccgcgttgctccccagcgaggagtgggagcggtgtcagtcttttttatccttttttactccaagcacccttggccttaacgacaaggaagatcttggcagtaagtccgttggcgaggggccttacagcgaacttgctaaactatccggaagcttcttgaaagaactggagaaaagcaagtttttgccatccataagtacaaaagaaaacacactgtccaagagtcttgaggagaaacttaggggactgagtgatggattccgcgagggagccgaaagtgagcttatgcgggacgcacaactgaacgatggtgctatggagaccggaactctgtatctagccgaagaggaccccaaagaacaggtcaagcgctatggtggtttcctcagaaaataccctaaaagatcttcagaggttgcaggcgaaggagacggggattctatgggccacgaagacctgtacaaaagatacgggggctttctcagacgtatccgcccaaagcttaagtgggacaaccagaaacgctacggcggatttcttcgacgacagttcaaggtggtgaccaggtcccaagaggaccccaacgcctacagcggtgagctttttgatgcttag

SEQ ID NO: 30981 - DNA, 1929 bp, Artificial Sequence
  Description of Artificial Sequence: Synthetic coding sequence
atggcaaccgccatggactggttaccttggtcactgctgctctttagtctcatgtgcgagacctctgcattttacgtgcctggtgtggcccccatcaatttccaccagaatgatcctgtggagattaaagccgtgaaattaacatcttctcggactcagctgccgtacgagtattattcactgcctttttgccagccttctaaaataacctacaaggcagagaatttgggggaggtgctgcgcggcgaccgcatcgtcaacaccccttttcaggtactgatgaactccgaaaagaaatgtgaggtgttgtgtagtcagagtaacaagccagtcaccctcaccgtggaacagtccaggctggtcgccgagaggattaccgaagattactacgtgcatttgatagcagataaccttcccgtggccacccggctggaactctactccaatagagatagcgacgacaaaaaaaaggaaaaagatgtgcagttcgagcatggataccgcctaggattcaccgacgttaacaaaatctatctgcataatcaccttagcttcatcctctattaccatcgggaagacatggaggaggaccaggagcatacatacagagtcgtgcgttttgaagttattccgcaatccattaggctggaggatctgaaagccgacgaaaaatcgagctgtacgctccccgaaggtaccaactcttccccccaagaaattgacccaactaaggaaaaccagctgtacttcacttactccgtgcattgggaggagtctgatataaaatgggcgagccgatgggatacatacctaacaatgagtgacgttcagattcattggttctctatcatcaatagtgtggtggtcgttttcttcctgagcgggattttatccatgattattatccggaccctacgcaaggatatcgcaaattacaacaaggaggatgatattgaagacaccatggaagaatcaggatggaagttggttcatggggatgtgttccgccccccccagtaccccatgattttatccagcttgctgggatctggaatccaattattctgcatgatcctgatcgtgatttttgtggcaatgttgggcatgctgtcaccctcttccaggggagctcttatgaccactgcttgcttccttttcatgttcatgggcgtgtttggcggcttctcagctggcaggttatatagaaccctaaaaggacacagatggaagaaaggagctttttgcacagcgaccctataccccggcgtggtattcggaatatgtttcgtgctcaattgttttatctggggaaaacattctagtggagccgttcccttccctaccatggttgccctgctgtgcatgtggttcgggatttcattgcctttggtctaccttggatattacttcgggtttaggaaacagccgtacgacaatccagtccgaactaatcagattcctaggcagatacccgagcagagatggtacatgaatagattcgtgggaatactgatggcgggcattctgccttttggcgctatgtttattgaactcttttttattttctccgcgatatgggagaaccagttttattatctctttggctttctgttcctggtgttcataatactggttgtatcatgcagccagatatctatagttatggtgtattttcagctctgcgcagaagactatcggtggtggtggcggaatttcctggtatctggagggtccgcattttacgtgctagtgtatgctatattttatttcgtcaataaactggatatcgtggagtttatcccgagtctcctgtactttggttatacagccctgatggtactgtcattctggctgcttaccggcacaatcggcttttacgcggcgtacatgttcgtccggaaaatttatgccgccgtgaagatcgactag

SEQ ID NO: 30982 - DNA, 735 bp, Artificial Sequence
  Description of Artificial Sequence: Synthetic coding sequence
atggcccagatgttcctggagcctctggccgataagttcatttactgtcaggtcttgatgaactccgagaaaaagtgcgaggtgctgtgttcccagagtaacaaaccagtgacacttactgtagaacagtcccgtctggttgccgagcgcataacggaggactactacgtgcatctgattgccgataacctgccagttgccaccagactggagctgtacagcaacagagacagtgatgataaaaaaaaggagaaggacgtccagttcgaacacggctacaggcttggatttaccgatgttaacaagatctatctgcacaatcacctgtcgtttatcctgtactaccaccgggaggatatggaagaagatcaggagcacacataccgggttgttaggttcgaggtgattccccagtcaatccgtctcgaagacctgaaagcagacgagaagtcatcctgcactctgcctgagggcactaatagcagtccccaagagattgacccgaccaaggagaaccagttatatttcacgtactccgttcactgggaggaaagtgacatcaagtgggcttcacgctgggatacttacctaacgatgtctgatgttcaaatacattggttctccatcattaattcagtggttgtggtcttttttctgtcggggattctgagtatgattatcattagaactctgcggaaggacatcgcaaattataacaaagaggatgacatctag

SEQ ID NO: 30983 - DNA, 1425 bp, Artificial Sequence
  Description of Artificial Sequence: Synthetic coding sequence
atggtacaacgattttctttgaggcgacaattaagcaaaatcgaacggcttgaggtgtccagcttggctcagacaagctcggcagttgcatcgtccacagacggttccatacatacagattcagttgatggaacccctgaccctcagcgtacaaaggctgcgatcgctcacttgcagcaaaagattctcaagttgaccgagcagatcaagatcgcacaaacggctcgagacgataatgtcgcggaatatctgaagttggctaactcagcggacaagcagcaggctgcacggattaaacaggtcttcgaaaagaagaatcagaagagcgcccagaccatcctgcagctgcaaaagaagctcgaacattatcacagaaagcttcgagaggtggagcaaaatggtattccccgacagcctaaggatgtttttagagatatgcaccagggtttgaaggatgtcggggccaaggttacagggttttccgagggtgtggtggattcagtcaaggggggattctctagtttcagccaggctacccatagtgctgctggggccgtcgtcagcaaacctagggaaatcgctagccttattaggaacaaatttggcagcgctgacaatattcctaacttaaaggactcactcgaagaaggacaggtcgacgacgctgggaaagcgcttggagttatctcaaacttccaatcctcacccaaatacggaagtgaggaagattgctcctccgcaacaagcggaagcgtgggggccaattcaactaccggagggatagcggtcggagcatcctcctccaagaccaatacgctggacatgcagtcctccggttttgacgcactccttcatgaaatccaggagatacgggagacccaagcaaggctggaagagagttttgaaactctaaaggagcattaccaacgagactattccttgatcatgcaaaccctgcaagaggagaggtatagatgtgaacggcttgaggagcaactcaatgatctgactgagctccaccaaaacgagatcctaaacctcaagcaggagctggcttcaatggaagaaaagatcgcctatcagtcatacgaacgggcccgggacattcaggaggcactggaggcctgtcagacacggattagcaagatggaactacagcagcagcagcagcaggtggtgcaactggaggggctagaaaacgcaacagccagaaatctgctaggaaagctcatcaacatcttgctggccgtgatggctgttttattagtcttcgtctccaccgtggccaattgtgttgtacccctcatgaagactcgaaatagaacgttttccactttatttctggtcgtatttattgcattcttgtggaagcattgggacgcgctgttttcttacgtagagagatttttctctagcccccggtag

SEQ ID NO: 30984 - DNA, 1962 bp, Artificial Sequence
  Description of Artificial Sequence: Synthetic coding sequence
atggagcccagtggcagcgagcagctcttcgaggaccccgatccgggcgggaagtcccaagacgccgaagcccgaaagcaaactgagagtgagcagaagttgagcaagatgacccataatgcgctagaaaacattaacgttataggacagggcctgaaacacctcttccaacaccaacgcagaaggtcaagcgtgagccctcacgatgtccagcagatacaggcagatcccgaaccagagatggacctcgaatctcagaatgcctgcgcagagattgacggtgtccccactcaccctactgctcttaatcgggtcctccagcagatcagagtgccccccaagatgaaacgcggcacatcattgcatagccggcgaggaaaacctgaggcacccaagggttcccctcagataaaccgcaagtctggccaggaaatgacagcagtcatgcaatctggccgcccgagatcatccagcactacagatgccccaacatctagcgcaatgatggagatcgcttgcgctgcagccgccgcagcagctgcatgcctgccaggcgaggaaggcactgcagaaaggatcgaacggctcgaggtgtcctctctggcccagaccagcagtgctgtggcaagctctactgatggaagcatccacaccgattccgtcgacggcacacccgacccccaaaggacgaaagctgccatcgcccacctccagcagaagatcctaaaactgactgagcagattaagattgcgcagactgctagggacgacaacgtggctgaatacctgaagttggcaaacagcgccgataaacagcaggcggccagaattaagcaagtattcgaaaaaaaaaatcagaaatctgcacaaactattctgcagcttcagaagaaactcgaacattaccatcggaagctaagggaagtggagcagaacggcattccgaggcagccaaaagacgtattcagagatatgcaccagggcctgaaggatgtgggcgccaaagtcaccggcttcagcgagggagtggtggatagtgtgaagggagggttttcatctttttctcaggctacccatagtgcagcaggcgctgtcgtgtcaaagcctcgcgagatagccagtctcatcaggaacaagttcggatccgccgataatattccaaacctgaaggattcgcttgaagagggtcaggttgacgacgccggaaaggcgttgggagtgattagcaattttcagtctagccctaagtacggctcggaagaggactgctcgagtgccaccagcggatcggtgggtgctaacagcactactggagggattgctgtgggtgcaagttccagcaagacaaatacgctggacatgcagagcagtggctttgacgccctgttacatgagattcaggagattcgagagactcaggcgcgtctcgaggaatcctttgaaactctgaaggagcactatcagcgggattacagtttaataatgcagaccttgcaggaagagcgatacaggtgtgaacggctcgaggagcagctgaacgaccttaccgaattacaccaaaatgagatactgaacctgaagcaggaactcgcttctatggaggagaaaatagcctaccagagctacgagagagccagggacatccaggaggctctggaggcttgccagacccggatttccaagatggaactacaacagcagcagcagcaggtcgtacagcttgagggtctggaaaatgcgaccgcacgaaatctcttgggtaagctcataaatatcctgctagctgtgatggcggtgctactcgtctttgtttctaccgtggccaactgtgtagtaccactgatgaaaactaggaacaggacattctctaccctgttcctggtggtatttatagcattcctatggaagcattgggatgccttattcagctacgtcgagaggttcttctcctctccacgttag

SEQ ID NO: 30985 - DNA, 1620 bp, Artificial Sequence
  Description of Artificial Sequence: Synthetic coding sequence
atgaaacgaggtacatccctccacagtcgaagggggaagcccgaagctccaaagggaagcccccagattaaccgcaaatctgggcaggagatgactgcagtgatgcaaagcggacgcccacggtcatccagtactactgatgctcccaccagctcggccatgatggaaattgcatgcgcggctgccgccgctgccgcagcatgcttgcccggtgaggaaggcacagccgaaaggatagagcgtttagaggtaagcagtttagcccaaacgtctagcgccgtggcttcaagcaccgacggatcgatccacacagattccgtggacggaactccggatccccagagaacaaaagctgctattgcgcacctccagcagaagattttaaaactcacagaacagatcaagattgcacaaacggccagagatgataatgtggccgagtacctgaaactggcgaattccgctgataagcagcaggctgctcggattaagcaggtctttgagaagaagaatcagaagtccgcacaaacaattctgcagttgcagaaaaagctcgagcattatcaccgcaaattgagagaggtggaacagaatggcattcctcgacagccaaaagatgtcttcagggacatgcatcagggtttaaaggacgtgggcgcaaaagtgaccggattctccgagggggttgttgactctgtgaagggtggcttcagtagcttttcacaagccactcatagcgccgccggagcagtcgtgagtaagcccagagagattgcatcgctgatccggaacaagttcggttctgcagataatataccgaaccttaaggactccctcgaagaaggtcaggtggatgacgctggcaaggcattaggagtgatttccaacttccagagttctcccaagtatggatccgaagaagactgctcttcagccacctctggttctgtgggagcaaacagcactaccggagggattgctgttggggcttcatcatccaagactaacacgcttgatatgcagagtagtggtttcgacgccttgctgcacgagattcaggaaataagagaaacacaggcccgcctggaggagagctttgagacccttaaggagcactaccaaagggattactccttgataatgcagaccctccaggaggaacggtacagatgtgagaggcttgaggagcagttgaacgatttaactgagctgcaccagaatgaaatactgaacctgaaacaggaactggcaagcatggaagagaaaatcgcatatcagagctacgagcgcgcccgcgacatccaagaggcgctggaagcctgtcagacacggatctccaagatggagctccagcagcagcagcaacaggttgtacagcttgagggattggagaatgcgacagcccgaaacctattggggaaactgatcaatatccttttagccgtgatggccgtcctgttagtctttgtgtccacagtagctaactgcgtggttcccttgatgaagacaaggaacagaactttttctacattattcctggtggtgtttatagcttttctctggaaacactgggacgcgctgtttagttacgttgagcggttcttcagttcgccgcggtag

SEQ ID NO: 30986 - DNA, 990 bp, Artificial Sequence
  Description of Artificial Sequence: Synthetic coding sequence
atgcatcaggggctaaaggacgttggagcaaaggtgacggggttctccgagggagtggtggactctgtcaagggcgggtttagtagtttttctcaggccacacactccgcagcaggtgcggtggtgagcaaaccaagggagattgcctcccttattcgcaacaagttcggatcagctgataacattccaaatcttaaggattcattagaagaagggcaggtcgatgatgctgggaaggcccttggcgtaatttccaactttcagagctctccaaagtacggaagcgaagaggactgcagctcagctaccagtggttcagttggcgccaatagtactactgggggcatcgcggtgggagccagtagcagtaagacaaatacacttgacatgcagtccagtgggtttgacgcactgcttcatgagatccaggaaatcagagagactcaggcacgcctggaggagagtttcgaaactctaaaagaacactatcagcgagactactccctgattatgcaaacactgcaggaggagaggtataggtgtgaaagactggaagagcagctgaatgacttaaccgaactgcaccagaacgaaattttaaatctgaaacaagaattggcgagtatggaggagaaaattgcctatcagagttatgaacgggcgagagatatccaggaggccctggaggcgtgtcagaccagaatatcgaaaatggaactgcaacagcagcagcagcaggtggtccagctcgaaggcttagagaacgcaaccgcccggaatctcttagggaagctcattaacatattgctagcggtcatggctgtacttctggtatttgtgtccactgttgccaactgcgtagtgccactgatgaagacacgaaaccgcacattctctacactgtttcttgtcgtcttcattgctttcctatggaagcattgggacgcccttttctcctatgtggagcgcttctttagcagcccaaggtag

SEQ ID NO: 30987 - DNA, 1410 bp, Artificial Sequence
  Description of Artificial Sequence: Synthetic coding sequence
atgaagtcaaaagaggaggagacagctgtggataaaggggatctagtagctctatccctacccgcaggtcacggagatactgatggccccatcagcttggacgtgcccgatggcgctccggacccccagcggaccaaagctgcaatagatcatctccaccagaagattttgaagatcacagagcaaataaagattgagcaggaagcccgcgatgataacgtggctgaatatttgaaactggcgaacaacgccgataaacaacaggtgtcaaggatcaaacaggtgtttgaaaagaagaaccagaaatccgcacaaacaattgcacagctgcacaaaaagctcgagcactacagacggagactcaaggagatcgagcagaacggtccatccagacagccgaaggatgtgctgcgcgacatgcagcagggcctcaaggatgtcggcgctaacgtacgcgccggcatttccggattcggcggaggggtagtcgagggggttaaaggtagcctcagcggcctgtcacaagccactcatacggccgtagtgtccaagccaagagagttcgcctcacttatccgtaataagtttggatccgccgataacatagctcacctcaaagatccacttgaggacggtccaccagaggaggctgcccgggctctgtccgggtccgcaaccctggtcagctcccccaagtacggtagcgacgatgagtgcagctctgctagtgcttcttcagcaggagcaggttcaaattcaggcgctggccccgggggcgcacttggtagccccaagagcaacgccctgtacggagctcccggcaatctggatgctttgttggaggagcttcgagagatcaaggaaggccagtctcacctggaggatagtatggaggatctgaaaacacaactgcagcgggattacacatacatgacccagtgtcttcaggaggagaggtacagatatgaacgcttagaagaacagttaaacgacctcaccgagctccaccagaatgagatgacaaatctgaagcaagagttggcaagtatggaagagaaggttgcttatcagagttacgaaagggccagagacatacaagaggccgtggaatcttgtctgacaagggtcaccaagttggaactgcagcagcaacagcaacaggtcgtgcagctggaaggggtcgagaacgctaacgccagagcactattgggcaagttcatcaatgtcatccttgccctaatggccgtgttactggtgttcgtctccaccatcgcaaacttcattaccccgcttatgaagacacggctgagaatcacctctaccacattgctcgtactggtcctctttctgctgtggaagcactgggatagcctcacttatctgctcgaacacgtcctcctgcctagttag

SEQ ID NO: 30988 - DNA, 1455 bp, Artificial Sequence
  Description of Artificial Sequence: Synthetic coding sequence
atgaatcaggtggtgcagcctttaatgtccaggcactctgcttgtcgcggcagtcaagctcatctcagttgggtggataaaggagatctcgtggccctgtctcttccagccgggcacggtgacacagacggcccaataagcctggacgtccccgacggagcccccgacccgcaaagaactaaggctgctattgaccatctccaccagaagatacttaagatcacagagcagatcaaaatcgagcaggaggcacgggacgacaatgttgcggaatacctgaagctggccaacaacgcggacaaacagcaggtgagccgtatcaaacaggtgtttgaaaaaaagaaccagaagtcggctcagacaattgctcagctccataagaagctcgagcactaccggaggaggctcaaagagattgagcaaaacgggcctagtcggcagcctaaagatgttctccgcgatatgcagcaggggctcaaagatgtgggtgccaatgtccgggcaggaatttcgggcttcggtggaggagtcgtagagggagtgaaaggctctctaagtggattatcccaggccacccacacagctgttgtctctaaacctagagaattcgcatcactcataagaaataagttcggttctgctgacaatatcgcccacctgaaggacccgcttgaagatgggccacccgaagaagcggcccgagccctgagtgggtccgccaccctggtatcatccccaaaatacggtagtgatgacgagtgcagtagcgcctccgccagctcagccggagcaggttcaaacagcggggccggaccaggtggcgccctcggatccccaaaaagtaatgccctgtacggcgctccaggcaacctggatgcactgctcgaagaactccgggagattaaagaaggacagagccaccttgaagactccatggaggatctcaaaacccagctgcaaagagactacacatacatgactcaatgcctccaggaggaacgttatcgatacgagaggcttgaggagcagctcaacgatttaaccgagctccatcagaatgaaatgacaaatctcaaacaggagctggctagtatggaagagaaggtggcgtaccagtcttatgaacgggctagagatatacaggaagccgtcgaatcctgccttacccgcgtgaccaaactcgagcttcagcaacagcagcagcaggtggtacagctggaaggcgtcgaaaatgcaaatgcacgggcactgctggggaaatttatcaacgttattctggctcttatggccgtgttacttgttttcgtgagcacaatagctaatttcatcactccgctgatgaagacccggctgcggatcacctctacaacactcttggttctcgtgctctttctgctgtggaaacactgggactctctcacctacttactcgagcacgtcttacttccaagctag

SEQ ID NO: 30989 - DNA, 2130 bp, Artificial Sequence
  Description of Artificial Sequence: Synthetic coding sequence
atgaagagatgtaggtcagatgagctccagcagcagcaaggggaggaggacggagcagggcttgaggacgccgcaagtcacctgccaggagccgacctgcgtcctggagagacaactggggctaactccgcaggaggcccgacatctgacgcaggggcggctgctgcccccaaccccggccctaggtccaaacccccggaccttaaaaaaatccagcagctgtctgaaggaagtatgtttggacacggcctaaagcatctgttccatagcaggcgcaggagtagagaaagggaacatcagacctcacaggacagtcaacaacaccagcaacagcaggggatgagcgatcacgactcccccgacgaaaaggaacggagccctgaaatgcatcgggtatcttatgccatgtcattacacgacctgcctgctaggcccactgctttcaatcgtgttctccagcagataaggtcccgccccagtatcaagaggggcgcttctctgcactcctcctcaggcggcggaagctccggttctagctcccgtagaaccaaaagcagcagcctggagccccagcggggatctccccacctgctgagaaaagcaccccaagattcttccctcgctgccatcctgcaccagcaccagtgcagaccccgttcttcctcaacgaccgacaccgctctgctgttggccgatggatctaacgtctacctactggctgaggaagctgaagggattggggacaaggtcgacaaaggcgacttggttgctctgtctctgcccgctggtcacggggatactgatgggcctattagcctggacgtgcccgatggggcccctgatccgcagcgaaccaaagcagccatcgatcatctccaccaaaagatacttaagattactgaacagattaaaattgagcaggaagcccgggacgataacgtagcagaatatcttaaacttgcgaacaacgctgataagcagcaagtttcccgaattaagcaggttttcgaaaagaagaaccagaagagcgctcagaccattgcgcagctgcataagaagcttgagcattatcggcgccgattaaaagagattgaacagaatggcccatcaaggcagcctaaggacgtcctcagagacatgcagcagggtctcaaggatgttggtgctaacgtgcgcgccgggatttctggttttggcggcggcgtcgtggagggagtgaagggatccctgagcggtctaagtcaagccacccacactgcagtcgtgagcaagcctcgggaatttgcgagtctaatccggaataagtttggctcagctgataatatagcacacctgaaggatccgctggaagacggacctccagaagaagctgcccgcgcattgagcgggtccgctacgctggtgagctcaccaaagtacggcagtgatgacgaatgcagcagtgcctccgcgagttcagccggagcaggcagcaattcgggcgctggccctggaggagcgcttgggtccccaaaatccaacgctttatacggcgctcccggaaacctggatgctctcctcgaggagctgagagagattaaggagggccagtctcacctcgaagattcgatggaggacctgaagacacaattgcagagagactatacctatatgacccagtgcctgcaggaggaacgctacaggtatgagcgcctcgaagagcaactcaacgatttaacagagctgcatcagaacgaaatgactaacctgaaacaggaattggcgagcatggaggagaaggtggcttaccaatcttacgaacgcgcacgagacattcaggaggccgtcgaatcatgtttaactagagtgaccaagctggagctgcagcaacagcagcagcaggtggtgcagctggaaggtgtcgagaacgccaacgcccgtgctttactggggaaatttatcaatgtcatcctggcactcatggcggtcctgctggtattcgtctctacaattgctaacttcataacacctctaatgaagaccaggctgcgcatcacttcaaccactctcctggtcctggtgttattcctcctatggaaacattgggactcccttacttacttgctggagcacgtccttctgccttcatag

SEQ ID NO: 30990 - DNA, 771 bp, Artificial Sequence
  Description of Artificial Sequence: Synthetic coding sequence
atgaaccaggttgtgcagcccctgatgagtcggcactcagcttgcaggggaagccaggcacacctgagttggttgtggacgagcgtacctctgtgctggcctctgacggagtttcccgctggcacagtaaagatgaagagtaaggaggaagagacagccgttgataaaggcgatctggtggctttgtctctcccggccggacatggcgatactgatggacctatttccctggacgtgcccgacggcgctccagatccgcaaaggactaaggctgcgatagatcatctgcatcagaaaatcttgaagattacagaacagatcaagatagaacaggaagccagggatgataacgtggccgagtatcttaaactcgctaataacgccgacaaacagcaggtgtctcgaataaaacaggttttcgagaaaaaaaatcaaaaatctgcgcagaccatcgcacagttacacaagaaacttgagcactatcgacggcgcctgaaggaaattgagcaaaatggaccctcacggcagccgaaggatgtgctgagggacatgcagcagggactgaaagatgtgggcgctaatgtccgggccggcatcagtgggtttgggggtggggtagtggagggagtgaaaggttctttgagcggcctgtcacaggcaactcatactgcagtcgtcagtaagccccgggagtttgctagcttgatacgcaacaaatttggaagcgctgacaacatcgcacacctcaaagacccactcgaggacggatag

SEQ ID NO: 30991 - DNA, 1896 bp, Artificial Sequence
  Description of Artificial Sequence: Synthetic coding sequence
atgttcggacacggcttaaaacacctgttccatagccgaaggcgctcccgcgaaagggaacaccagacttcccaagatagccaacagcatcagcaacagcaaggtatgtctgatcacgatagtcccgatgagaaggagaggtcgcctgagatgcatagagttagctacgcaatgtcactgcacgacctgccagccagacccacggcatttaatcgagttctccaacaaatacgatcccgcccttctatcaagagaggagcctccttacactcctcaagcggcggcgggtcctctggatctagctcaaggcggactaaaagctcatctctcgaacctcagcgcggctctccacacctactgagaaaggccccacaggactcctcactcgccgctatcctgcaccagcaccagtgcagaccgaggtccagttctaccactgacaccgccctgttgttggctgatggtagcaatgtgtatcttctggccgaggaagccgaaggaattggggataaggttgataagggcgacttggtagccttgagtctcccggctgggcacggcgacaccgatggccccattagcctcgatgtccccgacggagcccccgaccctcaacggacaaaagccgctatcgaccatctgcaccagaaaatcctcaaaatcactgaacaaatcaaaatcgaacaggaggcccgcgatgacaacgtagccgaatacctgaaattggcgaacaacgcagataagcagcaagtgagtcgaatcaagcaagtctttgagaagaaaaatcagaaaagcgcccagactatcgcccagctgcataaaaaacttgagcactaccgccgtcgtctgaaagaaattgagcagaatgggcctagccgccagcccaaagacgttctgcgggatatgcagcagggcttaaaggatgtgggcgcaaatgtgagagccgggatcagtggattcggggggggagtcgtcgagggagtgaaagggtctcttagcggactctctcaagctacacataccgcagtggtgtccaagccacgcgagtttgcctcattgattcggaacaaattcggctcagctgacaacatagcgcatctgaaagatccactggaagatgggcctcccgaagaggcggcacgggccctgagtggtagcgcgacgttagttagttcacctaagtatggttctgatgacgagtgttcctctgcatccgcttccagtgctggagctggttccaattcaggtgcgggacctggcggcgcattgggcagccccaagtccaacgctctgtacggggcccctggaaacctcgacgccctgctggaggagcttcgcgagataaaggagggacagtcacacctggaggacagcatggaggaccttaaaacacaactccaaagggactacacctatatgacccagtgcttacaggaggaaagatatagatacgaaagacttgaagagcaattgaacgacttaactgaattgcatcagaacgagatgactaacctgaagcaagaacttgcctctatggaggaaaaggttgcctaccagtcatatgagagagctcgtgacattcaggaggcggttgaaagttgcctgactagggtgactaagctggagctgcaacagcaacaacagcaggtcgtccaattagagggggtggaaaacgccaatgcccgggcgctgctgggaaagtttataaatgttattctggctctgatggccgtgctgctggtgtttgtttctaccattgcaaattttatcaccccattaatgaaaactcggctgcgaatcacttcaacgacactgcttgttctggtgctgtttctcctatggaagcattgggatagtctcacgtacctgctggagcacgtactgctcccttcatag

SEQ ID NO: 30992 - DNA, 1434 bp, Artificial Sequence
  Description of Artificial Sequence: Synthetic coding sequence
atgcccggtagcgatacagcgctgaccgtggaccggacatatagctacccaggtcggcaccaccgatgtaagagtcgcgtggagcgccatgatatgaataccttatccctccctctgaatattcggcgtgggggtagtgacacaaatttgaactttgacgtgccagatggaattctggattttcataaggtaaagttaacagccgattccctgaaacagaagatcctgaaggtgaccgaacaaataaaaatcgagcaaacgagcagggacggaaacgtggcagaataccttaagttagtgaacaacgctgataaacagcaagccggccgaattaagcaggtttttgaaaagaagaaccagaaatccgcccactctatagcacagctgcagaagaaactcgagcaataccacagaaaattgagggaaatcgagcagaatggcgcttcaagaagcagcaaggatatctcaaaggaccacctgaaagatattcatcgttcgctcaaagacgcccatgtgaaatccagaacagcgccccattgtatggagagctcgaaaagcgggatgcctggcgttagcttgacccccccagtctttgttttcaataagagtagagagtttgcgaacctgataagaaataagttcggaagcgctgataacatcgcccatctgaagaactctctagaagaattccgacccgaggcctcagcaagggcttatggggggtccgcaacgatcgtaaataagcccaaatacggctcagacgatgaatgcagctcaggcacgtccggtagtgctgactccaacggaaaccagtccttcggcgctggaggggcaagcaccctggattctcagggtaagctggcagttatacttgaagagctgagggaaattaaggacacccaggctcagctagccgaagatatagaggctttaaaagttcagttcaagagggagtatggattcatctcccagacgttgcaagaagaaagatataggtacgaaagattggaagatcagctgcatgatctcacagatctgcaccagcatgaaactgcgaatctcaagcaagaactggccagcatcgaggagaaggtggcgtaccaagcatatgagcgaagccgcgatatccaagaggcgctcgaatcttgccagaccagaatcagtaaactcgagctgcaccagcaggagcagcaagccctacagactgatactgtgaacgccaaggtccttttaggaaggtgtatcaatgtcatcctcgcttttatgaccgtgatcttggtgtgcgtcagcacaattgcaaagttcgtgtctccaatgatgaaaagccgctgtcacatactcggcacatttttcgccgtgacattgctggccatcttctgcaaaaactgggatcatattctctgcgcaatcgaacggatgatcatcccaaggtag

SEQ ID NO: 30993 - DNA, 549 bp, Artificial Sequence
  Description of Artificial Sequence: Synthetic coding sequence
atgagcacctcaagttccagttcgtgggacaatctgctcgaaagcctgtctctgtccacagtctggaattggattcaggcttcttttcttggagaaacaagcgcaccccaacagacctccctgggcctgctggataaccttgctcccgctgtccagattatacttagaatttcatttctcatcttgctaggcatcggtatttacgccctttggaagcggtccatacaaagtattcaaaagactctcctcttcgtaattaccctctataaactgtataaaaagggctcacatatctttgaagccctgcttgcaaacccggaaggcagtggcctgcggatccaggacaacaacaacctctttctgtccctgggactgcaggaaaaaatattgaaaaaactgaagaccgtggagaataagatgaaaaatttggaggggatcatcgtcgcccagaagcctgccaccaagagggattgttctagcgagccatattgtagctgcagtgattgtcagtcccccctgtcaactagcggctttacctccccaatctag

SEQ ID NO: 30994 - DNA, 2034 bp, Artificial Sequence
  Description of Artificial Sequence: Synthetic coding sequence
atgaaggtgctgggtcgctcttttttctgggtgttgtttccagtgctgccatgggccgtccaggcggtggaacacgaagaggtggcccagagagtcattaagctccacagaggccgaggggtcgctgcaatgcaatcacgacagtgggtccgggacagctgcaggaagttgagcggactgctcagacagaagaacgctgtgcttaataaactaaaaaccgctatcggggctgtggagaaggacgtcggactgtccgacgaagaaaaactctttcaggttcatacattcgaaatcttccagaaggagctaaacgaatctgagaacagtgtgttccaggccgtctacgggcttcaacgagctttacaaggagactacaaggatgttgttaatatgaaagaatcttcccgccagcgcctagaagcgctacgcgaggctgccatcaaggaggaaactgagtatatggagttactggcagccgaaaaacatcaagtagaagcccttaagaacatgcagcaccagaaccagagtctgtccatgttggacgagatcctcgaggatgtgcggaaagccgccgatcgcctcgaggaagagattgaagagcatgcctttgacgacaataaatccgtgaaaggtgtcaacttcgaagcggtactgagggtggaggaggaagaagccaactctaaacagaacatcactaaacgggaagttgaagatgatctgggcttatcgatgctgatcgatagccagaacaatcagtacatactaacaaaaccgagagactccaccatacccagagccgaccaccacttcataaaggatatagtcactataggaatgctgtctttaccatgtgggtggctgtgcacggctataggcctaccaaccatgtttggatatatcatttgtggcgtcctactgggaccctccggactgaatagtataaagtctatcgtgcaagtcgagacgctgggtgagttcggagttttttttaccctattcttagtggggttagagttcagtcctgagaaactgagaaaggtttggaagatatctctgcagggcccgtgctatatgactttgctgatgatagccttcggactgctatggggacacttgcttcgcatcaagcccacacagtccgtgttcattagcacatgcctttccctgagctcaactcctttggtaagtcggttccttatggggtccgcccgcggcgacaaagagggcgatatcgactattccaccgtgctgctggggatgttggtgacacaggatgttcagctgggtctttttatggcggtcatgccaactctcatacaggcaggggcatcagcctcctcctccattgtagtggaagtcctgaggattttggtgctcatcggccaaatcctatttagcctggccgctgtgttcctgctatgcctggtcattaaaaagtaccttatcggcccatactacagaaaactgcacatggagtccaaaggaaacaaggagatcctgatactgggcatctctgcctttatctttctaatgctgacggtgacggagctgcttgacgtcagcatggaattgggctgctttctcgcaggcgccctggtgagcagccaggggccagtcgtgacagaagaaattgccactagcatcgaacccatccgcgatttcctcgctatcgtcttcttcgcttcaatcgggctgcacgtttttccgacgttcgtcgcctatgaactgaccgtgcttgtttttttaaccctgagtgtagtggtcatgaaattcctcctcgcagcactcgtgctctcgctgattctgccccggtcatctcagtacattaaatggatcgttagcgctggccttgcacaggtcagcgagtttagttttgtcttaggatcacgagccagacgggccggggtgataagtagagaagtgtatctgcttatcctcagcgtgactaccctgagcctgttgcttgcccccgtgctttggcgggccgccattacaaggtgcgtgcctaggcctgagcggaggagcagtctttag

SEQ ID NO: 30995 - DNA, 1905 bp, Artificial Sequence
  Description of Artificial Sequence: Synthetic coding sequence
atggccatgtggaatcggccatgccaaaggctgccacagcaacccctggtggcagaaccaacagctgaaggagagccacatctgcccacaggtcgggagctcacagaggctaaccgctttgcttacgctgccctgtgcggtatctctctgtcccagctgttccctgagcccgagcatagttccttttgtacagaatttatggcaggactggtccagtggctggagttgagtgaggcagtcctaccgaccatgacggctttcgcaagcggcttgggcggagagggggccgacgtgtttgttcagatcctattgaaggatcccatattaaaggacgatcccaccgttatcactcaagacctgctgagctttagtctgaaggacgggcattacgacgcccgtgctagagtcttggtgtgccacatgacaagtttactgcaggtacctctggaggaactcgacgtcctggaggagatgtttctcgaaagtcttaaagagatcaaagaagaggagagcgagatggcggaagcctctagaaaaaagaaggaaaatcgccgcaagtggaagaggtatctgctgataggccttgccactgttgggggaggaaccgttatcggcgttaccggtggcctggcagcccccctggttgccgctggcgcagccactatcataggttcagccggagcagccgccctgggttccgccgctggtatagcgattatgactagcctcttcggcgccgcaggagccggcctgactggctataaaatgaagaaacgtgtcggtgctatcgaggaattcacctttctgcccctgacggaagggagacagctgcacatcactattgccgtcacgggctggctcgcctctggaaaatatagaacgttcagtgctccatgggcagccctggcccacagtagggagcagtactgcctggcttgggaagccaagtatctaatggaactgggcaatgctctggaaacaatccttagcggtctggctaacatggtggcacaggaagctctaaagtatacagtcctgagcgggattgtggctgcactaacttggccggcttccctcctgtccgttgcgaacgttattgacaacccctggggagtctgcctgcatagaagtgctgaggtggggaaacacctcgcccatatactcttgtcaaggcagcagggacggaggcctgtgaccctcattgggtttagtctcggagccagggtcatttacttctgtctccaggaaatggctcaagagaaagactgccagggcattatcgaagatgtcatcttgctcggagcgcccgtagagggtgaggccaagcactgggagccatttcgaaaagtcgtgagtggaagaatcataaatggctactgccgaggggactggctgctgagttttgtctacaggacctcctctgtgcaactgagggtggcgggtcttcagccagttcttttgcaggaccgccgggtggagaatgttgatctgacttccgtcgtctctggacatctagactacgccaaacaaatggacgccatactgaaggcagtaggtatcagaactaaaccaggctgggacgaaaagggtcttctactggcacctgggtgcttgccttccgaagagccacggcaggcagccgccgctgcgagctccggtgaaaccccacaccaggtaggccaaacacagggccccatttccggggatacgtctaaacttgccatgagcaccgacccatcacaagcacaggtgcccgtaggtttggaccagagcgagggtgcatcactcccagctgccgcaagtcctgaacgccctccaatttgctcccacgggatggatcccaacccactagggtgtccagactgcgcttgtaaaacgcagggccctagcacaggcctggactag

SEQ ID NO: 30996 - DNA, 1785 bp, Artificial Sequence
  Description of Artificial Sequence: Synthetic coding sequence
atggctatgtggaatcgcccctgccaacgcctgccccagcagcccctggtcgccgagcctaccgctgaaggcgagccacacctgccaacaggcagggagctgactgaggctaacagatttgcatacgcggccttgtgcggcatttctttgtcacagcttttccccgagccagaacatagttctttctgcaccgagttcatggccggactcgttcagtggctggagctgtctgaagctgtgctaccaacaatgacggcctttgcaagcggccttggaggagaaggcgcggacgttttcgtccagatactcctcaaagacccgatcttaaaagacgatcccactgttatcacacaagatctgctgagcttcagccttaaagacggtcactacgacgcacgggccagagttctcgtgtgccacatgacttctctgcttcaggtgccgctggaagagttggatgtgttagaggaaatgttcctagaatccttaaaggagataaaagaggaagagagtgaaatggccgaggccagtcgcaagaagaaagaaaacagaaggaaatggaagcgctacctcctgattggactcgccacggttggaggaggcactgtgatcggggtcaccggaggccttgcagcccccctggtggccgcgggggccgccaccatcatcggaagtgccggggcagctgccctaggctctgcggccggcatcgccattatgacgtcactctttggtgcggccggtgccggactgaccggcactttttctgcaccttgggcagctttggctcatagccgggagcaatactgccttgcttgggaagctaaatacctgatggaactggggaatgcactggagacgattttgagcgggcttgctaacatggtcgcacaagaagccctgaaatacactgtccttagtggaattgtggccgctttaacctggcctgctagtttgctgtctgtcgccaacgtaattgacaatccttggggggtgtgcttacatagatcggccgaagtgggcaaacatctggcacacatcctgttgtccaggcaacagggtagacggcctgtcacgctgattggattctccttgggagccagagtcatctacttctgtctgcaggagatggctcaggagaaagactgtcagggaataatagaggacgtaatcctgcttggggctccagtagagggagaggccaaacactgggagccatttcgtaaagtagtgtcggggcggatcattaatggctattgtcgcggggactggcttctgagcttcgtatatcgtacgtcctccgttcagctccgggtggctggtcttcagcccgtattactgcaggaccgccgagtcgaaaacgtggacctgacaagcgtggtctccggccacctggattatgccaaacaaatggacgccattctgaaagctgtggggattagaaccaagcccggctgggacgaaaaaggattgcttctggcacccggctgcttgccttccgaggaaccaagacaggctgcagccgcagcatccagcggggagaccccacaccaggtgggtcagacccagggtccgatcagtggggatactagcaagctggccatgtcaacagacccatcccaggcacaggtgcctgttggactggatcagagcgaaggcgcctctctccctgccgcagctagtccggagcgccctcccatctgttctcatggaatggacccgaatcccctgggctgccccgattgcgcttgtaagacgcagggtccttctaccggcctcgactag

SEQ ID NO: 30997 - DNA, 1743 bp, Artificial Sequence
  Description of Artificial Sequence: Synthetic coding sequence
atggctatgtggaacagaccctgccagcgcctccctcagcagccgctggttgccgagccaaccgccgaaggcgagcctcacctacccacggggcgagagctgactgaggccaacaggtttgcttacgcagcattatgcggaatttcactgtcacaactttttcccgaacctgagcacagctcattctgtacagagtttatggccggtctagtccagtggttggagttgtcagaagcggttctgcctactatgaccgccttcgccagtggactggggggggaaggggccgacgtcttcgtgcagatcctgttgaaggaccctattctcaaggacgaccccacggtcattactcaagacctgctcagcttttcactcaaggatggacactatgacgcccgggcccgcgtattggtttgccacatgacatcccttttgcaggtgcccttggaagaattggacgtgttggaggagatgttcctggaatcattaaaggagatcaaggaggaggaatccgaaatggcggaagcgtcgcgcaaaaagaaagaaaaccgacgcaaatggaaacgctatttgctgataggtttagcgaccgtgggggggggtacagtaattggggtgacgggtgggttggcagcccctctggtagcagccggcgccgctaccattataggctccgccggggctgcagcactgggatccgccgcaggaattgccattatgacctccttgttcggggcagccggggcaggcctgacaggatacaagatgaagaagcgggtgggggctatcgaagagttcacgtttctcccgctcaccgagggcaggcaattacacattacgatcgctgtcacaggttggcttgcaagcggcaagtaccgtacattctctgccccatgggctgctcttgctcactcccgtgagcagtactgcttggcatgggaagccaagtacctgatggagctggggaacgctctggaaacgatactgagcgggctcgccaacatggtggcccaagaagctctaaagtatactgtactgtcaggaatcgtcgctgcgctgacatggcctgcctctctcctctccgtggcgaacgttatagataatccatggggggtgtgcctgcaccgcagtgccgaagtaggaaaacacctggcgcacattttgctcagccgccagcagggtcgacgcccagtcaccttaatcgggttttccctgggtgcccgggtcatctacttctgtctacaggagatggcccaggaaaaggactgccaaggaatcatcgaggatgttatactccttggagctccagtagaaggggaagcgaagcattgggagcccttcaggaaggtggtatctgggcgcatcattaacggctactgccgcggggactggcttctctcattcgtctaccgaacttccagcgtccagcttagagtggctggactccagcccgtcctactccaggaccgcagagtggagaatgtcgatcttaccagcgtcgtttccggccatctggactacgctaagcaaatggatgcgatcttaaaggcagtgggcatacgcacaaaaccaggatgggatgaaaaaggactcctgcttgctcctgggtgcttgccctccgaggagccaagacaggctgcagccgccgccagctcagctctggagtccggatgcccctctgggggacctgaggggtccctcgggcccgaggcccccaccccggccctgccttggcctcaatag

SEQ ID NO: 30998 - DNA, 867 bp, Artificial Sequence
  Description of Artificial Sequence: Synthetic coding sequence
atggagatttcccgactggcacagtcaaagagaaacattatcagcctcaacatggatctcgaaagagacacccagagaattgatgaggcaaaccaaaaactactgctgaaaatccaggagagggaagataagattcagagactcgaatctgagattatccagacccgggggctcgttgaagacgaggaatgggagaaggagaaccggacaacaatggagcgggagcgggcgctccaggagttagaagaggaaacagcccgcctagagaggaagaacaaaactctggtgcattccattacagagttacaacagaagctaacacgcaagtcacaaaaaattaccaattgcgaacaaagctcacccgacggcgcccttgaagagaccaaggtgaagttgcagcaactcgaggcttcgtacgcttgtcaggaaaaagaactactgaaagtaatgaaagagtacgccttcgtgacacagctctgcgaggaccaggccctctacattaagaagtaccaggagacgctgaagaaaattgaagaggagttggaggcccttttcctagaacgagaggtgtctaagctggtgtctatgaaccctgtggaaaaggagcacacctctcagaacaacgagggcacccctacacaaaagaccgcacgactcttctctaagaagatcttctgctgcctgtttttcataaccctgttcttcattagactcctgtcctacatgtttttccacgtgagatttatcaatcctgacctgctggtcaatgttcttccgaaggtactggggcgctcgaccctgtggaagctgagatgctttttctttccttccctcacgttggaaacggaggacatgctcccccactag

SEQ ID NO: 30999 - DNA, 687 bp, Artificial Sequence
  Description of Artificial Sequence: Synthetic coding sequence
atggaaattagcaggttagcacagagcaaaagaaacatcataagtctaaatatggacctagagcgagatactcagcggattgacgaagctaatcagaagctgctccttaagatacaagagagagaagacaagatccagagattagagagcgaaattatccaaaccaggggattagtggaggacgaggaatgggaaaaagagaacaggaccacgatggagcgggaacgcgcactccaagagttagaagaggaaacggccaggctggaacggaagaataagactcttgtgcatagcataacagaactgcagcaaaagttgacaagaaagtcccagaagattaccaattgtgagcagagcagccctgatggtgccctcgaagagacgaaggtgaaattgcagcaactggaagccagttatgcgtgccaggagaaggagctgctcaaggtaatgaaggaatacgcttttgtgactcagttatgcgaagaccaggcgctatacatcaaaaaatatcaggagactctcaagaaaattgaggaggaactcgaggccctgtttctcgaacgcgaggttagcaaactggtgtccatgaatccagtggagaaggagcacacaagtcaaaacaatgagggcacccccactcagaagacagcccggctgttcagtaagaactggcaccactcgttttag

SEQ ID NO: 31000 - DNA, 246 bp, Artificial Sequence
  Description of Artificial Sequence: Synthetic coding sequence
atggaaatatcccgcctggcacagtctaagcggaacattatttccctcaatatggacctggaaagagacacccagcggatagatgaagccaaccaaaaattactcctgaagatccaggaacgggaggataaaatccagcgactggagtctgaaatcatccagacccgtgggttagttgaggatgaggaatgggaaaaagagaatcggacaaccatggagcgggagagggccctacaggagctctag

SEQ ID NO: 31001 - DNA, 435 bp, Artificial Sequence
  Description of Artificial Sequence: Synthetic coding sequence
atggaaatttcacgcttggctcaatccaaacgcaatataattagcttaaacatggatttggaacgggatacacagcggatagatgaggccaaccagaagctgctcctcaagatccaggaaagagaggacaagattcagaggttggagagtgaaatcatccagacccgcggtttggtggaggacgaggagtgggagaaggagaaccgtaccacgatggaaagagaacgcgctctgcaagagcttgaggaggagacagcccgcctggagcgtaaaaataagactcttgtgcactctataacggagctgcagcagaagcttactcgcaaaagccaaaaaattactaactgcgagcagtcgtctcccgacggggccctggaggaaacaaaagtcaaacttcagcagttggaggcctcctacgcttgccaggagaaatag

SEQ ID NO: 31002 - DNA, 687 bp, Artificial Sequence
  Description of Artificial Sequence: Synthetic coding sequence
atggagatctccagactggcccaaagcaaaagaaacattatctccctgaacatggacctggaaagggacacacaacgtatcgacgaggcaaaccagaagctgctgctgaagatacaggaacgggaagacaaaatccagcggctggagagcgagattattcagacccggggccttgtggaggacgaagagtgggaaaaggaaaacagaactactatggagcgcgagcgggctctgcaggaactggaagaggagacagcgcgactggaaagaaaaaacaagaccttggttcattccatcactgagttacaacagaagctaaccaggaagtcccagaagataaccaactgcgagcagtcaagtcccgatggggcccttgaagagactaaagtcaagctccagcagctggaggcaagctacgcctgccaggaaaaagaactcctgaaagtcatgaaggaatacgcctttgtgacccagctgtgcgaagaccaggccctgtacattaaaaagtaccaggaaaccctgaagaagatcgaggaagagttggaggctcttttcctggagagggaagtctccaagctggtctcaatgaacccagttgagaaagaacatacctcacagaacaatgagggaaccccaacacagaaaaccgcccgactgttctccaagaagtgggcttcgagtttctag

SEQ ID NO: 31003 - DNA, 216 bp, Artificial Sequence
  Description of Artificial Sequence: Synthetic coding sequence
atggagattagcaggctggcccaaagcaaaaggaacattatttcactgaacatggatctcgaacgcgacacccagcgtatcgatgaggcgaatcagaagttattacttaagatccaggagagagaagacaagatccagcggctggaaagcgaaatcattcagacccggggtttggtagaggacgaggaatgggagaaggagaaccgcactacctag

SEQ ID NO: 31004 - DNA, 3285 bp, Artificial Sequence
  Description of Artificial Sequence: Synthetic coding sequence
atggcggcgagacaggccgtcggaagcggcgcacaggagacatgcggtctagaccgaatcctagaggccttaaaactgctcttgtcacctggggggagtggaagtagttctttacaggtcacgaaacatgacgtgctgctggcaactctgaagagtaatctgtcagctctggaggacaagtttctcaaagatccacaatggaagaatctgaaactgctgcgcgacgagatagccgacaaggcagagtggccacagaacagcgtcgatgttacttggtctttcacaagtcagacactgctgctgctgctctgcctgaaggagactatgattagactggccgccaattttaatcctggcaaacccaacccaaggaccccagaagtagctccagctctgtcaccagatgcattatccatctcacagcagaagaccgtgcaatttgtgctccagttcgtcgtgaccctcggaatctgcccctacctcatgcctggtgtgggtgtgcccctccgctaccgcacagaatttggcgccgtggtacaggatgtcgtgtgctttgatgccgcccccgacgcgactcgcagactgtataccagttgcaaggccttactgaacgtggcgcaacacacctcgcttgggtcactgatcttctgccatcactttggagacattgctgccggcctgtgtcagctgggcttctgcccgacaaaacggaagcttctgacacccgccgaggaagtcctgacggaggaggaacgaaccctgtcacggggagctctgcgggatatgctcgaccaggtctatcagccattggctgtacgcgagttattaatactgcagggaggaccccctcagagttgcacagacgtaaaaacacaaatgaggtgtcgggcacccgcatggcttcgacggttgtgtggccagctcctttctgagaggctgatgcgccctaacggtgtgcaggcggtggtgaggggaatccttgagggagctggtgccggcgcagccggcggcagcgacgccgaagttactgcggccgactggaaaaaatgtgatcttattgccaaaatattggcgagctgtccccagcagtctctttctcccgagaattactacagggatatctgccctcaagttctggatctctttcactttcaggacaaactaaccgctcgccagtttcaaagggtcgctaccacaacattcatcactctgtcccgcgaaagacctcatctcgctgccaaatatttacttcaacctgtattagcacctctgcacaggtgcctgaataccgcagaattgagcgaatccgacatggtccccggcacgatattggtaactgaggaggagctctccagatgtattgaagacgtttttaaagtatacgtggtgggaaatgagccgctgaccgttctcatggacagcctcctgccggtgctaggcgttctgtttctgctatactgctttacaaagcagagcgtgtcacatattaggagtctgtgccaggagattctgttgtggatcctgggtaagctcgagaggaaaaaagctattgcctccctgaaaggtttcgctggtcttgataaagccgtgcccagcctgcatagcttgtgccagttccgggttgcaacccagggggggatcatgatcactattaaagaggctatatcggatgaggatgaggatgaggcactttatcagaaagtctcaagcgagcagggcagggttgagcacttgggcgatctactgagccattgtcaagaatgcgggttggctggtgatttctttatcttctgccttaaggaactgacccacgtagccagtgaaaatgagactgagctgaagaccgaaccattctcttcaaagtcactgctcgaactagaacagcatcaaacattactagtggaggggcaggaacggaagctgttggtcctgcagctaatggctgtgctgtgtgaacggatgtccgagcagatcttcacgaatgttactcaggtggtggactttgttgcggctactctacaacgggcttgtgctagcctagcacaccaggcagaatccaccgtcgaatcacagacactttccatgtcaatgggtcttgtggctgtaatgctcggtggagcagtgcagcttaagagcagtgacttcgccgttctgaaacagttgttgcccctcctcgagaaagtgagcaacacttaccccgatccagtcattcaagagctagccgtcgacctacgtataacgatctctacgcacggggcattcgcaacagaggccgtcagtatggccgcccagagtacacttaaccgcaaggacctggaggggaaaatcgaagaacagcagcaaaccagccatgagcgcccaactgatgtcgcacatagtcaccttgagcagcagcagagtcatgagacagcaccacaaaccggcctgcagtctaatgcccctattatcccccagggtgtcaacgaaccctcaaccaccacatcccagaaatccgggtccgtgacgaccgaacagttgcaggaggtgttactttccgcttacgaccctcagataccaactcgcgcagccgccctgcgaacactgtctcactggattgaacaacgagaagctaaagctcttgagatgcaagaaaaactactgaaaattttcctggaaaacctggagcacgaggatacttttgtgtacttaagcgcgattcagggcgtggccctactgtccgatgtgtatccggagaagatcctccctgatctactggcacagtatgacagctctaaagacaagcacacgcctgagaccagaatgaaggtgggtgaagtcttgatgcggatagtgagggcattgggagacatggtcagcaaatatcgcgagcctctaatccacacctttctgagaggcgtgcgagaccccgatggagcacaccgggcatcctctcttgcaaacctcggcgagctttgtcagcggctcgatttcctgctcggaagtgttgtacacgaggttacagcctgcctcattgcagtggcaaagactgatggagaagtgcaagtcagaagggccgctattcacgtggttgtactgctgctcagaggcctgtctcagaaggctaccgaggtgttaagcgcggtgctcaaagacctatatcatctccttaagcacgtagtgtgtctggagcccgatgacgtagctaaattgcatgcacagcttgccctcgaggaacttgacgacatcatgaaaaacttcctattccctccccaaaagttggagaaaaagattatggtgctaccgtag

SEQ ID NO: 31005 - DNA, 789 bp, Artificial Sequence
  Description of Artificial Sequence: Synthetic coding sequence
atggcctggaagagtagcgttattatgcagatgggtcgcttccttttactcgtaatcttgtttctccctcgcgagatgacctcctccgtactaacagtgaatggtaaaactgaaaactacatcttggatactacccctgggagtcaggcaagtctcatttgcgcagtccagaatcatactcgcgaagaggagctactgtggtacagggaagagggccgagtggatctgaaatcaggcaacaagattaattcctcttccgtttgtgtgtcaagcatctccgaaaatgacaacggcatctcctttacttgtagactcgggcgcgaccagtcagtatcggtgagcgtggttctcaatgtcaccttcccgcctctcctgagtgggaacgatttccagactgtggaagaaggaagtaacgtaaaactggtgtgcaacgtaaaggctaatcctcaggctcagatgatgtggtacaagaattcctccctcctggacctcgaaaaatcaagacaccagatccagcagactagcgagtcttttcagctgtccattacaaaggtagaaaagccagataatggcacttattcatgtatcgctaaatcatccctgaaaaccgagtccctggattttcatttaattgtcaaggacaagacagtaggagtccctattgagccaattatcgccgcatgtgttgtgattttcctcaccttgtgcttcggacttatcgccaggcgcaaaaagattatgaagttatgtatgaaagataaagacccccatagcgagaccgccctgtag

SEQ ID NO: 31006 - DNA, 657 bp, Artificial Sequence
  Description of Artificial Sequence: Synthetic coding sequence
atggcctggaaaagttcggtgattatgcagatggggcgcttcctgttactcgtcatacttttccttccacgcgaaatgacatcaagcgtgctgaccgtgaacggaaagaccgaaaactatatccttgataccaccccagggtctcaggctagcctaatttgcgccgttcaaaaccatacacgggaagaagagctcctctggtatcgagaggagggacgcgtcgacttaaagtctggaaataaaattaactccagtagcgtctgcgtgtcatctattagcgagaacgacaacggtattagctttacctgcaggctgggaagagaccagagcgtgtctgtaagtgtggttttgaatgttacatttcctccactccttagtggcaacgacttccagactgtggaagagggctctaatgtgaagctcgtttgcaacgttaaagctaatccccaagcccagatgatgtggtataaaaatagcagtttgttggatctggaaaagtcaagacatcagatacagcaaacgtccgagagcttccaactttcaatcacaaaggtggaaaaaccagataatggcacttattcttgtattgcaaagtcttcccttaagacagagagtttagattttcacctaattgtgaaagcgcttcagcaaggctag

SEQ ID NO: 31007 - DNA, 849 bp, Artificial Sequence
  Description of Artificial Sequence: Synthetic coding sequence
atgggttctccaggtatggtgctgggcctcctcgtgcagatttgggcgctccaagaggcttcttcactaagtgttcaacaaggccctaatctcctgcaagttcgccagggttcgcaggctacgctggtttgtcaggtagatcaagccaccgcctgggagagactgcgggtcaagtggacgaaagacggagccattctgtgtcaaccttacattacaaatggttctcttagccttggagtttgtggccctcaaggcagactatcctggcaggcaccctcgcacctgactctgcaactcgatccagtttccctgaaccattccggcgcctatgtctgctgggcggccgtcgagattcctgagctagaagaagcagaaggcaatataacaagattgtttgtagatccggacgatcccacccagaaccgaaaccggattgcgtctttccccgggttcctctttgtattgttgggtgtcgggtctatgggcgttgctgcaattgtgtggggggcctggttctgggggagacgcagttgccaacaaagggattccggaaattcccccggcaacgccttctattcaaacgttctctatcgcccacgaggcgctccaaagaagtccgaggactgctctggcgaggggaaggatcagcgaggccaaagcatctatagtacgtcatttccacagccagcccctagacagccccatctggcttcccggccatgcccgtctcctagaccttgcccctcaccacgccccggacatcctgtgtccatggtgcgggtcagcccaagaccatcccctactcagcagcccagacctaagggcttccccaaggtaggcgaagagtag

SEQ ID NO: 31008 - DNA, 2325 bp, Artificial Sequence
  Description of Artificial Sequence: Synthetic coding sequence
atgaaccctttctatttccatgcagtgaacatcatccttcattgcttagttaccttagtgctcatgtatacctgtgacaaaaccgtgttcaagaaccgcggcttggcctttgtgacggctctgcttttcgccgtccaccccatccacacggaggcggtggccgggattgtgggaagggcggacgtgttggcttgcctactgttcttgctcgcttttctctcatacaacagaagcctggaccagggctgcgtgggaggttcattccccagcacagtgtcaccattcttcttgcttctctctctctttctgggaacctgtgcaatgttggtcaaggagacaggaattacagttttcggagtgtgcctggtgtatgatctgttttcgctttctaataaacaagataagtcgtcaaatggagctctgtgcccgagaagtccccagcagcctggatctccccagccttcctcgctgccgggccacccgcatagggaaaacggaaaacagcagaggttcccacacaagggcgcatggggcggctgtcactcccctctgccccctgagcccaaaagctccgggttcccagtctcccccagggccgtgtggtccatgatgaggttcctgacctacagttacctgttggccttcaacgtgtggctgctgcttgcacctgttaccctgtgctatgactggcaggtcgggtctatcccgctggtcgaaaccatctgggacatgagaaacctcgctactatttttctggccgtggtgatggcgctacttagtctccactgtctcgcggcattcaagcgcctggagcataaggaggtcttagtgggcctgctgtttctcgtgttcccgttcatccccgcgtctaacctgttttttagggtaggcttcgtcgttgcagagcgggttctgtacatgcccagcatgggctattgtatccttttcgttcacgggctgagcaaactgtgcacatggctgaatcggtgtggagctacgacactaatagtctcgactgtgctactcctcctgctgttcagctggaagacagtgaagcaaaatgaaatttggctatcaagggagagcctctttcgatcaggcgtgcaaacactccctcataacgccaaagttcattacaattatgcaaattttctgaaggaccagggcaggaataaggaggctatttatcactaccgcaccgccctgaagctctatcctcgccacgcctcagctctcaataatctcggcaccctcacacgggacaccgcggaggctaagatgtactatcaaagagctttacagctgcaccctcagcataatcgggccctctttaacttgggcaatctgctgaaatcacaagaaaaaaaagaagaggcaattaccctgctgaaggattctataaagtatggaccagagtttgccgacgcttactctagtctggccagtttgctggccgaacaggaacggtttaaggaagcagaggaaatttaccagactggcattaaaaattgccctgactcatcagatctgcacaacaactatggtgtgttcctagtagatacaggacttccagaaaaggccgtggcccactaccagcaggcaattaaactgtcaccaagtcaccacgtggcaatggtgaatctgggtaggctttatcggtccctgggcgagaacagcatggctgaggagtggtacaaacgggctctgcaggttgctcacaaagccgagatcctctcgcctctcggagctctgtattacaacaccggacggtatgaggaagcgctgcagatataccaagaggcagccgctttacagccctcccaacgcgagttacgcctggccctggctcaggttcttgctgtgatgggccagacaaaagaggccgagaagatgaccaatcatattgttagcgaagagactggatgcctcgagtgttatcggctcctgtctgcaatctacagtaagcaggagaaccatgataaagcgcttgacgccattgataaggctctgcaactgaagccgaaagatcccaaggtgatcagcgaacttttttttacaaaaggaaaccagttgcgggagcagaacctcctcgacaaagcattcgagagctatagggtggcagtccagctgaaccctgatcaggcgcaggcttggatgaatatgggcggaatacagcatatcaaggggaagtacgtgagtgcccgcgcatattacgagcgcgctctgcagctggtgcctgatagcaaactgctgaaggagaatctggctaagctggacaggctggagaaacggttacaggaagtgagggagaaagatcaaacatag

SEQ ID NO: 31009 - DNA, 1725 bp, Artificial Sequence
  Description of Artificial Sequence: Synthetic coding sequence
atgaacccattttattttcacgccgtgaatataatccttcactgtttggttacgttagtattaatgtacacctgcgataagaccgtttttaagaaccgtgggctcgcttttgttacagccctgctctttgccgtacatcccatccatacagaagctgtggcaggcatagtgggaagagctgatgtcttagcctgtcttctttttctcctggcctttctgagctataatcgaagcctagatcaaggttgtgtcggcgggagctttccgtccacagtgtccccattttttctgctgctgtctcttttcctagggacctgcgctatgttggtgaaagagacaggaatcacggtcttcggagtgtgcctggtgtacgacttattctcactgtctaacaagcaagacaaatcctcaaacggcgctctgtgtccccggagtccccagcagcccggatctcctcagccaagcagcctgcccggccaccctcatcgcgaaaatgggaagcagcaacgattcccccacaaaggcgcatgggggggctgccattctccactccccccggagcccaaatcttccggctttccagtgagcccaagagctgtatggagcatgatgagatatctgagagcatccagtaatcgcaactttctgctgactatgcggccatttcttaagcgcgctatactcgtactgagctacgtgcttgtgattctgtactttcgcctttggattatgggcggttccatgcctttattctctgaacaggacaatcccgcttcattctccccatacatcctgactagattcctcacttattcgtatctcctcgcattcaacgtgtggctcctgctggcccctgtcacgctgtgctacgattggcaagtcggcagtattccactggtggagaccatttgggatatgcgtaatctggcgaccattttcttggctgttgtgatggcactcctcagcctgcactgtctggcggcctttaagcgtctcgaacataaagaggttttggtgggcttgctgtttctcgtgtttcctttcattcctgcaagcaacctcttttttcgagtcggattcgtcgtcgctgagagggttctctacatgcccagtatgggctattgcatcctgtttgtccatggcctctccaagttgtgtacctggctcaaccggtgcggggcaactacactcatcgtaagcaccgtactcctgcttctcctgttctcttggaaaaccgttaagcagaacgagatctggctcagtcgtgagagcctgttcaggtccggagtgcagactctgccccataacgcgaaggtacattacaattatgccaactttctgaaagaccaggggcgcaataaagaggccatctatcattatcgcacagcgctgaagctgtaccctaggcacgctagcgccctgaacaatcttggcacgttaacccgggataccgcagaagcgaagatgtactaccaaagagcactgcagctgcacccgcagcacaatagagccctattcaatctcggaaaccttctgaaatctcaagagaagaaagaggaggccattaccttgctgaaggactctatcaaatatggcccggagttcgcagacgcctatagctcccttgcctccctgctcgccgaacaggttatagtctcgcacagttcatttttccagtgctattgttacatgtacaaactgatgctgcatcgattcctgtactag

SEQ ID NO: 31010 - DNA, 2649 bp, Artificial Sequence
  Description of Artificial Sequence: Synthetic coding sequence
atggttgttaccacctcagcaaggggcggcggcggggatagaacaccttcacgacgccgcgggtgtgggctcgcccctgctggggcagcggccctgttggctggtgcttcctgcctttgctacgggagatctcttcagggagagtttgtgcatgacgacgtctgggctatagtgaacaatccggacgttcgtcctggcgctcctctccgatggggcatcttcaccaatgacttttggggcaaaggcatggctgagaacacatcacacaagagttacaggcctttgtgtgtgcttactttcaaacttaacatcttcctaacagggatgaatcctttctacttccacgccgtgaacataattctccattgcctggtaaccctcgtgcttatgtacacatgcgataagaccgtatttaagaacagaggcctggcttttgtgaccgccctgctatttgcggtccaccctatccacactgaggctgtcgctgggattgtaggtcgcgccgatgtactcgcttgcttgctttttttactggcatttctgagttataatagaagcctggatcaggggtgcgtcgggggaagtttccccagcaccgtatctccattctttctgctgctgtccctatttcttgggacctgcgctatgctggtgaaagaaaccggtatcactgtgtttggcgtctgcctggtgtacgaccttttcagcctcagcaacaaacaagataagtctagtaatggggccctgtgcccgcgctcaccccagcagccaggctctccccagccttcttcgctgcccgggcatcctcacagagagaatggtaagcagcagaggttcccacacaagggcgcatggggaggctgtcatagtcctttaccaccggaaccgaagtcaagtggctttccagtcagccccagagctgtctggtcaatgatgcggttcctcacctactcttatctgctggcttttaatgtttggctcctgcttgctcccgtcaccctttgctacgactggcaggttggtagtatcccgctggtcgagacgatctgggatatgcgcaacctcgctaccatttttcttgctgtggtgatggcgttgcttagcttacactgtctggctgcgtttaagcggctggaacataaggaggtgctggtggggctgttattccttgtgtttcccttcatcccagcctccaacctgtttttcagagtaggcttcgtcgtcgcagaacgggtactgtacatgccgagcatgggctattgcattcttttcgtccatggcttgtccaaactgtgtacctggctgaatagatgcggggcaacaaccctgatagtttctacagtgctcctactgctactgttctcttggaagaccgtgaaacagaacgagatttggctatctagggaatctcttttccggagtggagtgcagacactgccccacaatgctaaggtacattacaattatgcaaattttcttaaagaccaaggccgcaacaaggaggccatctatcattaccgcacggcgctcaagctctaccctaggcacgcatccgccttgaataatctcggcacactgacaagagacactgccgaagccaagatgtactaccagcgcgcgctacaactccacccccaacacaatagggccttgtttaatctggggaatctcctcaagtctcaggagaaaaaggaggaggccatcaccttactgaaggattcaattaagtatggtcccgagtttgcggacgcctattcctctctcgcctccctgcttgccgagcaagagagatttaaggaggcggaagaaatctatcagacaggcattaagaattgtcccgacagcagtgatctccacaataattatggcgtgttcctggtggatacagggctgccagaaaaagccgttgcgcactatcagcaggcgatcaaactctcacctagtcaccacgtagccatggtgaacctgggcagactgtatcgatcgctcggcgagaactcaatggcggaggaatggtacaaaagagcattgcaagtcgcgcacaaagcagagattctatcccccctgggagccttgtattacaacaccggcaggtatgaggaagcccttcagatttatcaagaggctgccgctttacagccttctcaacgggaactgaggcttgcacttgcccaggtgctcgccgtgatgggccaaactaaagaggcagaaaagatgaccaatcatatcgtaagcgaagagactggttgcttggagtgttaccggttattgagcgccatttatagtaagcaggagaatcatgataaggctctggacgccatcgataaggcattgcaactgaagccaaaggacccgaaagtgataagtgagctctttttcaccaagggcaaccaactccgagagcagaacctgctggataaagcctttgagtcctacagagttgccgtgcagctgaatccagaccaggctcaggcgtggatgaatatggggggcattcaacacattaaaggtaagtacgtgagcgctagagcctattacgaaagggcccttcaactagtccctgactctaagctgctgaaggagaacctagctaagctggatagactcgagaagagactgcaggaggtgcgagagaaggaccagacatag

SEQ ID NO: 31011 - DNA, 1938 bp, Artificial Sequence
  Description of Artificial Sequence: Synthetic coding sequence
gtgaccgaaagagactcagtttccaagaaaaagaaaaaacggtacttaagagcaagcagtaaccgtaatttcttgctgacaatgcgcccttttcttaagcgggccattttggtgctgtcatacgtcttggtgatcctctacttccggctgtggatcatgggtggtagcatgcctttgttttcagagcaggacaatccagcctccttcagtccatacattttgactcgcttcttaacctattcttacctgttggccttcaatgtctggttgcttctagcccctgtcaccttgtgctacgactggcaagtcggctctattccactggtggaaacgatttgggacatgcggaatttagctacaatatttctggctgtcgtcatggctcttctgtcccttcattgcctggccgcatttaaacgcctggagcataaagaggtcttggtgggtttgttgttcctggtgttcccgtttattcccgccagcaacctcttctttcgagtcgggtttgtggtcgccgagagggttttgtacatgccctctatgggctattgtatcctgtttgtccacggactgtcaaaactctgtacctggctgaaccggtgcggggccactacactgatagttagtacggtgctcctgcttctgttattttcttggaagacagtcaaacaaaatgagatttggctctctcgggagagcctgttcaggagcggagtgcagaccctcccacacaacgccaaagtgcattataactatgctaactttcttaaggaccaggggcgtaacaaggaggctatctatcactacaggacagccctaaaactctatcccagacacgcgagcgccctgaacaacctgggcactcttacgcgcgacaccgcggaagccaagatgtactatcagcgtgcccttcagctgcaccctcaacacaacagagccctctttaatcttggtaatctgctcaagtctcaagaaaagaaggaggaggccattacattgctgaaggacagtatcaaatatggcccggaatttgccgatgcgtattcatctctggcctctctcctagccgaacaagaacgcttcaaggaggctgaagaaatctaccagactggcataaaaaactgccctgattctagcgacctgcataataactatggggtgttcttagtagacacaggattgcccgaaaaagcagtcgctcactaccagcaggccataaagctgagtcccagtcaccatgttgccatggtgaacctgggccgcctctatcggtcattaggcgaaaattcgatggccgaggaatggtacaaacgtgccctccaggtggctcacaaggcagagattctgtcccccctgggagcactgtactacaatacaggtcgttatgaggaggcacttcaaatctatcaggaagctgccgctctgcagccaagtcagcgcgagcttcggctggcacttgcccaggtgttagcagtaatgggacagacgaaggaggccgaaaagatgactaaccacatagtttcagaagaaaccggttgcctggaatgttatcggctcctgtcagcgatttactccaagcaggagaatcatgacaaagccctcgatgcaattgacaaggccttacagttgaaaccaaaggaccccaaagtgatttccgagttgttcttcactaagggtaatcagctcagggaacagaaccttctggataaagcattcgagtcctacagggtggccgtccagctgaaccctgatcaagctcaggcttggatgaatatgggtgggattcagcatatcaaggggaagtatgtgagcgcgagagcctactacgagagagcactgcagctcgtcccggattccaagttactcaaggagaatctcgcgaagttagacaggctggagaagcggttacaggaagtgagagaaaaagatcagacatag

SEQ ID NO: 31012 - DNA, 2835 bp, Artificial Sequence
  Description of Artificial Sequence: Synthetic coding sequence
atggttgtgactaccagcgcaaggggggggggaggagacaggacgcctagccgcaggcgaggctgtggactcgctcctgccggcgctgccgcccttcttgcaggagcctcttgtctgtgttacgggcgcagcctgcagggcgagtttgtgcacgacgatgtgtgggcgatcgtaaacaatccggatgtgcggccgggagcccccctgaggtgggggattttcacaaatgacttctggggcaaaggaatggccgagaatactagccataagagttatcgacctctctgcgtgttgactttcaagctaaacatcttcctcaccggaatgaaccctttctacttccacgctgtcaatatcatcctacattgcttagttaccctggtgctgatgtatacatgtgacaaaaccgtgttcaaaaacagaggcttggccttcgtcactgcccttttatttgccgttcatcccatacacaccgaggctgtcgccggaatcgtaggtagagctgacgtccttgcttgtctcctgtttctgttagcattcctgagctacaaccgcagtctggatcaggggtgtgtgggcgggtctttccctagtacggtgagccctttctttctcttgcttagccttttcctcggcacctgcgccatgttggtgaaagagacaggcattaccgtgtttggggtttgcctagtttacgacctgtttagtttaagcaataaacaggataaaagtagtaacggtgctctttgtccacgaagtccacagcagcccggctcgccgcagcctagctcgttgcccgggcatcctcaccgagaaaatgggaagcagcagagattccctcataagggagcatggggcggttgtcacagtccattaccacccgagcctaagagttccggcttccctgtttcacctagagccgtgtggagcatgatgcgatacctccgagcgtccagtaacaggaatttccttctcacgatgcgccccttcttgaaacgggcaattctggtgctctcttacgtgctcgtgatcctttatttcaggctgtggataatgggtggtagtatgcctctcttcagtgaacaggataaccctgcctccttcagcccttatattctgacccgctttttgacctacagctacctattagcctttaatgtgtggcttctgttggctccagtcacgctatgttacgactggcaggtggggagcatcccactcgttgagacaatctgggatatgcgaaatctcgctaccattttcctggccgtagtgatggctctgctgtccttgcactgcctagctgcctttaagaggctcgagcacaaagaagtcttagtcggcttgctgttcctagttttccctttcatccctgcctccaacctgtttttcagagttggctttgtggtggctgagagggtgctgtacatgccctctatgggctactgcatcttattcgtgcacggactttcaaaattgtgtacatggctgaaccgttgtggggcgacgaccttgatcgtgtccacggtgctcctactcctcctgttttcttggaagaccgttaagcaaaatgagatctggctgtccagggaaagtctgtttcgatccggcgtccagacgctaccacataacgcaaaggttcactataattatgcaaatttcctgaaggaccagggaaggaacaaggaggcaatataccattataggacggctctgaaactctaccctagacacgcttctgcactcaataatctcggaaccttgactcgcgacactgcagaggctaaaatgtattatcagagggcactccaactgcatccacaacacaatagagccctgttcaaccttggaaatttgcttaagtcacaggagaagaaggaggaagctataaccctgctcaaagatagtatcaaatacggtccggagtttgccgatgcatacagcagtctggccagtctgttggcagagcaggagaggtttaaggaagccgaggaaatctatcagacgggcattaagaattgcccagactcctctgacctgcataacaactacggagtgtttttggtcgatactggcctccctgagaaggctgtggcccactaccagcaggcaatcaagctgtctccatctcaccatgtggccatggtaaatcttgggagactctaccgctcccttggggagaactccatggctgaggaatggtacaaaagggctctgcaggttgcccataaggctgagatcctgagcccattaggagcgttgtactacaatactgggagatacgaggaagcacttcagatataccaggaagctgcagcgcttcagccttcccagcgagagctccgcctggccctggctcaggtcctcgcagtgatgggtcagactaaggaagcggagaagatgacaaatcatatagtgtctgaggagacgggttgcctggagtgttatcgactgttaagcgctatttattctaagcaggagaaccacgataaggcactcgatgcaatcgataaagcactgcaattgaaacctaaggaccccaaagtcattagtgagctctttttcaccaaagggaatcagttgagggaacaaaacttgctcgataaggcttttgaatcttatcgagtggccgttcagctgaaccctgaccaggcccaggcctggatgaatatgggtgggattcagcatatcaagggaaagtacgttagtgcgcgggcttactatgagcgcgctctgcagctggtacctgactcaaaactcctcaaagaaaatttggccaagctggacaggctggaaaagcggctgcaggaggttcgcgagaaggatcagacgtag

SEQ ID NO: 31013 - DNA, 2511 bp, Artificial Sequence
  Description of Artificial Sequence: Synthetic coding sequence
atgatcgccgagctggtgagttcagccctcggactcgcactttacctaaatactttatcagcagacttttgctacgatgactctagagccatcaagactaatcaggatctcctgcccgaaaccccatggacgcacatcttttataatgatttttgggggaccttgctgactcactcagggagtcataaatcatatcggcctctttgtactctgagtttccggctgaaccatgccattggtggcctcaatccctggagctaccacctggtcaacgtcctgctccatgccgctgtgaccggtttattcacctcctttagtaaaattttgttgggagacggctactggacctttatggcaggcctcatgttcgcttctcaccctattcacactgaggccgtagcaggtatcgtaggaagggccgatgttggtgcgagcctcttctttctactgagtctgctgtgttacattaaacactgtagcaccaggggttatagcgcccgaacttggggctggtttctgggctctggcctctgcgccggttgttccatgctgtggaaggagcagggcgtaaccgtgctggccgtgtctgctgtgtacgacgtatttgtcttccacagactgaaaattaaacagattttaccgactatctataaaaggaagaacttgagccttttcctgagtatcagtctgttgatcttctggggatctagcctcctgggagcgcgactttactggatgggaaataagcctcccagcttttccaactctgataatcctgcggccgattctgacagcctgcttactcgcaccctcaccttcttctatctccccaccaaaaatctctggctgctcctatgtcccgacactctgtcttttgattggagtatggacgcagtacccttgctcaagacagtgtgcgattggagaaatcttcacacagtggccttctatactggactgttgctcctggcctactatggtctgaagagtcctagcgtggatagagagtgtaacggcaaaaccgtgacgaacggcaagcagaatgcgaatggccactcctgtctgagtgatgttgaatatcaaaatagtgagaccaagagtagtttcgccagcaaggtggaaaacggaattaaaaacgacgtgtcccaacggacacagctgccgtcaactgaaaatatcgttgtgctctcactgtccttgctcatcattccgttcgttcccgctactaatctgttcttctacgttggtttcgtcattgccgagagggtgctgtacatcccatccatgggattttgcctgctcataacagtcggcgctagggctttgtatgtaaaggttcaaaaacgattcctgaaaagcctgatcttctacgcaacggctactctgatcgtgttctatggtctcaagactgctatcaggaatggcgattggcagaatgaggagatgctgtataggagcgggattaaggtaaatcccgcgaaggcttggggaaatctcggtaatgtcctgaagtcccagagcaagattagcgaggcagaatctgcttaccgaaacgcactgtactacagatccaacatggccgatatgctgtataatttgggcctactgctgcaagaaaacagccggtttgccgaggccctccattactacaagctggctataggttcaaggccaacgttggcttcggcctacttgaataccggaatcattctgatgaatcagggacgcaccgaggaggctagacggacctttctaaagtgctccgagatccccgacgaaaatctgaaggacccgcacgctcacaaaagctcggtgacgagctgtctttataacttggggaaactgtaccacgaacagggtcactatgaagaggccttgagcgtttacaaagaggccatccagaaaatgccaaggcagttcgccccacaaagcctctataatatgatgggcgaggcctacatgagattaagtaaattgcccgaagccgaacactggtatatggagtcactgagatccaagaccgaccacattccagcgcatctcacctatggcaagttgcttgccttgacggggcgcaaaagtgaagcagagaagctgttcctaaaggccatcgagctggatcccactaaaggtaactgctatatgcattacggtcaatttttactagaggaggctagactcattgaggccgccgaaatggcaaaaaaggccgcagagctggattctaccgagttcgatgttgtgtttaacgcagcacatatgctgcggcaagccagtttaaatgaggctgcagagaaatactacgacctagccgcccgcttgcgtccgaattaccccgccgcgctcatgaaccttggcgctattctccacctgaacggccggttgcagaaagccgaggccaactatctgcgggccctgcagttgaagcccgacgacgtgattacccaatctaatcttcggaaattgtggaatattatggaaaagcagggcctaaagacaagcaagacctag

SEQ ID NO: 31014 - DNA, 2745 bp, Artificial Sequence
  Description of Artificial Sequence: Synthetic coding sequence
atggccaatataaatctgaaagagatcacactgatcgtgggcgtcgtgaccgcgtgttactggaactcgttgttctgcggcttcgtattcgacgatgtaagcgctatcctagataacaaggacctgcaccccagcacacccctgaagacactgtttcagaatgacttctggggcacaccaatgagcgaagaacgttcccataagtcttatagacctctgacagtgctcacatttcggctcaattatctgctgtcagagctgaagccaatgtcctaccatctgctgaacatgatctttcacgccgtggtgagtgtgattttcctgaaggtgtgtaagttgtttcttgataataaaagctctgtcattgcctcacttctctttgctgtacacccaatccatacagaggcagttaccggggttgtgggacgcgcggagctgttgtcatcaattttctttcttgcagccttcctcagctacacccgaagtaaaggccctgataattccatcatctggacccccatagccctcacagtgttcctcgtagccgttgctaccctttgtaaggagcaagggatcaccgttgtgggaatctgttgcgtctacgaggtgttcatcgcccaggggtatactctcccactgctgtgtacaacggctggccaattcctgagaggcaagggctccattccattcagtatgctgcagacccttgtgaagctgattgtgctcatgttttccaccttgcttctggtcgtgatcagagtgcaagtgatccagagccaactgcctgtcttcacccgttttgacaacccagccgcagtgtccccaacacccacaagacagttgacgtttaactatctgctcccagtgaatgcctggcttcttctgaatccaagtgagctgtgttgcgattggacgatggggacgattccgctcattgagtctctactggatattagaaacctggcaaccttcacgttcttctgttttctgggtatgcttggcgtgttcagcatacgttactcaggagatagcagcaaaactgtgctgatggccctatgcctcatggccctaccattcataccagcatccaatttgtttttcccagtcgggttcgtggttgcagagagggtgctgtatgtcccttcgatggggttttgcatacttgtggcccatggatggcaaaaaatttcaactaagtccgtcttcaagaagctgtcatggatctgcttgtctatggtgatcctgactcattcattaaaaacatttcatagaaactgggactgggagagcgaatacactctgtttatgtcagccttgaaggtgaataagaacaacgcaaagctgtggaataatgtgggccacgctcttgagaacgagaagaactttgagagggccttaaagtactttttgcaagctacccacgtgcagccagacgacatcggagcgcatatgaatgtcggtaggacatacaagaatctcaatcggactaaggaagccgaggagtcatatatgatggctaagagcttgatgccacaaattattcctggcaaaaagtatgctgcaagaatcgcccctaaccatctgaatgtttacatcaatctcgccaacctgattagggccaatgagtcccgtcttgaggaggccgaccagctttaccgacaagccattagcatgcgccccgactttaagcaggcatatatctctcgaggcgagctgctgcttaagatgaacaagcctctgaaggccaaagaggcctacctgaaagcgttggagctggatcgcaacaatgcagacctgtggtacaatctcgccatcgtacacattgagcttaaagagcctaacgaggcgttgaaaaacttcaatcgggcgctggagctaaaccccaagcataagctggccctgttcaattcagctatagtgatgcaagaaagtggggaagtgaagctgcgaccggaagcccgcaaaagattattgagttatatcaatgaagaaccactcgacgcgaacggctacttcaacctgggcatgctggcaatggatgataagaaagataatgaggcggagatttggatgaaaaaagccatcaagctccaggctgattttcggagtgctctctttaatctagccctgctgtactcgcagacagcgaaggagctgaaggcgctgccgattttagaagagctgctccggtactacccagatcacatcaaggggcttatcttgaagggtgatatcctgatgaaccagaagaaagacatcttaggggcaaaaaagtgtttcgagcgcattctagagatggatccaagtaatgttcaaggcaaacataatctgtgcgtggtgtatttcgaagagaaggacctcctcaaagcagaacggtgcctactggaaaccctggccctcgctccacatgaagagtatatccagaggcacctgaacattgtgagggacaagatctcttcctctagctttattgagcccatcttcccgacgtctaagatatccagtgtcgaaggaaagaagataccaaccgagtcggtgaaagaaatccgcggggaaagccggcagacacaaattgtgaagacatccgataacaagtcgcagtctaaatcaaataagcagttgggaaaaaacggagatgaggagaccccccacaagactactaaagacattaaggagatcgagaagaagcgggtggcagcactcaaaaggctcgaggagatcgaaaggatcctgaacggcgagtag

SEQ ID NO: 31015 - DNA, 447 bp, Artificial Sequence
  Description of Artificial Sequence: Synthetic coding sequence
atggccaatatcaacctcaaagaaatcaccctcattgtgggcgtggtaaccgcttgttactggaacagtctattctgcgggttcgtcttcgatgacgtatctgccatacttgacaataaggacttacacccgagcactccgctgaagaccctatttcagaacgatttctgggggactccaatgtccgaggaacgctcccacaaatcctatcgacccctcactgtgcttaccttccgcctgaactacctcctgtccgagctgaagcccatgagttaccatcttctgaacatgatttttcatgccgtagtgtccgtcatattcctgaaggtctgtaaactctttctggacaataagtcctcagtcatcgcgtcactgctgttcgcggtgcatcctattcacacggaggccgtaactggggtggtaggtcgagccgaactgctcagttag

SEQ ID NO: 31016 - DNA, 1893 bp, Artificial Sequence
  Description of Artificial Sequence: Synthetic coding sequence
atggctgtgctggatactgacctggaccacatcctccccagttcagtgctcccacctttttgggcgaaattggttgttgggtctgttgctatcgtttgcttcgctaggagttacgacggcgatttcgtgtttgatgattcagaagctatcgttaataataaggtggcaggggttgtggggcgcgcagatcttctctgtgccttgtttttcttgctgtccttcctcggttactgtaaagcctttcgcgaatctaataaggaaggggcccattcttccaccttctgggtcttgctgtcaatcttccttggtgccgtcgctatgctctgcaaggagcagggtatcaccgttttaggcctgaacgccgtatttgacatacttgtcattgggaagttcaatgtcctcgagattgtgcagaaggttcttcacaaagacaagtcactcgaaaacttgggcatgctcaggaatgggggtctgctgttcagaatgactttgctcacgagcggaggcgctggcatgctgtacgttcgatggaggataatggggaccggacccccagcgtttacggaagtggataatcccgccagtttcgccgacagtatgctagttagagccgttaactacaattactactactcgcttaacgcatggctcttactgtgcccatggtggctctgctttgattggtctatgggctgcatcccactgatcaagtctatctctgactggagagtgattgccttggccgcattgtggttctgtctaattggtcttatctgccaggcgttgtgttctgaagacggccacaagagaaggattttaaccctgggtcttgggttcctagtgatcccttttttgcctgcctccaaccttttcttccgggtggggttcgtggtggccgaacgcgtgctctatttaccctcagtgggatactgtgtgctcctgacgttcgggtttggggcactatcgaaacacactaagaagaagaagttgatcgcagctgtagtcttggggatcctgttcataaacaccctgcgttgtgtgttgcgctcaggtgaatggcggagcgaggagcaactcttccgtagcgccctctccgtctgtcccttaaatgcaaaagtgcattataacataggtaaaaatttggcagacaagggaaatcaaaccgctgccatcaggtactaccgcgaagccgttcggctgaatcccaagtatgtacacgctatgaataatttgggcaacattcttaaggaacgaaacgaactacaggaggcagaagaacttctctccctggcggtgcagatccagccagatttcgccgctgcctggatgaatttgggaattgtgcagaactctctcaagcgtttcgaggctgcagaacaatcctatcgcactgcgattaaacatcggagaaagtatcccgattgctactataacttaggccgactttatgcagatctgaatagacacgtggacgcactgaacgcctggcgaaacgccacggtcctgaagccagagcacagcttggcgtggaataacatgatcattcttttagacaacacagggaacctggcccaagctgaggcggtcggccgggaggccctggaacttattcctaatgatcattccttgatgttttcactggcgaatgtgctggggaagagccagaagtataaagaaagcgaagcactctttcttaaagccattaaggcgaatcctaacgctgcctcataccatggcaatttagccgtcctttaccacaggtggggtcatctcgacttggccaaaaagcactacgaaatctccttgcagctggatccgaccgccagtggcaccaaggaaaattacggtctgctccggcggaagttagaactgatgcagaagaaggccgtttag

SEQ ID NO: 31017 - DNA, 2283 bp, Artificial Sequence
  Description of Artificial Sequence: Synthetic coding sequence
atgatccctaaccagcataacgcgggcgcgggtagtcatcaaccggcagtgtttcgcatggcagtattagatactgaccttgatcacattttgcctagttccgtgctccctccgttctgggcaaagctggtggttggatccgtagccatagtttgcttcgccagatcctacgatggggacttcgtctttgatgatagcgaagcaatcgttaataacaaggacttacaggccgagactccactcggtgatctatggcatcatgacttctggggctccagactgtccagtaacacttctcataaatcataccggcctttgaccgtcctcacgttcaggataaattattatctgtcaggcgggttccaccctgtgggcttccacgtggttaatatccttttgcattctgggatctctgtgctgatggtggacgtatttagcgtgctcttcggcgggctccagtatacatcaaagggaagaaggctgcacctggccccccgtgctagcctgctcgctgccctcctgttcgccgtgcatcccgttcacactgagtgcgtggcaggagtcgtggggcgagcagatctcctctgcgccctgttctttctccttagcttcctgggatactgtaaggctttccgcgaatcgaacaaggagggagcccattcttctacattttgggttctgcttagcatttttctgggggcggtcgctatgctctgcaaagaacaagggatcacagtgttgggtttgaatgcagtattcgacatcctggtgatcggcaagttcaatgtgctggagatcgttcagaaggtgctgcataaggataagtcactggagaacttgggtatgttgcgcaatggcggtctactctttagaatgaccctgctcaccagcgggggcgccggaatgctttacgtcaggtggcgtataatgggaacgggacctccagctttcaccgaagtcgacaatcctgcaagcttcgcggattctatgctcgtaagggccgtgaattacaactactattattcactcaatgcctggttactgttgtgcccatggtggctgtgcttcgactggtcaatggggtgcatcccactgattaagtctataagcgattggcgcgtcatagctctggccgccctgtggttctgcttaatcggtctcatttgccaggctttatgctccgaagatgggcataaacgccgcattctcacgcttggcctcggttttctggtgatcccatttctccccgcttctaatctgtttttcagagtgggtttcgtggtcgccgagcgtgtactgtatctgccctccgtcggctactgcgtgctgctaacattcggttttggtgcgttatccaagcacactaagaagaaaaaactgatcgccgcagtggttctggggatcctcttcatcaacaccctgagatgcgtgctgaggtcgggagagtggagaagcgaggagcagctgttcagatcagccttgtcggtctgtccgctgaacgccaaagtgcactataatattggtaagaatctggccgataagggcaaccagaccgctgcgattagatactatagggaagccgtgagactgaaccctaaatatgtgcacgctatgaataatctggggaacatcctgaaggaaagaaatgaattgcaagaagcagaagagctgctgagcctggccgtgcagatccagccggatttcgctgccgcctggatgaacctgggcatcgtccagaacagcctgaaaaggtttgaggctgctgagcagtcatatcggacagccattaaacatcgacgcaagtatccagattgttattacaatcttggaaggctgtatgccgacttgaatagacacgtggacgccctgaatgcttggagaaatgctacggtgctgaagccggaacattcccttgcctggaataacatgataattctgttggacaatacggggaacctggcgcaggccgaagccgtaggccgcgaggccttggagctaattccaaatgaccacagtctgatgtttagcctcgccaacgtgctgggcaagagccagaaatataaggagtcagaggccctgtttctgaaggctatcaaagccaatccaaacgcggctagctatcacgggaacctcgcggtcctgtatcacagatggggacatcttgacctggctaagaagcactatgagatttctttgcagctggaccctaccgcttccgggacaaaggagaactatggactgcttagaagaaagctcgagctcatgcagaagaaggctgtgtag

SEQ ID NO: 31018 - DNA, 2226 bp, Artificial Sequence
  Description of Artificial Sequence: Synthetic coding sequence
atggccgtcctcgacacagatctggatcatattctgcccagcagtgtgctgccccctttctgggctaaacttgtggtggggagcgtggcaattgtatgctttgctcgaagttacgacggggactttgtcttcgacgactctgaggcgatcgtgaataataaggacctccaggctgaaacccctctgggagacctttggcaccacgacttctgggggagcagactaagtagcaatactagtcataaatcgtatcgccctttgactgtcctaacttttcgaatcaattattacttgagtggaggttttcatccagttggattccatgtcgtgaacattttgctgcactccggaatctccgttttgatggtggacgtgttttccgttttgttcggagggttgcagtatacgagcaaaggtagaagactccatctggccccgagggcctctcttctggccgcgcttctgtttgcagttcacccggtccacaccgagtgcgtcgccggtgttgtgggccgagccgaccttttgtgtgcactgtttttcttgctgagcttcctgggctattgtaaggcttttcgtgagtcgaacaaagaaggggcccatagctccactttctgggtcctcctctccatattcctcggagccgtggccatgctgtgtaaagagcagggaatcactgttctgggactcaatgcagtctttgacattcttgttatcgggaaattcaatgtcctggagatcgtgcagaaagtcctccacaaagacaaaagcttagagaacctcgggatgctgcgcaacggaggcctcctctttcggatgacccttctgacatcaggcggggctggcatgttgtacgtgcggtggcgtatcatgggcactgggccccctgctttcaccgaagtggacaacccagcttcgtttgcagactctatgctggtgcgcgcagtcaattacaactattactacagcctcaatgcttggctgctcctttgtccatggtggctatgtttcgattggtccatgggatgtatccctcttatcaaaagtattagcgattggagggtaatcgcgctggccgctttgtggttttgcctgattggattaatttgccaggccctttgctctgaagacggccataaaaggagaatcctgaccctgggccttggcttcttggtgatcccttttttgcctgccagcaacttgttctttcgagtgggattcgtcgtggccgaacgcgtcttgtatctcccgtccgtgggatactgcgttctactcacattcggattcggtgcacttagtaagcatacaaagaaaaagaaactcatcgccgcggttgtcttgggtattctgttcatcaacacactgcgctgcgttctgcggagcggcgagtggcgtagcgaggaacagcttttccgcagcgccctgagcgtgtgccccctgaacgccaaagtgcactataacatcggcaaaaatctggctgacaaagggaatcagacagccgccattcgatactacagggaggccgtccgactcaatccaaagtacgtgcacgctatgaacaatctcggaaatattctgaaagaacgcaatgaactgcaagaggctgaggagctgctctcactggctgtgcagattcaacccgacttcgctgcggcttggatgaatctgggaatcgtacagaacagtctcaagaggtttgaggcagccgagcaatcataccggactgcaataaaacatagaagaaagtatcccgactgctactataacctcggccgcctttatgcggatctcaatagacatgtggacgcccttaatgcctggcgaaacgcaacagtgctgaaaccagaacactcacttgcctggaacaacatgatcatactcctggacaatacagggaatctggcccaggccgaggccgttgggcgggaagctctcgaattgatccccaatgatcacagcttgatgttctccctagctaacgtgctgggaaaatcacagaagtacaaggagagcgaagccctgtttctcaaggctattaaggccaaccccaacgctgcctcttaccacgggaacctggctgtcctatatcaccggtggggacatttggacctggccaagaagcattatgagatctcgctgcagcttgatcccactgctagtggaacaaaagagaactacggcttgttgcgtagaaaattggaactcatgcaaaagaaagcagtgtag

SEQ ID NO: 31019 - DNA, 165 bp, Artificial Sequence
  Description of Artificial Sequence: Synthetic coding sequence
atggctgtgttggatacagatcttgatcacatactgccgagttctgtgctgccaccattttgggccaagctggttgtggggagcgttgccatcgtgtgcttcgctcgctcttacgacggcgattttgtgttcgatgatagcgaagcgatcgttaataacaagtag

SEQ ID NO: 31020 - DNA, 222 bp, Artificial Sequence
  Description of Artificial Sequence: Synthetic coding sequence
atgattcctaatcagcataatgcgggggctggatctcatcagcccgcggtcttccgaatggcagttctggatactgacctggaccatatcttacctagctcagtcttgccgcctttttgggctaaactcgtagtaggctctgtggctattgtctgctttgcccgaagttacgacggcgacttcgttttcgatgactccgaggccatcgtgaataataagtag

SEQ ID NO: 31021 - DNA, 741 bp, Artificial Sequence
  Description of Artificial Sequence: Synthetic coding sequence
atgactctgatcgaaggggtaggggacgaagtgactgtgctgttttccgtgctggcctgtcttttggttcttgctctggcatgggtcagcacacatactgccgaagggggcgaccccttacctcagcccagcggaaccccaactccaagccaaccctctgctgctatggccgctacagactctatgcgaggcgaagcccccggtgcagagacaccctcgctccgccaccggggacaggcagctcagccagaaccttctacagggtttacagcaacacctcctgcgcctgacagcccgcaggaacctctggtgttgcgcctgaagtttctgaatgacagtgagcaggtggcccgggcctggccccacgacacgatcggttctttgaaacggacgcaatttcctgggcgcgagcagcaggtccgactcatctaccagggacaactcttgggtgacgacacccaaaccctgggttcactgcacctcccacctaactgcgtgctccactgccatgtcagcacaagggttgggccaccaaaccctccctgcccacctggttcagagccagggccttccggcctggaaatcggctctctcctgctacccttgctgttgctgcttctgctcctgctatggtactgccagattcagtatcgccccttcttccccctcacagcgacccttggtctagccgggtttaccctgttgctatcacttctagcctttgctatgtatcgcccctag

SEQ ID NO: 31022 - DNA, 741 bp, Artificial Sequence
  Description of Artificial Sequence: Synthetic coding sequence
atgaccttgattgagggagtcggggacgaggtgaccgtcctgttctccgtactggcctgcctgttggtgctcgctctggcatgggtcagcacgcacaccgcggagggcggcgaccccctgccccagccttcgggcacccctacgccatcgcagccatcagccgcaatggcagcgacagacagtatgcgaggcgaagcccctggagctgagacaccatccctgcggcaccgtggtcaggccgcacaaccggagcctagcacgggctttaccgcaacacctccagccccggacagtcctcaagagcccttggtccttaggttgaagttcctgaacgattcagaacaagtggctcgagcctggccgcacgacactatagggagtttgaaacgcacccagttccctggcagggagcagcaggtgagactcatctaccagggccaactcctgggcgatgacacccaaacgctcggatctcttcatctcccgcccaactgcgtcctacattgtcatgtctctaccagagtcggccctccaaacccgccctgtcctcccggctcagagccaggaccttcaggactggaaattggctcattgctcttgcctctcctcctgttgcttctgctgctcctgtggtactgccaaatccaatatcgtccttttttcccattgacagctaccttagggctggcaggctttaccttgctgttaagccttctggctttcgcaatgtaccgcccctag

SEQ ID NO: 31023 - DNA, 741 bp, Artificial Sequence
  Description of Artificial Sequence: Synthetic coding sequence
atgaccctgatcgagggcgtgggtgatgaagttactgtcctgttctctgtactggcttgtttgctcgtcctggcccttgcgtgggtgagcacacacactgcagaaggaggtgaccccttaccacaacccagcggcaccccaaccccttctcaacccagtgccgccatggccgctacagactccatgaggggtgaggctcccggggccgagaccccaagtctgcgccaccgcggacaggcggcacagccagaacctagcaccggtttcaccgccactccaccagccccagactcaccacaagagcccctcgtgctgagactgaaattcctgaatgacagcgaacaagttgcacgtgcctggccccatgataccatcggaagcttaaaacgtacccagttccctggtagagaacagcaggtccggctgatttatcaggggcagttgttgggcgatgacacccagaccctcggcagcctgcacctgccaccaaactgcgtactgcactgtcacgtgtccacacgggtgggccccccaaatcctccatgcccccccggctcggaacctggcccttccgggttagaaataggcagtctcctgctgcccctcctcctactcctcttactcttgttgtggtactgccagattcagtaccgcccattcttccctctcacagccactctgggcctcgcagggtttacacttttgcttagccttttggcgtttgccatgtaccgtccatag

SEQ ID NO: 31024 - DNA, 741 bp, Artificial Sequence
  Description of Artificial Sequence: Synthetic coding sequence
atgacgctcattgaaggagtgggtgacgaagtcaccgttctgttctccgtcctcgcatgtttgctggtgctcgctttagcctgggtctcgacccatactgccgaagggggtgacccactgccacaacctagcggcacacccacccctagccagccctccgctgcaatggcagcaaccgacagcatgaggggtgaagccccaggcgcggagacccctagcctgcggcacagggggcaagcagcccagccggaaccaagcacaggctttacggccacgcccccagcccccgattcccctcaagaacctttggttctcaggttaaaatttctaaacgactccgaacaggttgcccgcgcttggccccacgatacaattggtagcctgaaaagaacgcagttcccagggagggagcagcaggttcgcctgatctaccagggccaattgcttggcgacgacacacagacactcgggtcacttcatctgcctccgaactgcgttctacactgtcacgtgtccactcgcgtgggtcctcccaaccccccttgtccccctggctcggaacctgggccatcgggcctcgaaattgggagcctgctgctgcctctgcttctgctgctcctccttcttctttggtattgtcagattcaatatcgtcctttctttcctttgaccgctacacttggtctggctggcttcacactgctccttagcctgcttgcgttcgctatgtacagaccatag

SEQ ID NO: 31025 - DNA, 741 bp, Artificial Sequence
  Description of Artificial Sequence: Synthetic coding sequence
atgaccctcattgagggagtgggtgacgaggtcactgtcctgttctctgtccttgcttgcctgcttgtgctggcgctcgcctgggtgtccacacacactgctgaggggggtgatccgctgccacagccgtccggtaccccaacgccgagccagcccagcgccgctatggccgccacagattccatgagaggggaggccccgggagctgagacacctagcttgaggcacagaggccaggccgcccaaccagagcccagtactgggtttaccgcaaccccacccgcccccgactctccacaggaacccctcgttctcagattgaagtttctcaatgacagcgagcaggtggccagagcgtggccccacgatactataggctccttgaagcgaactcagttccctggccgcgaacaacaggtgcgccttatttaccagggccagttattgggagatgatacgcaaactctaggtagcctgcaccttcctcctaattgcgtgctgcactgccacgtttctacacgggtggggcctccgaaccctccatgtcccccaggatcagagccagggcccagcggactggaaattggaagtctgctactgccactccttcttttgctccttttactcctctggtactgtcagatacagtaccgcccatttttccccctgaccgcaacactcgggcttgccggattcacactgcttttgtcactcctcgcatttgcgatgtaccgcccatag

SEQ ID NO: 31026 - DNA, 516 bp, Artificial Sequence
  Description of Artificial Sequence: Synthetic coding sequence
atgaccctcatcgagggggtcggggacgaagtcaccgttctgttcagcgtgctggcctgtctgttagtgctggctttagcctgggtgagcactcacacggcggaggggggcgacccgctaccccaaccatctggcacccccactcctagtcaaccctcagcagcgatggctgcaactgattcaatgcgcggagaagctcccggggccgaaactccctctcttagacaccggggacaggctgcccagcctgaaccctccacaggttttaccgccacaccacccgctccagattcaccccaggagccactagtcctccgactgaaatttcttaacgatagtgagcaggttgcaagagcatggcctcacgatactattgggagtctgaagcgaacgcaatttcccgggcgggagcagcaggtgcgactcatttatcagggacagcttctcggcgacgacactcaaactcttggctcattacatctccctcctaattgtgttttgcattgccatgtgtag

SEQ ID NO: 31027 - DNA, 459 bp, Artificial Sequence
  Description of Artificial Sequence: Synthetic coding sequence
atgaccctaatagagggggtgggagacgaagttacagtgctgttttccgtgctagcttgcttgctggttcttgccctggcctgggtttcaactcataccgctgaggggggcgatccgttgccccaacctagcggcacccccacaccctctcagccctccgcggctatggccgcaaccgactctatgagaggtgaggcacctggtgctgagacacctagcttaaggcacaggggccaggcagcacaaccagagccttccactggtttcaccgcgactccgccagcgccagatagccctcaagagcctcttgtgctacgacttaaatttctcaatgattcggaacaggtcgctcgagcctggccccacgatacaatcgggtccctcaaaagaacgcagttccctggcagagagcagcaggtgaggctcatttatcaggggcagcttcttggagacgactag

SEQ ID NO: 31028 - DNA, 906 bp, Artificial Sequence
  Description of Artificial Sequence: Synthetic coding sequence
atggaactctctgacgtgaccctgattgaaggagttggaaacgaggtgatggtggtcgcaggcgtcgtggtactcatactggcactggtgctggcctggttatccacttatgttgccgacagtggttccaaccagctgttaggcgccatcgttagcgccggcgacacttctgtgctgcaccttggacacgtcgatcacctcgtcgcaggccaaggcaaccccgagcccacagagctgcctcatccttcagaggggaatgacgagaaggcagaagaggctggcgagggaagaggcgattcaacaggggaggctggcgctggtggaggcgtggagccatcgcttgaacacctgctggatatccagggcctccccaagagacaggcgggcgccgggtctagttcacccgaagccccactgagatctgaggatagcacgtgcctccctccttcccccggacttatcactgtgcgcctgaaattcctcaacgacaccgaggagctggcagtagctcgcccggaagacacagtgggagccttaaagtcaaaatattttcccggccaagagtctcagatgaagctgatttatcagggaaggctcctccaggacccagctcggaccctcagatctctgaatataacagacaattgtgtgatccattgccaccggagcccaccgggtagcgccgtacccggtccttcggccagtttagcccctagtgctacagaaccccccagcctgggcgtcaatgtgggctccttgatggtgcctgtcttcgtcgtgctgttaggcgtggtttggtactttcgcattaattataggcagttttttactgcaccggccaccgtctcactggtcggggtaactgtctttttttcattcctagtgttcggtatgtacgggcgctag

SEQ ID NO: 31029 - DNA, 906 bp, Artificial Sequence
  Description of Artificial Sequence: Synthetic coding sequence
atggagctgagtgacgtgactctgatcgagggcgtcggcaacgaggtcatggtggtcgctggcgtggtcgtcctgatcttggcactcgtgctggcttggcttagcacatatgtcgctgactccgggtctaaccagctgctcggggccatcgtgtctgctggagacacttcagttctgcacctcggccatgtggatcacctggtggccggtcagggcaacccagaacccaccgaattgccccacccctcggaaggtaacgatgaaaaggccgaagaagcaggcgagggtcggggggactctacgggcgaggctggagccggagggggagttgaaccttctctggaacatctcttggatatccaggggctgcctaagcgtcaggccggtgcaggatcaagcagtcccgaggcacccctccgcagcgaggattcaacctgtctgccaccatcgcctggtcttattacagtgcgcctgaaatttctgaacgacaccgaggagctcgctgttgcccggcccgaagataccgtcggagcactcaaatccaagtacttcccagggcaggagtctcaaatgaaactgatatatcaggggcgattgctgcaagacccagctcgtaccctcaggagcctaaacatcacagataactgtgtaatacactgccacaggtctccaccgggcagtgccgtcccaggcccctccgcctcactggccccgtctgctacggagcctcctagcctaggggtcaatgtaggtagtcttatggtaccagtttttgtggtacttctcggcgtggtgtggtactttaggatcaattatcggcagttctttaccgcccccgcaacggtaagtctggtcggggtgaccgtgttttttagtttcttagtatttggtatgtatggacggtag

SEQ ID NO: 31030 - DNA, 795 bp, Artificial Sequence
  Description of Artificial Sequence: Synthetic coding sequence
atggaattgtcagacgtgactctgattgagggggtcggcaatgaggtgatggtcgtggctggtgttgtcgttctgatcctggccctggttttggcatggcttagtacctatgtcgctgatagcggatccaatcagctgctgggcgccattgtcagcgccggcgatacttctgtgctgcatctcggtcacgtggaccatttggtggcaggacaggggaatccagaacccaccgaactgccacatcccagcgaagggctgccaaagagacaggctggtgcagggtcctctagcccagaggcgccgctccgaagcgaagatagcacatgtttacctccatccccagggctcatcaccgttcggctgaaatttctcaacgataccgaggaacttgccgtagcaagaccggaggacaccgttggagccctcaagtccaaatacttccccggccaagaaagccaaatgaagcttatctatcagggccgcctcctacaggaccctgcaaggactttgcggtctctgaacatcacagataactgcgttattcactgccatcgtagtccacccggaagcgcagtgccaggtccgtccgcctctttagcaccttccgccacagagcctccatccttgggagtgaacgtcgggtccctgatggtccccgtgtttgtggtgctgctgggagtggtgtggtactttaggatcaattatagacaattttttaccgctccagccaccgtcagcctggttggcgtcacggtgtttttttctttcctggttttcgggatgtatggccgatag

SEQ ID NO: 31031 - DNA, 966 bp, Artificial Sequence
  Description of Artificial Sequence: Synthetic coding sequence
atgataagtaggcacctgcagaataatctgatgtccgtggaccctgcaagctctcaggccatggaactgtccgatgtaacattaattgagggcgtgggtaacgaggtgatggtggtagcaggcgtcgtcgtgctgatactggcacttgtccttgcctggctgtcaacctatgtggcagactccgggtcaaaccagttgttgggcgcaatcgttagtgctggagacacttcggttctccacctgggacatgtggatcatctggtggcgggacaaggcaatccagaaccaactgagctgccccatccttccgagggaaacgacgagaaagccgaggaagccggggagggaaggggtgattctacgggtgaggcaggcgcaggtggtggggtcgaacccagcttagagcacctgctcgatatccagggacttcccaaaaggcaggcgggcgccgggtcatccagtcctgaagctcctctgcggtcggaagacagcacatgccttcctccatcaccaggcctaattaccgtgcgcctgaaattcctcaacgacactgaggagctcgccgtggcccggcccgaggacactgtgggggctctcaagtccaagtatttccccggccaagaaagccagatgaaactgatctatcaagggcgtttgctccaggatccagcgcggactctcagatccctcaacatcactgacaattgcgtcatacattgtcaccgatcaccacccggatctgctgttcccggaccctccgcctccctggccccatctgccacagaacctcctagtctgggagtcaacgtgggctccctgatggttccagtgttcgtggtcctcttgggtgtagtttggtactttcggatcaattaccgccagttcttcaccgctcctgccaccgtaagtcttgtgggggtgaccgttttctttagtttcttggtttttggaatgtacggccgttag

SEQ ID NO: 31032 - DNA, 936 bp, Artificial Sequence
  Description of Artificial Sequence: Synthetic coding sequence
atgtccaacccaagcgccccacccccttacgaagatcgcaaccccctctaccccgggcctcctccacccggaggctacggccaaccctctgtcctgcctggaggttaccccgcctaccccggatacccgcaaccagggtacggccaccctgcaggctacccacagccgatgcctcccacccaccccatgcctatgaattatggtcctggccacgggtacgatggggaagagcgtgcagtgtcagattcctttggccccggcgagtgggacgaccggaaagtccgtcatacattcattcgtaaagtatacagcatcataagcgtgcaactgctaattacagtcgccattattgcaatctttacttttgtggaacccgtctctgcgttcgtgagacgcaatgtggccgtgtattatgttagttatgctgtgtttgttgttacgtacctcatactcgcttgttgccagggtcccaggagaaggtttccttggaatattatcctgctcactctgttcacctttgcgatgggattcatgacaggaacgatttcgtcgatgtaccagacaaaggctgttatcatcgctatgattattaccgctgtggtcagtatttccgtaactattttctgcttccaaacaaaggtggatttcacctcttgtaccggactcttttgtgtgcttggcattgtgctacttgtcactggcattgtgacatccatagtgctgtactttcaatacgtgtactggctgcatatgctgtacgcagctctcggagcaatctgcttcaccttatttctcgcttatgacactcagctggtgctcggtaacaggaaacatactatatcacccgaagactatattacaggcgctcttcaaatttataccgacattatttacatcttcacattcgtgctgcagctgatgggcgatcggaattag

SEQ ID NO: 31033 - DNA, 936 bp, Artificial Sequence
  Description of Artificial Sequence: Synthetic coding sequence
atgagtaatccatcggcacctccgccgtacgaggaccgaaaccccctgtatccaggcccccccccacctggggggtatgggcaaccctccgtgcttccggggggatacccggcgtatcccggatatcctcagcctggctacggtcaccccgctggataccctcaaccaatgcctcccactcatcccatgcctatgaactacggccctggccacggatacgatggcgaagagcgggcagtatcagattccttcggtccgggggaatgggacgatcgaaaggtgaggcatacgttcattaggaaggtatattccattattagtgtgcaactgttgataaccgtggcaattatcgccatttttactttcgtggagccagtgagcgcgtttgtgcggcgtaatgtggccgtatactatgtctcatatgccgttttcgtggttacttacttaattctcgcttgctgtcaggggccaagacggcgctttccttggaatataatcctgctaaccttatttactttcgctatgggctttatgacgggcactataagttccatgtaccagacaaaggctgtcattattgcaatgatcattacggccgtagtgagcataagcgttaccattttttgcttccagaccaaagttgacttcacctcatgtactggtttattctgtgttcttggcattgttctattagtgactgggattgtcacttctatcgtgctgtacttccagtatgtttattggctgcacatgctatacgcagccttaggcgccatatgctttacactatttctcgcctacgatacacaattggttctgggcaatcgaaagcatacgataagccccgaggattacattaccggcgccctgcaaatctacacagacatcatttatatcttcacttttgtgcttcagctcatgggcgatagaaattag

SEQ ID NO: 31034 - DNA, 141 bp, Artificial Sequence
  Description of Artificial Sequence: Synthetic coding sequence
atgtccaacccatcggcacccccgccttacgaggataggaatcctctgtatcctggcccgccccctcccggcggctacggccagcctagcgtgctaccaggcggctaccccgcataccctggataccctcagccaggttag

SEQ ID NO: 31035 - DNA, 456 bp, Artificial Sequence
  Description of Artificial Sequence: Synthetic coding sequence
atgtccaacccaagcgccccccctccttatgaggatcggaatcccctgtacccgggtcctccgccacctggcggttacggccaaccatcagtgctgcctggcgggtatccagcctatcctgggtatccccagccgggatatggccaccccgctgggtatccccagccaatgcccccaacccatccaatgcccatgaactacggaccaggccacggatatgacggggaggagcgagctgtttcagattctttcggcccgggggagtgggacgacaggaaagtgcggcacacattcatccgcaaagtgtacagtatcatttctgtccagttactgattaccgtggctatcatcgccattttcacttttgtggaacctgtgtctgcattcgtgcgccgcaatgtcgcggtttattatgtctcgtacgctgtgtttgttgtcacatatctgattctgtag

SEQ ID NO: 31036 - DNA, 27 bp, Artificial Sequence
  Description of Artificial Sequence: Synthetic coding sequence
atgtctaaccccagtgcaccaccttag

SEQ ID NO: 31037 - DNA, 504 bp, Artificial Sequence
  Description of Artificial Sequence: Synthetic coding sequence
atgtccaacccctctgccccacctccttatgaggaccgaaaccctctttaccctggtccccctcctccaggtgggtacggccaaccctccgttctcccaggcgggtatcctgcctatcctggatatccccagcctggatatggacaccccgcaggctacccacagccgatgccgccaacacacccaatgcccatgaattacggaccgggccatggatacgacggggaagagcgagccgtatcagattcatttggtcctggcgagtgggacgaccgcaaggtgcgtcataccttcattcggaaagtttacagtattattagtgtgcaacttctgattactgtcgccatcatcgccatcttcacgtttgtggagccagtgtccgcttttgtacggcggaatgttgccgtctactatgtaagttacgctgtctttgtggtcacttacctcattctcgcgtgctgccaaggtccccgacggagattcccatggaatatcattctctag

SEQ ID NO: 31038 - DNA, 516 bp, Artificial Sequence
  Description of Artificial Sequence: Synthetic coding sequence
atgtcaaatccttctgcccctccaccgtacgaagacaggaatccactgtatcccggccccccgcctcctggaggctatggacagcctagcgtgttaccaggtggttatcctgcttatccgggttacccacagcctggctacggtcacccagcgggttatcctcagcccatgccccccactcatcctatgcctatgaactatggtccgggtcatgggtacgatggcgaggagagggctgtcagtgactccttcggccccggagaatgggacgacaggaaggttcggcatacgttcatcagaaaggtgtatagtatcataagcgtacagttgctgatcaccgttgccattattgctattttcacgtttgtggaaccagtgtccgcatttgtcagacgtaacgtggcagtgtactacgtgtcgtacgccgtgttcgttgtgacctatttgattctggcttgctgccagggaccccggaggcgctttccttggaatatcatcctcttgaccctcttctag

SEQ ID NO: 31039 - DNA, 207 bp, Artificial Sequence
  Description of Artificial Sequence: Synthetic coding sequence
atgtctaatccgtcagctccacctccttatgaagataggaacccactctaccccgggccccctccacccgggggatacggtcagcccagcgtgctgcctggagggtaccccgcgtacccaggttatccacagcctggctacggccaccccgcgggttatccacagcctatgcctccaactcaccctatgccaatgaattacggttag

SEQ ID NO: 31040 - DNA, 648 bp, Artificial Sequence
  Description of Artificial Sequence: Synthetic coding sequence
atgtctaatcctagcgctccacccccttacgaggaccgcaatccactataccctggaccgccgccccccggcgggtacggccagcccagcgtgctgcccgggggatatcctgcttacccagggtacccccagcccgggtacggacatcccgcaggctacccgcaacctatgccccccacacaccctatgcccatgaactacggaccaggacacggctacgacggagaggagcgggccgtgtccgattcatttggacccggagaatgggatgatcggaaggtaagacatacattcattcggaagggcacctgtcagaggctgtgtgaggagaagtgcggctgtctgctcagggtgctctgttgcttacgatgtcatctccccgacccctgcctccttccaggaacacagacccccttcccaatggaacaccattccgctgatcccttctacttttgtcatggccttcacgatggccaccactttcagtacgttccaaatcagtctcggcatcactgcaatgaccatcattgcggcggtattcatttttcacaccatctgctcctgtcagaccaagggggccttcatcttgtccaccggcctctgctgtgtcctgggaactgtgctcctggagattgggactgccactag

SEQ ID NO: 31041 - DNA, 324 bp, Artificial Sequence
  Description of Artificial Sequence: Synthetic coding sequence
atgagcaatccctccgcgccgcccccctacgaggatcgtaatccattatatcctggaccccctccacccggcggatacgggcagccttccgtcttgcccggggggtatccagcttacccaggttacccacagcctggatatggacatcccgctggttatccccaaccaatgcctcctactcatcctatgcccatgaattacggccctggtcacggctatgatggagaggagcgggccgtctccgactccttcggccctggcgagtgggatgacagaaaggttagacatacgttcattcgtaaggtgtattctatcatttcttag

SEQ ID NO: 31042 - DNA, 273 bp, Artificial Sequence
  Description of Artificial Sequence: Synthetic coding sequence
atgagcaatccctctgctccacccccctacgaggacaggaaccccctgtatcctggccctccaccgcctggtggttatggccagccatcagtacttccgggggggtaccccgcctatcctggttatccccaaccaggctatggacatccagccggctatcctcaacccatgccaccaacccaccctatgcccatgaactacggaccaggacacggctacgatggcgaggaacgtgcagtgtcagactctttcggtccgggggaatgggactag

SEQ ID NO: 31043 - DNA, 321 bp, Artificial Sequence
  Description of Artificial Sequence: Synthetic coding sequence
atgtccaatccatcagcgcctcctccatacgaggatcgtaacccgctctacccaggtcccccaccgcctggcggatacggccagcctagcgttttgccaggcggctatcctgcctatcctggctacccccagcctggttatggacacccggccggatacccacagccaatgcctcccacccatcccatgcccatgaattacggccccggccatgggtatgacggagaggagcgcgctgtatctgacagtttcggtcctggtgagtgggatgataggaaggttcgccacaccttcatacgaaaggtctattctataatatag

SEQ ID NO: 31044 - DNA, 936 bp, Artificial Sequence
  Description of Artificial Sequence: Synthetic coding sequence
atgtctaatccgagtgctccccctccatacgaagaccggaaccctctgtaccctggacctccccctcccggggggtacggacaaccttcagttctgcctggcggctacccggcttacccgggttatccccagcctggctatggccaccccgccggatacccgcagcccatgccacccacccaccccatgccgatgaattatggtccagggcacggatatgacggcgaagagagggctgtgtctgacagcttcggacctggagaatgggatgacagaaaggtgcggcatacttttatcaggaaggtgtactccataatcagcgttcaattgctcatcactgtggccatcatagcaatcttcaccttcgtagaacccgtcagtgcgtttgtgaggaggaacgtggcagtgtactatgtgagttatgcagtttttgttgtgacgtatctcatcttagcctgctgtcaaggcccccgccggcggtttccttggaatatcatcttgctgacgctatttacttttgccatgggctttatgactggcaccatttcaagcatgtaccagaccaaagctgtcattatcgctatgattatcacagcagtcgtgtcaataagtgtgacgattttctgttttcagactaaggtcgacttcaccagctgtaccggactgttttgcgtactgggtatcgttcttctcgtgacgggcatcgttacgagtatcgttttgtatttccagtacgtgtactggttgcacatgctgtacgccgccctcggggctatttgctttaccctgtttttggcatacgacactcagctagttttggggaatcgcaaacataccataagtcccgaggattacatcacaggggctctgcagatttacacagatataatttacatttttacgttcgtccttcagcttatgggagataggaactag

SEQ ID NO: 31045 - DNA, 414 bp, Artificial Sequence
  Description of Artificial Sequence: Synthetic coding sequence
atggggttcatgaccggcacgatctccagcatgtatcagactaaagctgtgatcatcgcaatgataattaccgcggtggtaagtatttctgtgacgatcttttgcttccagaccaaggtagatttcaccagctgtacgggcctgttttgtgtgctcggcatagtcttactggtgacaggcatcgtcacatccatcgtgctgtactttcagtacgtctattggctgcacatgttatatgcagccctcggcgccatttgtttcacccttttcctcgcttacgatacccagttggtgcttggcaatcgcaaacacaccatatcccccgaggattatatcacaggggctctgcagatttacacggacataatatatatcttcacatttgttctgcaactgatgggggatcggaactag

SEQ ID NO: 31046 - DNA, 222 bp, Artificial Sequence
  Description of Artificial Sequence: Synthetic coding sequence
atgtctaatccttctgccccacctccctatgaagatcgcaaccccttatatcctggacccccccccccaggaggctatgggcagccaagtgtcctgccaggcggttaccccgcctaccccggctacccccagccaggctacggacatcctgcaggctatcctcagccaatgccacctactcaccccatgccaatgaactatggacctggtcacggctattag

SEQ ID NO: 31047 - DNA, 255 bp, Artificial Sequence
  Description of Artificial Sequence: Synthetic coding sequence
atgtcgaacccttcagcccctcctccttatgaagacaggaacccactgtaccctggccctcctcctccggggggttatggacagccgagcgtgctgcctggcggataccctgcttatcccggatatccacaacctgggtatgggcatcctgctggctacccacagccgatgcctcccacccatcccatgccaatgaactacggtcccggccatggatacgatggcgaagagagggctgtgagcgattcattttag

SEQ ID NO: 31048 - DNA, 279 bp, Artificial Sequence
  Description of Artificial Sequence: Synthetic coding sequence
atgagtaacccttccgcacctcccccttacgaggaccggaatcccttgtaccccggccctccccctcctgggggatacggccaaccttccgtcctgccaggaggataccccgcataccccgggtaccctcagcctggctacggacaccccgcaggttacccgcagccaatgccccctactcaccccatgcctatgaattatggacctggtcacggctacgatggggaggagcgcgcagtttctgactcattcggacccggtgagtgggacgatcgatag

SEQ ID NO: 31049 - DNA, 750 bp, Artificial Sequence
  Description of Artificial Sequence: Synthetic coding sequence
atgccaatgaactacggacctgggcacggttatgatggcgaagagagggcagtgtctgacagctttgggccaggtgagtgggatgatcgcaaagtacgccatacattcatccgtaaggtgtactctattatcagtgttcagctgctcatcaccgtagcaattatcgccattttcacgtttgtagagccagtgagcgcctttgtccgaagaaatgtcgccgtgtattatgtaagttatgctgtgtttgtcgtgacgtatcttatacttgcttgttgtcaagggcctagacggcgtttcccctggaacatcatcctcctcacactgttcacattcgcgatgggtttcatgaccggcactatcagctcgatgtaccagactaaggctgtcatcatagccatgatcatcactgctgtggtttccatatcagtaacaattttttgttttcagactaaggttgactttacaagctgtacaggattattttgtgtgttgggcattgtgttactggtaactggcatcgtgacgagcatcgtcctctacttccagtacgtatattggctgcatatgttgtacgcagctcttggagctatttgtttcacactatttctggcatacgatactcagctggtgctgggtaatcgaaagcacacaatctcccctgaggattatattacaggcgctctccagatctatacagacataatttatatttttacattcgtcctccaattaatgggggaccggaattag

SEQ ID NO: 31050 - DNA, 717 bp, Artificial Sequence
  Description of Artificial Sequence: Synthetic coding sequence
atggctgaccccgacccaaggtatcctaggtcctcgattgaagacgactttaactatgggtcatctgtcgcatcagcaacagttcatatccggatggcttttctccgcaaggtctacagcatcctttctctgcaagtactgctcacaaccgtaacgtcaaccgtctttttgtacttcgaatcagtccggacattcgtccacgagagccctgctttgatcctgctgttcgccctggggtcgctgggcctgatcttcgccctaattctgaatcggcacaagtaccccttgaacttgtatttactgtttggctttacgttattggaggcattgacagtggcagtggtcgtgacattctatgacgtttacattattttacaggctttcatcctgacgaccactgttttttttggtttgacggtttataccctgcagagcaaaaaagacttctcgaagtttggggctggactcttcgctctgctttggatcttgtgtctgtccggattcctaaagttctttttctattcagaaatcatggaactcgtgttggctgccgccggtgcactacttttctgcggcttcataatatatgacacgcacagcctgatgcacaagctgagcccagaagaatatgtgctcgctgctatatctttgtacctggatattattaatctgtttctgcatctcttgagattcctcgaggctgtcaacaaaaagtag

SEQ ID NO: 31051 - DNA, 636 bp, Artificial Sequence
  Description of Artificial Sequence: Synthetic coding sequence
atggctgatcccgatcctaggtatccccggtcttctattgaggatgattttaattacggctccagcgtcgcaagcgccacggtgcatattcgaatggcatttttacggaaagtttattctatcctcagtctgcaagtgcttttaactacggtgacatctaccgtattcctgtacttcgagtctgtgcgtacgtttgtccacgagtctccagctttaatcctgctgttcgctctgggctctctggggttgatatttgcgctcattctgaaccgccataaatacccactcaacttgtaccttctcttcgggtttaccctcctggaagccctgaccgttgcggtggtagtcaccttctacgacgtgtatattatcctgcaggccttcatcttaactaccacagtcttttttggactcaccgtctacaccctgcagtctaagaaggactttagcaagtttggtgccggtcagtcagctcttctcgtggatattgtgccagttaggattctcgaagtgtttttctattcagagatcatggagctggtgttagcagccgcaggcgcactgcttttttgtgggtttatcatttatgacactcactccttgatgcataagctctccccaaagagcacatactag

SEQ ID NO: 31052 - DNA, 852 bp, Artificial Sequence
  Description of Artificial Sequence: Synthetic coding sequence
atggcggaccgcccacctgtgccaagcttatcaatcgaagacgattttaactacggaagctcagtggcctcagcaaccgtgcacatccgaatggtgctgcaacgggactgcaccttctccaagcagtacatgcgaatcccgtcagcgccctccgctacacttaatatcatccggtttttccacctcaggcagtccggacggtcgggtatggtaaacattttctataagggacctactttccttcggaaagtgtactctatcctatccctgcaggtattactcactaccgtgaccagtaccgtgttcctatatttcgagagcgttaggacttttgttcacgagagtcccgcccttattctactgttcgcactgggtagtctgggccttatctttgctttgattctgaaccgccacaaatatcccctaaatctctatctcttatttggattcacattgctggaagcgctgactgtggccgtggttgttacattctatgacgtgtatatcatcctgcaagcctttattctgaccactaccgtcttcttcggtctgaccgtctacactcttcagtcgaagaaggacttttccaagttcggcgcaggcctcttcgctctgctgtggatcctttgcttgtcgggattggaggtgttcttttatagtgaaataatggagttggtcctggccgccgcgggggcattactgttctgcggtttcatcatctacgatacccatagtttaatgcacaagctgtctccggaggaatacgtgctggccgccataagtttatacctcgatattattaatctgttcttgcatctgcttaggttcttagaggccgtgaacaaaaagtag

SEQ ID NO: 31053 - DNA, 507 bp, Artificial Sequence
  Description of Artificial Sequence: Synthetic coding sequence
atggcagacccggacccacggtatcctcggagctcaattgaagacgatttcaactacggatcttcagtggcctccgcaacggtgcacatccgcatggcattcctacggaaggtgtatagcatcctgagcctgcaggttcttctgaccacggtgacctctaccgtgtttctctatttcgagtcagtgaggacattcgtgcatgagtcaccggccttaatactgctctttgcgctgggctccctgggactcatctttgccctaatcttgaacagacacaagtatccacttaacctctacttgctttttgggtttacgctcctagaggccctcacggttgccgttgtggtaactttttacgatgtgtatatcatactgcaggcattcatcctcaccaccacagtttttttcggcctcaccgtgtatacactccaatccaaaaaggatttttctaaatttggcgcagggagatgcaggagcccgtctttcttgtggatacaccacttatag

SEQ ID NO: 31054 - DNA, 714 bp, Artificial Sequence
  Description of Artificial Sequence: Synthetic coding sequence
atgaacatcttcgatagaaagatcaacttcgacgcgttgctgaagttcagtcacatcacccccagtactcagcaacatctcaaaaaggtctacgccagctttgcactttgcatgttcgtagccgctgcaggtgcgtacgtccacatggtgacacacttcatccaggcaggattactcagcgccttgggttctctgatcctgatgatctggctgatggcaacaccacattcgcatgagacggaacagaagcggctcggtttgctcgctggctttgcgttcctaaccggtgtgggtctggggcctgcactcgaattctgtatagccgtaaacccttctattctccctactgccttcatgggaaccgcgatgatttttacgtgttttacactgtctgccctttacgcccgaagaagaagctatctatttctgggaggaatcctgatgagcgctcttagtcttctgctgttgtcaagtttggggaacgtcttctttggttcgatttggttattccaagcgaatctctacgtgggcctcgtcgtgatgtgcgggttcgtgctgttcgatacccagctgattattgaaaaggcagaacacggggatcaagactatatttggcattgcattgatttgttcctggacttcatcactgtcttcagaaagctgatgatgatactggcaatgaacgagaaggacaagaagaaggaaaagaagtag

SEQ ID NO: 31055 - DNA, 714 bp, Artificial Sequence
  Description of Artificial Sequence: Synthetic coding sequence
atgaacatcttcgatagaaaaatcaatttcgacgcattgctgaaattttcacatattaccccatcaacacagcagcaccttaaaaaggtgtatgcttcattcgctctctgtatgtttgtcgccgctgcgggagcctacgtgcacatggtgactcattttatccaagctgggctcctgtccgcattggggagcttgatactgatgatctggctgatggcaacgccgcattctcacgaaaccgaacagaagcgcctcggcctgcttgccggtttcgctttcttaactggcgtgggacttggccctgcgttggaattttgcatcgccgtgaacccttccatccttcctactgcctttatgggcactgcaatgatatttacatgcttcactttgtccgccctgtatgctcgaaggcgatcttacttatttcttggagggatattgatgagcgcgttatctcttctgctgctatccagtctcggcaacgtatttttcggcagtatctggttgttccaggcgaacctctacgtaggcttggtcgtaatgtgtggcttcgtacttttcgacactcagttgatcatcgaaaaagctgaacatggagaccaagattatatctggcactgtattgacttgttcctggacttcatcactgtattccgaaagctaatgatgattcttgccatgaatgagaaagacaaaaaaaaggaaaagaaatag

SEQ ID NO: 31056 - DNA, 888 bp, Artificial Sequence
  Description of Artificial Sequence: Synthetic coding sequence
atgagccatagtagtgtcaccagagaagctccccaactgctcagccaaagacagaggcgagaggttaggggagtatgggggtggggttgcctcccagggccgagggggggccccgctctgtttggccttgttacgtttggtcaatctggagattgctgcactgacagtggaacgatgaatatcttcgaccgtaaaatcaacttcgatgcgctccttaagttctcccatatcaccccaagcacacagcagcacctgaaaaaagtttatgcatcattcgccttgtgcatgttcgtcgccgccgccggcgcctacgttcatatggtcactcactttatccaggctggactgttgagcgcactgggtagcttaattctgatgatctggctgatggccacgccccactctcatgagactgagcagaagcgcctaggactcctcgcagggtttgcgtttctgaccggtgtcggactgggccccgctctcgaattttgcatcgccgtgaacccctcaattctacctacggccttcatgggtacagcgatgattttcacttgttttactctttccgccctgtatgctaggaggcggtcttacttgtttcttggtgggattctgatgtctgctctgtcccttctcctgctttcatcactggggaacgtcttctttggatccatttggctgttccaagcaaatctctacgtgggtctggttgtcatgtgtggctttgttctgttcgacacgcagttaataatagagaaggctgaacacggagaccaggattacatctggcactgtatagatctgtttctggattttattaccgtctttagaaaactgatgatgattctcgctatgaatgagaaggataaaaaaaaggagaaaaaatag

SEQ ID NO: 31057 - DNA, 381 bp, Artificial Sequence
  Description of Artificial Sequence: Synthetic coding sequence
atgaatatttttgatagaaaaatcaacttcgacgccctgttaaagttcagccatatcactccatccacacagcagcacctgaaaaaggtttacgctagttttgctctctgtatgtttgtggctgccgctggagcgtacgtccatatggtgactcactttatccaagctgggcttctctccgccctggggtctctgatattgatgatctggctcatggccaccccccacagtcacgaaactgagcagaagcgccttggattactcgccgggtttgcattcctaactggagtgggcctgggacccgcattggaattttgtattgctgtgaacccttctattctgccaacggctttcatggggacagctctcatctcctcatag

SEQ ID NO: 31058 - DNA, 714 bp, Artificial Sequence
  Description of Artificial Sequence: Synthetic coding sequence
atgaacatttttgatcgaaagatcaacttcgacgctctcctgaaattctcgcacatcaccccttcaactcagcagcatctcaaaaaagtctatgcatcattcgccctgtgtatgttcgtggctgctgcaggtgcatatgtccatatggtgactcattttatccaggccggtcttctgtcagcactgggcagcttaatacttatgatttggctgatggcgactccacattcacacgagacagagcagaaaaggctggggctcctggccggtttcgctttcctcactggcgtggggctgggaccagccttagaattctgcattgcagtaaatcctagtatcctgcccactgcttttatggggactgcgatgatatttacgtgttttacactgagtgctctgtacgcgaggaggaggtcttacctatttctcggaggaatcctgatgtccgctctcagcctgctcctgctgagcagtctaggtaacgtgtttttcggatctatctggctgtttcaagctaatttgtacgttggactggtggttatgtgcggttttgtgctgttcgatacccagttaataatcgagaaggcagagcatggggaccaggactatatctggcattgtatcgatctctttttggactttatcactgttttccgtaagcttatgatgatcctggccatgaacgagaaggataagaaaaaggagaagaagtag

SEQ ID NO: 31059 - DNA, 438 bp, Artificial Sequence
  Description of Artificial Sequence: Synthetic coding sequence
atgaacatcttcgacagaaaaattaattttgatgccctgctaaaattctcccacataactcccagtacccagcagcatctgaagaaggtgtatgccagcttcgccctgtgtatgttcgtggccgcagcgggcgcatatgttcatatggtaactcactttattcaggctggtcttctttcagccctcggctccttgatcctgatgatctggctgatggcaaccccacacagccatgagaccgagcagaagagactggggctactggccggcttcgccttcttaacgggggttggactgggccctgcattggaattctgtattgccgttaatccgagtatcctacctactgcttttatgggaacggcaatgatattcacatgctttacgttgtctgcactgtatgccagacgcagaagctacctgtttcttggaggctag

SEQ ID NO: 31060 - DNA, 291 bp, Artificial Sequence
  Description of Artificial Sequence: Synthetic coding sequence
atgaatatctttgacaggaagattaacttcgacgctcttctcaaattttcacatatcacccctagtacccagcagcatttgaagaaggtttatgccagctttgcgctttgtatgtttgtggccgccgccggcgcctatgtccacatggtcacccattttatacaggctggtctcttgagcgccttaggaagcctcatactgatgatctggttgatggctaccccccattcccatgaaaccgagcaaaaaaggctgggccttctggccggcttcgcattccttaccggatag

SEQ ID NO: 31061 - DNA, 291 bp, Artificial Sequence
  Description of Artificial Sequence: Synthetic coding sequence
atgaacatttttgatcgtaagatcaattttgacgcactactgaagtttagccacatcacccctagcacgcaacagcatctgaagaaagtgtacgcttctttcgctctctgcatgttcgtggccgccgcaggggcctatgtccatatggtgacacacttcatccaggctggcttgctctctgcactcggttctcttattctcatgatctggctgatggcaacacctcatagccacgaaaccgaacaaaaaaggctgggcctgctcgcagggttcgcattcctcacaggctag

SEQ ID NO: 31062 - DNA, 417 bp, Artificial Sequence
  Description of Artificial Sequence: Synthetic coding sequence
atgaatatctttgaccgcaaaataaatttcgacgcactgctgaagttttcacacatcaccccttccactcagcaacacttgaagaaagtgtacgcaagcttcgccttgtgtatgttcgtggccgccgctggagcatatgtgcacatggtgactcactttattcaagccggcttactgagtgcactgggctcattgatactgatgatctggctaatggccactccccactctcacgaaactgaacaaaagcgactgggtttacttgccggctttgccttcctgaccggtgtgggtctcgggcccgcattagaattttgcatagcagtgaatccgtccattttaccaacagcctttatgggcactgctatgatctttacatgcttcaccctgtccgccctgtatgcaaggaggcggtag

SEQ ID NO: 31063 - DNA, 393 bp, Artificial Sequence
  Description of Artificial Sequence: Synthetic coding sequence
atgaatattttcgatcgaaaaattaactttgacgccctcctaaagtttagccacataacacctagtacgcaacagcacctgaagaaagtttatgcgagttttgcactctgcatgttcgtcgcagcagcaggagcttatgttcatatggtgactcacttcatacaggcaggtctgctttctgcattaggcagccttatcctcatgatttggttgatggctactcctcacagccacgaaaccgagcagaaaaggctgggactgttggcgggatttgcttttctcactggcgtaggtctcggcccggcactggagttttgcatcgctgttaatccatccatattgcctacagcctttatggggaccgcgatgatcttcacctgcttcaccctgtag

SEQ ID NO: 31064 - DNA, 33 bp, Artificial Sequence
  Description of Artificial Sequence: Synthetic coding sequence
atgaacatctttgacaggaagattaatttttag

SEQ ID NO: 31065 - DNA, 36 bp, Artificial Sequence
  Description of Artificial Sequence: Synthetic coding sequence
atgaatatatttgaccggaagattaatttcgactag

SEQ ID NO: 31066 - DNA, 51 bp, Artificial Sequence
  Description of Artificial Sequence: Synthetic coding sequence
atgaacatcttcgacagaaaaattaacttcgatgctctgctgaaattctag

SEQ ID NO: 31067 - DNA, 270 bp, Artificial Sequence
  Description of Artificial Sequence: Synthetic coding sequence
atgaatattttcgataggaaaattaattttgacgcgctgttgaagttctctcatattacaccaagcactcaacaacacctgaaaaaggtgtacgcatcctttgccctctgcatgttcgttgctgccgccggcgcttacgtccacatggtgacgcattttatccaggcaggtctgttatctgcactgggctcattgatcctgatgatttggttaatggctacgcctcatagtcatgagactgaacaaaagaggctcggactgttggcatag

SEQ ID NO: 31068 - DNA, 714 bp, Artificial Sequence
  Description of Artificial Sequence: Synthetic coding sequence
atgaacattttcgatagaaagattaactttgacgcattgctgaagttttcccacattacgccatccactcagcagcatcttaaaaaggtttacgcctccttcgcactgtgtatgtttgttgccgccgcaggcgcatacgtacatatggttacacacttcattcaggctgggctcctgtctgccctaggctctcttatcctcatgatctggctcatggccaccccacactctcatgagacagagcagaagaggctggggttgcttgctgggtttgcctttctcacaggtgtgggcttgggaccagcactcgaattctgtatcgcggtaaatccctcaatcttgccaaccgcttttatgggcactgcgatgatttttacgtgtttcaccctaagcgctctttatgcgaggcgccgctcttatctctttctcggaggcatcctgatgtctgcccttagcttattgctgttatcatcgctcggcaatgtgtttttcggttctatctggctgtttcaagcaaatctgtacgtgggcctggttgtgatgtgtgggttcgtactcttcgatactcagttgataatcgagaaggccgagcatggcgaccaagattacatatggcattgtattgacctgtttctcgacttcatcacggtgtttcgaaagctcatgatgatcttggcaatgaacgaaaaggacaaaaaaaaggaaaagaaatag

SEQ ID NO: 31069 - DNA, 291 bp, Artificial Sequence
  Description of Artificial Sequence: Synthetic coding sequence
atgaatatctttgataggaagattaatttcgatgccttactgaaattttcccatatcacaccatccacccagcagcaccttaagaaggtgtacgccagctttgctctgtgtatgtttgtggccgccgccggggcctatgtccatatggtcacgcacttcatccaagctggattgctgagtgctctgggcagcttgatcctcatgatctggctcatggctacaccacacagccatgagaccgagcaaaaacgattaggattgttggccggcttcgctttcctgacaggttag

SEQ ID NO: 31070 - DNA, 327 bp, Artificial Sequence
  Description of Artificial Sequence: Synthetic coding sequence
atgaacatttttgaccggaagatcaatttcgacgccctacttaaatttagccatatcaccccatccacccagcaacatcttaagaaagtgtatgccagtttcgccttgtgcatgtttgtcgctgccgctggggcatacgtccatatggtcactcatttcattcaggcggggctgctgtcagctctcggaagcctaattttaatgatatggctcatggccacgccccattctcatgaaacagaacaaaagaggctgggcctgctcgccgggtttgctttcctcacgggagtgggccttggtcccgcactcgagttttgcatcgcctag

SEQ ID NO: 31071 - DNA, 438 bp, Artificial Sequence
  Description of Artificial Sequence: Synthetic coding sequence
atgaatatttttgaccgcaagataaacttcgatgccttacttaagttctctcatatcacacccagcacacagcagcacctgaagaaggtctacgccagtttcgccctgtgcatgtttgtggccgcagcgggagcctacgtgcatatggtcacgcatttcatacaggccgggcttctttctgccctggggtcactgattctaatgatctggctcatggcaaccccccattctcacgagacagagcagaagaggctgggattgctagcagggtttgcctttctgactggggtggggctggggcctgctctcgagttttgcattgcagttaaccccagtattctgcctacagctttcatgggtacagctatgatcttcacttgctttaccctgtctgcgttgtatgcacggcgtcggagctacttatttctgggtggctag

SEQ ID NO: 31072 - DNA, 135 bp, Artificial Sequence
  Description of Artificial Sequence: Synthetic coding sequence
atgaatatattcgatcgtaagattaattttgacgccctgctgaaattcagccatattactccttcaacccagcagcatttgaaaaaagtgtatgcatccttcgccctttgtatgtttgtagccgccgctgggtag

SEQ ID NO: 31073 - DNA, 126 bp, Artificial Sequence
  Description of Artificial Sequence: Synthetic coding sequence
atgaacatttttgaccgcaagatcaattttgacgccctcttgaagttttctcacattactcccagcactcaacagcacctgaaaaaggtttacgcgagttttgccctgtgtatgttcgtggcctag

SEQ ID NO: 31074 - DNA, 618 bp, Artificial Sequence
  Description of Artificial Sequence: Synthetic coding sequence
atgaacatttttgaccggaaaatcaattttgatgcactcctgaaattcagccatatcacacctagtacacagcagcacctaaagaaagtttatgcatctttcgctctgtgcatgttcgtcgcagcagccggcgcttacgttcatatggtaactcattttatccaagcagggctgcttagcgccctgggaagcctgatcctgatgatttggctgatggcgactccccactcccacgagaccgagcaaaaaaggctgggcctgttggccgggttcgcttttctgacaggagtaggcttaggacccgctctggagttttgtattgccgtcaatccaagcatcctaccaaccgccttcatggggactgccatgattttcacgtgttttacgctgtctgccctctacgctcgaaggcggtcctacctgttcttgggaggtattctgatgagtgcactgtccctgctgctgcttagcagcctcggcaacgtgttttttggttccatctggctgttccaagccaatctttatgttggcctggttgttatgtgcggattcgtgttgttcgatacccaactcatcattgaaaaggccgagcatggagatcaggattatatttggtag

SEQ ID NO: 31075 - DNA, 888 bp, Artificial Sequence
  Description of Artificial Sequence: Synthetic coding sequence
atgtctcacagtagcgtgacccgcgaggctccacaactactcagtcaaaggcagaggcgtgaggtgcgaggggtttgggggtggggctgtctgccaggtccccggggggggcccgcattgttcggccttgtgactttcggccagagtggcgattgttgtacagattctggcacaatgaatatcttcgatcggaagatcaacttcgacgcactgctgaaattcagtcacataaccccatctacacaacaacatctcaagaaggtgtacgcaagctttgcgctgtgtatgtttgtggctgccgccggtgcttatgtccacatggtaacccatttcattcaggcaggtctgctgtccgccctcggctctctgatccttatgatatggctgatggcaactccccactctcacgaaactgagcagaaaaggctcggcctacttgctgggttcgctttcctgacaggagtggggctaggcccagccctggaattctgcattgctgttaaccccagtattctgccaacagccttcatgggaactgctatgattttcacctgttttacgctgtctgccctttatgctcgacggaggagttacctgttcctgggcgggatcctaatgagcgctctttcgctactgctgctgtcaagcctcggcaatgttttcttcgggtctatatggttgttccaagcaaacctctacgttggactcgtggttatgtgcgggtttgtactgtttgacacccaactcataattgaaaaagccgagcacggcgatcaggactatatttggcactgcatagacctcttcctggattttattactgtctttagaaaactgatgatgatcctggctatgaatgaaaaagataaaaaaaaggaaaaaaagtag

SEQ ID NO: 31076 - DNA, 3303 bp, Artificial Sequence
  Description of Artificial Sequence: Synthetic coding sequence
atgaagacctcaaaggcttcccagcgttaccgtgggattagaagaaacgctagtcagtgctacctctatcaggagtcattacttctgtccaatctggacgactcctttagcgccgatgagaccggagattccaacgacccggaacagatcttccaaaatattcaatttcaaaaggacctgatggccaacataaggtgtagaccctggactatgggacaaaaacttcgagccctgcgacaagctaaaaatatcgtgctcaagtttgaaggacgactgactcgaacaaggggttatcaggccgcaggagctgagttgtggagaaaattcgcacggctggcctgcaatttcgtcgtgattttcattccatgggaaatgcgcatcaaaaaaattgaatctcacttcggatctggcgtggcaagttactttatctttttaaggtggttattcggcatcaacattgtactcactattatgaccggggcctttatcgtaatcccggagctgattgctgggcagcccttcggaagtaccgctcgtaaaacaattcctaaggagcaagtctcctcggcgcaggacctggacactgtgtggagcctaggcggctacctacagtactcggtgctgttctacggatactacgggagagagcgcaaaataggccgggccggataccgtttgcccctcgcctatttcttggtgggcatggctgtatttgcatattcattcatcatcctgctgaaaaagatggcaaagaactctcgcactagtttggcctccgcttccaatgaaaattacaccttttgctggcgggtgttttgcgcttgggattaccttataggcaatcctgaagccgccgaaagtaaaaccgccgctatcgtaaactctatcagggaggcaattctggaagagcaggagaaaaaaaaatcaaagaacctcgcggtaaccatctgtctgaggattatcgccaacatcctggtgctgttgtctctcgctggaagtatctatctgatctactttgtcgttgatagaagccagaaacttgagcagagcaaaaaggaactgaccctgtgggagaagaacgaggtgtccgtggtggtcagcctggttacaatgattgctccatcggcgttcgacctgatcgcggctctggagatgtatcacccacgaacaactttgaggtttcagctcgctagggttctcgtcctgtacttggggaatctttactccctcattatcgccctgcttgataaagtgaattccatgagtattgaagagatggctaccaagaacaacacgtcccattggatcgactcaaccactttctttgcaactcgtactgcacctgaggaagaaaaatggagtacctcaagacccggaatgggcttgcgcagaaacaacacttgggcgttggaagagacaagtattagcgcttacaccatgcccttgataaaagccaataaaacatccttacacacccagagtccccaggatcagtgttgggaaacatatgtcggccaagaaatgcttaaactgagcatcatagacatgctcttcacggtcgccagcatcttgttgatcgactttttccggggattgttcgtgaggtatctgtccgattactggtgctgggacctcgagtccaagttcccagaatacggtgagtttaagattgcggagaacgtgctgcatctggtttacaatcaaggtatgatctggatgggcgctttttttagcccctgcctccccgctttcaacgtactgaagctcattgggttgatgtatctcaggtcctgggccgtcctgacatgcaatgtgcctcaccagcaggtgtttcgcgcctctcgctcaaataacttttatttggccatgctgctctttatgctgttcttatgcatgcttcccacaatcttcgccatagtgaggtataagcctagtctgaactgcggccccttctctgggcaggagaagatctatgacatcgtgtctgaaaccatagaaaaggactttcccgtgtggtttggaagtgtggtcggccacatttcatcccctgtggttatcctgccagctgtgctcctactattcatgctgatttattacctacaatccatagccaggtcactcaagctgagcaatcaccaactaaagatgcagatacagaacgctcgcagcgaggataaaaaaaaggtagctcaaatggtggaggctcggattcaaacacaggaggaaagtaccaagaaactccccaatgatagcgacctgacctctcagctatcttccgcacactctggcacgccgcagaataatgggaacgttgctcatttcgatagtggctctagcaagtcaggacgtattgagactgtggcccagagcatgcctcagtccccgaggccaggtgacagagccccatcgtctccactgccaggggtccccaaaagccgcttggagcacgagactaaccggtatctacacggcctttgtgcatctactagtgatcttcaccggaaccggtctagaacgcctatgacgtttacaactcacatagaagatgtgcacagcgagccgctgttcagaaaagattttcagcaaatcaatcccccacataggggaccacaggcctctactctactcgcccaggggcctagacctcacgcccctaggtactatgtgatcaacgagtgtgattcttataaaaagaaacacttaaatgtttggcctgagcgccactttaaaattgatgcaagtggagacattgtggagctgtaccctcgcaacgtgcggcagtatgccagtcgtgtaccccggcagcctccgtccccccagctgtctgaagaggaggaagaaacgccaagccgggattggattaaaagaagtctgccccccaggagcctgatcgatttaagacgtgccccccatttttacattggggagcgcagtgagtcacagacaagagacccagagcatcagggtcgtgtgcactacaagtcatggaacgaggacttcgagggtcacttggagcggccagcgtacgtccctaggaagcctagaagcagaaattttcagtatcctcagcctcctcttaaaccgcgcggaaagcctagatttgagcccagtctgacagaaagcgactccgtctcagccgcttcttcctccgaccaacaaaacagtagtgctgatcaatacctccaggtaacccatagccagggtcggttcccaaggtctgtggggcaacccagccgaagaaaggccaaatcaggtcaggagttgacagtggatctggacgacctgatctgctctgatgtctag

SEQ ID NO: 31077 - DNA, 3306 bp, Artificial Sequence
  Description of Artificial Sequence: Synthetic coding sequence
atgaagaccagcaaagcaagccagcggtataggggtatcagacgcaacgcctctcagtgctacttgtaccaggagtcccttctgctctctaacctcgatgatagttttagtgctgatgagacgggcgactcaaacgatcccgaacaaatttttcagaacatacagtttcagaaagatctgatggccaatattcgctgtcgtccatggactatggggcagaaactgcgggcactgagacaggccaaaaatatcgtgcttaagtttgagggacgcctaactcggacaagaggataccaggccgctggagccgagctttggagaaagttcgctcgtttggcttgcaatttcgtcgtgatatttataccctgggagatgcgcatcaaaaagatagagagccactttgggtcaggtgtggcctcatattttatctttctcagatggctcttcggcatcaacattgtgctgactataatgacaggcgcctttatagttattcctgagctgatcgccggccagccgttcggcagcaccgcccgtaagactattcctaaggaacaagtgagctctgctcaggacctggacacggtgtggtcattagggggctacttgcaatatagtgtattgttctatgggtattacgggcgcgagcgtaagataggcagggccggatatcgcctgccactcgcttactttctggttggcatggcggtgttcgcctactcttttattattctgctcaaaaagatggccaaaaattctcgaaccagccttgcctccgcaagcaacgagaactataccttctgttggagggtgttctgcgcatgggactacctcatagggaatccagaggctgccgagagcaagaccgccgcaatcgtgaacagtatcagggaggccatcctggaggagcaagagaagaaaaaatctaaaaatctggctgtgactatctgtttgagaattatcgcaaatattctggtgttgctctccttggctgggagtatctatctaatttacttcgttgtcgatagatcacagaaactcgagcagagcaaaaaagaacttacactatgggagaaaaacgagcaggtgtcggtcgtggtgtcccttgtgactatgattgccccatctgcctttgacctgattgcagccctagagatgtaccatccaaggactacactccgcttccaactcgcacgggttctcgtcctctacctgggcaacctctattccctcattatagcgctgttagataaggtgaattccatgtctatcgaagagatggccactaagaacaatacctcccactggatcgatagcactaccttctttgcgacaagaactgcccctgaagaggagaaatggtccacctctcgacccggcatgggtcttcgtcgaaataatacttgggctctagaagaaacttccatttctgcgtacactatgccactgataaaagccaataaaacgagtctgcacacccagtccccccaggatcaatgttgggaaacttacgtgggtcaagaaatgctgaagctctcaataatcgatatgctgtttactgttgcatcaattctgttaattgatttcttcaggggactgtttgtccggtacctcagcgactattggtgttgggacctggaatcaaaattcccagaatacggagaattcaagatcgcagaaaacgtgctgcatctcgtatataaccagggcatgatctggatgggagctttctttagcccctgtctgcctgctttcaatgtgttaaagctgatcgggctcatgtacctgcggtcttgggccgtgttaacctgtaatgtgccacaccagcaagtgttccgcgcatccagaagcaataatttctacctggccatgctgctgttcatgctcttcctatgtatgctgcctacgatcttcgcaatcgtccggtacaagcccagcctgaactgcggaccattctccggtcaggaaaagatctatgacatagtgagcgagacaatcgagaaggattttcctgtgtggttcggatcagttgttggccacatatcttcacccgtggtgatactgccagctgtcctactgttgttcatgctcatctattacctccaaagcatcgcgaggagtctcaagcttagcaatcaccaattgaagatgcagattcagaacgctagaagcgaggacaaaaagaaagtcgcacaaatggtggaggcgagaatccagacacaagaagagtcgactaagaagctccccaacgattcggacctgacctcacagctatcaagcgctcatagcgggacgccccagaataacggcaacgtggctcacttcgactcaggctcctcaaagtcaggaagaattgagacagtggcccagtccatgccgcaaagtccacgccctggcgatcgggctcccagcagccctctccctggcgtgccgaaatctcggctggagcacgagaccaacaggtacctacacggtctctgtgctagcacttctgacctgcatcgcaataggtcaagaactccaatgacgttcactacccacatcgaggacgtccattctgagcccctattccgtaaagacttccagcaaattaacccacctcatcgaggacctcaggcgagtactctcttggctcagggcccccggcctcacgccccccggtactatgtaattaatgagtgcgactcatacaaaaagaagcacctgaacgtttggcctgagcggcattttaaaattgacgcttcaggggacatcgtagaattataccctagaaatgttagacaatacgcctcgagagtgccccgccagccacctagtccacagctgtctgaggaggaggaagaaaccccatctcgggattggataaagcggtccctcccgccacggtcactgattgatcttcgacgggcccctcatttttatattggagagcggtctgaaagtcaaacccgtgaccccgaacatcagggccgcgtgcactacaaatcttggaacgaagatttcgaggggcacctggagcgccccgcctatgttccgcggaaaccccggtcgcgaaatttccagtacccgcaacctccactgaaacccagaggcaagccccgatttgagccatcgttgaccgaaagtgactccgtctcagctgcatcatctagtgatcaacagaattccagcgctgaccagtacctccaggtaacccattcccaagggcggtttcccagatccgtaggacagccctcaagaagaaaggctaagagtgggcaggaacttaccgtcgacctggatgacctaatctgttcagatgtctag

SEQ ID NO: 31078 - DNA, 2121 bp, Artificial Sequence
  Description of Artificial Sequence: Synthetic coding sequence
atggaggagaacccaactcttgaatccgaagcctggggcagcagtcggggttggctggcacccagggaggcacggggcgggcccagtctatctagcgtgctgaacgagctcccaagtgccgctacgttgagataccgcgaccccggtgtgttgccatggggggccttggaagaggaagaggaggatggcgggaggagcaggaaagcatttacagaggtgacacagacagaactgcaggacccacacccttctcgggagctgccctggcccatgcaggcgagacgggcccaccgtcagaggaatgcgtcccgcgaccaggttgtgtatggctccggcacgaaaacggatagatgggcacgactgctgcgacgctccaaagagaagacaaaagagggactgcgcagtctgcagccatgggcttggaccctgaaaagaattgggggccagttcggagctgggacagaatcttatttctccctgctgcgcttcctcttgctgttgaatgtactggcatccgtgctaatggcctgcatgacactgctacccacatggctgggaggagcgcctcctggccccccaggtcctgacatatcatctccgtgcggttcttacaatccacattctcaggggctggtgaccttcgccacccagctatttaacttgctctcgggagagggatatctagagtggtcccctctcttctacgggttctaccccccccgaccccgtctggctgtcacttacttatgctgggcctttgccgtcggattaatctgcttattgctcattctgcaccgatccgtgagcggtcttaagcaaaccttacttgctgagtccgaggccctaactagttactcgcatagagtatttagtgcgtgggacttcggcctgtgtggggacgtgcatgtaagactgcgacagaggataatcctgtatgagctcaaggttgagctggaggagacagtggtgagacgccaagccgcggtcagaactttgggacagcaggcaagagtgtggttggtgcgagttctcctaaatcttctcgtcgttgccctgttgggtgccgccttttatggtgtctactgggctacaggatgtacagtcgagcttcaggaaatgccattggttcaggagctcccgctattaaagctcggagtaaactatcttccctccattttcatcgctggagttaacttcgtgctgccaccagtgttcaaattaattgctcccctggaagggtacacgaggtctcgtcaaatcgtattcatactgttaagaaccgtgtttctgcggctagcctcgttagtcgtgttactgttcagtctctggaatcagattacttgtgggggtgacagtgaagccgaagactgcaagacgtgcggctataattacaagcagctgccttgttgggagaccgtgcttggccaggaaatgtataagctactgcttttcgacttgttgacggtgttggccgttgctctactgatacaatttccacgaaagctgctctgtggcctgtgcccaggggctctcgggcgactggccggtacacaggagtttcaagtgcccgatgaggtactgggtctcatctacgcccaaactgtcgtctgggtgggatcttttttttgcccattgttgccgctgttaaatactgtcaaatttctgttactattttacctgaagaagctgactttgttttctacatgcagccccgcagccaggacctttagagcaagcgccgctaactttttcttccctttagttcttcttctgggcctggccattagtagcgttcccctgctgtactcgatctttctgatccctcctagtaagctgtgcggacctttcagggggcaatcctccatttgggcccagatcccagagagcattagcagcctaccggagaccacccagaactttctattttttctgggtacacaggcttttgccgtgccactgctgctgatctcatcaatcctcatggcatacacagtggccttggctaactcatacgggcgccttatatctgagttgaaaagacaaagacagaccgaggcccaaaacaaggtcttcctcgcaaggagagctgtggccttgacaagcactaagcccgctctatag

SEQ ID NO: 31079 - DNA, 2139 bp, Artificial Sequence
  Description of Artificial Sequence: Synthetic coding sequence
atggaggaaaacccgactttggagagcgaggcctgggggagttctcgggggtggttggctccacgcgaagccagaggggctccttgcagttctcctgggccatctctgagcagcgtcctaaatgagctgcctagcgcagccactctcagatacagagaccctggcgtgctgccctggggcgccttggaagaggaagaggaggacgggggccgctcccgtaaagctttcactgaggtgactcagaccgaattgcaggacccgcatccttcccgggagctgccttggccaatgcaggctaggagagctcatcggcagcggaacgcgagtcgcgaccaggtggtgtatgggagtggcaccaagaccgataggtgggctaggttgttacgaaggagtaaggagaagactaaggagggcctacgctctctgcagccctgggcatggacgctgaaaaggataggcggacagttcggtgcgggtaccgagagttacttctcactactcaggtttctcctactactgaatgttctcgcaagcgtcctgatggcatgcatgacactcctcccaacttggttgggcggagccccacccggtcctcccggaccagacatctcgtctccctgcgggtcatacaatccgcactcgcagggacttgtaaccttcgcaactcagctgttcaatttgctgtccggtgaaggatacctggaatggtcacccttgttttacggtttttaccctccacgtccgcgacttgctgtgacatatctgtgttgggcttttgccgtcggtctaatctgtctcttgcttatcctccacagatctgtttcgggactaaaacagacgctgctggccgaaagcgaagcactgacctcctacagccaccgggtattcagcgcatgggatttcgggttgtgcggggacgtccatgtcaggttgcgtcagcgcataattctgtatgagcttaaggtggagctggaggaaactgtggtcaggcggcaagcagctgttagaaccctaggtcagcaggcccgagtgtggttagttcgggtcctgctaaacttgctcgtagttgcactactgggcgccgcgttctacggcgtgtactgggctaccggatgcacagtcgaactgcaggagatgcccctggttcaggaactgccacttcttaagctgggggtgaattacctaccaagcatctttattgccggggtcaactttgtattgccacccgtattcaaacttattgctccccttgaaggttatacacggtcacgacaaatcgtcttcattttgctccgaaccgtctttttgagactggcctctctggtcgtgctcctcttcagcctttggaaccagattacttgcgggggcgatagcgaggccgaggactgcaaaacttgcggctataattacaagcaattgccttgctgggagactgtgctgggccaggaaatgtataagctgctcctcttcgatctccttaccgtcttggctgtagccctgcttatacagttccctcgcaaactgctgtgcggcctgtgtccgggcgctctgggcaggctggccggaacacaggaatttcaggtacccgacgaagtgctcggcctgatttatgcccaaaccgttgtctgggtggggagttttttttgcccacttctgccccttcttaacacagtgaagttcctcttgcttttctatcttaaaaagctgactctcttctccacatgttcccctgcggctcggacttttcgggccagcgcggctaacttcttttttccgcttgttctgctgcttggtctcgcaatctcttcagttccccttctatattcaatcttcctgataccacccagtaagctctgtgggcctttccgcggtcagtcatctatctgggcccaaatccctgaaagcatttcctcactgccagagaccacacaaaacttcctgttctttctcggtactcaggcttttgcagtccccctgctcctgatcagcagcatccttatggcttacaccgtagccctggcaaatagctacggccgcttgatcagtgagttgaaacgtcagcggcagactgaagcccaaaataaggtctttctggcgaggcgagccgtcgccctgaccagtactaagcccgcattatag

SEQ ID NO: 31080 - DNA, 885 bp, Artificial Sequence
  Description of Artificial Sequence: Synthetic coding sequence
atgaaagggggcggcggccagagggatgtgggagctgacagaactgtttttctgcggcttgcctccttagtagtcctgcttttctcattgtggaatcagatcacttgcggaggcgacagcgaggctgaggactgcaagacttgcggatacaattataaacagcttccctgttgggaaacagtcttgggacaagagatgtacaagctcctgctgtttgatttacttaccgtgctcgcggtcgcactgctaatacagttcccacggaagctcctgtgtgggctgtgcccaggtgcactaggcaggttggcagggacccaggaatttcaggtgcccgatgaggtgctcggcctaatatatgcacagacagtggtgtgggtgggctctttcttttgcccactactgccattgctgaatacggtgaaatttctactgttgttctacttaaagaagttaacactctttagtacgtgtagccccgcagctagaaccttcagagcatcggcggctaacttcttttttcccctggtgctgctcctgggccttgcaatttctagtgtgcctttactgtactccatattcctgataccccccagtaaactctgtgggcccttcaggggacagtcatccatatgggcccagattccggaatccatctcctcgttgcccgaaacaacccagaattttctgttcttcttaggaacacaggccttcgccgtgccactcctgctcatcagctcaatcctcatggcctacaccgtagcgctggccaattcctacggtagacttatctccgagctgaagaggcagagacagacagaagcccagaacaaggtttttctggcaaggcgggcagtggccctcacctccacaaagcctgccctctag

SEQ ID NO: 31081 - DNA, 1377 bp, Artificial Sequence
  Description of Artificial Sequence: Synthetic coding sequence
atggccgctcagggagcggccgccgccgtcgccgcaggcacgagcggggtcgcaggagagggggaacccggtccgggagagaacgccgccgctgagggcaccgcgccctctcccggacgcgtttctcccccgactcccgccaggggagagccagaagtgactgttgagattggggaaacgtatttgtgccggcggccggactcaacctggcatagcgctgaggtgattcagtcacgcgttaacgaccaggagggtcgggaagagttctatgtacactatgtaggattcaataggcggctcgatgaatgggtggacaaaaaccggctggccctgacaaagacagtcaaggacgccgtgcaaaaaaatagtgaaaagtatttatccgagcttgctgaacagcccgaaaggaagatcaccagaaaccaaaagcgaaagcacgatgagattaaccatgtgcagaaaacgtatgctgagatggaccccacaacagctgcgctggagaaagaacatgaggccatcaccaaagtcaagtatgtagacaagatacacatcgggaactacgaaattgatgcttggtacttttctccctttcccgaagattatggtaaacaaccgaagctttggttgtgtgaatattgcctaaagtatatgaaatatgagaaatcctaccgcttccatttgggccagtgccaatggcgccaaccacccgggaaagaaatctataggaagagcaatatttccgtctacgaagtagatggcaaggatcacaaaatctactgtcagaatctttgtctgctggcgaaactatttttggatcacaaaactttatacttcgacgttgagccatttgtcttctatatactaacagaggtggatcgtcagggggcacatatagtgggatattttagcaaggagaaggagtcccctgatggtaataacgtggcttgtatcctgaccctaccaccatatcagcggaggggttatggcaaatttctgatcgctttctcatatgagttgtccaagttagaatccactgtggggtcacccgaaaagcccctaagtgatctcggcaaacttagctatcgttcatactggagctgggtgttactggagatcctgcgcgattttcgcggcactctgtccataaaggacttgtcacagatgacgagtatcacacagaatgacatcatatccaccctgcaatcgcttaacatggttaaatattggaagggccagcacgtcatttgcgtaactccaaaattggtcgaggagcatctcaagagtgcccagtataaaaagcccccaatcacggtggattctgtgtgcctgaagtgggcccctccaaagcacaaacaggtgaagttatctaagaaatag

SEQ ID NO: 31082 - DNA, 2847 bp, Artificial Sequence
  Description of Artificial Sequence: Synthetic coding sequence
atgagcgcctactataggaataattggagtgaggaagatcccgactacccagactattctgggtcacagaatcgcactcagggttatctcaagacccaaggttatcccgacgtccccgggccgcttaataaccctgattacccgggcacaaggagcaacccttactcagtggccagccgtacaagaccagattatcccggcagtcttgctgaacctaactatccacgtagcctatccaacccggattatagcgggactcgatctaatgcttatagcgccgcgtccagaacatccccagatcacccaacgtctctgccagagcccgattatagcgaattccagagtcacccctaccatagagcgagctcgaggcagccggactaccccggcagccaaagaaatcctgactttgcagggagctccagctctgggaactacgcgggaagcagaactcacccagaccactttggctccttggaacccgattaccccggagcccagtccaattccgaccaccccggccctcgggctaacctaaatcacccgggatctagaaagaatcttgagcatacctctttcagaattaacccctatgctgacagcttgggtaagcctgattatcctggcgcagatattcagcccaattctcctccctttttcggggaaccagattatccatcggcggaggacaaccaaaacctgcccagcacttggagggagcctgactattcggacgccgaaaacggccacgactacggaagttcagaaacccctaaaatgaccagaggagtccttagtcgtaccagctcaatacagccatccttccgtcacaggagtgatgaccctgtgggcagcctctggggcgaaaatgactacccagagggcattgagatggccagcatggaaatggccaattcttacggacacagtttgcctggcgcccccggaagtggctatgtcaatcccgcctatgtcggcgagagtgggcctgtgcacgcttatggaaatcctcccctgtccgagtgcgattggcataagagcccacagggacaaaaacttatcgcctcgttgatccctatgacaagccgagaccgtataaaggcgattcggaaccagccaagaacaatggaagagaagaggaaccttagaaaaatcgtagacaaggagaagagcaagcagactcacaggattcttcaacttaattgttgtatccagtgcctgaattctatttccagagcgtataggaggtctaagaactctcttagtgaaattctgaattcgatctccctttggcaaaaaacccttaaaatcatcggtggcaaattcgggactagtgtgctgtcatacttcaactttctcaggtggctcctcaaatttaacattttctctttcatattgaacttcagctttatcattatcccccaatttactgtggccaaaaagaatactctgcagtttaccggcttggagtttttcacgggagtgggatattttagggatacagtcatgtactatggcttttatacaaacagcactatccagcatggaaatagcggggcaagttacaatatgcagctcgcctatatttttaccatcggagcctgcctgactacctgcttcttcagtctgctcttttccatggccaagtatttccgcaacaactttatcaacccccatatctactcgggtgggattacaaagctgattttctgctgggactttactgttacacatgagaaagccgttaaactgaagcagaagaacctttcaaccgagatcagggagaatctgagtgaactcaggcaggagaacagcaagctgaccttcaatcagcttctcacacgcttctccgcctatatggtggcctgggtggtctccaccggggtagcaatagcctgctgtgctgctgtctactaccttgctgaatataacctcgaatttctcaaaactcacagtaaccccggtgcagtgctgctgctcccctttgttgtgtcctgtataaacctggccgtgccttgcatctacagtatgttccgccttgtggagcggtacgagatgccgagacacgaggtgtatgtgttacttattcgcaacattttcctcaaaatcagtatcattggtatcttgtgttattattggctgaacacggtcgcactgagcggagaagagtgctgggagaccctcatcggccaggatatttatagattattactaatggactttgtgttctctctggtgaacagtttcctgggcgaattcctacggcggataatcggtatgcaactgatcacatctttgggacttcaggaatttgacattgcaaggaatgtgctcgaactgatctacgcccaaacattggtatggatcggcatctttttctgtcctctcctccctttcatacagatgattatgctcttcataatgttctattcaaaaaacatcagtctgatgatgaatttccagccgccctctaaagcttggagggcaagccagatgatgaccttcttcatctttctcctgttctttccctccttcactggagttctttgcaccctggcaataacaatctggcgcattatcacctacctctattggcagattaccgagggtagaaaaataatgattcgcctgctccatgagcaaattattaatgaggggaaagataagatgtttctaatcgaaaagctgataaagttacaagatatggaaaagaaagcaaatccatcttctcttgtcctggagcggagagaggtcgagcagcagggatttcttcacttgggagagcacgatgggagcctggatctcaggagtagacgaagcgttcaggagggtaaccctagagcatag

SEQ ID NO: 31083 - DNA, 3021 bp, Artificial Sequence
  Description of Artificial Sequence: Synthetic coding sequence
atgagtgcttattaccggaataattggtctgaggaagatccggactacccagattactcgggttctcagaatcgtacacaaggctacctgaagactcagggctatccagacgtgcccggacctctcaataaccctgactacccaggaacccgctctaacccatactctgtggcctcgaggacaaggcccgactatcctgggtcactggccgaacccaactatccaaggtctcttagcaatcctgattactctgggactcgctccaacgcatactctgcggcctcaaggacttctcccgatcaccccactagccttccagagcccgactactcagagttccagtctcatccctaccacagggcatcatcacggcaacccgattatccaggttcccaaagaaatcctgacttcgcagggagctccagctccggaaattatgccggatctaggacccaccctgatcattttggatcccttgaaccagactatcccggcgctcaatcaaattccgatcaccctggacctagggctaatctgaaccacccaggaagtcgtaagaatctggagcacactagcttccggatcaacccttatgctgactcccttggtaaacctgactatcccggcgccgacattcagcccaatagccctcccttcttcggcgagcctgattacccatcagccgaagataaccagaatcttccttcaacttggagggaaccagattatagcgacgctgaaaatggacatgattacggtagctccgaaacaccaaaaatgacacgaggagtgttaagtagaacctcttccattcaaccctccttccgccaccggtcagacgaccctgtggggagcctctggggggagaatgactacccagaaggaatcgagatggcatcaatggagatggccaattcctatgggcactcgttgcccggagcgcccggcagtggttacgtgaaccctgcttatgtcggcgaatctgggccagtacacgcctacggtaacccgcctctcagcgagtgcgattggcacaaatcaccccaagggcaaaagctaattgcctcactgatacctatgacatctcgcgataggattaaagcgattaggaaccagccaaggaccatggaggagaaacgcaacctaagaaagattgtggacaaagagaaatctaaacagacccatcgtattcttcagctgaattgctgcatccagtgcctgaatagcatttctcgtgcctatcgccggtccaagaactccctgtctgaaattttgaattctatatctctctggcaaaagacgctgaaaattatcggcggaaaatttggtacctctgtcctgtcctatttcaacttcctaagatggctcctcaagtttaacatcttcagtttcattctgaacttcagctttataatcatccctcagttcaccgttgctaaaaagaacacattgcagtttaccgggctggaatttttcacaggggtgggctacttcagggatacagtgatgtactacggcttctataccaatagcactattcagcacggcaattccggcgcgtcatataacatgcagttagcttacatcttcacaattggcgcctgcttaacaacttgcttcttcagtttgttgttctctatggctaaatatttccggaacaacttcataaacccccacatctactccggaggcattaccaagctgattttttgctgggactttaccgtgacacatgagaaggctgtaaagctgaagcagaagaatttaagtacggaaataagggaaaacctttcagaattgcgccaggagaactcaaaactgacttttaatcagctcctcactagattctctgcttacatggtggcgtgggtggtgtctaccggagtggccatcgcttgttgcgctgcagtgtactacctggcagaatacaatctggagtttcttaagactcattcaaatcctggggcagtgctgctgctgccttttgtggtgtcgtgtataaacctcgctgtgccttgcatttacagcatgttccgactcgtggagcgttatgagatgccccgtcacgaggtgtacgtgcttctcattcgcaatatctttctgaagatatcgattatcgggattttatgttactattggttaaacactgtggctctcagcggcgaagagtgctgggaaactctcataggccaggatatctataggctgctgttgatggatttcgtgttctccctagtcaactccttcttgggggaatttttgcgtcggataatcggtatgcagctgatcacttcactcggtctgcaagaattcgacatcgcgcgtaatgttctggaactgatatatgcccagacattggtgtggatcgggattttcttttgccccctgctgccgttcatacagatgatcatgttgtttattatgttctatagtaagaatatctcattgatgatgaacttccagccgcccagcaaagcctggcgggccagccagatgatgaccttctttatcttcctccttttcttcccaagcttcactggcgtactgtgtactctagctattaccatttggcggcttaagccaagcgccgactgcggcccttttcgtggtttgccactatttatccattcaatttacagttggatcgatacattgtctacaagacctggatacctgtgggtcgtctggatttaccgcaacctcattggctccgtacatttctttttcatcctcacacttattgtactcataattacatacctatactggcagatcaccgaagggcgcaaaattatgatccgcctgctgcatgagcagatcatcaacgagggaaaagataagatgtttctgatcgagaagctcatcaaattgcaggacatggaaaagaaggctaacccatccagcctggtgctggaaaggcgcgaggttgaacaacaggggtttctgcacctgggagaacatgacgggtcgctggatctccgatcgcgacgttccgtccaggagggcaaccctagagcctag

SEQ ID NO: 31084 - DNA, 2103 bp, Artificial Sequence
  Description of Artificial Sequence: Synthetic coding sequence
atgctaagtgacgatcacgttaacgagatcatcatccaaaagctaattgcctcccttattccaatgaccagccgggatcgaatcaaagcaataagaaatcagcccagaacaatggaggagaaacggaatctcagccgcggaggcctgaccatcacaaccgaagatgagggacgtgccaaagcgcaccttacttggtggaaaattgtcgacaaggaaaaatcgaaacagacccatcgtatcttgcagttaaactgctgcattcagtgcctcaacagtatctccagagcttacagaaggtcgaagaattcactgagcgaaatcctgaatagcatatctctatggcaaaagacgcttaagataatcggaggaaaattcggcacatctgtgctcagttacttcaatttcctcaggtggttgctgaaattcaacatcttctcattcattctaaactttagcttcattatcatacctcagttcaccgtcgcaaaaaaaaatactctgcagtttacaggcctggagttcttcacgggagtgggttacttccgcgacaccgtgatgtactatggattttatacaaatagcaccattcaacacggtaatagtggagcctcctataatatgcaactagcctacatttttacaatcggtgcatgtttgaccacgtgcttcttcagtctactgttcagtatggccaaatactttaggaacaattttattaacccgcatatttactctggtgggatcactaaattaatattctgctgggatttcactgtgacgcatgaaaaagccgttaaactcaagcaaaagaacttaagcacggaaatcagagagaatctctccgaactgcggcaggaaaacagcaagttgacctttaaccagctgctgacccgctttagcgcctatatggtggcctgggtcgtgtccacgggggttgccattgcatgttgtgccgcagtgtactatcttgccgagtataatttagaatttcttaaaactcactcaaacccgggtgccgttctcctcctccccttcgttgtctcttgtatcaatctggcagtcccatgtatctacagtatgttcaggctcgttgaacggtatgaaatgccccgccacgaggtgtatgtactgctaatcagaaatattttcctgaagatttctatcattgggatcctctgctattattggttaaacaccgtggctctttcgggtgaagagtgttgggagacactgatcggccaggatatttatcggctgctgctcatggactttgttttttctctggtgaactcattcttgggagagtttctgagaaggatcatcggcatgcaactcatcacgagtctgggactccaagagtttgacattgcccgcaacgtgctggagctaatctatgctcagaccctagtctggatcggaatatttttctgtccactacttcccttcatccagatgattatgttattcataatgttctactcaaagaatatctccctcatgatgaatttccagccccccagtaaggcatggagggcttcacaaatgatgacatttttcatcttcttactgttctttccttctttcaccggtgtgttatgcactctcgctattaccatttggagattaaagccaagcgctgattgtggtcctttccgtggactacccctcttcatccactccatttactcctggattgacacgctcagcacccgacccgggtatctctgggtggtgtggatataccggaatctgatcgggtctgtacactttttctttatccttacattgatcgttctgatcatcacttacttgtattggcagattacagaagggcgtaagataatgattcgtctactgcatgaacaaattataaatgaaggaaaggataagatgtttctaatcgagaaactgatcaaattgcaggatatggaaaaaaaagccaatccaagcagccttgtgctggagagaagggaagttgagcagcagggattctgcatttggggcaatatgatggcagtcctgacctgtgaccttgaggaccagtttaagaaggtgattcaaggtcctgatgactcttttgggaaccagactcccatcaaatag

SEQ ID NO: 31085 - DNA, 2865 bp, Artificial Sequence
  Description of Artificial Sequence: Synthetic coding sequence
atgtctgcatactaccggaacaactggtctgaggaggatcccgattatcccgactactccgggtcccagaacaggactcagggctacctgaaaacacaggggtatccggacgtgcccggaccactcaataaccccgactaccccggtacccggagcaatccttattcagtggcctcaagaacaagacccgactatccgggctccctggccgagccaaactatccaaggagtctttccaatcctgactactctggaaccagaagcaacgcctattcggcagcttctcgcacttcgcccgatcatcctaccagcctgccagagcctgattatagcgaattccagtcccacccctaccatagggcgtcttcgcggcagcccgattaccctggatcccagcggaatcccgactttgctgggtcttcttctagcggtaattatgccggctctaggacccacccggatcactttgggtcccttgagcctgattacccaggggcccagtcaaactcagaccaccctggaccccgcgccaatctgaatcaccccggttcccgtaaaaatctggaacacacaagttttagaataaatccttacgccgacagcctgggtaaacccgactacccaggcgccgacatacagcccaattccccaccattctttggcgagccggactatcctagtgcggaggacaaccagaacctcccgtctacatggagagagcctgattactccgacgccgagaatggccatgattatggctctagcgagactccgaaaatgactagaggcgtcctcagccggacatccagtatacagccctccttcaggcacaggtcggatgaccccgtgggtagcttgtggggagaaaacgattaccctgaaggaattgagatggcctccatggaaatggctaattcttacggtcactctcttccaggagccccagggtccggttatgtaaatccagcctacgtgggggagagcgggcctgttcatgcttatggaaacccccctttgtccgaatgcgattggcacaagtccccccagggccagaagctgatagcatctctaatccccatgacgagtagagatcgcattaaagccattcgaaaccaaccacgaaccatggaggagaaacgtaacctcaggaagattgttgataaggagaagtctaagcaaacccacaggattctccaattaaactgctgcatccaatgtttaaactctatttcccgcgcctataggcgtagcaagaactctctcagcgagatccttaattctatttcactctggcagaagactcttaagatcattggtggaaagttcggcaccagcgtgttgtcttactttaatttcttgcgttggctactgaagttcaatatcttttcgtttatcctgaacttttccttcatcattatcccgcagtttaccgtggcaaagaaaaatactctacagtttacgggccttgaattcttcactggcgtcggctatttccgggacacagttatgtattatggtttctacactaactctactattcagcacggcaatagtggggccagctacaacatgcagctggcatacatattcacaattggcgcctgcctcaccacctgtttcttttccctgttattcagtatggccaagtactttaggaacaacttcataaatccgcatatctattccggtggcattaccaaattaatcttctgttgggactttaccgtgactcacgaaaaggctgtgaaactgaaacaaaagaatctgtcaaccgaaatacgattccttaagacccatagtaatcccggagccgtgctgctcctgcctttcgtggtctcttgcattaatctggcagtgccttgcatctattctatgtttcgtctagtcgaaagatatgagatgcccaggcatgaagtctatgtgctcttgatccgcaatattttcttgaagatatctattatcggaatcctttgctattactggctgaacactgtggccttgtcaggggaagagtgctgggaaacgttgatcggccaagacatctatcggctgctgctaatggacttcgtgtttagcctagtgaattcgtttctgggcgagttcctacggagaataataggcatgcagttgatcaccagcttaggcctccaggaattcgacatcgcccgcaatgtcctggaactaatctatgcccaaaccttggtttggattgggatcttcttttgcccactactgccatttattcaaatgatcatgctgtttatcatgttctatagtaagaacatctccctgatgatgaattttcaaccgccctctaaggcctggagagcttcgcagatgatgacttttttcatttttctgttgttttttccatctttcacaggagtactttgcactctggctataaccatttggcgcctcaagccgagcgccgattgcggacccttccgagggctgccgctgttcattcactccatttactcatggatcgacactctctcaactaggcctgggtatttgtgggtggtgtggatttatcggaatctcatcgggtctgtgcattttttttttatcctgaccctgattgtcctcatcatcacctacttatactggcagattaccgaaggcagaaagataatgatccgccttctgcacgagcaaattattaatgaaggtaaggacaaaatgttcctgattgagaagctgatcaagttgcaggatatggagaaaaaggctaaccccagctctctggtgctggaacggagagaggtggagcagcaagggttccttcacttaggagaacacgatggcagtttagacctgcggagtagaaggtccgtgcaggagggcaatccccgagcttag

SEQ ID NO: 31086 - DNA, 3021 bp, Artificial Sequence
  Description of Artificial Sequence: Synthetic coding sequence
atgtctgcatactacaggaataactggtccgaggaggaccccgactatcctgactacagcggtagccagaatcgtacccaaggctatcttaagacgcagggataccccgacgtgcccggaccactgaataatccagactaccccggtacacggagtaacccctacagcgtcgcttccagaacacggcccgattaccctgggtccctggccgagcccaattaccctagatctcttagtaatcccgactattctggaacccgaagcaatgcctatagcgccgcctcacgtacttctcccgaccaccccaccagcctgcctgagcccgactattccgaattccagtcccatccatatcatcgtgcaagtagtaggcagcccgattatccgggttctcagcgcaaccctgactttgccgggagctcctctagcggcaactacgccggcagtcgcactcacccagaccatttcggatcactggaaccagactacccaggggctcagagcaactccgatcatccagggcctcgagctaatctcaatcacccaggctcaaggaaaaatcttgagcatacctcctttcgtattaacccctacgcggattctcttggtaagccagactaccccggggccgatatccagcccaactctcctcccttttttggcgagcccgactatcccagtgcagaagataaccagaatctaccgtctacatggcgcgaacctgactactcggatgctgagaacgggcatgactacgggagctcagaaacccctaaaatgacaaggggtgttctgtccaggacctctagcattcagcctagcttcaggcaccgttctgacgaccctgttggaagtctgtggggggagaacgattaccccgaagggatagaaatggcatccatggagatggccaattcttatgggcacagcctccccggggcccccggatctggctatgtgaatccagcatacgtgggggagtccggcccagtgcacgcatatggcaacccccccctgtctgaatgtgactggcataaaagccctcagggccagaagctgatcgcatctctgattcccatgacttcaagagataggatcaaggctatccgcaatcagcccagaactatggaggagaagcggaacctcagaaagattgtggataaagaaaagtctaaacagacacaccggatactccagcttaattgctgcatccagtgtctaaactccatctcacgggcctatcggcgctcaaagaattcattgtctgaaattcttaactcgatctcactctggcagaaaactctcaagatcatcggtggcaaattcggcacttcagtactcagctacttcaacttcctgcgttggctgcttaagtttaacattttttccttcatcctgaatttttcctttattatcatcccccaatttactgttgccaagaaaaatacattgcagttcacaggcctagaattttttacgggagtaggctacttccgggatactgtgatgtattatggcttctacactaactctactattcagcacgggaacagcggagctagttacaatatgcagctagcctatatcttcacaataggcgcatgtttgaccacttgtttcttctccttgctgttctcaatggccaaatatttccgtaataactttatcaatccccatatctatagcggcggcatcactaaactgatattttgctgggatttcaccgtaacccatgagaaggccgttaagcttaaacaaaaaaatctgagcacagagatacgtgaaaatctgagcgagctgaggcaggaaaactccaagctgacattcaaccaactcctgacccgcttttcggcatacatggtcgcgtgggttgtgtctaccggagtcgcaatcgcttgttgcgctgcagtctactatctggccgagtataacttggaattcctcaagactcattctaaccccggcgccgttctgctcctcccattcgtggtttcctgtatcaatcttgccgtaccttgtatttactccatgttccgtctcgtcgagcgatatgagatgcccagacatgaggtctacgtcttgttaattcgcaatatttttctgaagatttccatcatcggaatcctatgttactactggttgaatacagtagctttgtctggcgaagagtgctgggagacactgattggccaggatatctaccgcctcctactcatggactttgtcttcagcctggtaaactctttcctcggtgagtttcttagaaggatcataggcatgcaactgataacgtcactcggcctgcaggagtttgatattgcaagaaacgtactggaattgatatatgctcagaccctggtctggatcggtatctttttctgccccctgctgccctttatccagatgataatgctcttcatcatgttttactctaagaacattagtctgatgatgaattttcagccaccctctaaagcttggcgggcctctcagatgatgactttcttcatcttcctcctctttttcccttcctttaccggggtgttgtgtacccttgccattacaatttggcgcctcaaaccgagcgccgattgcggcccctttcgcgggctccctctcttcattcactcgatctattcttggattgacactctctctactcgcccaggctacctgtgggtggtgtggatttaccggaatcttataggctcggtgcactttttctttatccttaccttaatcgtcctgattatcacctatttatactggcagatcaccgagggccggaagataatgataagacttctgcacgaacagatcatcaacgaaggaaaagataagatgtttctgatcgagaaattaatcaaattgcaggacatggagaagaaggcaaatccaagttcattggtattggaacggagggaagttgagcagcagggctttctccatctcggcgagcatgatgggtcccttgatctgagaagtcggcggtctgttcaagagggcaaccccagggcttag

SEQ ID NO: 31087 - DNA, 2172 bp, Artificial Sequence
  Description of Artificial Sequence: Synthetic coding sequence
atgtccgagagttcgggcagcgcattgcagcctgggcgcccgtcaaggcagccggccgtccatcctgaaaatctgtctttagattcgtcatgtttctcttcccctccggtgaatttcttgcaggaactgccttcttacaggagcattgcaaggagacggaccaccgtccattccagagataaacagagcggaaccctgctcaaaccaactgatagttacagttcccagctggaagatcgtattgccgaaaatctgtcctcccactcactacggaactatgcgctgaatatctcagagaagaggcggctgcgggacattcaggagactcagatgaaatatctgagtgaatgggatcaatggaagaggtatagtagcaagagctggaagagatttctggagaaggcccgcgaaatgacgactcatttggagctgtggagggaggacatcaggagcatagaaggcaagtttggcacgggaattcaatcatatttttccttcctgcggttcctggttctgttaaacctagtgatcttcttaattatcttcatgctggtcctgctccccgtcctcctcacaaaatataaaattaccaatagttcctttgttctgatcccattcaaagatatggacaagcaatgtacggtgtatcccgtttcttcatccggactgatatacttttattcctacatcattgatctgctgtccgggaccggcttcctagaggagactagcctgttttacgggcactacactatcgacggggtgaagtttcagaacttcacctacgatttaccactggcttacttgctgtccacaatcgcctctctcgccctgtctctcctatggattgtcaaaagatctgtggagggattcaaaatcaacctcatcaggtcagaagaacattttcaatcctactgtaataaaatattcgctggctgggacttttgcatcactaatcgttctatggccgacttaaagcactcatctctgagatacgagctgcgcgctgatctggaggaagagcgcatgcgccaaaagattgccgagagaacgagcgaggagacaattcggatctactccctgcggctgtttctcaactgcattgttctggctgtgctcggtgcctgcttttacgcgatctacgttgccacagtcttcagccaggagcacatgaaaaaagagatagataaaatggtgtttggcgaaaatttgttcattctgtatctgcctagtattgtgattaccctggcgaacttcatcacacctatgattttcgccaagatcattcgttacgaggattacagccctggattcgagattcggctgacgatcctaaggtgcgtatttatgcgcttggcaactatttgtgttttggtttttacattgggaagcaaaatcacaagctgtgacgacgacacctgcgacttatgcggctacaaccagaaactgtatccttgttgggaaacacaggtgggccaagagatgtataagctgatgatatttgactttattattatccttgcagtaactctgtttgtggacttcccccggaagctgttggtgacatattgttcctcctgcaagcttatccagtgttgggggcaacaagaatttgcaattcctgacaacgtcctgggcattgtctatggccagacgatctgctggatcggggccttcttctctccgttgctcccggcaattgccaccctgaagttcataatcatcttttacgtgaaggaatggagtctgctttacacctgccgcccctcgccacgtccattcagggcttctaactctaattttttcttcctgttggtgttactgatcgggctgtgtctcgcaattatcccactcaccatcagcattagtagaataccttcaagcaaggcttgtggacccttcactaactttaacactacttgggaagtgatcccgaagacagtcagtactttcccatcttccctacagtccttcatccacggtgttaccagcgaggcatttgcagtgcctttttttatgatcatatgccttattatgttttattttatagccttagccggggcacataagagagtcgtcattcagttgcgtgagcagctgtccctggagagtcgcgataaatgctacttgatacagaagctgaccgaagctcagagagatatgcggaattag

SEQ ID NO: 31088 - DNA, 1842 bp, Artificial Sequence
  Description of Artificial Sequence: Synthetic coding sequence
atgaagtacctcagtgagtgggatcagtggaaacggtactcatccaagtcttggaagcgattcctggaaaaggcccgagaaatgacgacgcacttggagctgtggcgggaagacatcagatcaattgagggtaagttcgggacagggattcaaagttatttttctttcctgcgttttctcgtcctgctgaatctggtgattttcttgatcatcttcatgctggtgctgctccccgtattgctgacaaagtacaagatcaccaacagttcgttcgtgctgatcccattcaaggacatggataaacagtgtaccgtgtatcccgtgtcatcaagcgggctgatctacttttatagttacattatagatctcttatccggtactggctttttggaagagacatcgctcttctatggacactacaccatcgatggcgtgaaatttcagaattttacttacgacctgcctctggcctatcttttatcaacgattgcgagtttggcattgtctctgctatggatcgtgaagaggagcgtcgaagggttcaaaatcaacctgataagatcagaagaacacttccagagctattgtaacaaaatcttcgccggatgggatttctgcataacgaacagaagcatggctgacttaaaacacagcagtttacgttacgaactgcgagccgatttagaagaggaacgcatgcgacagaaaatcgccgaacgtacaagcgaagagacgatccggatctactcactgaggctgttcttgaactgcatcgttctggccgtacttggggcctgcttttacgctatctacgtggcaaccgttttctcacaagagcacatgaaaaaagagattgacaaaatggtgtttggcgagaacctgttcatcttgtatctgccttccatagtgattacacttgcgaatttcatcacacccatgatcttcgccaagataattcgctatgaggactattctccaggattcgagatacggttaaccatactccgatgcgtgttcatgaggctcgccacaatatgtgtgctggttttcacgctggggtccaagattacatcatgcgatgacgatacttgcgacttgtgtggatacaaccagaaattgtacccttgctgggaaacgcaggtgggacaggaaatgtataagttaatgatctttgactttatcatcatcctagccgtgaccctttttgtggattttccaaggaaactgctggtaacctactgttcctcttgcaagctgatccagtgttgggggcagcaggagttcgccatcccggacaacgtgctaggcatcgtctatggccagaccatttgttggatcggagcctttttcagtcctctcctccccgccatcgccactctgaaattcatcatcatcttttatgtgaaggagtggtcacttctctatacgtgcagaccatcacccagacctttccgggccagtaatagcaactttttctttctcctggtgcttttaatcggcttgtgtctggccataatccccctgaccataagcattagtcgcattccgtcctcaaaagcatgcggcccattcactaacttcaacacaacatgggaagtgatccctaaaaccgtgtctacctttccaagttccctgcagtcctttatacatggagtcacatccgaggcattcgcggtgccgttcttcatgatcatttgtctgataatgttttacttcatcgctctggctggggcccataagcgggtggtcatccagctgcgtgagcagctatcactggaatcgcgcgacaaatgttatctgatacaaaaactaaccgaggcccagcgcgatatgcgtaactag

SEQ ID NO: 31089 - DNA, 606 bp, Artificial Sequence
  Description of Artificial Sequence: Synthetic coding sequence
atggtaaccctcgctgaactgttagtcctgctggcggcacttcttgctacagtgagcgggtacttcgtgtccattgatgctcacgccgaagagtgcttttttgaacgggtgacatccggcacaaagatgggacttatttttgaagtggccgaagggggatttctggatatcgatgtggagattactggtcccgacaacaagggcatatacaagggtgaccgcgaaagcagcggtaagtacacgtttgctgcacatatggacggtacctacaaattctgtttctcaaaccggatgagtactatgactcctaaaatcgtgatgtttactattgatattggcgaagccccaaaaggccaggacatggaaaccgaagctcatcaaaacaagctggaggaaatgattaacgagctggccgtggctatgacggccgtgaagcacgaacaagaatacatggaggtgcgggaaagaatacatcgggcgatcaacgacaacactaacagccgcgtggtcctttggagcttctttgaagcacttgtgctagtcgccatgacacttgggcaaatatactacctgaaacgattttttgaggtgaggcgtgtggtctag

SEQ ID NO: 31090 - DNA, 510 bp, Artificial Sequence
  Description of Artificial Sequence: Synthetic coding sequence
atggttacactggccgagcttctggtgttgcttgccgcccttttagccaccgtatccgggtactttgtgagcattgacgtggaaattaccgggccagacaacaaaggcatctacaaaggggatagagagagttccgggaagtacacatttgcagcgcacatggacggcacttacaagttttgcttctctaatcggatgtctacaatgacccctaaaatcgttatgttcaccattgatatcggagaggcccctaaggggcaggatatggagaccgaagcccaccagaataaactggaggagatgataaatgagttagccgtcgcaatgactgcagtcaagcacgagcaagaatacatggaggtcagggaaagaatacaccgtgccattaacgacaatacgaattccagagtggtgctgtggagctttttcgaagccctggtgctggtggcgatgactcttggacagatctactacctgaaacgcttcttcgaagtgcgccgagtggtgtag

SEQ ID NO: 31091 - DNA, 456 bp, Artificial Sequence
  Description of Artificial Sequence: Synthetic coding sequence
atggtgaccctagcagaattgttggtcctccttgcggcattgttggccaccgtgagtggctatttcgtgtccattgacgcacacgccgaagaatgtttcttcgagagggttacatccgggaccaaaatgggcctaatcttcgaagttgccgaaggtgggtttttagacattgacgttgagattacaggccctgacaataagggtcaggatatggaaacagaagctcaccaaaacaagctcgaggaaatgataaatgaactcgccgttgccatgacggccgtgaagcatgagcaggaatacatggaggtccgagaacgtatccaccgcgccattaacgataacacaaatagtagggtcgtgttgtggtctttcttcgaggcccttgtgctcgttgctatgacactagggcaaatctactacttgaagcggttctttgaagtgaggcgagtcgtctag

SEQ ID NO: 31092 - DNA, 654 bp, Artificial Sequence
  Description of Artificial Sequence: Synthetic coding sequence
atgggatcaacagtccccagatccgcatccgtgctgcttctactgctgctgcttcgccgcgctgagcaaccttgcggcgccgaactgacatttgaactccccgataacgctaagcagtgttttcacgaggaagttgagcagggggtaaagttttctctggactaccaagttatcacaggaggacactacgacgtagactgttatgtagaggatccccagggtaataccatttatagggagaccaagaagcagtacgactcgttcacttaccgagctgaggtcaagggggtgtatcagttttgctttagtaacgagttctccacttttagccacaagacagtgtattttgacttccaagtaggcgatgagccaccaatcctgccagatatgggcaacagggtgactgccctgacacagatggaatctgcctgcgttaccattcacgaggctctgaagaccgtgatcgatagccagacccattacagactgcgggaagcccaggatcgggcaagagcagaagatctcaattctagagtgtcatactggtcggtgggtgagaccatcgccttatttgtcgtgagcttttcacaagtcctcctgctcaagtcttttttcacagagaagcgccccatttcacgggcagttcactcctag

SEQ ID NO: 31093 - DNA, 522 bp, Artificial Sequence
  Description of Artificial Sequence: Synthetic coding sequence
atgggatccacggttcctaggagcgcttctgtcttacttctgctactactactgagacgggctgagcagccatgcggggctgagcttacctttgaactccctgataatgccaaacagtgttttcatgaggaagtggaacagggagttaagtttagcttggactatcaggtaattaccggcggccactacgacgtggactgctacgttgaggacccccagggtaacacaatttatcgggaaaccaaaaaacaatatgattctttcacttaccgcgccgaagtcaagggagtctaccagttctgcttcagtaatgagttttccactttttctcataaaacggtttacttcgatttccaagtgggtgacgagccccccattctgcctgacatggggaaccgggtgaccgcgctcacccagcggttccgaggcgcctattggaaggaggttgacaagatggttgactacatgcagccgggagggacccccgccactgaagggctgggcaggctcgctccttcctag

SEQ ID NO: 31094 - DNA, 489 bp, Artificial Sequence
  Description of Artificial Sequence: Synthetic coding sequence
atgggcgacaaaatctggctccccttccccgtgctgctcttggcagctctgcctccagtgctgttgcctggtgccgccgggtttacaccatcactggactccgatttcacattcaccctgcccgctggtcagaaagaatgcttctatcagcctatgccattaaaagccagtctggaaatagaataccaggtactggatggggccggactggacattgatttccatctggccagtccggagggtaagacactggtgttcgagcaacgcaagtcagacggagttcataccgtggaaaccgaggtcggagattacatgttttgctttgataatacattctctacaatttctgagaaagtgatattcttcgagctaatcctagataacatgggggagcaggctcaagagcaggaagactggaagaaatatatcaccggtaccgacatcctggatatgaaactcgaggatatcttggtgtcaatggttttctag

SEQ ID NO: 31095 - DNA, 690 bp, Artificial Sequence
  Description of Artificial Sequence: Synthetic coding sequence
atgggggacaagatttggctaccctttcctgttctacttctggctgcattgccccccgtgttactgcccggcgcagccggcttcacaccctccctcgactccgattttactttcaccctgccagccgggcagaaggaatgcttctaccaacccatgcccctcaaggcatctctggagatcgagtaccaggttctggacggagcgggcttagacattgatttccacctcgcatctccagagggcaaaacgctggttttcgaacagaggaaaagtgacggggtgcacacagtggagactgaggttggtgactacatgttttgcttcgataatactttcagtactatctcagaaaaagttatcttttttgagctgatcctggataatatgggagagcaggctcaggagcaagaagactggaaaaaatatataacaggaaccgacatcttggatatgaaactggaggacattctggaaagcatcaactctattaagtcacgtttatccaaatctgggcatatacagaccctgctgcgggcatttgaggcacgcgacagaaacatacaggaatcaaacttcgatcgtgtaaatttctggagtatggtcaatctcgtcgtgatggtcgtggtgtccgcaatccaggtgtatatgctcaagagtctcttcgaagataagagaaagagcagaacatag

SEQ ID NO: 31096 - DNA, 582 bp, Artificial Sequence
  Description of Artificial Sequence: Synthetic coding sequence
atgggagacaagatctggctgccattccctgtcctgctcttagcagctctgcccccagtgctcctgccaggcgctgctgggtttacaccaagtctggattcagattttacctttacactccctgctggtcagaaggaatgtttttaccaacctatgcccctgaaggctagcctcgagatcgaatatcaggtgttggacggcgccggcctcgacattgatttccacctggccagccccgaaggcaagacactcgtgttcgagcagagaaaatccgacggggtgcacacagtcgagacagaggttggtgactacatgttctgcttcgacaatacgttttcaactatatccgaaaaagtgatcttctttgaactcatcctggataacatgggcgaacaagctcaagagcaggaagactggaagaaatacatcactggaacagacatcctcgatatgaagttggaagacatacttgacccaattattaagatcgccagcgacgtgcagatcagactacatttgggcattcatcagcagcaccaggtccagactaagcagaaatgggcacacaccaacagcgcatag

SEQ ID NO: 31097 - DNA, 537 bp, Artificial Sequence
  Description of Artificial Sequence: Synthetic coding sequence
atgcccttgaaggcaagccttgagatcgagtaccaggtgctagatggggctggactggatatcgacttccatcttgcaagcccagagggcaagacactcgtcttcgaacagcgaaaatccgacggcgtgcataccgtggagacggaggtgggagactatatgttttgtttcgacaacacgttctccacgatctctgaaaaggtgatattcttcgaactgatactggacaacatgggagagcaggcccaggagcaggaagactggaaaaagtatattaccggtaccgatattctggacatgaaactggaagatatcctagaaagcatcaactccatcaagagtcgtctctctaagagtgggcacattcagaccttgctaagggcttttgaggctcgagaccgcaacatccaggaatccaacttcgatcgagtgaatttctggtctatggttaatctggttgtgatggtggtggtgtcggcgatccaggtctacatgctaaagagcctgttcgaagacaagaggaagtctcggacttag

SEQ ID NO: 31098 - DNA, 723 bp, Artificial Sequence
  Description of Artificial Sequence: Synthetic coding sequence
atgagtcctctgttgttcggtgccggcctggtggtgctgaacctggtcactagcgcaaggtcacaaaaaaccgaaccgctgagcgggtccggagatcaaccactatttcgcggggcagataggtacgattttgcaatcatgattccccctggcggaacagagtgtttttggcagttcgcccatcagacgggctacttctatttttcatatgaggtacaacggacggtgggtatgagtcatgacagacacgtggcagctacagcccacaatccccaggggtttctgattgacacaagtcagggggtacggggacagattaacttttccacccaggagactggtttttatcagctatgtctgagcaatcagcacaatcacttcggctctgtccaggtgtatctcaattttggagtattctatgaagggccagaaacagaccacaaacagaaagagcggaaacagctcaacgacacactggacgccattgaagacggcacacagaaggtacagaacaacatctttcacatgtggagatactacaactttgcacggatgaggaagatggctgacttcttcctgatccagagtaactacaactacgtgaattggtggtctactgctcaaagtttggtcatcatcctctcagggatcctgcaattatacttcttgaaaagactatttaatgtccctaccacaactgacacgaaaaaacctaggtgttag

SEQ ID NO: 31099 - DNA, 675 bp, Artificial Sequence
  Description of Artificial Sequence: Synthetic coding sequence
atgcccagaccaggctccgcccagcgctgggcagctgtggccggtcggtgggggtgtcggctgttagcgctgctccttcttgtgccaggtccagggggcgccagcgagataactttcgagttgcccgacaacgcgaagcaatgtttttatgaggatatcgctcagggcactaagtgtacacttgagttccaggtgattaccggcgggcactacgacgtggattgcaggctggaagatcctgatggcaaggtgctctacaaggagatgaaaaagcaatacgactcgttcacctttaccgccagcaagaacgggacatacaaattctgctttagtaatgagttcagcactttcacgcacaagacagtttactttgatttccaggtgggtgaagatccacctctctttccttctgaaaaccgcgtgtctgctctaactcagatggagagtgcctgtgttagtattcacgaagcacttaaatccgtcattgattaccagacacacttccgattgagggaagcccagggccggtctcgagcagaagatctgaacaccagggtcgcgtactggagcgtgggcgaggccctcatccttcttgttgtatcaattggtcaggtgtttctgctgaaaagttttttctctgacaagcgaactacgacgacaagagtaggttcatag

SEQ ID NO: 31100 - DNA, 249 bp, Artificial Sequence
  Description of Artificial Sequence: Synthetic coding sequence
atgcctcgcccagggtccgcccagaggtgggccgctgtggcagggaggtgggggtgcaggttgctcgcccttctcttgctagtgcccgggccaggcggagcatcagaaatcacttttgaattaccggataatgccaaacagtgtttctacgaggacatcgctcaaggcaccaaatgcactctggaatttcaggtaattacagggggccactatgacgtggattgccgtctggaggaccccgacggctag

SEQ ID NO: 31101 - DNA, 651 bp, Artificial Sequence
  Description of Artificial Sequence: Synthetic coding sequence
atgcaggccggcaaaccgattctctactcgtactttcgttccagctgcagttggcgggtgcgtatcgcacttgcccttaagggcattgattacgaaaccgttcctatcaatctgattaaagacggcggccaacaattcagcaaggacttccaggcgttaaaccctatgaagcaagtgcccacactgaaaatcgatgggattaccatccaccagagtttggcgatcatcgagtacctggaggaaatgcgaccaacaccccgactgctccctcaggatccgaagaagagggcttctgtgaggatgatttctgatctgatagccggtggtattcagcccttacagaatttgtccgttctgaagcaagttggcgaggagatgcagctcacatgggcacaaaatgcgataacttgtggatttaacgctctggagcagatcctgcaatcgaccgctggaatctattgtgtcggggatgaagtgactatggcagacttatgccttgtgccccaggtcgccaacgctgagagatttaaagtggacctgacaccctatccaaccataagctcaatcaacaaaagactccttgtcctcgaggccttccaggtctctcatccctgccggcaacctgacactccaaccgaactgagggcatag

SEQ ID NO: 31102 - DNA, 708 bp, Artificial Sequence
  Description of Artificial Sequence: Synthetic coding sequence
atggccgttgagctgggcgtactcctggtcagaccacgcccaggtactggtctcggaagggtcatgcggaccctgttgctcgtcctctggctggccactcggggaagcgctttgtatttccacatcggtgaaaccgagaagaaatgtttcattgaggaaattcccgacgaaacaatggttataggcaattatagaacacagctgtatgataagcagcgggaagagtaccagcccgctaccccggggctcggcatgttcgtcgaagtgaaggacccggaagataaggtgattttagcacgccaatatgggtccgaagggcgtttcacattcaccagccatactcccggcgaacatcagatctgtttacatagtaactctacgaaatttagccttttcgctgggggcatgttacgtgtgcacctggatatccaagttggagaacatgcaaacgactatgcagaaatagctgctaaggacaagctcagtgaactccagttaagagttagacaactcgtggagcaagttgaacaaattcaaaaggaacagaattatcagaggtggcgtgaggagagattcaggcagacgtctgagagcacgaatcaaagagtgttatggtggtctatcctgcaaactctgattttagtggccattggggtctggcaaatgcggcacttaaagtccttcttcgaagccaagaagttagtctag

SEQ ID NO: 31103 - DNA, 822 bp, Artificial Sequence
  Description of Artificial Sequence: Synthetic coding sequence
atgattctcaaaggttgcctcttgtaccccctgtgcagcccccgtaataagcagagatgcgcaagactgtggaagatagcctatggaggcctgctcaaaattgtgaccggatcgttacttactttttacgtagtcctgtgtctcgatggtgggatggttctgatgcgcaagcaggtccccagtaggtttatgtaccctaaagagtggcaacacctgactatgttcatacttctcacactcaacgggtgtgtcgactttatgtcaaagaatgtactccctcagcgctgtgtgggactggagaaagggacgttggttctcataatctatgaactgcttctactgatggtgtcccacgttaaagactccgagggcgtggagttgcacgtgtacagcctgcttatcttggtggtttttttacttctcctggtactaactgccgaactttgggctcctaatatgtgccatctgcagctcatggaaacctttctcattctcatgatggggtcttggctgatgcaagccggttttattctgtaccgacccgtcagcggttacccatggcaggacgatgatatcagcgatataatgtttgtgactacatttttctgttggcatgtcatgattaatgccagctttcttctgggcatttacggattctcctctttttggtaccactgtttcagaccaagcttgaagctcacaggacccaaagaggcaccttactacgcttcgaccccggggcccttgtacaaactgctgcaggaggtggagcagtccgagaaagaggaccaggcgctcttgctcccaaaatcatctccttag

SEQ ID NO: 31104 - DNA, 1338 bp, Artificial Sequence
  Description of Artificial Sequence: Synthetic coding sequence
atgaacgaatcccctcagactaatgaattcaagggcactaccgaggaggccccagctaaagagagcccccacactagcgagtttaagggggcagccctggtgagccccataagcaagcgcatattcggcgtctttctagttcttctggacgtgactctgctgctggcagaccttatttttactgattccaaattatatatccccctcgagtatcggtctatatcactcgctatcggtttattctttttgatggatgtgttgcttcgggtgttcgttgaaggctggactcatctcgtcaggctcctgagattaatcatcctgatccgcattttccaccttttacaccagaagcggcagttggagaagttgatgaggcggctagtgtctgagaacaagcgccggtatacaagagatggttttgatctggacctgacatatgtgacagaacggatcatcgcaatgtcattcccctctagtgggagacagtcattttaccgtaatcctattgaagaggttgtgagattcttggataagaaacaccgcaaccattatcgggtatacaatttgtgttcagagagagcctacgacccgaaacatttccacaatcgagtctcacgtataatgattgacgatcacaatgtgccaaccctgcacgaaatggtcgtattcactaaggaggtgaatgagtggatggctcaggatcttgagaacattgttgccatacactgcaagggaggaaagggtcggacaggcacaatggtatgcgcccttctcatcgcatctgaaattttcttaaccgcggaggagtctctgtattatttcggagaacgaagaaccaacaagactcactctaacaagtttcagggggtggaaacaccgtcacagaatagatacgtgggatattttgctcaggttaagcacctttataactggaatcttcccccacgcaggattttatttattaaacggttcattatttacagcatccgcggggacgtctgtgacctgaaagtgcaagttgtgatggaaaagaaggtggtgtttagctccacatccctggggaattgctccattctacatgacatagagacagacaaaatcttaatcaacgtttacgatgggcctccactgtacgacgacgtgaaggtccagttcttctcctccaacctccccaagtattatgacaactgccccttcttcttttggttcaatacttctttcattcagaacaatagattatgtcttccaaggaacgagctcgacaatccacacaagcaaaaagcttggaagatctatcctccagaattcgccgtggagattctgttcggggaaaaatag

SEQ ID NO: 31105 - DNA, 1467 bp, Artificial Sequence
  Description of Artificial Sequence: Synthetic coding sequence
atgaacacgagtccccagacgaatgaatttaaaggtacaacagaggaggcacctgctaaggaaagccctcatacctccgaatttaagggagctgcgttagtatctccgattagcaaatcaatgctggagagactatccaagttcgaggttgaggatgcagagaatgttgcatcgtacgattccaaaattaagaaaattgttcacagtattgtctcttcctttgcctttggtatctttggcgtgtttctggtcttgctagatgtgaccttactactggctgacctaattttcacagacagcaagctctacataccattagaataccggagtatctccctcgccataggcctgttctttttgatggacgtcttgctcagagtattcgtcgagggccggcaacaatacttcagtgatctctttaacatactcgacaccgccattattgtaatcccattgcttgtggacgttatttatatcttttttgacattaagttacttagaaacatcccccgctggacccatctagtgaggttattgcgtttaattattctgattagaatctttcacttgcttcaccagaagaggcagctcgagaaactgatgagacgtctagttagtgaaaataaacgaaggtatacaagggatggattcgatctggacctgacctacgtgaccgagagaattattgccatgagtttccccagcagcggtcgacagtctttctaccgaaatccaatagaagaggtcgttcgctttctggacaagaagcacaggaaccattacagggtatacaacctgtgctcagagcgcgcatatgatccaaagcattttcacaatcgcgtgtccaggattatgatcgacgaccataacgttcctacgctgcacgagatggtggtgttcaccaaggaggtgaatgagtggatggctcaggacttggagaatattgttgctattcactgtaagggcggtaagggtcgcaccggcactatggtatgcgcccttttaatagcatccgagatctttctcacagcagaagaatccctgtattatttcggggagaggcgcactaataagactcattcaaataaatttcagggggttgagactcctagtcaaaatagatacgtagggtacttcgcacaggtgaaacacttatacaactggaatctcccacctcgccggatattgttcatcaagcggtttattatttatagtattcgcggggacgtatgtgatctcaaggtccaggtggtgatggaaaaaaaagtggtcttttcgtccacttccctgggaaactgttccattctccacgacatcgagactgataaaatcttgatcaacgtgtatgacgggccaccgctgtatgacgacgtgaaggtgcagtttttctctagtagggcagagaaacgggccgcccacagggccaattggaaaggggagccatctagaagacccgtcttggactag

SEQ ID NO: 31106 - DNA, 1449 bp, Artificial Sequence
  Description of Artificial Sequence: Synthetic coding sequence
atgaacgagtctcctcaaaccaacgagtttaagggtaccacagaggaagcccccgctaaagaatccccccacacctccgagttcaaaggcgcagctctggtgagccccatcagcaagtctatgctggagaggctgtctaagttcgaagtcgaggatgccgaaaacgtggcctcttatgattctaagatcaagaaaatcgtccattccatcgtgtcgtcatttgcctttggaatttttggcgtgtttcttgttctgcttgacgttaccttgctcttggctgacctgatttttaccgatagcaagctttatatacctctggaatatcggtccatctctctagcgatagggctttttttcttgatggatgtgttgctgcgtgtgttcgtggagggttggacccatctagtgcgtcttctcaggcttattatcctaatacggatcttccacctgttacatcaaaagagacagcttgaaaaactcatgaggagactggtgtcggaaaacaaaaggcgctacaccagggacggattcgatctggacctaacgtacgttacagagcggatcattgccatgtctttccccagttccggccgacagtcattctatcgtaatcccatcgaggaggtcgtcaggttcctcgacaagaagcatagaaatcactaccgggtgtataacttgtgttctgaacgggcatatgatcctaagcacttccacaatcgggtttcacgcattatgatcgacgaccacaacgtcccaactttgcatgaaatggtggtcttcacgaaggaagtcaacgaatggatggcacaggatttggaaaacatcgtggccattcactgtaaggggggtaaaggcagaaccgggactatggtgtgtgctttactgatcgcttctgaaatcttccttacagcagaagagtcactctactatttcggagaacgaaggacaaataaaactcactcaaacaagtttcaaggcgtcgagacccccagccagaaccgttacgtcggctactttgctcaggtaaagcacctctataattggaacctgcccccccgaaggatcctgttcatcaaacggtttatcatttactccataaggggcgatgtctgcgacctgaaggtgcaggttgttatggaaaaaaaggttgtttttagcagcacatctttgggtaactgctctatcctgcatgacatcgaaaccgacaaaatactgattaatgtgtacgacggccctccactgtacgacgacgttaaagttcagttctttagttctaatctgccaaaatactatgataattgtccattttttttttggttcaacacctctttcatccagaataatagattgtgcctgccacggaacgaacttgataacccgcacaaacagaaggcatggaaaatttacccccccgagtttgccgttgaaatcctttttggagagaagtag

SEQ ID NO: 31107 - DNA, 1569 bp, Artificial Sequence
  Description of Artificial Sequence: Synthetic coding sequence
atgaacgaaagccctcaaactaacgagtttaaggggactactgaggaagcccccgccaaagagagccctcatacctctgaattcaaaggcgccgccctcgtgtcacccatctcgaagagtatgctggaacgactgtctaagttcgaagtggaagacgccgaaaatgtggcctcatatgacagcaaaatcaagaagattgtacacagcatcgtgagctcattcgcatttggaatcttcggcgtctttctggtgcttctggacgtcaccctcctgctggcagatctgatctttacagacagcaaactgtacattccactcgagtacagaagcattagcttggcgatcggcctattttttctgatggacgtgctgttgcgcgtgtttgtggagggccgccagcagtacttctcagacctgttcaacattcttgacacagcaattatagtcatccctctgcttgtagatgtcatctacatattcttcgatatcaaactgttacgcaacatcccacgttggacccatctggttaggctcttgcggttgattattctgattcggatttttcacctgctgcatcagaagcgccaattggaaaagttgatgagacgacttgtctctgagaataaacgccggtacacacgggacggattcgatctggatctgacgtatgtaaccgagcgcatcatcgccatgtcctttccttcgtcaggacggcagagtttctacagaaaccccattgaggaggtcgtccggttcctagacaagaaacaccggaatcactatagggtatataatctgtgtagcgagagggcctacgatcctaagcatttccataatagggtaagtaggataatgattgacgaccacaatgtcccaaccctccacgagatggttgtgtttactaaggaagtgaatgagtggatggcacaggatctggaaaacatcgtggcgattcattgcaagggggggaagggacggactggcactatggtgtgtgcactgctgatcgcttctgaaatcttcttaaccgcagaagagagcttgtactacttcggagaaaggcgcacaaacaagactcattcgaataaattccaaggagtggagaccccatcacagaaccgctatgtcggatactttgcgcaggtgaagcatctgtacaactggaatcttcctcctcggcgaatcctgtttatcaagcgctttattatctactcaattcgcggggacgtctgcgacctgaaggttcaggtggtgatggaaaaaaaagtggtcttctcctcaacctccctcggtaattgcagcatcctccacgacatagaaacagataaaattctgataaacgtgtacgatggaccaccactgtatgacgacgtgaaggtgcagtttttttctagcaacctgcccaagtactatgataactgtcctttctttttctggttcaatacctccttcatccagaacaataggctttgccttcctcgcaatgaactggataaccctcataaacagaaggcttggaagatctacccgcctgagtttgctgtggagatattgtttggggaaaagtag

SEQ ID NO: 31108 - DNA, 1338 bp, Artificial Sequence
  Description of Artificial Sequence: Synthetic coding sequence
atgaatgagtcaccgcagaccaacgagtttaagggcacaactgaagaagcacctgcaaaagagagcccccatacctccgaatttaaaggagccgccctggtgtcgcccatctccaaacgtatttttggagtctttctggtgcttctagacgttactctgctgcttgctgatctcatatttactgacagcaagctgtacatccccttagagtatcgaagcatcagcctcgcaatcgggctgttctttttaatggatgttctgctgcgagtttttgtcgaaggctggacacatctggtccgtcttctgcgactcattatcctaataagaatcttccacctcttgcatcagaagcggcagctggagaaacttatgcgaagactagtgagtgaaaacaagcgtaggtataccagggatggtttcgacctggacttgacttacgtgaccgagaggattattgctatgtccttcccatcgagcggcagacagtccttctatcgtaatcccatcgaggaggtggtccgtttcctcgataagaaacaccgcaatcattatagggtatacaacctttgctctgagcgtgcatacgacccaaaacatttccacaacagggtgtcccgcattatgattgatgatcacaatgttcccactctgcatgagatggtggtgtttactaaggaggtaaatgagtggatggctcaggatctggaaaacatcgtagcgatccattgtaaaggcggcaagggtcgtactggaacaatggtctgcgcattgctgattgcgtccgagatttttctgactgcagaggaatcactgtattactttggcgaaaggcgaaccaacaagacacatagtaacaagttccagggcgttgaaaccccatcccagaacagatatgtcggatatttcgctcaggtgaagcacctgtataactggaacctccctcccaggaggattctcttcattaaacgattcattatctattccattcgcggtgatgtatgtgacttgaaggtgcaggtggtaatggagaaaaaagtcgtctttagcagcacatccctcggtaactgttccattttacatgatattgagactgataagattctgatcaacgtctacgacggccctccactttacgatgatgtgaaggttcaatttttttcatccaacctccctaagtattatgataattgcccgttttttttctggtttaataccagctttattcagaataatcggctttgcctgccacggaacgaattggacaacccccataagcaaaaagcatggaaaatctaccctcccgagttcgccgtggaaattctgttcggagaaaaatag

SEQ ID NO: 31109 - DNA, 1236 bp, Artificial Sequence
  Description of Artificial Sequence: Synthetic coding sequence
atgaacgaatctccacaaactaatgaatttaaaggcactacagaggaggcacctgctaaagagtccccccacactagtgaatttaagggcgcagccttggtgtcaccaatctccaaatccatgttggagagattatccaaattcgaagtcgaggatgctgaaaatgttgcaagttacgagtggacccaccttgtgagacttctgcgcctcataattcttataaggatcttccatcttttgcatcagaagaggcagttagaaaagttgatgcggcgcctcgttagtgaaaacaagcgcagatatactcgtgacgggttcgatctcgacctgacctacgttaccgaaaggatcatcgcaatgtcattccctagcagtggcaggcagtccttctaccgtaaccccatagaagaggtcgtcaggtttctggacaagaaacacaggaatcattacagggtttacaacttatgtagcgagcgggcctacgaccccaagcattttcacaatagagtcagtagaataatgatagacgaccacaatgtgcctactttacacgagatggttgtgtttaccaaggaggtgaatgagtggatggcgcaggacctggaaaatattgtggcaatacactgtaaaggcggcaagggaaggacagggacaatggtgtgtgctttgctcattgcaagcgagatttttctgacggcggaggagagtctctattacttcggcgagcgacggaccaataagacacactctaacaaattccagggggtggagaccccctctcaaaatcggtatgtgggttatttcgcccaggtaaaacacctctacaattggaacctgcccccccgccggatcctgttcatcaaaaggttcatcatttattctattaggggagacgtgtgtgatttaaaggtacaggtcgtgatggagaagaaagttgttttttcatccacttccctcggcaattgtagtatactacacgatatcgagaccgataaaatcttgatcaatgtgtatgatggaccgcccctgtatgatgatgtaaaggtgcagttcttttcttctaacctaccgaaatactatgataactgtccgttctttttttggtttaacacatcttttattcaaaacaatcggctgtgtctgcctcgtaatgaactagacaatcctcataagcagaaggcttggaagatttatcctcctgagttcgcagtagagatcctgtttggagaaaaatag

SEQ ID NO: 31110 - DNA, 1569 bp, Artificial Sequence
  Description of Artificial Sequence: Synthetic coding sequence
atgaatgaaagtccccagactaacgagtttaagggaactaccgaggaggcaccagccaaggaatccccccatacttccgaattcaagggagccgctctggtgtctcctatttccaaatcaatgctcgaacgtctttccaagttcgaggtggaggatgccgagaatgtggccagttacgattccaagattaagaaaatcgtacattctatcgttagctcctttgcatttgggattttcggagtctttctggtgctactggacgttacacttttactggcagatctcatctttaccgactccaagctgtacatcccactggaataccgctccatctctcttgcgattggcctgttttttctcatggacgtgctgttgagagtctttgtggagggccggcagcagtattttagcgatcttttcaacattctggatacggcaattatcgtgattcccctgctcgtcgacgtgatctacatctttttcgacatcaaattgctgagaaacattccacggtggacacacttggtgaggttgttacgcttgatcattttgataaggattttccacctattgcaccagaagaggcaactggagaaacttatgcgacgcctagtctccgagaacaagcgaagatatacccgcgacgggttcgatctggatctgacatacgttacggagagaataatcgctatgtccttcccatcttcgggaaggcaaagtttttatcggaaccccatcgaggaggttgtgcggttcctggacaaaaaacatagaaaccactatagagtgtataatttatgcagtgaaagggcttatgaccctaagcacttccacaacagagtgtcaagaatcatgatcgacgatcacaacgtgccaaccctacatgaaatggtggtgtttaccaaggaggtgaacgaatggatggctcaggacctggagaacatagtcgcaatccattgtaagggaggaaagggtcggacaggaaccatggtatgcgccttgctgattgcatccgagattttcctaaccgccgaggagtctctttattattttggagagcgtcgtaccaataagacgcactctaacaagttccaaggggtggagactccgtctcagaacagatacgttgggtacttcgcccaggtaaagcacctgtataactggaatctgccgcccaggcggattttgtttatcaaaagatttattatttattcgattaggggggatgtgtgcgacttgaaggtccaggtcgtcatggagaagaaggtggtgttctcttctactagtttggggaattgcagcatcctgcatgatattgagacagacaaaatacttataaacgtgtatgacggacccccactctatgatgatgtcaaagtgcagttcttctcctccaatctgccgaagtattatgacaattgtcctttcttcttctggttcaacacttcgttcatccagaataaccggctgtgcctgccccggaatgagcttgataatcctcacaaacagaaagcatggaagatctacccccctgagtttgctgtggaaatcctattcggcgagaaatag

SEQ ID NO: 31111 - DNA, 975 bp, Artificial Sequence
  Description of Artificial Sequence: Synthetic coding sequence
atgaatgaatctccgcagacgaacgagtttaagggtactaccgaggaagcccctgcgaaggaaagcccccatacttcggagtttaagggggcagcacttgtgtcacctatttctaaacgttggacgcatctagtccggctgcttagactgatcatcttaatcagaatctttcatctgctccaccagaagagacagttagagaagctaatgcgcaggcttgtgagcgaaaacaaacggcgatatacccgggatgggttcgacctcgatcttacctacgtgacagagcgaatcatagctatgagctttcctagctctggccggcaatcgttttatcgaaatccaatcgaggaggtcgtcagattcttggataaaaagcacagaaatcactaccgggtatataacctgtgttctgagagagcctacgatccgaagcacttccataatcgggtgtccagaatcatgatcgacgatcataatgtccccacactgcatgaaatggtggtatttaccaaggaggttaacgagtggatggctcaggacttggagaacatcgtggcaatacattgcaaagggggtaaaggtcgcactggcaccatggtgtgtgccctactgatcgccagcgaaattttcctgacagcagaggagtctctatactatttcggcgagcggagaacgaacaagactcattctaacaaatttcagggagttgaaacaccctcccagaatcgatacgtaggctactttgcccaggtgaagcatttgtacaactggaaccttcctccacgcagaatcctgtttatcaaaaggttcatcatctacagcatcaggggcgacgtctgtgacctgaaggttcaggtagtcatggaaaagaaagtagtattttcttccaccagcttgggtaactgttctcgagaagagggctctacacgggccaactggaagggagagccaagccgcaggccggtgctagattag

SEQ ID NO: 31112 - DNA, 1236 bp, Artificial Sequence
  Description of Artificial Sequence: Synthetic coding sequence
atgaacgagtcaccccaaactaacgagtttaaagggactacagaagaggctcctgctaaggagagtccccacaccagcgagttcaaaggtgccgcacttgtatctccaatcagtaagagtatgcttgagaggctctctaagtttgaagttgaggatgctgagaatgtagcttcatacgagtggacccatcttgttcgtctgctccgtctcatcatcctcatccggatatttcacctcctccaccaaaagaggcagctggaaaagttgatgcgccgactggtgagtgagaataagcgaaggtacaccagggacgggtttgatctagatctcacctacgtaaccgagaggatcatcgccatgagttttccctccagcggacgtcagtcattctaccggaatccaatagaagaggtggtgcgcttcctagacaagaagcatagaaaccactaccgcgtgtataacctgtgttcagagagagcttatgaccccaagcacttccacaatcgcgtctctagaattatgatagatgaccacaacgttccgacccttcatgagatggtcgtgtttactaaagaggtgaacgagtggatggcacaggatttagagaacattgtggctatccactgcaagggcggcaaaggtagaacggggactatggtctgcgcactgctgatcgcctctgagattttcttgaccgccgaagaatccctgtattacttcggggagcgccggaccaacaagacccactccaacaaatttcagggcgtggagactccatcgcaaaatcgttacgtcgggtatttcgcccaagtgaagcacctgtacaattggaatttgccgccaagaagaatcctgttcatcaagaggtttatcatctactccatacgcggagacgtgtgcgacctgaaggtgcaggtggtaatggagaaaaaggtcgttttttcgagtactagcttaggaaactgctcaatactgcacgatatcgaaacggacaaaattcttatcaacgtctatgatggaccacccctgtacgacgatgtgaaggtacaattcttctctagtaatctccccaaatattacgacaactgcccattttttttttggttcaatacttcctttatccagaacaaccgcctctgcctcccacgtaacgagctggacaatccccacaagcagaaggcctggaaaatctatccccctgaatttgcagtcgagatcttgttcggagaaaagtag

SEQ ID NO: 31113 - DNA, 1257 bp, Artificial Sequence
  Description of Artificial Sequence: Synthetic coding sequence
atgtataggcctgctagggttacttcgaccagccggttcctgaacccttatgtcgtctgcttcatcgtggtggcaggagttgtgatcctcgccgtgacaatagcattgttggtgtattttctcgcattcgatcagaaaagctatttctatagatcatcattccagttgctcaacgttgagtataacagtcagttaaactcccccgccactcaggagtaccgcacactgagcggaaggatagaatcactgattacaaaaaccttcaaggagtccaacctccgcaaccagtttattagggctcatgtggctaagctgagacaagacgggtcgggggtgagggctgacgtggtcatgaagttccagtttacgagaaacaataacggagcaagcatgaagagcaggatcgagtccgtgctgagacagatgttaaacaactccggaaatttggagattaatccatcaacggagattacctctctgaccgatcaagctgcggcaaactggctgatcaatgagtgtggggcgggacctgacctaattacgctctcagagcagcgtatcctcggcggcacagaagccgaggaggggagctggccgtggcaggtttccctgagactcaacaacgctcatcattgcggcggatccctaatcaacaacatgtggatattgactgctgctcactgcttcagaagtaacagcaatcctcgcgactggatcgccacttctggcatttcaacaacgttccccaaactacggatgcgcgtgcgtaacattttgattcacaacaactataaatctgctactcacgaaaatgacattgctctggtccgcctcgaaaattctgttacttttaccaaggacattcactctgtctgtctcccagcagctacccaaaacatacctcctggcagtacagcctatgttacaggttggggcgcacaggaatatgccggccacaccgtacccgagctcagacaagggcaggtgcgtattatcagtaacgacgtgtgtaatgcacctcattcatataatggtgcaatcctgtccggcatgctctgcgccggtgtgcctcagggcggtgtcgatgcctgtcagggggacagcggcggacccctcgtgcaggaggacagcaggagactctggttcattgtgggaattgtttcgtggggggaccagtgtggtctacctgacaagccaggtgtgtatacacgagtcactgcatacctcgattggattagacaacagactggtatctag

SEQ ID NO: 31114 - DNA, 906 bp, Artificial Sequence
  Description of Artificial Sequence: Synthetic coding sequence
atgaaatttcaattcacgcgtaacaacaacggcgcgtcaatgaaaagccgcattgagagcgtcctgaggcagatgctgaacaatagtgggaatcttgagatcaatccaagcacagaaattaccagtctcactgaccaagccgccgccaattggctcatcaatgagtgtggcgccggccccgacttgatcactctgagcgaacagcgtatcctgggaggaacggaagcagaggagggaagctggccatggcaggtgagtctgcgattgaataatgcccatcattgcgggggcagcctcatcaacaacatgtggatcctgactgcagcgcactgctttaggtccaatagcaacccacgtgattggattgcaacatcaggcatcagcaccacctttcccaagcttaggatgcgggtccgcaatatactgatccacaataattataaatccgccacccacgagaacgacatcgcgttggtcagactcgagaattccgttaccttcactaaagatattcacagcgtgtgcctacctgcagccacgcagaatattccaccagggtctacagcctatgtcacagggtggggggcccaggaatatgcgggacataccgtccccgaactaagacagggacaagtgagaattatcagcaacgacgtgtgtaacgcaccgcattcttacaacggtgctatcttaagtggcatgttgtgcgctggggtaccgcagggcggggtcgacgcatgccagggagactctgggggtcctttggtccaagaggatagccgaaggttgtggtttatcgtgggcattgtatcctggggagaccagtgtggtttaccagataaaccaggagtgtacacccgggtgaccgcttatctggactggatacgtcaacagaccggaatctag

SEQ ID NO: 31115 - DNA, 3060 bp, Artificial Sequence
  Description of Artificial Sequence: Synthetic coding sequence
atgggctccaaacggggtataagtagcagacaccactcgctgagtagctacgaaatcatgttcgctgcccttttcgccatcttagttgtcctgtgtgccggactgattgctgtgagctgcctgacaatcaaggaaagccagcgaggagcagctctgggccagagccacgaagcacgggccaccttcaaaatcacttctggcgttacatataacccaaatctgcaggacaagctgtctgtagattttaaggtgctggccttcgatctccaacagatgatcgatgaaatcttcttgtcttccaaccttaagaacgagtataagaactccagggttctacagttcgaaaatggcagcatcattgtcgtgtttgatctgttttttgctcagtgggtcagcgacgagaatgttaaagaagagttgatccaagggctggaggcaaacaaaagctctcagctcgttaccttccatattgacttgaacagtgtggatattctggataaattgacgactaccagtcatctagccactcctggcaacgtgagcattgaatgtcttcccggctctagcccttgtactgacgcactgacttgcataaaagctgaccttttctgcgacggagaggtaaactgccccgatggcagcgacgaggataacaaaatgtgtgccaccgtgtgcgatggtcgttttctgctgactggatcctctggaagtttccaggctacacattatcccaagccttcagaaacctctgtggtgtgtcaatggattataagagtgaatcaaggcctcagcattaagctctcatttgatgatttcaacacgtattatactgatatcctggacatttatgaaggggtggggtcatcgaaaatcctgcgggcaagtatctgggagacgaatcccggaaccattagaatctttagtaatcaagtaactgcgaccttcctcattgagtctgatgagagtgactacgtaggctttaatgcaacgtataccgcatttaattcttctgagcttaataattacgaaaagattaactgtaattttgaggacgggttctgcttttgggttcaagacttaaatgatgacaatgagtgggagcggattcagggctccaccttcagtccctttaccggacctaacttcgatcacacttttgggaacgcaagtgggttctatataagcactcctactgggcctggcggtagacaggaaagagtggggcttttgtctctaccactggatcctactttagagcctgcgtgcctgagtttttggtaccacatgtatggcgaaaatgtgcataagctgtcgatcaacatcagcaatgaccaaaacatggagaagactgtgttccagaaagagggtaactacggtgataactggaattatggacaagtcactttgaatgagacggtgaaatttaaagtggccttcaatgccttcaaaaacaaaatcctctcggatattgcactggacgatatctccctcacgtacggtatatgtaacggctccctttatcctgagcccactctggtgcctacccccccacctgagctgcccactgactgcggcggtccttttgaactctgggagccaaacactacctttagctcaaccaactttcctaactcctaccctaacttagcattttgcgtgtggattctaaacgcacagaaggggaaaaatatacaactacacttccaggagtttgacctggagaacattaatgatgtggtagaaatcagagatggggaagaggcagatagtcttctactggccgtgtatacggggcctggacccgtgaaggatgtgttctcaacaacaaaccgaatgacggtgctgctgatcacaaacgatgtacttgctaggggaggattcaaggccaactttacgactggttaccacttagggatcccggaaccatgtaaagccgaccacttccaatgtaagaatggtgagtgcgtgccactcgtgaacctctgcgacggtcatctccattgcgaggatggctccgatgaggccgactgtgttaggttcttcaatggaactacaaataacaacgggctagtccgcttcaggattcaatctatttggcataccgcctgtgctgaaaactggactacccagatctccaatgatgtgtgtcaactgctggggctcggtagcgggaattcctcgaaacccatctttccaaccgatggaggcccctttgtgaaactgaatactgcgcctgacggccatctcattctgaccccgagccaacagtgcctccaggattccctgatcagactacagtgcaatcataaaagctgcggaaagaaacttgcggcccaagacatcacccccaaaatcgtgggagggagtaatgcaaaggagggtgcatggccctgggttgttggcttgtactacggagggagactgctgtgtggagccagcttggttagctccgattggctggtttccgctgcccactgcgtgtacggtcgcaacctggagccgagtaagtggacagcaattttgggcctgcacatgaaatctaacctgacttctccacagacagtccccaggcttatcgacgagatagtaatcaacccccactataacaggcggaggaaagataacgatattgctatgatgcacttagaatttaaagtgaattatacagactacatccagccgatttgcctgcctgaagaaaaccaggtgtttccacccggccgaaactgcagcatagccggctggggcaccgtcgtgtaccaagggactaccgcaaacatcctgcaagaggcagacgtgccactcctgagcaatgaaagatgtcaacagcagatgcccgaatataatatcactgagaacatgatctgtgctgggtatgaggagggggggattgatagctgtcagggagactctggtggacccttgatgtgccaggagaacaaccggtggttcctcgcaggcgtgacctccttcggatataagtgcgccctgccaaatagacctggcgtatacgcgagggtgagtagatttaccgagtggattcagtcgttcttacactag

SEQ ID NO: 31116 - DNA, 2154 bp, Artificial Sequence
  Description of Artificial Sequence: Synthetic coding sequence
atgttccggattaccaacatcgaatttctgccagaataccggcagaaagaatctcgcgaattcctctctgttagccggaccgtgcagcaggttataaatctcgtgtatacaaccagcgctttcagcaaattctacgagcagagcgtggtggccgatgtgagtaacaacaaaggcggactgctagtgcacttctggatagtcttcgtgatgccaagggcaaaaggacacattttttgtgaggactgtgtggctgcaatactcaaggattccatacagacatcgataatcaaccggacctctgtgggatcactccagggactggccgtggatatggatagtgtggtgctgaacgataaagggtgctctcaatacttttacgcagagcatctgagccttcactaccctctggagatttctgctgcctctgggagactgatgtgccactttaagctggtggcgatcgtgggctatctgattagactgtctatcaagtcaatacagattgaagcagacaactgtgtcactgactctctgacaatatacgattcgctcctacctattagatcaagcatcttgtaccggatttgtgagcctacccgcacgttgatgtctttcgtgagtactaataatctgatgctggtgacttttaagtccccccatattcgcagactgtccggcatcagagcttacttcgaggtgatcccggagcagaagtgtgaaaatacagtcctagtcaaggacatcactggattcgagggtaagatctcatcgccttactatccgtcctactatcccccaaaatgtaagtgcacctggaagttccaaacaagtttatctactctgggtattgcactgaagttctataattactccatcacgaagaaaagcatgaaagggtgtgagcacggctggtgggagatcaatgaacacatgtattgtggctcatacatggatcaccaaacaatctttcgcgttccttcccctctggtccacatccagctacagtgcagttcccggcttagcgacaagcccctcctcgcggaatacggctcctataacatcagtcagccctgtccagttggaagttttagatgcagctcaggtctgtgcgtcccccaagcccaacggtgtgatggtgtaaatgactgctttgatgagtcagatgagctcttctgtgtgagtccccagcctgcatgcaatacctccagcttccgtcaacacgggccccttatctgtgatgggtttcgtgattgcgaaaatggccgtgatgaacagaactgcacgcaaagtatcccttgcaacaacaggacatttaagtgtggcaacgacatttgtttcagaaaacagaatgcaaagtgcgacggaactgtggactgtccagacggcagcgacgaggaaggttgcacctgttctcgaagctctagtgccctgcaccggatcattggaggtaccgacacactggaaggcgggtggccatggcaagtttccctgcactttgtgggcagtgcctattgcggcgctagcgtcatttcacgtgaatggctgctgagcgccgcccactgcttccacggaaaccggcttagcgacccaaccccttggacagcccaccttggtatgtatgtgcaaggtaatgcaaagttcgtgtccccagtgagacgaatcgtcgtgcacgaatattacaactcacagacctttgactacgatattgcattactccaattgtcgatcgcttggcctgagacccttaagcagttaatccagccaatctgtatccccccgacaggacaacgcgtaaggagcggcgagaagtgctgggtgaccggctggggcaggagacacgaggctgataacaaagggtcgctagtgctgcaacaggcggaggtggagctgatagaccaaaccctgtgcgtgagcacatacggcatcattacctcccgaatgctttgcgcaggaattatgagcggaaagagagacgcatgcaaaggcgacagcggaggaccactctcttgcaggcggaaaagcgatgggaaatggatacttacaggaatcgtctcctggggccacggatccgggaggccaaacttccccggcgtttacacccgcgtcagtaacttcgtaccatggatacacaagtacgttccgtcactcttgtag

SEQ ID NO: 31117 - DNA, 2454 bp, Artificial Sequence
  Description of Artificial Sequence: Synthetic coding sequence
atggacaaagaaaactccgatgtctcagctgctcccgccgaccttaaaatttcaaacatttccgtgcaagtggtctcagcacaaaagaaacttccacccggcaggcgacccccgcaaagaccaatcggtaaagccaaacctaagaagcagtccaaaaagaaagtacccttctggaatgtgcaaaacaagatcatcctgttcacggtttttttgtttatcctggctgttatcgcctggaccttgttgtggctgtatatcagcaaaaccgagtcaaaggacgcattttactttgccggcatgttccgcatcaccaatatagaatttttgcccgagtataggcagaaagaatctagagaatttctatctgttagtaggacagtgcagcaggtaattaacctggtgtacactacgagcgccttttccaaattttacgaacaaagtgtggtggcggatgtttctagcaataacaaaggaggtcttctggtgcacttctggattgtgtttgtgatgcctagggctaaggggcatatcttttgcgaagattgtgttgcggctatcctcaaagacagcatccagacatccattataaaccggacgtctgtcggctccctccagggcctcgccgtcgacatggactccgtggttcttaacgacaagggctgcagccagtacttctacgcagagcacctttcattgcattacccgctagaaatatcagcagcaagcggaagacttatgtgccacttcaagctcgtggcaatcgttggctacctcattagattatccattaaaagtatccagattgaagcagataactgtgtcactgattccctaacgatatatgacagtctgctgcctattcggagctccatcctttaccgtatatgcgagcctacgcgcactctgatgtcgtttgtgtcaacgaacaacctgatgctggtaaccttcaagtccccgcatatacgtcggctctcgggcattcgcgcttatttcgaggtcattccagagcagaaatgcgaaaatacggtgcttgtgaaagatataaccggcttcgagggaaaaatctcaagcccttattacccttcctactatcctcccaaatgcaaatgtacatggaagtttcaaacgagtcttagcactctggggatcgctctgaagttctataactactccattacaaaaaaaagtatgaagggttgtgagcacgggtggtgggagatcaacgagcatatgtattgcggcagctacatggatcaccagaccatctttagagttccttccccgctcgttcacattcagcttcagtgtagctctcggctcagtgacaaacccctgctcgctgagtatgggagctacaacatcagccaaccttgtcccgtaggatcttttcggtgttcatccggattgtgtgttccacaggctcagcgatgcgatggagtgaatgattgttttgacgagtccgacgagttgttctgcgtctctccccagcccgcctgcaacacatccagcttccggcagcatgggccactaatctgcgatggatttcgggactgtgaaaacgggcgggacgagcagaattgcactcaatcaattccctgcaacaatcgcaccttcaaatgtggcaatgacatttgctttaggaaacagaacgcaaaatgtgatgggaccgtggattgtccagacgggtccgacgaagagggatgtacctgctcccgctccagctccgccctacaccgaattatcgggggcacagacactctggaaggggggtggccctggcaagtgtcgttacatttcgtgggaagtgcctattgtggtgcttcagtcatttcgcgcgagtggctgctctccgctgcacactgttttcatgggaataggctgtcagatcccacaccgtggacagcgcatctgggaatgtatgttcagggcaacgcaaaattcgtgtccccggttagacgcatcgtggttcacgaatactacaattcgcaaacctttgattatgacatcgctctgctacagctgtcgattgcgtggccggagaccttgaaacagctgatccaaccgatttgtataccacccaccgggcagcgggtaaggtccggcgaaaagtgttgggtaaccgggtggggaagacgccatgaagcggacaataaaggctccttagtgctccagcaggctgaagtggagctgatcgatcagaccctttgtgtgagcacttacggtataatcacaagccggatgttgtgtgctgggatcatgtccggtaagcgggatgcctgtaagggagactctggggggcctctgtcttgccgacggaaatcagacggtaagtggatcttaaccggaatcgtttcatggggccatgggagtggacgtccaaattttccgggagtgtacacccgggtatccaacttcgtgccgtggatacataaatacgttccctcattactgtag

SEQ ID NO: 31118 - DNA, 2496 bp, Artificial Sequence
  Description of Artificial Sequence: Synthetic coding sequence
atggacaaggagaattccgatgtctcggccgcccctgcagatctgaagatcagcaacatatccgtgcaggtggtgtctgcacagaaaaagctcccccctggccgccgaccaccacaacgcccaattgggaaagcgaagccaaagaagcagtccaagaaaaaagtgcccttttggaatgtccagaacaagatcattctgttcacagtgttcctgtttattctcgccgtgattgcctggaccttattatggctgtatatatctaagacagagagcaaagatgccttttacttcgctggcatgtttagaattaccaacattgagtttctgcctgagtatagacagaaggagtcgcgcgagtttctgtccgtgagcagaactgtccaacaggttatcaatctggtctatacaacctccgcatttagcaagttttatgagcaaagcgtggtggctgacgtgtcttctaacaataaagggggactgctggtgcacttttggattgtgttcgtgatgccacgggccaaggggcacattttctgtgaagactgtgtcgccgcaatcctcaaagactccattcaaacatccataatcaatcggacaagtgtaggcagccttcagggactggccgtggatatggacagtgtggtcaacgccgccggcctgcgttccgactattcctcgaccattggcagtgccgacaaggggtgtagccagtacttctacgcagaacacctatctcttcactacccattggagattagtgccgcatccgggaggctgatgtgtcattttaaactcgtggctatcgtcggctacctgatacgcctgagcattaagtccattcagattgaggccgacaattgcgtgaccgattcactcactatttatgactccctcttacccattagatcgtcaattctgtaccgcatctgcgagccgaccaggacacttatgagctttgtgagcaccaacaacctaatgctggtgacattcaaatcacctcacattcgcagactcagcggcattagggcatactttgaagtgatcccagaacagaaatgcgagaacactgtcctagtgaaggatatcacggggttcgaaggtaaaatatcatccccctattatccaagctattaccctcctaaatgtaagtgcacgtggaagtttcagacgagcctctcaacactcggcattgctttaaagttttacaactattctatcacaaaaaagtccatgaagggctgcgagcatgggtggtgggagattaacgagcatatgtattgcggaagctacatggaccaccaaacaatctttagggttccctctccactggtgcatatccagctgcagtgcagtagtcggctgtccgacaaacctttgctggcggagtacggctcctacaatatttctcagccatgccctgtgggctcatttcggtgctcctccggcctgtgtgttcctcaggcccagaggtgcgatggcgtcaacgattgtttcgatgagagtgatgagctcttttgtgtgtcccctcagcctgcctgcaatacctcatcttttcgtcagcatgggccgctgatatgcgatggttttcgggattgcgagaatggcagggacgaacagaactgtacgcagtccatcccgtgtaacaatagaacgtttaagtgcgggaacgatatttgctttcggaagcaaaacgctaagtgcgacggtacagtggattgtcccgatggatcagatgaagagggctgcacatgctctcgttcttcatccgcactgcatcgtattatcgggggcaccgacactctggaaggcggatggccctggcaggtttcactgcattttgtaggctccgcttactgtggagccagcgtgatctcacgcgaatggctgctgtctgccgctcactgctttcacgggaacaggttgtcagatcccacaccatggacagctcacctcgggatgtacgtccagggtaatgcgaagttcgtttcaccagtacgaaggatagtggtgcacgaatattataattcccagacatttgattacgacatcgccttgctgcagctgagcatagcctggcccgagactctgaagcagctgattcaacccatctgcatacctcctaccggacagagagtgagaagcggcgaaaaatgttgggtcacaggatgggggcggagacacgaggccgacaacaaaggatctctcgtgctgcaacaagcagaggtggaattgattgaccaaactctgtgtgtttccacatatgggatcatcacgtctcggatgctgtgtgccgggattatgtcaggcaagcgcgatgcctgcaaaggggactcaggtggccccctgtcctgcaggagaaaatcggacggtaagtggatattgactggcatcgtgagttgggggcacggtagtggcagacctaattttcccggtgtgtacacccgagtctcaaacttcgtgccctggatccataagtatgttcccagcttgttgtag

SEQ ID NO: 31119 - DNA, 2532 bp, Artificial Sequence
  Description of Artificial Sequence: Synthetic coding sequence
atggataaggaaaactctgacgtgagcgcggctccagccgatcttaaaatctcaaatatcagcgttcaagttgtgtccgcccaaaaaaaactccctgtcagacggcctcctctcccaggaaggcggctgcccttgccggggcgcaggcctccgcagaggccaatcgggaaagccaaacctaagaagcagtctaagaagaaagtacctttctggaatgtccagaacaaaataatattattcaccgtgttcctatttattctggctgtgatcgcttggacgcttctttggctgtacatatcaaagacagagagcaaggacgcgttctacttcgcggggatgttccgcatcactaacatcgaattcctgcctgaataccgccaaaaagagagcagagagttcctgagcgtgtccagaactgtgcagcaagtgattaacttggtgtacacgacttcagccttctcaaagttttacgaacaatccgtggtcgccgatgtgagttctaataacaagggcggactgctggttcatttctggatcgtctttgtgatgccccgcgctaaggggcacatattctgcgaagactgtgtcgctgctatcctgaaagatagtatccaaacaagcatcattaatagaacctccgtcggatcactccagggcttggcggtagatatggacagcgtcgtgctgaacgctggactgagaagcgactactctagcactattggatccgataaaggctgttcacaatatttctacgctgagcatctgagtctgcattatcctctggagatctccgccgcttctgggcggctgatgtgccacttcaaactcgtagctatcgtgggatacctcattagactctctattaagagcatacagatagaagctgataactgtgtaacagactccctgaccatttacgattccctcttacctatccgcagctctattctctatagaatctgcgaacctactcgcaccctgatgtcttttgtgtctactaacaatctgatgctggtcacgttcaagtcccctcacatacgccgcctcagtggtatacgggcttactttgaggtgatcccagagcagaagtgcgaaaatactgtcttggtgaaggacattaccggttttgagggaaaaattagctctccctactatccctcttattaccctcctaagtgcaagtgcacatggaagtttcagacctccctcagcaccctgggtatcgccttgaagttctataactactccataaccaaaaagagcatgaaaggatgcgagcatggctggtgggagatcaatgaacatatgtattgcggaagctacatggaccaccaaaccatcttccgcgttccctctcccctggtgcatatacagctccaatgctctagtaggctatctgataaacccctactggctgagtatggttcgtacaatatcagccagccatgccctgttggtagtttcagatgttctagcggcttatgcgttccacaggctcagcgctgcgatggcgttaatgattgcttcgacgagagcgacgagctcttctgtgtcagcccccagcctgcctgtaatacgtcctccttccgccaacatggccccctgatttgcgatgggtttcgtgactgcgagaatggtcgggacgaacagaattgtacccaaagcatcccatgtaacaataggaccttcaaatgcgggaatgacatttgttttcggaaacagaacgcgaagtgtgatggcacagtggactgccccgacggtagcgacgaggaggggtgcacctgtagtagatccagctcagccttgcatagaataatcggaggaacagataccctcgagggggggtggccttggcaagtcagcttacacttcgtcgggtccgcgtactgtggcgcaagcgtgatttccagggagtggttattgtccgctgcccattgcttccacggtaaccgactcagcgatccaaccccatggacagcccatttaggtatgtacgtccagggcaatgctaagtttgtcagtcccgtcagacggatcgtggttcacgagtactacaactctcagacattcgactatgacattgcgcttctacagctcagtattgcctggcctgagaccctaaaacaactgatccagccaatttgcataccaccaacaggacagagggttagaagcggggagaagtgttgggtgactgggtggggccggcgacatgaggccgataacaaagggagcctggtactacaacaggctgaagttgaactgatcgatcagaccctgtgcgtctcaacatatgggatcatcacatcccggatgttatgcgcagggattatgtcaggcaagcgggacgcatgcaaaggcgacagcggcgggcctcttagttgcaggcgaaagagcgacggcaaatggatattgaccggcattgtctcttgggggcacggatcggggaggccaaatttcccaggcgtttacactagggtgagcaactttgtgccttggattcataagtacgttcctagcctcctttag

SEQ ID NO: 31120 - DNA, 3180 bp, Artificial Sequence
  Description of Artificial Sequence: Synthetic coding sequence
atggaacctaccgtagctgatgtgcacctggtgccacgcactactaaggaggtgcctgcattggacgctgcctgttgtcgggcagccagcatcggcgttgtagcaacctccttggtcgttctaactctaggggtgctcctggcatttttgtctacccaaggtttccacgtggaccacaccgccgaattgcgtggaatcagatggacttctagcctacggcgcgaaacctctgactatcacagaaccttgactcctaccctggaggctttactgcacttcctgctgagacccctgcaaacactatccctgggcttggaggaggaattgctccaaagagggatccgggctcgcctcagagagcacggcatcagcctcgctgcttatggcaccatcgtctctgcagagctaactgggaggcacaaaggccctctcgcagagcgcgacttcaagtcgggcagatgccctggcaactctttctcctgcgggaacagtcagtgtgtgactaaagttaaccctgagtgcgacgaccaggaggactgtagtgacggtagtgacgaagcccattgcgagtgcggactgcagccggcatggagaatggcaggccgcatcgtgggcggtatggaagcatctccaggagagttcccctggcaggcctctcttcgcgagaacaaggaacatttttgcggagccgctattattaatgctcgctggctcgtcagtgcagcacactgcttcaatgaattccaagatccaactaaatgggtggcctacgtgggcgcgacctacctgtctgggtccgaggcttctaccgtgcgggcccaggtggtgcagatagtgaagcaccctttgtataatgctgatactgctgacttcgacgtcgccgtcctggaactaactagcccactgccctttggccgtcacattcagccagtttgcctgcccgcagctacacacatcttccctccttctaaaaagtgcttgattagcgggtggggatatttaaaagaagacttcttagtgaagcctgaagtcttacagaaggctaccgtggagcttttggatcaggcgctatgcgcctccctatatgggcacagccttacagaccggatggtgtgtgcaggatacttagacggtaaggtggattcctgtcagggcgacagcggaggcccactcgtgtgcgaagaaccgtcaggtcggtttttcctggctggaatcgtgtcctggggcatcgggtgtgctgaggctcggcgacctggagtctacgcacgagtgacacgtctgcgcgactggattttggaggcaacaaccaaggccagcatgcccctggctccaaccatggctccagctccagcggcacccagcactgcttggcccacttcaccggaatcccccgtggtgagcacaccaacgaagtcaatgcaggctttgtctaccgtgcccctagactgggttaccgtgccgaaactgcaggagtgcggagccaggcccgccatggagaagcccacgcgcgttgtgggtggtttcggtgcagcaagcggtgaggtgccttggcaagtaagcctgaaagaggggagtagacatttttgtggcgctactgtggtgggagaccgctggcttctttctgctgcccactgcttcaaccacacgaaagttgagcaggtgagagctcatctgggcacagcgtcactcctggggctcggaggaagccccgtgaagataggattacgtcgggtcgttctgcaccctctgtacaacccaggcattctggattttgacctagcggttttagagctggcaagtcccttagccttcaataaatatatccagccggtgtgcttgcctctggccattcagaaatttcccgtcggcagaaagtgtatgatcagtggctgggggaatacccaagaagggaacgcgaccaagcccgagttactacaaaaagctagtgtcggtatcattgatcagaaaacctgtagcgtcttatataatttcagcctcaccgacagaatgatctgtgccgggtttctggaaggcaaggtagattcgtgccagggggattctggtggccctctggcatgtgaagaggcacctggcgtcttctacctggcaggcattgtgtcatggggcatcggctgtgctcaggttaagaagccgggcgtgtatactcgaatcactcgccttaaagggtggatcctggagatcatgtcatcacagcctctccctatgagccccccaagcactacaagaatgctggccaccactagcccacggacgacagcagggctgactgtgccaggagcaaccccatcccggccaacacctggtgccgcctcccgtgttactggccagccagccaatagtactctcagcgcagtgagtaccactgcgagaggacaaaccccgtttcccgacgcccccgaagccactactcatacccagctccctgattgtgggttggcccctgcagctctgacaaggattgtgggcggttctgctgccggccggggtgaatggccttggcaggtgtctctgtggttgaggaggcgtgaacatcgctgcggtgccgtgctggtggcagagagatggctgctgtccgccgcccattgcttcgacgtgtatggggaccccaaacaatgggcagcttttctgggcaccccctttcttagcggggccgaaggccaactggaaagggttgcccgtatctataaacacccattctataacctctataccttggattatgacgtggccctgttggagctggccgggccggtcagaaggtctagactggtccgccccatatgcctcccagagcctgcgccccgcccacccgacggcacccggtgtgtgatcacagggtggggatcagtacgggagggtggatctatggcacggcagctgcagaaggcagcggtaaggcttttaagcgagcaaacctgcagacgcttttatcctgtgcagatctcctcccgcatgctgtgcgccgggttcccccagggcggcgttgattcgtgttcgggtgacgccggcggccccctcgcgtgtcgcgagccctcagggcgatgggtcctaactggcgtgacctcatgggggtacggctgtggtcgtcctcactttccaggcgtatatacaagagtggccgcagtgcgcggatggataggacagcatattcaagagtag

SEQ ID NO: 31121 - DNA, 1596 bp, Artificial Sequence
  Description of Artificial Sequence: Synthetic coding sequence
atggaaccaaccgtggctgatgtgcacctggtgcctaggacgacaaaggaagtcccagcactagacgccgcctgttgtagagcagcctccatcggggtagtcgctacatccctagtcgttctgaccctaggagtactccttgcattcttgtcaactcagggatttcatgttgatcatactgcggaactcaggggcatccgctggacaagctcactgagacgagaaactagcgattaccacagaaccttaactcctacactcgaggccctctttgtgtcctctttccaaaagactgagctggaggccagctgcgtgggttgtagcgttctgaactaccgcgatggaaactccagcgttctcgtgcactttcaactgcattttcttttgaggcccttgcaaaccctttctttggggctggaagaggagctattgcagcggggcattcgggcgaggcttagagaacacggtatctctcttgctgcttatggaactatagtctctgctgaactcactgggaggcacaagggacccttggcagaaagagactttaagtccggcagatgtccgggtaattctttttcttgtgggaattcccagtgcgtgactaaggtgaaccccgagtgtgatgatcaagaagactgcagtgacggttcagatgaagcacattgcgaatgtggcttgcagcctgcatggcgcatggctgggcgaatcgtgggaggcatggaggcttcccccggggagtttccctggcaggccagtctgagggagaataaggagcatttctgcggcgccgctattatcaacgccagatggttagtgtcagctgcacattgtttcaacgaattccaggaccctactaaatgggtggcctacgtgggtgccacgtacctgtcaggctctgaggctagcactgtgcgggcgcaggtggtacagatcgtgaaacatcctctttacaatgctgatactgccgacttcgacgtagctgtgcttgagctaacatcccctttgccattcggccggcatattcagccagtctgcctgcctgctgccactcatatttttcccccttccaagaagtgcctaatctcagggtggggctacctgaaagaagacttcctcgtcaagcccgaggtgctccagaaggccactgtggaactgctcgatcaggcactatgcgcatcgctgtatggtcacagtctgacggaccgcatggtgtgcgcaggttatcttgatggcaaggtggactcttgtcagggcgactcaggagggccacttgtgtgtgaggagccctctggtcggtttttcctagccggcatcgtatcatggggcatcgggtgcgccgaagcgagaaggcctggcgtctacgcccgagtcaccagactgagagactggatcttggaggcaactactaaggcatcaatgccattggcccccacgatggctcccgctccggcagccccctccacagcatggcccaccagcccagagtcgccagttgtcagcacccccaccaagtctatgcaggccctgtccacggtgcccctggactgggtaactgtgcctaaattgcagggtatcttcggagcagagcggtag

SEQ ID NO: 31122 - DNA, 405 bp, Artificial Sequence
  Description of Artificial Sequence: Synthetic coding sequence
atgactgaggagcctatcaaagaaattctgggcgcccctaaggctcacatggccgccactatggagaagtctcctaagagcgaggtcgtcatcacaaccgtccccctggtaagtgaaatccagctcatggctgcaactggaggtacagagctctcttgttaccggtgtatcattccgtttgcagtggtagtctttatagctggcatcgtcgtcacagctgttgcatattctttcaattctcacgggtctattattagcattttcggtttggttgtgctgtccagtgggctttttctgttggcaagctcggccctttgttggaaagttaggcagcggagtaagaaggctaaacggagagagtctcaaaccgccttggtcgcaaatcagaggtcactattcgcctag

SEQ ID NO: 31123 - DNA, 405 bp, Artificial Sequence
  Description of Artificial Sequence: Synthetic coding sequence
atgaccgaggaaccaattaaggaaatcctcggggcacctaaagcccacatggccgcgaccatggagaagagcccgaagagcgaagtggtgattacaaccgtacccttggtgagcgagattcagctgatggctgcgaccggcggcactgagttatcctgttatcggtgtatcatcccctttgccgtggtggtctttattgctgggatcgtggtcaccgcggtggcctattcttttaattctcatgggagcatcatttctatttttgggctggtcgttctctcatccgggctctttctgctcgctagcagcgcattgtgctggaaggtgcggcaacgatccaagaaggcaaaaaggcgcgaatctcagactgctttggtggccaatcagagatctctgttcgcatag

SEQ ID NO: 31124 - DNA, 405 bp, Artificial Sequence
  Description of Artificial Sequence: Synthetic coding sequence
atgaccgaggagcctatcaaagaaatcctgggggcgcccaaagcacacatggccgcaaccatggaaaaatcacccaaatctgaagtcgtcatcaccacagtccccctggtatcagagatccagctcatggccgccaccggaggtaccgagctgtcctgctatcggtgtatcatcccgttcgccgtcgtggtgtttatcgctgggattgtggttactgcagtcgcctattcattcaacagtcatggttccattatcagcatatttgggttggtcgtgctgtcttctggtctctttctactggcctcatccgcattgtgttggaaggttagacagcgctccaaaaaagcaaagagacgggagagccaaacagcacttgtggctaatcaacgtagcctattcgcctag

SEQ ID NO: 31125 - DNA, 633 bp, Artificial Sequence
  Description of Artificial Sequence: Synthetic coding sequence
atgcggaagagacaacagtcacagaatgagggtacaccagctgtgtcccaggcccctggaaaccagcgcccgaataacacatgttgtttttgttggtgctgctgctgttcatgctcctgcttgacagtacggaacgaggagcgcggcgaaaatgcaggacgaccaacacatacaaccaagatggagagcatccaagtgctggaggaatgtcagaaccctacagcggaggaagtgttgagttggtctcaaaattttgacaagatgatgaaggcgcccgctggccggaatctcttcagggaatttctccgtactgagtactctgaagagaacttgctgttttggctagcctgcgaggacctgaaaaaggaacagaacaaaaaggtgatcgaggaaaaagctagaatgatttatgaggattacatcagtattctatcacccaaggaagtttccttggattcacgtgtgcgggaggtgatcaatagaaatctgctggaccccaatccccacatgtatgaggatgcccaactgcagatctataccctgatgcacagagattctttcccacggtttctcaacagccagatctataaaagcttcgtggagtccactgcggggagtagttccgagagctag

SEQ ID NO: 31126 - DNA, 600 bp, Artificial Sequence
  Description of Artificial Sequence: Synthetic coding sequence
atgggcgccgctgtcctctgcgcgagcttcatgagcttcggcgtaaagcgacgctggtttgccctgggcgccgcactgcagctggctatttctacatatgccgcatacattggtggttacgtccactatggcgactggctgaaggtgaggatgtattcacgaaccgtagctattatcggcggattcctggtgctggcctctggtgctggcgaactgtatcgacgtaaacccaggagcaggtctttacagtcaaccgggcaggttttcctaggcatctacctcatttgtgttgcttatagtctgcagcactcaaaggaggaccgtctggcatacttgaaccacctgcctggcggagagttaatgattcaactgtttttcgtcctctacggaatactggcactggcattccttagcggctactacgtcacccttgctgcacagatattagccgttctgctgcctcctgtgatgctcctgatcgacgggaatgtggcttactggcacaacacacgccgcgtcgaattttggaaccagatgaaactgctgggggagtccgtgggcatattcggcaccgcagtcattctggcaaccgacggctag

SEQ ID NO: 31127 - DNA, 774 bp, Artificial Sequence
  Description of Artificial Sequence: Synthetic coding sequence
atggcctctaaaatcggtagcagacgttggatgttgcagttgatcatgcagcttggcagtgtgcttctcacccgttgtcccttttggggctgcttcagccagctgatgctgtacgctgagagagccgaagctcgccggaagccggacattcccgttccctacttgtatttcgacatgggcgccgccgtgctgtgtgcctcttttatgtcgtttggcgtgaagcgcaggtggttcgccttgggcgctgccctccagctagccatatccacttacgcagcctacatagggggctacgtgcattacggggactggctaaaggtcagaatgtacagccgcacagttgccatcattgggggctttctggttcttgccagcggggctggcgaactataccgaagaaagccccggagtagaagtctccagagtacgggccaggtcttcttaggaatctatctgatttgtgttgcctactccctgcagcattcgaaagaagaccggctggcatacctcaatcatctccctggaggagaactcatgattcaactgttctttgtgctgtacggaattctcgctctagcttttctatccgggtactacgtgacccttgcagctcagattctcgctgtgctgctgccacctgtgatgcttttgatcgatggtaacgtcgcgtattggcacaacacccggagagtagagttctggaatcagatgaaattgttaggcgaaagcgtcgggatcttcggcactgccgtaattctggctacagacgggtag

SEQ ID NO: 31128 - DNA, 1491 bp, Artificial Sequence
  Description of Artificial Sequence: Synthetic coding sequence
atggcgggggagatcaccgaaacaggggagctgtatagctcatacgtgggtctcgtctatatgtttaacttgatagtgggaacaggcgccctgactatgccaaaggcattcgcaaccgctgggtggctggttagcctcgttttgctcgtgttcctgggtttcatgtccttcgttaccacaacatttgtcatcgaggccatggctgctgctaacgcccagttacactggaaacgaatggagaacctcaaagaggaggaagatgacgatagctccactgcttccgacagtgacgttttgatcagagataactacgaaagggctgaaaagaggccgattttgtccgtccagagaagaggctctcctaatccatttgagattacggatcgggtggagatgggacagatggcgtctatgttttttaataaggtgggagttaatctcttctatttctgcattatcgtgtacctgtacggtgatctcgccatttacgccgcagccgtaccattctccctgatgcaagtgacctgctcagccaccgggaatgattcatgcggtgtggaagctgacactaaatacaacgacaccgatcgatgctggggaccgctgcgtcgggtcgatgcgtacagaatttacctcgccatattcactctcctgctgggccctttcacattctttgatgtccaaaagactaagtacctccagattttgacctcactgatgaggtggatcgcatttgctgtcatgatcgtcctggctctcattcgtatcgggcacggccaaggggaaggccacccccccctcgcagacttttccggggtgcgaaatctattcggggtgtgcgtgtattcctttatgtgtcagcacagcctgccctcacttataacaccagtatcaagcaagcggcacctcacccgactggtgtttttggattatgtgctgattctggccttttacggccttctgtcattcaccgctatcttttgctttagaggggactccctgatggacatgtatacattgaattttgctcggtgcgacgtcgtaggactcgcagccgtgcgattcttcctcggtctattccctgtgtttaccattagtactaacttccccatcatagccgtaacactgaggaacaactggaaaaccctgtttcacagggagggagggacgtatccctgggttgtagacagggtggtcttccctaccataactctggtgccccccgtcctggtggccttttgtacccatgacctggaaagcctcgtcgggatcactggtgcttatgccggcactggtattcagtacgtgatccccgcgttcttagtctaccattgtcggagagatactcagctggctttcggttgtggcgtctcgaacaaacaccgaagtccatttcgccacaccttttgggttggattcgtcctgctttgggcattttcctgctttatcttcgtgaccgctaatattatcctgtctgagacgaagctctag

SEQ ID NO: 31129 - DNA, 984 bp, Artificial Sequence
  Description of Artificial Sequence: Synthetic coding sequence
atggcgggcgagattacagaaacaggcgagttgtattcaagctatgtgtttgttcgggtagtgaaacctaataagatcgccatgctgttcataatgctcatacctggctgggctcgttggctgacaccggtcattcccgccctatgggaggctgaggccggacgatcccctgaggtaagatcatccaggcctgcatggccgacctgtttcgtaaccacaactttcgttattgaggctatggcagcagctaatgcacagctgcactggaagcgtatggaaaacctgaaggaggaagaagatgatgattcatccacggcttctgattctgatgtccttattagggacaattacgagcgcgccgaaaagagacccatcctgagcgtgcaacgccgcgggagcccaaaccccttcgagattactgatagggtcgaaatgggtcaaatggcatcaatgtttttcaacaaggttggcgtaaaccttttttatttctgtattatagtctacttatacggcgatctcgctatttatgccgcggccgtccccttctctctgatgcaggtaacgtgcagcgccaccggaaacgactcttgcggagtggaagcagacacgaaatacaacgacactgacaggtgctggggacctctgcgacgagttgatgcataccgtatctacctcgccatcttcacactgctgctggggcctttcaccttcttcgatgtgcaaaagacaaaatatttgcagatactaactagtctgatgaggtggatagatgggccgccgggctcagtgatgggccgagccgaagaggacgctagtcccgcctggcctcgatcccggtgtcgctgcggaggcaaattgaagctcaactctttgtatcctaccagtgccacatgcatggcccctgatgctcccggcgccggccaggtgaaggtgggggtcaacttcctctgtctgccgccccaccggtctaccagacccacttag

SEQ ID NO: 31130 - DNA, 390 bp, Artificial Sequence
  Description of Artificial Sequence: Synthetic coding sequence
atgctgctgaaggtccggcgcgcttccctgaaaccccctgctacaccacatcagggggcttttagagcaggaaacgtcattggacagctgatatacttgctcacttggtccctgttcaccgcatggctaaggcctccgacactgctgcagggacctagaactagtcctcagggctcacccccgcgatccccctggggcgactgcgcggaacccagctgtctctgcgagatgaaaatccgccgccggcgccacgaaggcccagcctggggacaatccggattcctggctggcggactacaccttgtgcctagtagtcttagccttgccgcctgcggggtagtccgcatgaaaggcctctggggtcgtggggccgggatacgaggaaggtag

SEQ ID NO: 31131 - DNA, 789 bp, Artificial Sequence
  Description of Artificial Sequence: Synthetic coding sequence
atgggcaagacgttctctcagctaggatcctggagggaggatgagaataaaagcatcctgagcagtaaacctgcaattggttcaaaagctgtgaattattcttcaaccggcagcagcaaatccttctgctcttgtgtgccctgcgagggcacagctgacgcatcatttgtaacctgtccaacttgccagggtagcggaaaaattccacaggagttggaaaagcaacttgtagccctcataccctacggagaccagcgtctgaagcccaaacataccaagctttttgtcttcctggctgtgctgatttgtctggttactagttctttcatcgtgttctttttgtttcctcgcagtgtgatagtacaaccagccgggctgaacagcagtactgtggcattcgacgaggctgacatctatctgaatattaccaacattttgaatatcagtaatggtaactattaccccataatggtcacccagctaactctcgaggtgttacatcttagcctggtggtcggccaggtgagcaacaacctcctcctgcacatcgggcctctcgctagtgaacagatgttttatgccgtggcaacaaagatacgtgatgagaatacctacaagatctgtacatggctggaaatcaaagtacatcacgtcctgttacatattcaggggacgttgacctgttcctacctttcccatagcgagcagctggtcttccagagttacgagtacgttgattgtcgcgggaacgctagtgtgcctcaccaacttacaccccaccctccctag

SEQ ID NO: 31132 - DNA, 648 bp, Artificial Sequence
  Description of Artificial Sequence: Synthetic coding sequence
atggggaagactttttcccagctcggaagctggcgggaggatgagaacaaaagcattctgtcttctaagcccgctatcggctcaaaagccgtcaattacagtagcacaggaagttcaaagagcttctgttcttgtgttccgtgcgaggggaccgcagatgcctccttcgtgacctgccccacatgccagggcagcgggaaaattccgcaggagctggagaaacagcttgtggcacttataccttatggcgaccagcgcctgaaaccaaagcataccaaactgttcgtttttctggccgtcctgatctgtctcgtgacatcctcctttattgtgtttttcctatttccccgttccgtgattgtgcagcccgccggactgaattcttctacagtcgccttcgatgaggctgatatatacctgaatattacaatgttctatgcagtcgcaactaaaattcgcgatgaaaacacctacaagatatgcacttggctcgagatcaaagtgcaccatgtgctgctccatattcagggaactctgacctgctcctatcttagtcatagtgagcagctggtatttcagagttacgaatatgtggattgccgcggaaatgcctcggtacctcaccagcttacaccccatcccccatag

SEQ ID NO: 31133 - DNA, 645 bp, Artificial Sequence
  Description of Artificial Sequence: Synthetic coding sequence
atgggaaccgccgatgctagctttgtgacttgtcctacttgccaaggttctggcaaaatcccccaggagttagagaaacagctcgtggcccttatcccgtacggggaccagcgtctcaaaccgaaacatacaaagctcttcgtttttcttgccgtgctaatctgcctcgttaccagctcttttattgtctttttcctgttcccgagatcggttattgttcagcccgcggggctgaacagcagcacggtcgcctttgatgaggccgatatttacctcaacataacaaatatcttgaatatttctaacggtaattactatccaattatggttacccagctaacattggaggttctccacctgagcctggtagtgggccaagtttccaataatcttctcttacacataggtcccctcgcgtccgagcagatgttttatgccgtggctactaagataagagacgagaatacctataaaatttgcacttggctcgagatcaaagtacatcatgtgctgctgcatattcagggcaccctgacatgctcttatctttcacactctgaacagctggtctttcaatcatatgaatatgtcgactgtcgggggaacgccagcgtgccacaccagcttacacctcacccaccctag

SEQ ID NO: 31134 - DNA, 696 bp, Artificial Sequence
  Description of Artificial Sequence: Synthetic coding sequence
atgggctcacagcatagtgcagccgctcggcccagttcctgcaggcggaagcaggaagacgatcgggacggactgctggctgaacgggaacaggaagaggccatcgctcagttcccatatgtcgagtttaccggacgagatagcatcacctgtctgacgtgtcaggggaccggctacattcccacggaacaggtgaacgaattagttgcacttatcccccattctgatcagagactgaggccccaaagaaccaagcagtatgtgttgctctccattcttctgtgtctcttggcctccggcttggtagtttttttcctctttccacattctgtcttggttgacgacgacgggatcaaggtcgttaaggtcaccttcaataagcaggattcactagtgatactcaccattatggccacgctgaaaatccggaatagcaatttttatactgtcgcggtgacctccctctcatctcaaattcagtacatgaatactgtcgtgaacttcactggaaaggctgaaatgggagggccattctcttacgtttactttttttgtacagtgccagaaattctcgttcacaacattgtgatttttatgcgtacgtcagtgaaaatcagctatataggacttatgacgcagagcagcctggaaacacatcactacgtagactgcgggggcaactctaccgcaatttag

SEQ ID NO: 31135 - DNA, 753 bp, Artificial Sequence
  Description of Artificial Sequence: Synthetic coding sequence
atgggaagtcaacattcggccgcagcgcgaccctcttcctgcagaaggaagcaggaggatgaccgcgatgggttgctggctgagagagagcaagaggaggccatagcccagtttccctatgtcgaattcaccgggcgggattctatcacctgcctcacttgccaggggaccggatacatacctaccgaacaagtgaacgagcttgtggcattgatcccacatagtgatcaacgattgcgcccacagcgcacaaagcagtatgtactgctgagtatcctgctatgcctgctggcttctggtctggtcgtcttcttcttatttccacattccgttctggttgatgacgatggcattaaggtggttaaggtgacttttaacaagcaagacagcttggtgattctgacaatcatggccacgctgaaaatcagaaacagcaacttctacacggtggcggtaacatctctgtcttctcagatccagtacatgaacactgtggtgtctacctatgtgacgactaatgtaagcctcatccccccgaggtccgagcagttggtgaattttacaggaaaagcagaaatggggggccccttttcttacgtgtacttcttctgcacggtgcctgagattctcgtccacaacattgtaatcttcatgagaacatcggttaaaatctcttacatcggcctgatgactcaatcgtctctggagactcaccattacgtggattgcggcgggaattccaccgccatctag

SEQ ID NO: 31136 - DNA, 696 bp, Artificial Sequence
  Description of Artificial Sequence: Synthetic coding sequence
atgggttcccagcattccgctgcagcgcgccctagcagctgtcgcagaaagcaagaagatgacagggatggactgttagccgaacgggaacaggaggaggccatcgcacagtttccctacgtggaatttacgggcagagacagcattacctgcctgacctgtcagggcaccgggtacatccctaccgaacaggtgaatgagctggtagctcttatccctcactcagaccaaagactacggccccagagaactaaacagtacgtccttttgtctatactgctgtgcctactggcctccggtctggtggttttttttctgttcccccactccgtgctcgtggacgatgacggtatcaaagtcgtgaaggtaactttcaataagcaggactcactcgttatcctgactataatggcaacgcttaaaatccggaacagcaatttctacacggttgcagtgacttcgctttcatcccagatacaatatatgaacacagttgttaactttaccggaaaggcagagatggggggaccatttagttatgtctacttcttttgcaccgtgcctgagatcctggtgcacaacatcgtgatcttcatgagaacgtcagtaaaaatctcttatataggtttgatgactcaaagcagcttagagacacaccactatgtggattgcggggggaatagtacagcgatttag

SEQ ID NO: 31137 - DNA, 753 bp, Artificial Sequence
  Description of Artificial Sequence: Synthetic coding sequence
atggggtcacaacatagcgccgctgctcgaccatcttcctgcaggcgaaagcaggaagatgaccgcgacgggctgctcgcggagcgcgaacaggaagaagcgatcgcacaattcccctacgttgaattcacagggagggactcaattacgtgtctgacatgccaggggactggttacattccaaccgagcaagtgaacgagttggtggctctaatcccacactctgaccaacggttaagacctcagcgaaccaagcagtacgttctgctaagtattcttctgtgcctgctggcctctggactggttgtattcttcttgtttccacattcagtgctggtggatgacgacggcatcaaagtggttaaagtgacttttaataaacaggatagcctggttatcctgaccattatggccacactgaagatccggaactccaatttctacactgtggccgtcaccagcctgtccagccagattcagtacatgaataccgtggtgtctacgtacgtcacgactaacgtttccctgattccccccagaagcgagcagctcgttaacttcaccggaaaggccgagatgggtgggccgttctcgtacgtgtacttcttctgcaccgttccggaaatcctggttcacaacatcgtgatcttcatgcgaaccagtgtcaagatcagttacatcggcctgatgacacagagcagcctcgagacccatcactacgtcgattgcggaggcaacagtaccgcaatttag

SEQ ID NO: 31138 - DNA, 441 bp, Artificial Sequence
  Description of Artificial Sequence: Synthetic coding sequence
atgggacgagtgtcaggcttagtcccatcgcgtttcttgacccttctggcacaccttgtcgttgtgatcactctgttttggtcaagggatagcaatatccaggcctgtctgccactgaccttcacgcctgaagaatacgacaagcaggatatccatcctctccctttgtgcaggctggttgccgcccttagtgttacccttggcctgttcgctgtggagctcgccggcttcctttccggtgtcagcatgttcaacagcacacagtcattgatatccattggtgcccactgttccgccagcgttgcactcagtttcttcatctttgaacgctgggaatgcacaacttattggtacatcttcgtcttttgctccgctcttcctgcagtcacagagatggctctcttcgtgacagtcttcggattgaaaaaaaagcctttttag

SEQ ID NO: 31139 - DNA, 492 bp, Artificial Sequence
  Description of Artificial Sequence: Synthetic coding sequence
atgggccgagtatccggactggttccttctcgctttttgacactgctagctcacctggtcgtagtgatcaccttgttttggtccagagtacgtcctacggcagcactgaatcctagtccattcccgtcactgagcggccccagcccgaccttaccccccccctcagtcctaccctcctgggtgttcctgtttccggctgctccacgtcccgctttacaacctgccccatttagcttactctcggctggctggtggcctcgatcacttagcccttgggcatcccttcaatggagctggccagtgtcctcacaagaaagtccatgctctactgcacctagggccagcagcgtgagcttcttgccagctcacttgtcacacacaacacatttctaccaggactccctgcagcctccagacactatagtcagtgccgtcgctaatccctcctcgtctaaaattttcaacgatgtcctcaaccctgctgtttactag

SEQ ID NO: 31140 - DNA, 423 bp, Artificial Sequence
  Description of Artificial Sequence: Synthetic coding sequence
atgggaagagtgtctggcctcgtgccctccagattcttaaccctgctggctcatctggttgtcgtgattaccctgttttggagcagagactctaacatccaggcatgcttacccctgactttcacccctgaagagtatgacaaacaggacatccagttggttgcggccttaagtgtgacactagggctattcgctgtcgagttagccggattcctgagcggtgttagcatgtttaatagcacacaatccctgatatctataggggcccactgtagtgcgagcgtggcactttctttcttcatcttcgagcggtgggaatgcacgacatactggtatatcttcgtgttctgctctgccctgcccgctgtgacggaaatggcccttttcgtgacagtctttggactcaaaaagaaacccttctag

SEQ ID NO: 31141 - DNA, 420 bp, Artificial Sequence
  Description of Artificial Sequence: Synthetic coding sequence
atgggccgggtttccggcttggtcccaagcaggttcctgaccttgctggcccacctggttgtggtgataacactcttctggtcacgtgatagcaatattcaggcctgcctgccccttacatttactcctgaggagtacgataaacaggacattcacccgctgccgctttgcagactggttgcagccttgagcgtcacattagggttgtttgcagtggagctggccggctttctgagtggtgtgtcgatgttcaactctacgcaatccctcattagtataggcgcacactgtagcgcttcggttgccctgtcattctttatatttgaaagatgggagtgcaccacgtactgtgctttgcccgctgtgaccgaaatggcactgttcgtaactgtttttggcctaaagaaaaagccattctag

SEQ ID NO: 31142 - DNA, 1728 bp, Artificial Sequence
  Description of Artificial Sequence: Synthetic coding sequence
atgaagagatcacttcaggcgctatattgccagctgctttctttcctccttatccttgcattaacagaagctctcgccttcgctatccaggagccatcaccacgagagagtctgcaggtgctgcctagcggaacccctcctggaactatggtgaccgccccgcattcttccacacgccacaccagtgtggtgatgctcacaccgaacccagacggccccccatcgcaggccgcagccccaatggctacacccaccccccgggcagagggccacccacccactcataccatctcaaccattgcagctaccgttactgcacctcacagcgaatcttccctgagtactgggcctgctcctgcagctatggcaacgacctcttctaaacctgagggaaggcccaggggtcaggccgctcctacgattttgctcaccaagcccccgggagctacctctcgccccacgactgcgccgccgaggactactactagacgccccccacgcccaccagggtcctcccgcaagggagccggaaattcgtctagaccagtccctccggcacctggaggacacagtaggagtaaggaaggccaaagggggcgcaacccgagttcaacaccactaggacagaaaaggcccctgggcaaaatcttccaaatctacaaaggcaatttcactggctccgtggagccagaaccctccaccctgacaccccgcacgcctctgtggggctacagttcgtccccccagccacagacagtcgcggcaacaaccgtgccctccaacaccagttgggcacctacaaccacgtcattgggacctgctaaggacaagcccggacttcgacgggctgctcaggggggaggaagcaccttcacatcccagggcggaacccctgatgccactgcagcctctggagcccccgtaagcccacaggccgcacccgtgccaagtcagagaccacatcatggagatccccaggatggcccctcgcacagcgatagctggctcacagtgactcccgggacctccaggcctctgagcacatcttctggtgtttttaccgccgccaccggccctacaccagccgcctttgacacaagtgtgtcagcccctagccaggggatcccacaaggcgcttctaccacacctcaggcccctactcacccatctcgagtcagtgagagcacaatatcaggggcaaaagaagaaacggtcgcaacgttgacgatgacagacagggtgccttctcctctgtccacggtggtgtccactgctactggcaatttcctcaacagactcgtgcctgccggcacctggaaacctgggactgctggcaacataagccacgttgccgaaggtgataagccacagcacagagcgaccatctgcctgtcgaagatggacatcgcatgggtgatcctggccatttccgtgccgatctctagctgctcagtactgctgaccgtgtgttgcatgaaaagaaagaagaaaacagccaaccccgaaaacaaccttagttattggaacaatacaatcaccatggattactttaaccggcacgccgtcgaactgccacgagaaatccagagcctcgagaccagcgaagaccagctgtctgaaccacgctcacctgcgaacggcgactatagggataccggtatggttttggtcaatcctttctgtcaagaaacactattcgtaggaaatgatcaggtaagtgaaatctag

SEQ ID NO: 31143 - DNA, 1728 bp, Artificial Sequence
  Description of Artificial Sequence: Synthetic coding sequence
atgaaaagaagcctccaggcgctctattgtcagctgctctcatttctgctgatcctggcgctcactgaagcactagcctttgcaattcaagaacctagcccacgagaaagcctacaagtgctgcccagtgggactcctccgggaaccatggtcactgcaccacactcctctactcggcatacctccgtggttatgctcaccccaaatccggacggaccaccctcgcaggctgcagctcccatggcgacacctactcctcgagccgagggccatcctccaacacacactatcagtactatcgcagccacagtgaccgcacctcattcagagagtagcctgagtacaggtccggccccggcagcaatggccaccacttcatcgaagcctgaaggccggccgagagggcaagcagcaccgacaattctattgactaaaccccccggtgcaacctcccgccctaccacggcgccgcctcgcactacaacccgaaggcctcctcggcctcccggcagttctcggaagggcgcaggcaactcttcaaggcccgtgcctcctgcacccggagggcacagtaggtctaaggagggccagcgcggccgcaacccgagcagcacaccactgggtcagaagcggcctttggggaaaatttttcagatatacaaagggaattttactgggtccgtggagcccgaaccttctacgttgacccccaggacgccactctggggctattcaagcagcccacagccccagaccgtggctgccaccaccgttcccagcaacacctcctgggctccaaccaccacatcccttggccctgccaaggataaaccaggcctgcgcagggcagcccaaggggggggctctacatttacctcacaggggggcacccccgacgctactgctgcatctggcgccccagtgagtcctcaggctgcacctgtgccatctcagcgccctcatcacggagacccccaagatggtccatcgcattccgactcatggctgaccgtgactcccggcacgagtcgacctctgtccacctcctccggggtgtttacagcggcaactggacctacccccgccgctttcgacacatccgtctccgctccaagccagggaatcccccagggcgcctccacgactccccaggctcctacccatcccagccgagtctccgaatctaccattagcggggcaaaagaggagaccgttgcgaccctgactatgactgatcgtgttccgagccctctctctaccgtggtatctacagcaacaggcaacttcttgaacagactggtaccagctggcacttggaagcccggaactgccgggaatatctcccacgtggctgagggagacaaacctcagcatcgggccacgatatgtcttagtaaaatggatattgcgtgggtcatcctggctattagtgtgcctattagctcatgtagtgtgttgcttaccgtgtgttgcatgaaaagaaaaaagaagaccgcaaatcccgaaaacaatctctcttattggaacaacaccattacaatggactatttcaatcgccacgccgtggagctgccccgcgaaatccagagcctggaaacctccgaggaccagctgtccgagccacgctctcccgccaatggtgattatcgggataccggaatggtcctcgtgaatcccttctgccaggagacactctttgttgggaatgaccaggtctctgagatttag

SEQ ID NO: 31144 - DNA, 318 bp, Artificial Sequence
  Description of Artificial Sequence: Synthetic coding sequence
atgaagagatcacttcaggctctctactgccagctgctaactgtgctactcactgtgtgttgtatgaaaaggaagaagaaaacggcaaaccctgagaataatctgagctattggaataacacgatcacaatggactacttcaaccgccatgccgttgagctgccccgcgagatccagagcctggaaacctccgaggatcaattgtctgagccaagatcccctgccaacggagactaccgcgataccggcatggtgctcgtgaaccccttttgccaggaaactttattcgtaggtaatgaccaggtgtcagagatttag

SEQ ID NO: 31145 - DNA, 462 bp, Artificial Sequence
  Description of Artificial Sequence: Synthetic coding sequence
atgaaacggtccctgcaagccctttactgtcagctgctgtctttcctgttaatccttgccctgaccgaagcgctggcatttgccatccaggaaccttcacccagagagagcctccaggtgcttcccagcggaacgccccctggaacaatggtgacagcaccacactcatccacgagacatacctccgtggtgatgctcacacctaatccggatgggcccccgtctcaggctgctgccccaatggcaacacctacgccacgtgccgaaggacacccacctactcataccatctctaccatcgcggccactgtcacggccccacactctgagagttctctcagtacagggccagctcccgctgcaatggcaacaacctctagtaagcccgagggtcggccccggggacaggccgcacccacgatcttgctgacgaaaccccccggagctacaagtcggccttag

SEQ ID NO: 31146 - DNA, 219 bp, Artificial Sequence
  Description of Artificial Sequence: Synthetic coding sequence
atgaagcgatctttgcaggccttgtattgccaactactgagtttcctactgatcctggctttaaccgaagccctggccttcgccatccaggagccctcaccaagggagtcactgcaggtgctccccagcgggacaccacccggcacgatggtgaccgctccacattcctcaacaaggcacacctctgtggtgatgctgacgcccaaccccgacggatag

SEQ ID NO: 31147 - DNA, 450 bp, Artificial Sequence
  Description of Artificial Sequence: Synthetic coding sequence
atgaagcggagtctgcaggccctgtattgccagctgctgagcttcctcctgattctagcgctgactgaggccctggcgtttgctattcaagagccttcaccccgagaatccttacaggttcttccatcagggaccccccccggaacgatggtcaccgcgccccactcttccaccaggcacacctcggtcgtgatgctgacccctaaccctgacggccccccatcccaagctgcagctcctatggccacgcccacgcccagggcagaggggcacccacccacacatacaattagcactatcgctgctactgttaccgccccccactccgaaagctcattatcaaccggacccgcacccgccgccatggccactacttcctctaagccagaagggagaccccgggggcaagcggcacctaccattctcctgactaagccacctggcgcctag

SEQ ID NO: 31148 - DNA, 1467 bp, Artificial Sequence
  Description of Artificial Sequence: Synthetic coding sequence
atgaaaaggagtctgcaggcattgtactgccagttgctttcctttctcctcatccttgcccttacagaagccctcgcgttcgccattcaggagccctcaccaagggagagcttgcaagttctgccaagtggcacccccccaggtaccatggtgactgccccacatagctccaccaggcacacctctgttgtaatgctcaccccaaatcctgatggcccacctagtcaggcagctgcgccaatggccaccccaaccccaagggctgaagggcatccccccacccacactattagcaccattgctgccacagtaaccgccccccatagcgagagctccttgtcaaccggacccgccccggccgctatggccaccacttccagcaagcctgagggccgccctagaggccaggcagcacctacaatactcctgacaaagccaccaggcgctacatctagaccgacaaccgcaccaccaaggacgacgactcgccgtcccccaagacccccaggatcttccaggaagggggctggcaatagctcgcgcccagtgccccccgccccaggtggccatagcagatcgaaagagggccagcgaggcaggaatccctccagtacccctctgggccagaagcgccctctcggcaagattttccagatttacaagggtaacttcaccggctctgtggaacccgaaccgtcaacactgactcctcgaacccccctctggggttattcctctagtccccaaccacagacggtagcagcaaccacggttccgtctaacaccagctgggctcctactaccacctctctgggccccgcaaaagacaagccgggtctccgccgcgcggcacagggcggcggttcgacgttcacaagccaaggaggaacaccggatgctacggcggcaagtggagctcctgtaagtccacaagctgctccggtcccctcacagcgcccacaccacggagatcctcaggacggaccctcacactccgatagctggctgaccgttactcccggtacatcaaggcccctctctactagcagtggtgtgtttacagcagccaccggacccacacccgcagcattcgacactagtgtttcagctccctctcagggaattccccagggggcctcaacaactccacaagctccaacacatccctctcgggtgtccgaaagtactatttccggggccaaagaagagacagtggcaaccctaacgatgactgaccgtgtaccttcaccgctctctactgtggtcagcaccgctaccggaaatttcctcaacaggctagtccccgctggtacttggaaaccaggtacggccggcaatatttcacatgtagcggaaggggacaaaccacagcaccgcgccacgatatgcctaagtaaaatggatattgcatgggtgattctggcaatctccgtgcctatatcttcctgtagcgaccccatcacttag

SEQ ID NO: 31149 - DNA, 1515 bp, Artificial Sequence
  Description of Artificial Sequence: Synthetic coding sequence
atgtcgctcatttgctccatctccaacgaagtgcccgagcacccttgcgtgagcccagtaagcaaccatgtgtatgagcgaaggctcatagagaagtatattgcagaaaatggaaccgatccaatcaacaaccagccactctcagaggagcaactgatcgacataaaagtagctcacccaattagaccgaagcctccctccgctaccagtattcctgccatcctgaaggccttacaggatgaatgggatgctgtcatgctccattcatttactttgaggcagcagttgcagactactaggcaagagctctcgcatgctctatatcagcacgatgccgcatgccgcgtgattgcccgcctgaccaaggaagtcacggcggctagagaggctcttgccacacttaaacctcaggccgggcttattgtcccccaggctgttccatcctcacagccaagcgtcgttggtgctggagaacctatggacctaggcgagcttgttgggatgaccccagagatcattcagaaacttcaggataaagccacggtactaacgaccgagcggaagaaacgggggaagaccgtgcctgaggaactcgtcaaaccggaggagctgagtaagtatagacaggttgcctcccacgttggactccatagcgcctcaatacctggaatcctagccttggacctatgcccctccgatacaaataagatcctgactgggggggctgacaagaatgtcgtagtgttcgacaagagtagtgagcaaattctggctacgctgaaggggcacacaaagaaggtaacctcagttgtgttccacccttcacaggatctggtcttttccgcctcccccgacgccactattcggatctggtccgtacctaatgcatcctgcgttcaggttgtcagagctcacgagagtgccgtcaccggtttgagtttacacgcaaccggcgattatctgctgagtagctccgatgaccaatactgggcctttagtgatattcagacaggtcgtgttctgactaaggtgaccgatgaaacttcaggctgctctttaacctgtgcccaattccacccagacggactcatattcggcacaggaaccatggactctcagatcaagatctgggacctgaaagagagaaccaatgtcgctaacttccctggtcactcaggccctattacgtctattgcttttagcgagaatggttactatctggccactgcggcggacgacagttccgttaagctgtgggacctgcggaaactgaagaacttcaagaccctacagctcgataacaattttgaggtgaagagcctgatcttcgatcagtctggaacatacttggcattgggagggaccgacgttcagatatacatttgcaaacagtggactgaaatactgcattttactgaacattcaggcctaaccactggggttgcgttcggccaccatgctaagtttatagccagtaccggcatggatcgcagtctgaaattttatagcctctag

SEQ ID NO: 31150 - DNA, 705 bp, Artificial Sequence
  Description of Artificial Sequence: Synthetic coding sequence
atggcagcctcatccatttcttctccgtggggaaaacacgttttcaaggccatactgatggtccttgttgccctcattctccttcacagcgctctggcccagagcagacgagattttgcccctcccggccagcagaaacgtgaggctccagtggacgtactgacacagatcggccgttctgttcgcgggactcttgatgcttggatcggtcccgaaacaatgcacctcgtgagcgagagcagcagccaagtcctttgggctatttctagtgcaattagcgtcgcgttctttgccctgtcagggattgccgcacaacttctgaatgctttgggcttggcgggcgactacttggcccagggtctcaagttgtccccgggacaggttcaaacattcctcctttggggcgccggggcactcgtcgtgtactggcttctttcactgctgctcggccttgttctagccctccttggtagaatcctgtgggggttaaagctcgtgatcttcttggccggctttgtagcgctcatgcggagcgtaccagacccgtccacacgagcgcttttgctgctggccctgctcacaccatgtcctttcctggccctgtccttgaatctccaaaacatcgacccttgccggagtccaacctcccaggagaagcagagaaagactatccccccagcctgcccgtgcggacccgtgttctag

SEQ ID NO: 31151 - DNA, 732 bp, Artificial Sequence
  Description of Artificial Sequence: Synthetic coding sequence
atggcagcttcctcaataagttctccctggggtaaacatgtcttcaaggcgatcctgatggtcctggtggccctgatactcttgcatagcgctctagcgcagtccagaagggacttcgccccccctggccagcagaagcgtgaagcccctgttgacgtcctgacccaaattggtaggagcgttagaggcacgttagacgcttggattggcccggagactatgcacctggtctcagaatcgtctagtcaagtcctctgggcaatatcaagcgctattagcgtggccttctttgccctatcaggtatagctgctcaactgttgaatgcgttgggattggccggtgactacctggcccaggggcttaagctgtctcccggtcaggtacagacctttttgctgtggggcgctggcgcccttgtggtgtactggctgctgagcctgctgttggggctcgttctagcacttctcggtcgaattctatggggacttaagctagtgatctttcttgccggatttgtggccctgatgcggtctgtccctgacccgtcgacacgggcattactgcttctagccctactaattctgtacgccttgctgagccgtctgactggatcgcgcgcctctggggctcagcttgaagcaaaagtgagaggattagagcgacaagtagaggaactaagatggagacagaggcgcgccgccaaaggcgccagatccgtcgaggaggagtag

SEQ ID NO: 31152 - DNA, 579 bp, Artificial Sequence
  Description of Artificial Sequence: Synthetic coding sequence
atggcagcttggggtaggcgaaggctggggcccggtagctcaggcggctccgctcgtgagcgtgtgtccctgtctgcaaccgattgctatatcgtccatgaaatttacaacggggagaacgcacaagaccaattcgagtacgagctggagcaggctctggaagcgcagtacaaatatatcgtgatagagcctacaaggatcggtgacgaaacagccaggtggatcacggtcggtaattgcctgcacaagaccgcagtgctggctggaacagcatgtctcttcacaccactcgcgctacccctcgactactcacactatatttctttgccagctggtgtgctgtccctggcctgctgtacactctacggtataagctggcagtttgatccctgctgtaaatatcaggtggaatacgacgcttataaactgtctcgcctccccttgcacacgctaacctccagcacacctgtcgtgctggtacgaaaggatgacctgcaccgcaaacggttacataatacgatcgctctcgctgcactggtgtactgtgtgaagaagatctacgagctatacgctgtctag

SEQ ID NO: 31153 - DNA, 885 bp, Artificial Sequence
  Description of Artificial Sequence: Synthetic coding sequence
atgcaggggcctgcagggaacgcatcccgggggcttccaggaggacctccgagcacggtggcttctggagccggccggtgcgaaagcggggctcttatgcactcttttggaatttttctccagggcctcctgggggttgtggccttttccacccttatgctaaagagatttcgggaaccgaagcacgaacggcggccctggcgcatctggtttcttgacacaagcaaacaggccatcggcatgctgttcatccatttcgctaacgtgtatctcgccgatttgaccgaagaagacccatgcagtctgtacctgatcaattttctgctggatgcaactgtggggatgctcctgatctacgtgggagtgcgggctgtttcggtactagtagaatggcagcaatgggaatcgttgagatttggggagtatggagatcccctgcagtgcggtgcttgggtaggacaatgcgccctctatattgttatcatgattttcgagaaatctgtggttttcatcgttcttctgatcctgcagtggaagaaagtggcactgctgaatccaatcgagaaccctgacctgaagctggcgattgtgatgttgattgtgccattctttgtcaatgctctcatgttctgggttgttgacaatttcttgatgcgtaagggcaagactaaggcaaagctggaagagaggggtgctaatcaggactcccgcaatgggtctaaggtccggtaccggagagcagcctcccacgaagagagtgaaagcgagattctgatatctgctgatgatgagatggaggagtcagatgtggaggaagatctccgaagactcacacctttaaaaccagtaaagaaaaagaaacacaggtttgggctgccggtttag

SEQ ID NO: 31154 - DNA, 786 bp, Artificial Sequence
  Description of Artificial Sequence: Synthetic coding sequence
atggctggtccagagctcctgttggactctaacattcgactgtgggtagttcttcccatagtgatcatcaccttctttgtgggcatgatccgccattatgtttcaattctcttgcagtccgataaaaaacttacacaggaacaggtcagcgacagtcaggtgctgatacggagcagagttttgcgggaaaatggtaaatatatcccgaagcaatcatttctgacacgtaaatactacttcaataatcctgaggacggcttttttaaaaagacaaagcgcaaggtcgtgccaccctcacccatgaccgatcctactatgctgacagacatgatgaaaggcaacgtgaccaacgtgctgcccatgatacttatcggcggctggatcaatatgacttttagcggctttgtcactacaaaagtcccctttcccctcactttaaggttcaaacccatgctgcagcagggcatagaattgctgaccttggacgcgtcttgggtgagctcggcttcatggtacttcctgaacgtattcggactcaggtcaatctatagcctgatcttggggcaggataatgctgccgatcaaagccggatgatgcaggaacaaatgacaggagcagccatggccatgccagcggataccaataaggctttcaagactgagtgggaagccttggaacttacggatcaccagtgggccctggacgacgtggaagaagaattaatggccaaagatctgcatttcgaggggatgtttaaaaaggaactgcagacctctattttctag

SEQ ID NO: 31155 - DNA, 612 bp, Artificial Sequence
  Description of Artificial Sequence: Synthetic coding sequence
atggcagggccagagctgctactggattccaatatccgactgtgggtggtcctgccaattgtcatcatcacatttttcgtcggaatgattcgccattacgtaagcatattgttacagtcagacaaaaagctcacgcaagagcaggtatcagaccgcaagtatctctccggcctcgtccagtggctgacacccataattcccgccctctggggggctgagatgggcgggtctctggagccccgaaaccttcggccaactttagctgcgtgccaagtcttaattcgctcacgggtgctgcgagaaaatgggaaatacattcctaagcagagctttttgactcgaaagtattatttcaataaccccgaggacggattcttcaaaaaaaccaaaagaaaggtagtgcctcccagtcccatgactgatcctaccatgcttaccgacatgatgaagggcaatgtcacaaatgtgctgcctatgattttgattggaggctggattaatatgaccttctcaggttttgttactacaaaagtaccttttccactaacattacggttcaagcctatgctccagcagggaatagagctgctgacgctggacgcttcgtggtag

SEQ ID NO: 31156 - DNA, 1056 bp, Artificial Sequence
  Description of Artificial Sequence: Synthetic coding sequence
atgcagagagctcttcctggagctagacagcacttgggtgcaattctggcatcagcaagtgtcgtggttaaggccctgtgcgccgctgtcctgttcttatacctgttatccttcgcagtggacacaggatgccttgcggtaacccccggttacttgttccctccgaatttctggatttggacacttgctactcatgggctcatggagcagcacgtttgggatgtcgccatctcacttactactgttgttgtagcaggcagacttctggaaccattatggggcgcattggagttgctgatcttcttctcggttgtgaatgtgagcgttggcttactaggcgcttttgcatacctgctcacttacatggcatcctttaatcttgtgtacctgttcacagttagaatccacggagccctagggttcctggggggagtcttggtagccctgaagcaaaccatgggagattgtgtggtgctgagggtaccacaggtaagggtgtccgtaatgcctatgctcctgcttgccctccttctgctgctaagactggctaccctgctgcaatctcctgcacttgcctcatatggctttggtttgctgagctcatgggtgtatctgcggttctaccaacgccattcacgcgggcgtggtgacatggccgaccattttgctttcgcgaccttcttccccgagatcctgcaaccagtggtcggcttactggccaatctggtccattcgttgttagtgaaagtgaagatatgccagaagaccgtaaaacgatacgacgtaggtgctccgtcctctattaccatatctcttcccggcaccgacccacaagacgcagagcggcggcggcagctcgctctcaaagctctgaacgaacgcctgaagagagtggaagatcagagcatttggccttcgatggacgacgacgaggaagaatctggtgcaaaagttgatagccccctaccatcagacaaggcgccaacccctccaggtaaaggcgccgcgcccgagtcgtccctgatcacctttgaagctgctccacctactctttag

SEQ ID NO: 31157 - DNA, 738 bp, Artificial Sequence
  Description of Artificial Sequence: Synthetic coding sequence
atgaaacacactcagagcggacaaagtacatcccctctggtaatcgactatacctgtcgcgtttgccagatggcttttgttttctcatcactgattcccctcctgctgatgaccccagtgttttgtctgggcaacacctctgaatgttttcagaacttttcccagtctcataaatgtattttgatgcattctcctcccagtgccatggccgaactgcctccctccgctaacactagcgtgtgctcaaccctgtacttctatggcatcgccattttcttaggaagctttgtcttgagcctgctcaccataatggtgctgttgatcagggcacaaactttatataaaaaattcgttaagtccaccggattcctcgggtcagagcagtgggcggtcatccatatagttgaccagcgcgtgagattctaccctgtggctttcttttgctgttggggacctgccgtgattttgatgatcatcaaattgactaaacctcaggatacgaagctgcacatggctctttacgtgctgcaagcattgacagcaacctctcagggtttgcttaactgtggtgtgtatgggtggactcagcacaagtttcatcagttgaagcaggaagccagacgcgatgctgatacacagacaccgttactctgctctcagaaaaggttctactcacggggcctgaattcgttagagagcactctgacttttcctgcctctacctccactatcttctag

SEQ ID NO: 31158 - DNA, 738 bp, Artificial Sequence
  Description of Artificial Sequence: Synthetic coding sequence
atgaaacacacccaatccggacaatctacgagcccgctcgtgattgattatacttgtagggtctgtcaaatggcatttgtgttctcctccctgatcccactgttgctcatgacacctgttttttgcctcggcaacactagtgagtgctttcagaactttagtcagagccataagtgcatattgatgcactccccaccatctgccatggcagagctgccccccagcgcaaatacttccgtttgttcaacattatatttttacggaatcgctattttcttagggtctttcgtcctgtccctgcttacaatcatggtactccttattagagcccagaccttgtataagaaattcgtcaaaagcaccggattcctcggcagcgagcagtgggccgtgatccatatcgtcgaccagcgggtgagattctatcccgtggcattcttttgttgctggggtccggctgtgatcttaatgatcattaaactcacgaagccacaggatacgaagttacacatggctctgtacgtattacaagctctaacggccacctcacaggggcttctcaattgtggagtttacggatggacgcagcacaagtttcatcagttaaagcaggaggcccgcagggatgctgacactcaaacacctctgctgtgttcccagaagcgcttttatagtaggggcctcaacagcctggagagcactctgacgtttccggcctcgactagtactatcttttag

SEQ ID NO: 31159 - DNA, 225 bp, Artificial Sequence
  Description of Artificial Sequence: Synthetic coding sequence
atggcgacactgagcgtgatcggctcttcgtccctcattgcctatgccgtgtttcacaacattcagaagtcccccgaaatccgacctctgttctatctctccttttgcgacctgctcctgggtctgtgctggctgaccgaaacgttgctctatggagcaagtgttgccaacaaggacatcatctgctataatcttcaggcagttggacaggtttccgccacttag

SEQ ID NO: 31160 - DNA, 321 bp, Artificial Sequence
  Description of Artificial Sequence: Synthetic coding sequence
atggccactctgtcagtgataggaagcagcagtctgatagcttatgccgtatttcacaatattcaaaagtctcccgagatccgccccctgttttacctgtccttctgcgatcttctccttggactctgctggcttaccgaaacactactgtacggtgcatcagtggccaataaggatatcatatgctataatctgcaggccgtgggtcagatcttttacatcagcagcttcttgtacacagtgaattacatttggtacctatataccgagctgcgcatgaaacacactcagtcagggcaatctacatcacccctggtctag

SEQ ID NO: 31161 - DNA, 528 bp, Artificial Sequence
  Description of Artificial Sequence: Synthetic coding sequence
atggccaccttatctgttatcggatcttcctccctgattgcgtatgccgtgtttcacaatatccaaaagtcaccagaaatcaggcccctgttctatctgagcttttgtgatcttctgctcggactctgctggctgaccgaaaccctcctttatggcgcttccgtggccaacaaagatattatttgttacaacctgcaggccgttggccagatcttctacatctcttcattcctctacactgtgaattatatttggtatctctacactgagttgcgaatgaaacatactcaaagcggccagtctacttctccactagtcattgattacacgtgcagggtatgccagatggcattcgtattttcaagtctcatcccgctgctgctgatgactccagttttttgcctgggaaacacaagcgaatgtttccaaaattttagtcagtcacacaagtgcatactgatgcacagccccccatccgccatggccgaactccctccaagtgccaacacgtcagtctgctctacatag

SEQ ID NO: 31162 - DNA, 156 bp, Artificial Sequence
  Description of Artificial Sequence: Synthetic coding sequence
atggccaccctgtccgtgattggatcaagctctctgatagcatacgcagtcttccacaatatccagaagagtccagaaattcgaccactgttttatctgtcattctgcgatttacttctgggactatgttggttgacagagacattgctgtactag

SEQ ID NO: 31163 - DNA, 738 bp, Artificial Sequence
  Description of Artificial Sequence: Synthetic coding sequence
atgaaacatacacagtctggacagagcacttctcccctcgtcatcgactacacgtgcagagtgtgccagatggcgttcgtcttctcgagtttgatcccactgctcctaatgactcccgttttttgcctcggaaatacgtcagagtgctttcagaattttagtcagagccacaagtgcatcctgatgcactctcccccctctgcaatggcggaacttcctccatccgctaatacctctgtgtgttcaacactctatttctatggcattgcaattttccttggaagtttcgtgttatccctgctgactataatggttcttctcatccgggctcagacactctataaaaaattcgtgaagagtaccggtttcttaggaagtgagcagtgggccgtcatccacatagtggaccagcgcgtgcggttttatccagtggcttttttctgttgctggggtcccgcagtaatcctgatgattataaaactgaccaaaccacaggatactaagttgcacatggctttgtatgtgctgcaggccctgaccgctacaagtcaggggttactcaattgcggtgtttatggatggacacagcacaaatttcaccaactcaaacaggaggcccgcagagacgctgatactcagacgccgctgttatgctcccagaaaaggttttattcccgcggccttaactccctggagtccacattgacatttcccgcatctacctcgactatattctag

SEQ ID NO: 31164 - DNA, 1014 bp, Artificial Sequence
  Description of Artificial Sequence: Synthetic coding sequence
atggctacgcttagcgtgattggttcatcatcactcattgcgtacgcagtgtttcataacattcagaaaagtccagaaattcgtcctctattctacctaagcttctgtgacctgctgctggggctttgttggctcaccgagacacttctctatggcgcctcggtagctaataaggatattatctgctataatctgcaagccgtgggacagatcttctacatctctagctttctctacaccgtcaattatatctggtatctgtacacagaactcaggatgaagcacacgcaatccggccagagcacgagccccctcgtcatcgattacacctgccgggtgtgccagatggcattcgttttttccagcttgattccactgcttttgatgacacccgtcttttgtcttggtaatacttcagagtgctttcaaaacttcagtcagtcccacaaatgcatactgatgcactctccgccatctgctatggccgagcttcccccatcggccaatacctcagtctgctcaacgctctatttttacggaattgccatcttcctcggaagcttcgtgctgtctctgcttacaatcatggtgctcctgatccgagcacagactctctataagaagtttgtcaagtctactggtttcctaggtagtgagcagtgggctgttatccacattgtcgatcaaagagtgcgattctacccagtcgcttttttttgctgctgggggcctgctgtcatcctaatgataatcaagcttacgaagccacaagacactaaactgcacatggcattgtatgtactacaggctctcacggcaacttcgcaaggactgctgaattgtggggtgtatgggtggacccagcataagttccaccagctcaagcaagaggctcgaagagatgccgacactcagacaccactgctctgttcccagaagcgattctattcaagaggactgaattctcttgagtccacactcacgtttcctgctagtacttcgactattttttag

SEQ ID NO: 31165 - DNA, 909 bp, Artificial Sequence
  Description of Artificial Sequence: Synthetic coding sequence
atggcaacactcagcgtgattggttcttcctccttaattgcttatgccgtgtttcacaacatccagaagtccccagagatcagacctctgttctacctgagcttctgcgaccttctgctgggcctctgctggctcacggaaaccctgttatacggtgcttcagtagcaaataaggacatcatatgctataacctgcaggcagtgggacaagtcatagactacacatgtagggtgtgccagatggcatttgtcttttcaagtttgatccccttgctgctcatgacaccagtgttctgtcttggcaacaccagtgaatgtttccagaacttttcccagtctcacaaatgcattttaatgcattctcccccttcagcaatggccgagttgccccccagcgccaatacttctgtgtgttctacactgtatttttacgggattgctatttttctcgggagtttcgtgctgtctttgttaacaatcatggttttactaattcgcgcccagacactttataagaagttcgttaaaagcaccggtttcttaggtagcgagcagtgggccgtgatacacattgtggaccagagagtccggttctaccctgtcgcttttttctgctgctggggccccgcagttatccttatgatcatcaagcttaccaaaccccaggacactaaactccacatggccctgtacgtcctgcaggccctgacagctacatcccaaggcctgctgaattgcggagtttatggatggacacaacataagttccaccagttaaaacaagaggccagacgcgatgccgacactcagacacccctgctttgttctcagaaacgtttttacagcaggggcctaaactcactggaatctacgttgacattccccgcgtcaacctctactatcttctag

SEQ ID NO: 31166 - DNA, 1545 bp, Artificial Sequence
  Description of Artificial Sequence: Synthetic coding sequence
atgggcaaggactttaggtactactttcagcatccttggtccagaatgattgtagcctacttagtcatcttcttcaacttcttgatattcgccgaggatcccgtaagccactcccagaccgaggccaatgtaatcgtggtgggcaattgtttcagctttgttaccaataagtacccacggggcgtcggatggcgaatcctcaaagttctgctgtggttacttgctatcttaactgggctcatcgccggcaaattccttttccaccagaggctttttggccagttgctcagattgaaaatgtttagagaagatcacggctcatggatgacaatgtttttctcgacgatcctgttcctgttcatcttttcacacatttacaatacaattcttctcatggatggtaatatgggtgcatatatcatcaccgactacatgggcattcggaatgaatcattcatgaagcttgccgctgttgggacgtggatgggtgacttcgtgaccgcatggatggtaactgacatgatgctacaggacaagccctatcctgactggggtaaatccgcaagagccttctggaaaaagggtaatgtgcggatcactttgttttggaccgtactgtttactctgactagtgttgtcgtcctggtgataactactgactggataagctgggacaagctgaaccgcggcttcctaccttccgatgaggtgtctcgcgccttcctagcttccttcattctggtctttgacctgctgatcgtgatgcaagactgggaatttcctcatttcatgggggacgtggacgtgaacttgcccgggctgcataccccccacatgcaatttaaaattccattcttccagaagatcttcaaagaagaataccgcattcatattaccggaaaatggttcaattacggcatcatcttccttgtgctcatactcgacctcaatatgtggaagaaccagatcttctacaagccacacgagtacggccagtatatcggccctggccagaaaatctacacagttaaagatagtgagtcccttaaagacctcaatagaaccaaactctcatgggagtggaggtccaatcataccaaccccaggacaaacaagacatacgtagaaggcgatatgtttctgcatagtcgattcatcggggctagcctcgatgtgaagtgtttggcctttgtgccatctctgatcgcttttgtatggtttggattcttcatctggtttttcggcaggttcttaaaaaacgagccacggatggagaaccaggataaaacttacactaggatgaagcggaagtcaccatccgaacacagtaaagacatggggattactcgggaaaatacacaggcctctgtggaggacccactgaacgatcccagcttagtgtgcattaggtccgatttcaacgaaattgtgtacaaatccagccacctgaccagcgaaaatttgagcagtcaactcaacgaatcaacgtcggcgacggaggccgaccaggatcccactacatccaagtccactccaactaattag

SEQ ID NO: 31167 - DNA, 789 bp, Artificial Sequence
  Description of Artificial Sequence: Synthetic coding sequence
atgtacattaaggactgggaattcccacacttcatgggagatgtggacgtcaaccttccgggcctgcacacccctcatatgcagtttaaaataccgtttttccagaaaatctttaaggaggagtaccggattcatattactggtaagtggttcaactatgggatcatcttcttggtgctcatcttggatttgaatatgtggaagaatcagatcttttacaaaccccacgaatacggccaatatatcgggcctggacaaaagatatatactgttaaggattcagaatcgctgaaggacttgaacaggaccaagctcagttgggagtggcgatccaaccacaccaatccccggaccaacaagacgtacgtcgagggcgacatgtttcttcactctcgattcatcggtgccagtttagatgtgaagtgtttggccttcgtgccatccctgattgctttcgtgtggttcggtttctttatctggtttttcggacgtttcttaaagaatgagccacggatggagaaccaagacaagacttacacacgtatgaagcgaaagagcccgtcggagcattctaaggacatggggattacccgtgaaaacacacaagcaagcgtagaggaccccctcaacgatccttccctggtctgcattcgcagcgacttcaatgagatcgtctacaaatcctcacacctaacctccgaaaatttatccagccagcttaacgagagcacaagcgctacagaggccgaccaggacccaactacaagcaagtcaacccccacaaattag

SEQ ID NO: 31168 - DNA, 1233 bp, Artificial Sequence
  Description of Artificial Sequence: Synthetic coding sequence
atggccacgtgccactctcacagaactaacagctggcaaatctccgtcccatcggcattcgtgtggtctgttgctcctattaaaaatgtgtcgcgtagatcctgggtagtcgacgataacgttctgcagcataatagcttgagtttacatatcttttcacatattcagcacgatagttctaatggatgggagcacggggtaactgacatgatgctgcaggataaaccataccctgactggggtaaatcagcccgagccttctggaagaagggcaatgtgcggattacgttattctggactgtcctgttcacacttactagcgtggtggtgttggtgatcacaactgactggatatcatgggacaaactcaacaggggctttctccccagtgacgaagtatcccgtgccttcctcgcctcattcatcctggtttttgatctgctgatcgtgatgcaggactgggaatttcctcactttatgggagacgtggacgttaaccttccaggactccacaccccacacatgcaattcaaaattcccttctttcagaagatctttaaagaggagtaccgcatccatatcactggaaaatggtttaactatggcatcatttttctggttttgatcttagacctcaacatgtggaagaatcagatcttctacaagcctcatgagtacggccagtacatcggccctggacaaaaaatctatacagtcaaggacagtgaaagtctcaaggatttgaatcgtaccaaattatcctgggagtggagaagcaaccataccaatccaagaaccaacaaaacttatgtggagggtgacatgtttctgcactctcgttttattggcgcatccttggacgtcaaatgtctagctttcgtcccttcgttgattgccttcgtttggttcggattcttcatatggttctttgggcgcttcctgaaaaatgaacctcggatggaaaatcaggataaaacctacacaagaatgaagcgtaagtcgcctagcgagcattccaaggatatgggaattactcgggaaaacacccaggcaagcgttgaggatcccctcaatgatcctagcctagtctgcattcgtagtgactttaatgaaatcgtctacaaaagcagccatcttactagtgagaatctcagctcccaactgaatgaatccacgagtgccaccgaggcagatcaggatcccaccactagtaagagcacaccgactaattag

SEQ ID NO: 31169 - DNA, 852 bp, Artificial Sequence
  Description of Artificial Sequence: Synthetic coding sequence
atggtgagcgctgcggcccctagcctgctaatcctcctgctgctgcttctgggcagcgtaccagctactgacgcccggtccgtccctttgaaggcaacctttctcgaagatgtggctggcagtggggaagccgagggtagttcagcctcctctccttccctgcctcccccttggacacctgctctctcgcccacgagtatgggccctcagcccatcactctgggtggcccatccccacccacaaatttccttgacggcattgtagatttctttcggcagtatgtgatgttgatcgcggttgtcgggagcctcgctttcttgctcatgttcatcgtatgtgccgcagttatcacccgtcaaaaacagaaagccagcgcctattatcctagctccttccccaagaagaaatatgtcgatcaatccgacagagccggaggccctcgagctttctctgaggtgccagaccgcgctccagatagcagacccgaagaggctctggactcctcccgccagctacaagctgatattctagccgccacacagaacctgaagagccccacccgtgcagctctgggaggaggagacggggccaggatggtggaaggccggggcgctgaggaggaagagaaggggtctcaagaaggtgaccaggaggtgcagggtcacggtgtgcccgtggagactccagaggcgcaggaggaaccctgcagtggtgtgctcgagggcgcagtggtagctggtgagggccaaggcgagctggaaggtagcttgctcctggcccaggaggcccagggtcccgtagggccaccagagtctccctgcgcctgttcgtcggtccaccctagtgtgtag

SEQ ID NO: 31170 - DNA, 654 bp, Artificial Sequence
  Description of Artificial Sequence: Synthetic coding sequence
atgggacctcagcctatcacactcggcggcccttcacctccaacaaatttcctggatgggatagttgatttcttcaggcagtacgtcatgctgattgctgtggtgggaagtttagccttcctgctaatgttcattgtctgcgccgccgtcatcacgcgccagaaacagaaagcgtcagcttattatccttcgagtttccccaagaaaaagtacgttgaccagtcggatagagctgggggcccccgcgctttctctgaggtaccagatcgtgcccctgactccaggcccgaagaggcattggacagttctcgacaactacaggcagacatcctggctgctacccagaacttgaagtctcccacccgcgctgccttgggcggcggcgatggcgccaggatggtcgaaggcaggggagcagaggaggaagaaaaggggtctcaggagggcgatcaggaagttcaaggacacggcgtgccagtcgaaactccggaagcgcaggaagaaccctgtagcggggttttggaaggcgccgttgtcgctggagagggacagggggagctagaaggcagcctgctgctggctcaggaagcccagggacctgtcgggccacctgaaagtccgtgtgcttgtagcagcgttcaccctagcgtttag

SEQ ID NO: 31171 - DNA, 87 bp, Artificial Sequence
  Description of Artificial Sequence: Synthetic coding sequence
atggtcagtgctgccgcccctagcctgcttatcctgctcttgctgctgctgggcagcgtgcccgcaactgatgctaggtctgtttag

SEQ ID NO: 31172 - DNA, 423 bp, Artificial Sequence
  Description of Artificial Sequence: Synthetic coding sequence
atggtctctgcggcagcaccgagcctgctcattttgctgcttctgctcttaggttcggttcctgccaccgacgccagaagcgtgcctctgaaggccacattcctcgaggatgtggcaggtagtggggaggcagagggcagctctgcctctagtccttctctgccaccgccttggacccccgccctgagcccaacctctatgggccctcagcccataactctgggggggcctagccctcctactaattttcttgatggcatagttgatttcttccggcagtatgtcatgctgatcgcagtggtgggcagtctcgcgttcctcctgatgttcattgtctgtgccgcagtcatcacacggcaaaaacagaaagcctcagcctactacccatcctctttcccgaaaaagaaatatgtcgatcagtag

SEQ ID NO: 31173 - DNA, 135 bp, Artificial Sequence
  Description of Artificial Sequence: Synthetic coding sequence
atggtgtcagccgctgccccaagtcttttgatcttactcctgttgctcctgggatcagtacccgccacagacgccaggagcgtgcctctgaaagctacctttctagaggatgtggccgggagcggcgaggcctag

SEQ ID NO: 31174 - DNA, 1020 bp, Artificial Sequence
  Description of Artificial Sequence: Synthetic coding sequence
atgagtggtcagctagaacgttgtgagcgagagtggcatgaacttgagggggagtttcaagaacttcaggagacgcatagaatctacaagcagaagctggaagagctagcagccctgcagacactgtgttcatcctccatatcgaagcaaaagaagcacctgaaagatctgaaattgactctacagcgatgcaagcgacacgcatcgcgcgaagaagccgagttggttcagcagatggcggcaaatattaaagagcgacaggacgtattcttcgacatggaagcttacctgcccaagaagaatggcctctacttgaatcttgttcttggcaatgtaaacgttaccctgctctcgaatcaggccaagttcgcatacaaggacgaatacgagaaattcaagctgtacctgacaattatccttctgctaggtgcggtggcctgtagattcgtgttacactaccgggtcacggatgaagttttcaacttcctgctcgtatggtactactgtaccctgaccattagagagagtattctaatttctaatggctctcggattaaagggtggtgggtgagccatcactatgtctccacatttctctctggggtgatgttgacatggcctaatgggccaatatatcaaaagttccgcaatcaattcttggctttttctatattccaatcctgtgtgcagttcttgcagtactattaccagcgtgggtgtctgtatcggctgcgcgcactgggagagagaaaccacctggacctgactgtcgaaggatttcagtcatggatgtggaggggactaacttttcttctgccctttttattctgtggacacttttggcaactgtacaacgccgtaactctctttgagctgtcgtctcatgaagaatgtcgggagtggcaggtgttcgtcctcgcctttacctttctaatcctgttcctgggaaatttcttgacaactctcaaagtcgtacacgcaaaacttcagaagaatcgtggaaagacaaaacagccttag

SEQ ID NO: 31175 - DNA, 1020 bp, Artificial Sequence
  Description of Artificial Sequence: Synthetic coding sequence
atgtccgggcaattagagaggtgtgagagggagtggcacgagctcgaaggcgagtttcaggagctccaggagacacaccggatctacaagcaaaagctggaagagcttgctgcacttcagaccctgtgctcctctagcatatccaagcagaagaaacatctgaaggacttgaagctcactctacaaaggtgcaagaggcatgcctcccgcgaggaagctgaactcgtgcagcagatggctgctaatatcaaggagcgtcaggacgtctttttcgacatggaggcttatcttcctaagaagaatggtctgtaccttaacctggttcttggcaatgtaaacgtgactctgctgtccaaccaagccaaatttgcttacaaggatgaatatgagaaatttaagctctatcttacaattattctgctcctgggtgcagtcgcttgcagattcgtgctccactacagggtcacagatgaggtgttcaacttcctactcgtatggtactattgtacattgaccatccgcgagagcatcttgatcagcaatgggtcccgaatcaagggatggtgggtgtctcaccactacgtttccacatttctgagtggagttatgttgacatggcccaatgggcctatctatcagaagttccgaaatcagttcctggcatttagcattttccagtcttgcgtgcaattcctgcagtactactatcagcgaggttgcctgtatcggctccgagctctgggcgagcggaatcatctggacctcaccgtcgaaggttttcagagctggatgtggaggggcctcacatttttgttgccctttttgttttgcggtcacttttggcagctgtataacgccgttaccttgttcgagctgtcaagtcacgaagaatgtcgcgagtggcaagtgttcgtgctggctttcacgtttctcatcctgtttctgggaaattttctcacgacactgaaggtcgtgcacgccaaattacagaaaaaccgcggcaagacgaagcagccatag

SEQ ID NO: 31176 - DNA, 960 bp, Artificial Sequence
  Description of Artificial Sequence: Synthetic coding sequence
atggttctccccccacccgatcgtaggcacgtatgtctgaccacgctagttattatgggatcgatggccgtgatggacgcctaccttgtggagcagaaccagggacccaggaagatcggcgtgtgcatcatcgttctggtcggggatgtatgcttcctgctggtcctccggtatgtggccgtctgggttggagctgaggtgcgcacggcaaagaggggatacgctatgatactgtggttcctttacatctttgtgttagagatcaagctctacttcatttttcagaactacaaggcggccagacgcggggctgctgatcctgttgcacgtaaggctctgacactgctgctgtccgtttgtgtgcccggattattcctgctccttgttgcgctggaccgaatggagtacgtccgaacgttcaggaagcgtgaagacctaaggggccgcctgttctgggtggcactggatctgctggatctccttgacatgcaagcaagtttgtgggagcctccccggagcggacttccactgtgggctgagggactgacctttttttactgctacatgctcctccttgtcctaccgtgcgtggctctatccgaagtgtccatgcagggagaacatatcgctccccaaaagatgatgttgtaccctgttttaagcctggccactgtcaatgttgtcgctgtcttggctcgggcagctaatatggcactgttccgcgatagtcgtgtcagtgccattttcgttggcaaaaacgtagtcgccttggcaacgaaggcgtgcacctttcttgaatacagacgccaggtccgggacttccctccacctgccttgtccctggagctgcagcccccacctccccaacggaattcagtgccgccccctcccccccctctacatggccctcccggcagaccccatatgtcctccccaactcgcgaccccttagacacctag

SEQ ID NO: 31177 - DNA, 960 bp, Artificial Sequence
  Description of Artificial Sequence: Synthetic coding sequence
atggtgctccccccacctgatcggcgacacgtgtgtctgaccaccctggtgattatggggtcaatggcagttatggacgcatacctggtcgagcagaatcagggcccacggaagatcggggtgtgcatcattgtcctagtgggcgatgtgtgcttcctcctggttctgcgctacgtggcggtatgggtgggggccgaagtcaggacagcaaagcgcgggtatgccatgattctgtggtttctgtatatattcgtcttagaaatcaaattatactttatcttccagaattacaaggccgctaggagaggagctgctgaccctgttgccagaaaagccttaacacttttgctgagtgtctgtgtgcctgggctgtttttgcttcttgtagccctagacaggatggaatacgtgaggaccttcaggaaaagagaggacctgagagggaggttgttttgggtcgccctggatctattagacctgcttgacatgcaggcaagcctatgggagccacctcggtcaggactgcccctgtgggctgaggggctgaccttcttctattgctacatgctactgcttgtcctgccctgcgtcgccctgtccgaagtgagcatgcagggcgagcacatcgctccacagaagatgatgctgtatcctgtgctgtctctggcaactgtcaatgtagtggccgttctcgccagagccgcaaatatggctctgttccgagatagccgggtgagtgccatttttgttggcaaaaacgtggtggccctcgcaaccaaggcatgtactttcctggaatacaggcgccaagtcagagatttccctccccctgctctgtcgctggaactgcagccccctcctcctcagcgcaatagcgtcccccctcccccccctccattgcacgggcctcccggcaggcctcacatgtcatctccaacaagggatcctctcgacacatag

SEQ ID NO: 31178 - DNA, 660 bp, Artificial Sequence
  Description of Artificial Sequence: Synthetic coding sequence
atgagtgagcaggaggctcaagctccagggggaagaggacttcctcccgacatgcttgccgagcaagtggagttatggtggtctcagcaaccacggagatccgccctgtgtttcgtcgtcgccgtcggcttggtggcgggctgcggggcaggaggggtggccctcctttctaccacctcctcccgatctggtgaatggagactggccacagggacggtcctctgtcttctggcactgttagtactcgttaagcagctcatgagttcggcagtacaggacatgaactgtatcaggcaggctcatcatgtcgcactgttgagaagcgggggcggagctgatgcactcgtcgttctgctgtccgggctggttttattggtcaccgggctcactttggcaggccttgccgctgcccccgctccagcacgtcccctagcggccatgctgagtgtgggcattgccctggccgcactggggtcactgctgctgctcggtttattactatatcaagtcggagtgtctggccactgtccttcaatctgtatggcaacgccatcaacacactcaggccacggtggacacggctccatcttttctatcagcgggcaactgagtgctggaaggagacacgaaaccacatcctctatcgcctcccttatctag

SEQ ID NO: 31179 - DNA, 660 bp, Artificial Sequence
  Description of Artificial Sequence: Synthetic coding sequence
atgtcagaacaagaagcgcaggcaccaggtggtcgaggactcccccctgatatgctggccgaacaggtggagctgtggtggagccaacaacctagacgcagtgcactgtgtttcgtagttgctgttggtctggtggcgggttgcggcgccggcggagtcgccttactgagcaccaccagttcccgctccggagagtggcgactggcaacaggcaccgtgttatgcctgctcgccttacttgttttagtcaagcaactgatgtctagcgctgtgcaagacatgaattgcattcgccaagctcaccatgtagccctgttgaggtccggggggggagcggatgctctggttgttcttcttagtggcctagtgctcctggtcactggactgactctcgccgggctggcagctgcccctgctcctgccaggcctctggcagccatgctctctgtgggcatcgctttagctgctctgggctcattacttctgcttgggcttctgctctaccaggttggtgtttctggacactgcccctctatatgcatggccaccccctccacccacagtggtcacggcggacatggttccatcttctccatttccgggcaattatcggccggccggagacacgaaacaacttctagtatcgcctctttaatctag

SEQ ID NO: 31180 - DNA, 51 bp, Artificial Sequence
  Description of Artificial Sequence: Synthetic coding sequence
atgagtgagcaagaagcccaagctccggggggcagaggactcccgccttag

SEQ ID NO: 31181 - DNA, 693 bp, Artificial Sequence
  Description of Artificial Sequence: Synthetic coding sequence
atggtggttttcggctacgaagccggtacgaagccccgcgactcaggagtggtgcctgtaggcacagaagaagcacctaaagtattcaaaatggctgcctcaatgcacggccagcctagtcccagtctggaggacgccaagctacgtaggcccatggttatcgaaataattgagaagaacttcgactacctcagaaaggagatgactcagaatatctaccagatggcgacattcggaacaaccgccggtttctccgggatattcagcaacttcctgtttagacgatgttttaaggtcaaacacgatgctctcaaaacttatgcctcactggcgacgttaccgtttttgtcaactgttgtcactgacaaattgttcgtgattgatgccctgtactctgacaatatctctaaggagaactgtgtgtttagaagttctcttatcggcatcgtctgcggggttttctacccttcttctttagcgtttactaagaatggccgcttggccaccaagtaccataccgtgccgctcccaccaaagggtcgtgtgctcatacattggatgacactgtgtcaaacccaaatgaaactgatggcaattcccctggtcttccaaatcatgtttggcatcctgaacggtctttatcactatgccgttttcgaagaaactctcgagaaaacaatacacgaggaatag

SEQ ID NO: 31182 - DNA, 603 bp, Artificial Sequence
  Description of Artificial Sequence: Synthetic coding sequence
atggccgccagcatgcatggacagccatccccttcacttgaagatgccaagctccgcagacccatggtgattgaaataattgagaagaacttcgactatctccggaaggagatgacccaaaatatataccagatggctacattcggaaccacagctggcttttcaggcattttctccaactttctatttagaaggtgtttcaaagtcaagcatgatgccttgaagacttacgctagcttggcaacgctcccctttttgagcaccgttgtgaccgataaactgtttgtcatagacgccctgtactcagacaacatatcaaaagagaactgcgtcttcaggtcctctcttattgggattgtttgtggagtcttctatccttccagcctggccttcacaaagaacggaagactggctacaaagtaccacactgtacctctccctccaaaaggcagggtcctgattcactggatgacactatgtcagacccagatgaaattgatggcaatccctctggtattccaaatcatgttcggcatattgaacggtctataccattatgccgtgtttgaagagactctagaaaagacaattcatgaagagtag

SEQ ID NO: 31183 - DNA, 513 bp, Artificial Sequence
  Description of Artificial Sequence: Synthetic coding sequence
atggtggtcttcgggtatgaggctgggaccaagccaagggactctggcgtggttcccgtgggaactgaagaagcaccaaaagtgttcaaaatggccgccagcatgcatggacaaccatcaccatctctggaggatgcgaagctaaggcggcccatggtaatcgaaataatagagaaaaatttcgattatctgcggaaagagatgacccagaatatctaccaaatggccacctttgggaccaccgcaggctttagcggcatcttttcaaatttcctgttcaggaggtgtttcaaggtaaagcacgatgcacttaagacatacgcaagtcttgcaacattaccctttctgtctaccgtcgtgaccgataagcttttcgtcatcgacgcgctctattccgacaatattagcaaggaaaactgcgtcttccggagctccttaatcggcatcgtgtgcggcgtcttttacccctcatctttagcttttaccaagaatgggagattggcaacaaaatag

SEQ ID NO: 31184 - DNA, 177 bp, Artificial Sequence
  Description of Artificial Sequence: Synthetic coding sequence
atggtcgtattcgggtatgaggctggcacaaagcctcgggattcaggcgttgtccccgtcggcactgaagaagccccaaaggatacaaaatatatatccaacggcgacatctggaacaattcttggttcctctggaacatcttgaagctgcctgtgcagactttgttacagggatag

SEQ ID NO: 31185 - DNA, 426 bp, Artificial Sequence
  Description of Artificial Sequence: Synthetic coding sequence
atgcctcctttcgggtacaaaaccgaaacctccacagccgtcgagaaaaaggaaaagcctttaccccggctaaacatacactcaggcttctggattcttgcatcaattgtggttacatactatgtcgacttctttaaaaccctcaaagagaatttccacacaagcagctggtttctgtgcggctcagctctgcttcttgtctcactatcgatcgccttctattgcattgtgtacctggaatggtactgcggcatcggcgagtacgatgtgaagtacccggcattgatacccattaccacagcctcctttatcgccgccggcatctgtttcaatatcgccctgtggcatgtgtggagttttttcacacccctgcttctgttcacacagttcatgggagtggtcatgttcattactcttcttggatag

SEQ ID NO: 31186 - DNA, 498 bp, Artificial Sequence
  Description of Artificial Sequence: Synthetic coding sequence
atggactcatcacgggcacggcagcagctaaggcgccgcttcttgctcctgccggatgccgaggcgcaactggatcgcgagggcgacgctggtccggagacatctactgctgtggaaaaaaaagagaagccgcttccaaggttaaacatccattcaggcttctggattctagcttcaattgtcgtaacctattatgtagacttcttcaagacactcaaagaaaactttcacacctcctcgtggtttctgtgcggtagcgcactgctcctcgtaagcctgtctatagcgttctactgcatcgtgtacctggaatggtactgtgggatcggcgagtacgacgtaaagtatcctgcattgatccctattaccacagcctcattcattgccgctggaatctgcttcaacatcgcgctgtggcatgtttggtccttttttacaccactcctgctttttacccaatttatgggtgtggtgatgttcattacactgctggggtag

SEQ ID NO: 31187 - DNA, 399 bp, Artificial Sequence
  Description of Artificial Sequence: Synthetic coding sequence
atggatagcagtcgagctcgacagcaattgagaaggcggttcttactgcttccggatgccgaggcacaattagaccgggagggcgacgctggcccggagaccagtactgcagtggaaaagaaggaaaaacccctgccacgcctgaatatccatagcggattttggatattggcctctattgtggtgacttattatgttgacttttttaagacactgaaagaaaactttcatacttcatcctggtttctctgcgggtctgctctgctgttggtgtctctctcaatcgcattctattgtatcgtctacttggaatggtattgtggtattggtgaatatgacgtcaagtacccggctctcattccaatcacgaccgcctcctttattgccgccggcatctag

SEQ ID NO: 31188 - DNA, 498 bp, Artificial Sequence
  Description of Artificial Sequence: Synthetic coding sequence
atggactctagccgggcccgccaacagcttaggcgtaggtttctgttgctaccggacgctgaggcacagttagatcgcgagggggacgccggacccgagacaagcaccgcagtggagaagaaagagaaacctctcccgcgcctgaatatccacagcggattctggatacttgcatctatcgtcgtgacctactatgtcgacttctttaaaacccttaaggagaacttccatacttccagttggttcctctgtggctcggccctccttctggtctccctgagcatcgccttctattgtatcgtttatttggagtggtactgcggaattggcgagtacgatgtgaaatatcctgccctgatacctattaccaccgcatccttcatcgcggctggaatctgttttaacattgctctgtggcacgtgtggtcattctttactccgctgctgctattcacccaattcatgggagtcgtgatgttcattacactcttgggatag

SEQ ID NO: 31189 - DNA, 1089 bp, Artificial Sequence
  Description of Artificial Sequence: Synthetic coding sequence
atggacagccccgaggtgaccttcacacttgcatacctggtgttcgcagtctgttttgtctttactccgaacgaattccacgccgctggcctcaccgtgcagaacttgcttagtggatggctcggatcagaggacgccgcgttcgtcccttttcatctgaggagaaccgccgccactctgctttgtcactctttactgcccttagggtactatgtaggcatgtgcctagctgcaagcgaaaagcgtctccacgccctttcccaggcccccgaggcttggaggttgttcctgttgttagctgtcaccctgcctagtattgcatgtatcttaatttactactggagtcgagatcgatgggcctgtcatccattagccaggaccctggccctttatgctctgccccaatcaggctggcaggccgtggcgagcagcgttaataccgagttccggaggatcgacaagtttgccaccggcgcaccgggcgctagggtaatcgtgacggatacatgggtgatgaaggtgacaacatatagagtccacgtggcacagcagcaggacgtccatttaaccgtaacagagtccagacagcacgaattgtcgcccgattctaacctgccggtgcaactgttaaccattcgcgtggcctccacaaaccccgcggtgcaggcgtttgatatttggcttaattcaactgagtacggagagctgtgcgagaagctgagagcgcctataagacgggcggcccacgtggtcatccaccaatcattaggtgatctgtttttagagaccttcgcgagccttgtcgaggtcaaccccgcttattccgtccctagtagccaggagctcgaggcgtgcatcggatgtatgcagacaagggctagtgtcaaactggtcaaaacatgccaggaagccgccacaggtgaatgtcagcaatgttattgccgaccaatgtggtgcctcacctgcatgggtaagtggttcgcgagtcgacaggaccccttgaggccggacacatggctcgccagtcgtgtgccttgccccacatgtagggcccgattctgcatcctagacgtgtgcaccgtgcgttag

SEQ ID NO: 31190 - DNA, 1089 bp, Artificial Sequence
  Description of Artificial Sequence: Synthetic coding sequence
atggactcaccagaggttacgtttaccctggcttacctggtttttgccgtgtgcttcgttttcactccgaacgaattccatgctgcaggtctgacagttcaaaatctcctgtctgggtggctaggctccgaagatgctgcattcgtgccttttcacttacgtcgcactgctgcgactcttctgtgccactctctgttaccattaggctactacgtggggatgtgcttggcagcctccgaaaaacggctccatgctctctcacaggctcccgaggcatggaggctgttcctgctgttggctgtgaccttgccaagtattgcatgcatccttatatactactggtctcgggaccgctgggcgtgccacccactggcacgaacactcgccctgtatgcgctgccacagtctggctggcaggccgtagccagcagtgtgaacaccgagtttaggcgcatagataagtttgccacaggcgctccaggggcacgtgtcattgtgaccgatacatgggtcatgaaagtgacaacataccgggttcacgtcgcccagcaacaggatgtgcatctgaccgtgaccgaaagccggcagcatgaattgagcccagattcaaatctgcctgtgcagctcctgactattcgcgtcgccagcacaaaccctgccgtgcaagcattcgatatctggctgaattcgactgaatacggggagctttgcgaaaaactgcgcgcgcccattagacgcgccgcccacgttgttatacaccaatcattgggcgacctgttccttgagacgtttgccagtttggtggaggttaacccggcctatagtgtgccgtctagtcaggaactcgaggcatgtatcggatgcatgcagacacgcgcgtctgtaaagttagtgaagacctgccaggaggctgctaccggggaatgtcagcaatgttactgcagacccatgtggtgtctcacatgcatgggtaagtggttcgcctcacgccaggacccactccgccccgacacctggctcgcgtctagagttccatgccctacctgcagagcacggttttgtatcttagacgtgtgtaccgtgcgatag

SEQ ID NO: 31191 - DNA, 699 bp, Artificial Sequence
  Description of Artificial Sequence: Synthetic coding sequence
atggacagtcctgaagtgacattcacactggcctacctagttttcgctgtgtgtttcgtgttcactcccaatgaattccacgcggcagggctgacagtacagaatctgttatccggctggttgggtagtgaggacgctgcatttgtaccctttcatctgcggcggacagctgccacattgttatgtcactcgctactaccgctgggctactacgtggggatgtgcttggccgcctccgagaaacggctacatgccctttcccaggctccggaggcctggagattgttcctgctgctggctgtcactcttcccagcatcgcctgcatcctgatttattactggtctagagatcgctgggcctgtcacccactcgctaggaccctcgccctttacgctctgccgcagtctggctggcaggccgtcgcatccagcgtaaacactgaatttcgccggattgataaatttgctacaggagcgcccggagctcgcgtcatcgtaacagacacatgggtgatgaaagtgactacctacagggtgcatgtggcccagcaacaggacgtgcacttgacagtcacagagtcgagacagcacgaattgagcccggattctaacctcccggtgcaattgctcaccatccgggttgcttctaccaaccccgcagtgcaagcctttgatatctggagctggcgtcccgcctag

SEQ ID NO: 31192 - DNA, 1272 bp, Artificial Sequence
  Description of Artificial Sequence: Synthetic coding sequence
atggcccaggctgtctggtcaaggcttggaaggatcttatggcttgcctgcctactgccctgggctcctgcaggggtcgctgctggactctatgagctcaacctcaccaccgatagtcccgccacaacaggggccgtcgtaacgatttccgcaagtctggtggcaaaggataacggatccctggcactccccgcagacgctcacctgtaccgcttccattggatacatacaccactggtgcttacaggaaaaatggaaaaagggctgtcttccacaatcagagttgtagggcacgtccccggcgagttcccagtctctgtttgggtgactgccgcagattgctggatgtgccagcccgttgctcgaggatttgtggttcttccaattacagaattcctggtgggagacctagtggtgacccagaacacatcgttgccttggcctagctcgtacttaaccaaaactgttctgaaagtctcgtttctactgcatgatcctagcaattttctgaaaaccgcactatttctttatagttgggatttcggcgatgggacacagatggtgaccgaggacagtgtcgtctattacaactactctatcatagggacatttaccgtaaagctgaaggtggtggctgagtgggaggaagtcgagccagacgcgacacgagccgttaaacagaagaccggggacttctccgcctctctgaagctgcaggaaaccctgagaggtatccaagtgctcgggcctacactgatccagacatttcagaaaatgacggtaaccctgaatttccttggcagtccccccttgacagtgtgttggcgcctgaaacccgagtgtctcccactggaggaaggtgaatgccaccctgtttccgtcgcaagtactgcctacaatcttactcatacttttcgggacccaggtgattattgcttctcaatcagagccgagaacattataagcaagacccaccagtaccacaagatccaggtctggccctcacggatccagccagccgtgttcgcatttccatgcgccacactgattaccgttatgctcgccttcatcatgtatatgacgctgagaaatgccacacagcagaaggatatggtggagaatccagaacccccttccggggtgcggtgctgctgccaaatgtgctgcgggccctttttactggagacaccttctgagtacctagagatagtcagggaaaatcatgggctgctgcccccgttgtacaaaagcgttaaaacatacactgtgtag

SEQ ID NO: 31193 - DNA, 966 bp, Artificial Sequence
  Description of Artificial Sequence: Synthetic coding sequence
atggcacaagctgtttggtccaggctaggcaggattctctggctagcttgcctactgccttgggcaccagccggcgtcgctgccgagtttctggtgggcgatctagtagtgacacagaatacctctctgccctggccatcttcttacctaacaaaaacagtcctgaaagtttcctttctgctccatgacccgagtaactttctcaagacagccctgtttctctatagctgggatttcggcgacgggacgcagatggtcacagaggatagcgtcgtatattacaattactcgattatcgggaccttcaccgtgaagctcaaggtggtggctgagtgggaagaggtggaaccggacgctacacgcgccgttaagcagaagaccggcgacttttcagccagtctgaagctgcaagagacattaagaggaatccaagtgctgggccctactctgattcaaacatttcagaagatgaccgtcaccttgaatttcctcggctctccgccgctgacggtatgctggagactgaaacccgagtgtttaccactggaggaaggagagtgtcatcccgtctccgtcgcctcaactgcctataatctcactcacacttttcgggaccccggtgattactgcttttccatacgtgcggaaaacataattagtaagacacatcagtatcataaaattcaggtttggccttctagaatccagcccgcagtgttcgcctttccttgtgctactttgatcaccgtaatgttggcatttataatgtatatgacactgagaaacgcaacgcagcaaaaggatatggtggaaaatcctgaacctccctccggcgtcagatgttgttgccaaatgtgttgtggcccttttttgctggagacaccctctgaatacctggagattgttcgcgaaaaccacgggctcctgcccccgctatataagtcagtgaagacatatactgtctag

SEQ ID NO: 31194 - DNA, 1308 bp, Artificial Sequence
  Description of Artificial Sequence: Synthetic coding sequence
atggcccaggcggtctggtcccggcttggtagaattctctggctggcttgcctgctgccttgggccccggccggggtggccgccgggctctatgagctgaatctgacgacagactcccctgccacaaccggagctgtggtgacaataagtgcaagcctggtggcaaaagacaacggatctcttgccctccctgccgacgcccacctgtacaggttccactggatccacactccactagtcctgacagggaagatggaaaaaggattgagctctacaattcgtgtggttgggcacgtacccggtgaattccccgtatcagtttgggtgacagccgccgactgctggatgtgccagcccgtggcccgcgggtttgtcgtgctccccattacagaattccttgtcggggacctagtggtaacccagaataccagccttccgtggccatctagctacttaactaaaacagtactgaaggtcagcttcttactccacgatccatccaactttctgaaaaccgctttatttctgtactcatgggatttcggagacggcactcaaatggtgacagaggatagtgtcgtgtactacaactactccatcatcgggaccttcaccgtcaagctcaaggtcgtcgccgaatgggaagaggtcgagcccgatgcgacgagggccgttaaacaaaaaacgggagatttttcagccagtctcaagctacaggagacccttagaggtatccaagtcctcggccctacattaatccagacctttcaaaagatgaccgttacactgaactttctggggagccccccactgactgtgtgctggaggctaaagccagaatgtttgccgctagaggagggcgagtgtcatccagtatccgttgcttctaccgcttacaatctcacccataccttccgggatccgggcgattattgcttttcaattcgggctgaaaacataatttctaagactcaccagtatcataagattcaagtctggccatcgcgcatccagcctgccgtgttcgcatttccatgtgcgaccctgattacagtgatgttggctttcataatgtatatgaccctgaggaacgccactcagcagaaagatatggtggaggtggctgacttcgattttagccccatgtctgataaaaaccctgagcctcccagtggtgtgagatgctgttgtcagatgtgttgtggccctttcctgctcgaaacgccatcagagtacctagagatcgtgagggaaaatcacgggctcctgccaccgctctacaaaagcgttaagacttacacagtgtag

SEQ ID NO: 31195 - DNA, 1215 bp, Artificial Sequence
  Description of Artificial Sequence: Synthetic coding sequence
atggaccctgagctcacgggttcttggggtttgtacgaacttaatctgacaaccgactcacctgctacgaccggagctgtcgtcacaatctctgccagcctggtcgctaaagacaatgggtccctggcactgcccgctgacgcacatctgtaccgatttcattggattcatacacccttggtactcaccggaaagatggagaagggcctgtcctcaaccattagagtggtgggccacgtgcctggagaattccctgtctcagtctgggtgactgccgccgactgttggatgtgtcagcctgtggcccgtggtttcgtcgttctacccatcactgagttcctggttggggatctagtcgtcacccagaatacaagtcttccttggccctcttcatatctgaccaagacagtcctgaaggtctccttcctgctgcatgatcctagcaattttcttaaaactgccctatttctttattcgtgggactttggggacggcacacagatggtcaccgaagacagcgttgtctactacaactactccattatcggaactttcacagtcaagcttaaagtggtcgcagagtgggaagaggtcgagcccgatgccactcgcgccgtcaagcagaagacaggggacttctctgcctccttaaaattgcaggagacactgcggggcattcaagtactcggccccaccttgatacagacatttcagaaaatgacagttacactgaactttctggggtcacccccgctgaccgtctgctggagattgaaacccgaatgcctacccctggaggaaggcgagtgccatccagtgtccgttgcctcgacagcctacaatctgacacataccttccgggacccaggggactactgcttctccattcgtgcagagaatattatcagcaagacccatcagtaccataagatccaggtgtggccatccaggatacagcccgcagtgttcgcattcccctgtgccacacttattacagtgatgctggcctttatcatgtacatgaccctccgtaatgcgacccaacagaaggatatggtggaaaaccctgagcctccctccggggtccgctgctgttgccagatgtgttgtgggccatttctgctggaaacccctagcgagtacttagagatcgtcagggaaaaccacggcctgctgccacccctttacaagtcagttaaaacatacaccgtttag

SEQ ID NO: 31196 - DNA, 5652 bp, Artificial Sequence
  Description of Artificial Sequence: Synthetic coding sequence
atgggcaaacgagctggcgggggcgccaccggagctactaccgcagccgtaagcacctccgcgggggccggcctggagcctgcagctgctaggtctggcggaccccgcagcgccgcagcaggcctcctgggcgccttgcacctggtgatgactctggtagtggccgccgctagggccgagaaagaagcattcgtgcaatccgagagcattatcgaagtattgaggttcgacgatggcggactgctccaaacggaaactacattgggattaagctcctatcagcagaaatccattagcctatacaggggcaactgtcgtccgatccgcttcgaaccacctatgttagacttccacgagcagcccgtgggaatgcccaagatggaaaaggtgtacctgcacaaccctagctcagaagagacaattacacttgtgagtatctctgcaacgaccagtcactttcacgcatccttctttcagaacagaaagatccttccaggtgggaatacttcgtttgatgtggtattcctggccagagttgtgggcaacgttgagaatactttgtttattaatacctctaatcacggagtttttacatatcaggtgttcggggttggagtgcccaacccgtataggctccggccgttcctcggagcgcgagttccagtgaatagctccttctcacccataattaatattcataatcctcactccgaacctttgcaggtggtagaaatgtactcatccggcggtgatttgcacttagaactcccgacggggcagcagggcggaacaagaaagctgtgggagatcccaccatatgagactaaaggcgttatgcgtgcttctttttcatctcgcgaggcggataaccataccgccttcattagaatcaagactaacgcctctgatagtactgagttcattattcttcccgtggaagtcgaggtcactacagcaccgggcatctacagctccactgagatgctggactttggcaccttacggactcaagatctgcctaaagtgctgaacttgcacctcctgaactctggtaccaaagatgtcccaatcacatcagtgcgacccactccacagaacgacgcgatcacagtccactttaagcccattacgttgaaggccagcgaaagtaaatacaccaaagttgcttcaatctcgttcgatgcatcaaaggcaaagaaaccgtcacagtttagcggcaaaatcaccgtgaaggccaaggagaagtcctactcaaagctcgagataccttatcaggccgaggtgttggacggatatctgggatttgaccacgccgcaacgctgttccatatcagagactctccagctgatccagtcgaacgcccaatctacctgacaaacacttttagctttgcaattcttatacacgacgttctcctgccggaggaagctaaaaccatgttcaaggtccacaattttagcaagcccgtactcattctgcccaatgagagtggttatatctttaccctgctgtttatgccatccacttcttccatgcacatagacaataatatcctcctgataacaaacgctagcaaattccacctgcctgtgagagtgtacacagggttcctggactactttgtgctgccgcctaaaatcgaagagagattcattgacttcggtgtcctgtccgccacagaagcctcaaacatcctatttgcgatcatcaactccaacccaattgaactagccatcaaatcatggcatattattggagatggactgagcatcgagctcgtggccgttgaacgtggcaatcggacgacaattatctccagccttcccgaattcgaaaagtcgagcttgagtgaccagtcgtcagtgacgctggcttctggatacttcgcggtattccgggtgaaactgaccgctaagaagctcgagggcattcacgacggagccattcagatcacaaccgactatgaaatcttgactattccagtcaaagctgtgattgccgtgggaagtcttacctgtttccccaagcacgtcgtgctgcccccgtctttcccagggaagatagtccaccagtcgttgaatatcatgaatagctttagccaaaaagtgaaaatacagcagatacggtctctcagcgaagacgtcagattttactataagcgtctgcggggaaataaggaagacctggagcctggcaaaaaatcaaagatcgctaacatatacttcgaccctggattgcagtgtggcgatcactgctacgtcggtttaccctttctaagcaagagcgagcccaaggtccagccaggggttgcaatgcaggaggacatgtgggacgccgactgggatctacaccagtccctcttcaaggggtggactggtatcaaagagaacagtggtcacagattgtctgctatattcgaagtcaacactgacttgcagaagaatattatcagcaaaataaccgctgagctgtcgtggcccagtatcttatcatcaccgcggcacctcaaatttccgctgaccaacaccaattgcagctcagaggaggagatcaccctggaaaaccccgcagacgtgccagtctacgtacagttcatcccactggcgctgtatagcaacccctcggttttcgttgacaaactagtcagtcgcttcaacttgagtaaagtggccaaaatcgatctaaggactctggagttccaagtgtttaggaactctgctcaccccctgcagagcagtactggattcatggagggcctatccaggcacctgattctaaacctgatcctgaagcctggtgagaaaaagtcagtgaaagtgaagttcacccccgtccataataggaccgtttcttctctaattatcgtaagaaacaatctgactgtgatggacgctgttatggtgcaaggccagggtaccaccgaaaatcttcgcgtggctggcaagttaccagggcccggttcaagtcttcgatttaagatcacagaggctctactcaaagattgcactgattccctaaagcttagagaacctaattttacgctgaaacgtacctttaaagtggagaacaccggccaactccagatccatatcgaaacaattgaaatctccggatatagctgcgaaggttacggtttcaaggtggtcaactgccaggagttcaccctcagtgccaatgcttcccgtgacataatcatcctgtttacccccgattttaccgccagcagagtaatccgagagcttaagttcattacgacttctggttcagagttcgtcttcatactcaacgcgagtctgccatatcacatgctcgctacatgtgccgaagccctccctagacccaattgggagctcgccctgtatatcataatcagcggcattatgagtgccctatttctactcgtgatcggtacggcgtacctagaggcccaggggatatgggagccattccggcgcaggttgtcatttgaggccagcaaccctccctttgacgtggggagaccttttgatcttagaagaatcgtaggtataagctcagaggggaatctaaacacacttagttgtgaccctggccacagtcgcggcttctgcggagctggaggctcatcctcacgccctagcgcggggtcacacaaacaatgcgggccttctgtccatccccattcttctcacagtaatagaaactcagctgatgtggagaatgtgcgggctaaaaactcctccagtaccagtagtagaacatctgcccaggcagcttcttcacagagcgccaacaagacaagccccctggtcctagacagcaacacagttacacagggtcacaccgccggcaggaagtcgaaaggtgccaaacagtcccagcacggctcacagcaccatgctcatagtccactggagcagcacccacagccacccctgccacctcccgtcccgcagccccaggagcctcaacctgagcggctcagtccagccccactcgctcatcccagccaccccgagagggcatccagcgcaaggcacagcagcgaagattcagatataaccagtctgatcgaagccatggacaaagacttcgaccatcatgacagccctgcccttgaggttttcactgagcagccgcctagccccctgccaaagagcaaggggaaagggaaacctctacagcgaaaagtgaaacctcccaaaaaacaggaagagaaagagaagaaagggaagggcaaaccccaggaggatgaactcaaggattcgctcgctgacgatgatagttcctctacaactacagagaccagcaacccagataccgaacctttgctgaaagaggacacagaaaaacagaagggaaaacaagctatgcctgagaagcatgaatcagaaatgtcccaagttaaacaaaaaagcaaaaagctgctgaatatcaaaaaggaaatccctactgacgtgaagccctcctctctcgagctgccatatacaccacctctcgagtcaaaacagcgacggaatctaccctcgaaaattcccctccccactgccatgacttcagggtccaagagcaggaacgcccaaaagaccaagggcacctccaaattggtggataacaggcccccagccctcgccaagttccttccgaacagccaggaattggggaacacctccagcagcgagggtgaaaaggacagtccaccccctgaatgggacagcgtgcccgtacataagcccgggtcctccacagacagtctgtacaaactgagcctgcagaccctaaacgctgatattttccttaagcagcgccagacttccccaaccccagccagccctagcccccctgccgcaccttgtcccttcgttgctcgcgggtcctatagtagcattgtcaattcttcatcctctagtgatcctaaaatcaagcaacctaatggctcgaagcataaactgaccaaagctgcatctctaccaggaaaaaatggcaatcccaccttcgcagcagtcaccgcaggctatgacaagagtcccgggggaaatggatttgccaaagtgagctccaataaaactggcttttcctcaagcctaggaatctctcacgcccccgtggattctgacggctctgactcaagtggcctctggtcgccggttagcaacccttctagtcccgatttcaccccactcaattcattcagtgccttcgggaacagttttaatctcactggagaggtgtttagcaaattaggcctgagtaggagttgcaatcaggcatcccagcggtcctggaatgaatttaattccgggccctcttacctatgggaatcccccgcaacggatccatctccatcgtggcctgcatcctcagggtcacccacccacacagcaacttccgtgttaggcaacacctccggtctgtggtccaccactcctttttctagctctatttggagcagtaatctctccagcgccttgcctttcacgaccccggcgaatacattggcctctatcggacttatgggtacggaaaacagccctgcaccacatgcgccctccacaagttctcctgcagatgacctgggccagacctacaatccctggcggatctggagccctaccattgggcgccgtagcagcgatccatggagtaactctcacttcccacacgaaaactag

SEQ ID NO: 31197 - DNA, 999 bp, Artificial Sequence
  Description of Artificial Sequence: Synthetic coding sequence
tagggactgctgggcgcactgcatctcgtgatgacattggtggtcgcagccgctagggctgaaaaggaggccttcgtacagtccgaaagcatcatcgaagtactccgattcgacgacgggggcctgttacagaccgagacgaccttagggctgtcctcataccagcaaaagagcattagcctatatcgcggcaattgccggcccatccgatttgagcccccaatgctagatttccatgaacagcctgtgggcatgccaaaaatggaaaaagtttacctccacaaccctagtagcgaggagactataacactcgtgtccattagcgccacaacctcccatttccacgcatcgttctttcagaacagaaaaattcttcccggcggaaatacctccttcgatgttgtcttcttagcaagggtggttggaaacgtggagaacacccttttcatcaacacgtcaaatcacggagtcttcacttatcaggtgtttggggttggggtgcccaacccttatcgacttcggccctttctcggtgcacgagtacctgtgaattcgagcttttctcccatcatcaacattcacaacccccactctgaacctctgcaagtggtggagatgtattcgagtggtggcgacctacatctcgagttgcccaccggacagcagggcgggacacggaaactgtgggaaattcccccctatgaaactaagggcgtaatgcgggccagttttagcagccgggaagctgacaatcacactgcctttatacggattaagaccaatgcatctgactcaacagagttcatcattcttcctgtggaggtagaagtgactactgcccctggtatatactcctccacagaaatgttggacttcggcactttgaggacgcaggatctgcccaaggtcctcaacttacatctcttgaactctggcaccaaggacgtccccatcacacataggcgtcagaaaagccacctgtcttttctcggcaagtag

SEQ ID NO: 31198 - DNA, 969 bp, Artificial Sequence
  Description of Artificial Sequence: Synthetic coding sequence
atgacgctggttgtcgccgccgcacgcgccgaaaaggaagccttcgttcaatctgagagcatcatcgaagtgctccggttcgatgacggaggactgctgcagacagagacaacgttaggcctgagtagctaccaacagaagagcatctccttatacagggggaattgccggccgatccgcttcgaaccgccaatgttagacttccatgagcagcctgtggggatgcctaaaatggaaaaggtatatttgcataatccaagcagcgaggaaactatcacgctggtgtccatttctgccacaaccagccacttccatgccagcttttttcaaaatcgcaaaattctgcccggcgggaacacatccttcgacgtggtcttcttggccagggtggtgggaaacgtggagaataccttatttattaataccagcaatcacggcgtattcacatatcaggtgttcggcgtgggcgtcccaaatccatacaggctacgtccatttctgggcgctagagtgccagttaactcttccttcagcccgatcattaacatccataacccccattcggagccattacaggtggttgaaatgtattcaagcggtggggacttgcatttggagctccccacgggacaacaggggggcacacgaaaactgtgggaaatcccaccatacgagactaagggagtgatgagagcctcattttcgtcacgtgaggctgacaatcataccgccttcattcgaatcaaaaccaatgcgtccgacagcaccgagtttataatcctgccagtcgaggtggaagtgaccacagcaccaggcatctattcgagcacagaaatgctggattttggcactctccgcacgcaggatttgccgaaggtccttaacctccacctattgaactcggggaccaaggacgtccctataactcatcgtaggcagaagtcacatctgagctttctaggcaagtag

SEQ ID NO: 31199 - DNA, 3237 bp, Artificial Sequence
  Description of Artificial Sequence: Synthetic coding sequence
atgttcggcgcagcgtcaagaatggatacaactgccgtgtgcacaggtggggtgaccgaatcccgcggaatcgtcgacagtctgcagaagttctccagcttgccggcgtacttgccgactaatttgcatataagcaatgccgaagaatcttttttcctgaaagaggccaaccaagacctgaccaggaattccagcttacaggctcgggtggagccgttcttcatctatcgggcccgaacacctcctattattaatgcgagctacggccctttttccgtggagaagatcatccctcaggaactgctgcttacttcgacagccttcggtaatatggataaatttcccttcaactggaagttgaaatctcatatccttgactcatctatctactccaacagacctaaagttcaaaccctgttctacgtcaccgggatgggttgggatgactcagacttgacagaggacctcccatgcgttaagatgttcgcttttcccgaagcaagagaagtggcggcttcatgcagactgcagggagcccccggactctgcgtggccgagctagaattactccctgagtggttcagtagtggactggaccttgaacccgaagaggagattccggctctgttgggcggaacgaccatggagctgttctttacactctatccagctgacaaggcgggacaatgccctttggaggaagagggtaaatgggaaaataacattcactccggcctagagtcccctcaacaggccttccccgctagagaaaggataggtagtgttgtcgtgtatcccactcaagacgacctgaaatggtcgttagtttctctagacgagaatgtggtcatttccgttcccttgaacctggtgcgggaaggcgacaccgccacctttttggtatctctgaccagctcctctgttgctgatcagtttaccttacggattaaggcggccgcaggtgtgaagatcacggcagtgagagtcagctctgaggatcagtgggccgtgcaggaggagatcgacaacgggtccacccagacatcagccacattgacatgtatgggacataggccagacacacagagtcgagtgaatggaagcttttatgaaatcctgcaggtggactttggcatagacaattcctcagatttggccggagcacagcagatcacctggcaagtagagtatccaatcgaggactccatgtccgaactggtggtaagcgagatttttgtcagtcagaccacctttgtggggattgtacctttggctatggatactgaagtgttgaacaccgccattctgacaggtaaaccggtgtcggtaccagtgaaagtggtcggggttcaggaagacggctcagtggttgacgttagcgaaagtgtcgagtgcaagtccgccgatgaggacgtcataaaggtctcaaacaactgtgacagtatatttgttaatggaaaggagatgaagtcaaaggtggatacaatcgtaaatttcactcatcagcactttacatctcagtttgaagtgacggtctgggccccgcggctgccgcttcagattgagatttctgataccgagttgagtcagataaaaggatggagaatacccgtcgcggctaacaggaggcccactagggagtccgatgacgaggacgacgaagagaagaagggacgtggttgcagtttacagtatcagcacgccacagtgcgcgtattgacccagtttgtggcagaaagcccagacctgggacagcttacgtacatgctggggccagattggcaattcgacataacagatcttgtgacagaattcatgaaggtggaagaacctaagatcgcacagcttcaggacggtaggacgctggcaggacgggaaccaggaatcactacagtgcaggtactctctcctttgtctgactccatcttggccgagaaaactgtgatcgtgcttgacgatcgcgtgacgatcgctgaattaggcgtccaactggtggccgggatgagtctctccctgcaacctcatcgggccgataagcgagccatcgtgagcaccgctgccgcactcgatgtactccagagccctcagcaagaggccatcgtatcctcttggatcttgttcagtgacggctcagtcacacctctagatatttacgacccgaaggactatagtgtgacggtgagttccttagacgaaatggtggtgtcagtacaggcaaaccttgagagtaaatggcccatcgtcgtggctgagggcgaaggtcagggccccttaattaagctggaaatgatgattagtgagccgtgtcaaaaaacaaagcggaagagtgtgttagctgttgggaaggggaatgtcaaagtgaagttcgagccaagcagtgacgagcaccaggggggttctaatgatatagaagggatcaaccgcgagtacaaagatcacttgtccaactccatcgagcgcgagggaaatcaggagcgcgcagtacaggaatggtttcatagaggaacacccgtgggccaagaagaaagcacaaataagagcacaactccccagagtcccatggaaggtaaaaacaagttactgaaatccggcggccctgacgccttcacctcgttcccaacccaggggaagagtccagacccaaataacccgagtgatttaacagtgacgtcacgcgggttaactgacctcgagattgggatgtacgctctgctttgtgttttttgtctcgccattctggtcttccttatcaattgtgtcgcattcgcatggaagtatcgccataagcgctttgcagtttcggaacagggaaacatccctcacagtcatgactgggtgtggttaggcaatgaagtggaactattagagaaccccgtggacatcacacttccatccgaagaatgcaccactatgatagacagaggactccaattcgaggagaggaacttcctgctcaacgggagctcccagaagacctttcacagccagctgctgcggccctctgattatgtgtacgagaaagaaattaagaatgaacctatgaatagtagcggccccaaacggaaacgggttaagtttacaagctacacaacaattttgcctgaggatgggggcccttacacaaacagtattctctttgacagtgatgacaacattaaatgggtgtgccaggatatgggacttggcgactcacaagatttcagggattacatggagtcgcttcaggatcagatgtag

SEQ ID NO: 31200 - DNA, 3327 bp, Artificial Sequence
  Description of Artificial Sequence: Synthetic coding sequence
atgcgaagcgagggggctgcccccgggcccgccgcccccctttgtggcgcgctttccctgctgttgggcgcgttactggggaaggttatcgaaggccatggcgtgaccgataatatccagcggtttagtagcctgccaccctacttaccagtgagctaccacatccttagggctgagaccagttttttcctgaaagaggctaaccaggacctgttgcgcaattcatcattacaggccagagtggaaagctttttcacatacaagacaagacagcctccggtcttaaacgcaagttatggtcctttttctgttgagaaagttgtgccattggatctgatgttgacctcaaatttcctgggcccaacgaacaagttttcctttgactggaagttgaaggcccatattcttcgagacaaggtgtacctgagccggcctaaggtacaggtgttgttccacataatgggtagggactgggatgatcatggcgctggtgaaaaactgccatgcttaagggtattcgcttttcgggaaacacgcgaggtgcgtggcagttgcagattaaaaggcgatttgggactttgcgtggccgagttagaactgctgtcatcctggttctcagcacccacagtgggcgcgggacgaaaaaaaagcatggatcagccagagggtacaccagtggaattgtactacaccgtccatccagggaacgaacggggagattgcgccggcggagattttcggaaaggaaatgccatccgccctggaaaagacggactcgaggaaacaacttcacatttacagcgaatcgggacagttggcctgtatagggcccaggattctgcccagctgagtgaacttcgattggacgggaacgtggtcatatggctgcccagccgaccagtgaagcaaggagaggtggttaccgcatatgtgactatctcatctaactctagcgtggatttattcatcctccgggccaaagtaaagaaaggagtgaacattctcagtgcccaaaccagggagccccgtcaatggggtgtgaaacaagaagttggaagtggcggcaagcatgtaacagccacagtagcctgccagaggctgggcccaagtccccggaacaggtccagtagtctcttcaacgaggttgtgcaaatgaacttcgagatcgcctccttctcaagtctatcagggacccagcctatcacatggcaggttgagtaccctcgaaagggaaccacggacattgctgtatcagagatatttgtgtctcagaaagatctggtcggcatcgtgcctctcgccatggacacagaaatcttgaatacagctgttctgactgggaaaactgtggcgatgccaatcaaagtcgtctcggttgaggaaaatagtgctgttatggacatttctgagagcgtggaatgcaagagcactgacgaggatgtcattaaggtctccgaaaggtgcgactacatatttgtcaatggcaaggagataaagggcaaaatggacgccgtggtaaattttacttatcagtacttaagcgcacctttgtgcgtgaccgtgtgggtgcctaggctgccactgcagattgaagtttctgatacagaactctcacagattaaagggtggcgagttcctattgtgaccaataaacggcctacccgggagagtgaggatgaggacgaagaggagaggcggggtagggggtgtgcactgcaataccagcacgccaccgtcagggtcttaactcagttcgtctccgagggcgccggaccatggggccagccgaactatctgctttccccaaattggcagttcgatatcacccatctggtggctgactttatgaagcttgaggagccccacgtagcaaccctgcaggatagcagggttctggtggggcgcgaagttgggatgaccacaattcaggttttgtctcctctgtctgacagtattctggcagagaaaacgattaccgtgctggacgacaaggtcagtgtgacggaccttgccatacagttggtggccggcctgagcgtggcactgtatcctaacgctgaaaattctaaggccgtcaccgcagtggtgaccgcagaagaagtcctaagaactccgaaacaggaggcggtgttcagcacctggttacagttctccgatggttccgtcactcctttagatatctatgacaccaaggatttcagcctggcagctacatcacaggacgaggccgtcgtgtcggtgccgcagcccaggagcccacggtggcctgtagtcgtcgctgaaggtgagggccagggtcctcttatacgcgtggacatgaccatcgcggaggcctgtcaaaaatcaaaacgtaagtccattctggcggtgggcgttgggaatgttcgcgttaagttcggacagaacgacgcagattcaagtcccgggggagattacgaggaagatgagataaaaaaccatgccagcgatcggcggcaaaaggggcagcaccatgaaagaacagggcaggacggacacctctatggatcaagcccggtggaacgcgaggagggtgcgctcagacgtgctaccacaactgcaaggagtctcctggacaacaaagtcgtcaagaactcccgagctgatggagggcggttggctggcgaagggcagctgcaaaacatacccattgactttaccaattttcccgctcacgtcgaccttccaaaggctggctctggactcgaagagaatgatctcgtgcagactccacgaggccttagcgatttagagatcggaatgtacgccctgctcggcgtattctgtctagccatattggtgtttctgatcaactgcgccactttcgcgcttaaataccgacacaaacaggtcccactcgagggccaggcctcgatgactcattctcacgactgggtctggctaggtaacgaggccgaactgctggagtctatgggcgatgcccctccaccgcaggatgaacataccactatcatcgaccggggacccggtgcctgtgaggaatccaatcacctgctcctcaatggtggctctcataaacacgtccagagccaaatacatcgctcagctgactccgggggcagacaagggcgcgagcaaaaacaggacccgctacacagtcctacgagcaagcggaagaaagtgaagttcaccacattcactaccatacctcccgacgactcctgccctaccgtcaactctattgtgagtagcaacgatgaggacataaaatgggtatgccaggatgtggctgtgggcgcaccaaaagaactccggaattacctggaaaagcttaaggataaagcatag

SEQ ID NO: 31201 - DNA, 1914 bp, Artificial Sequence
  Description of Artificial Sequence: Synthetic coding sequence
atgcagcgcgacgaaagctccccctttcccccgctcttcagcctgacctcatctcaggtctctgacaggtgcgattatgttttcgtgaacgggaaagagatgaagggcaaagtgaacgtggtggtgaactttacttatcagcacctgtcatcaccactggagatgacagtgtgggtgccgaggctcccattgcagatcgaggtgagcgataccgagctgaatcaaataaagggatggcgcgtcccaattgtgagctctcggaggcctgctggggactcagaagaagaggaagacgatgagagacgggggcgaggatgtacgcttcagtatcagcatgccatggtgcgagtcctaacacagtttgtcgccgaggcagccggacctggcggtcatttagcccacctgctgggatccgactggcaggtcgatattactgaattaattaatgattttatgcaagtggaggagcccagaatcgctaaactgcaaggcggccagatcctcatgggacaggagctgggaatgacaaccattcaaatcctttctcctttgtcggacacaattctggctgagaaaacaataacagttctagacgagaaagtgactattacggatttgggcgtacagctcgtaactggcttatcactgtcactgcaactgtcaccgggatcaaatagagccatcttcgctactgcggtggctcaggaactgcttcagaggcccaaacaggaggcagccatctcatgttgggtccaattttcagatggatcagttaccccacttgacatctacgatggaaaggacttctcactcatggcaacttcactagatgagaaggtcgtgagtatccaccaggacccaaagttcaaatggcctataatcgccgccgagacagaaggtcagggaacgctggtgaaagtggagatggtgatttcagaaagctgccagaagagcaaacggaaaagcgtgttggccgtaggcaccgctaacattaaggtgaaatttgggcagaacgacgctaaccccaacaccagcgacagcaggcatactggggccggtgtgcatatggagaataacgtgagtgatcgcaggcctaagaagccatcccaagagtggggatctcaggagggtcagtactatggatcgagctcaatggggctgatggagggccgaggcacaacaaccgacaggtctatccttcagaagaagaaggggcaagaatcactgctggacgacaacagtcaccttcagaccatccccagcgacctgactagtttcccggctcaggtggacctgccccgcagcaatggcgagatggacggcaatgatcttatgcaggcctcaaaaggcctgagcgacctggagattggcatgtatgcattgctcggcgttttttgtcttgcaatactggtttttctgatcaactgtgttaccttcgcactgaagtatcggcacaagcaagtgcctttcgaggagcaggaagggatgtctcacagccacgattgggtgggactgagtaacagaacagagctgttggagaatcatatcaacttcgcttcttctcaggacgaacagatcacagctattgatcggggaatggactttgaggagagtaaatatctcctttcaacgaactcccagaaatctataaatggacaactgttcaagcccctggggcctatcattatagatggtaaagatcagaaatcggaaccaccgacctctccaacctccaagagaaagcgcgtgaaatttactacctttactgccgtctcctcggatgacgagtaccccacgcgtaacagcatagtcatgagttctgaggatgacattaagtgggtctgtcaggacctggaccctggggattgtaaggaactgcataattatatggagagactacacgaaaatgtatag

SEQ ID NO: 31202 - DNA, 3300 bp, Artificial Sequence
  Description of Artificial Sequence: Synthetic coding sequence
atgtgcccatcagaaatgggaacactgtggcatcattggagtcctgtcttaatcagtctggcagctctgtttagtaaggttaccgagggcagggggattttggagtctattcagaggttctcactattgccaacctatctaccggtcacctaccatattaacaatgcagatgtgtccttttttctcaaggaagccaatcaagacatcatgcgtaactccagtctgcagtcgagggttgagtcttttcttatctataaatctagacggctgccagtgctcaatgcctcttacggacccttttctatcgagcaggttgtaccacaggatctgatgcttccaagcaatccatttggattcaccaacaaatttagcctcaattggaagttgaaagctcacattctcagggacaaagtctacctctcccgcccaaaggtgcaggtgctttttcatataatgggccgcgattgggatgaccggtctgctggtgaaaagctgccatgcctgcgggtcttcgcttttcgagaaactagggaagtcagaggttcctgtcggcttcagggcgatctgggactttgcgtcgccgaacttgagctgctgtctagctggttctccccccctacagtggttgccgggcggcgcaagtctgtggaccagccggaggggacacccgtggaactgtactatacagtgcaccctggcggcgagcgcggcgactgcgtgagggaagacgcgcgccgctccaatggtatccgcacgggccattctgacatcgacgaatcaggccctccgctccagaggatcggttccatcttcctgtatcaaacccaccgcaagccatctctgagagaactgcgactggataattctgtcgcgatccactatattcctaagactgtcagaaagggcgacgtactgacattccccgtctcgataagccggaattctacagaagaccgctttacactgcgcgctaaagtaaagaagggcgtgaacattataggtgtgagggcctcctcaccctccatctgggacgtcaaggaacggactgactataccggtaaatacgccccagccgtcatcgtgtgtcaaaagaaagcggcagggtccgagaattctgctgacggagcgagttatgaagttatgcagattgatgtcgaggtggaagaacccggagatctccctgcaactcagcttgtgacctggcaggtggagtatcccggcgaaataacttctgatctgggcgtgtcaaaaatttatgtgagccctaaagatctaatcggcgtggtgcccctggccatggaggcagagattctcaacaccgcgatactgaccggaaagactgtcgccgtgcccgtgaaagtggttagtgtggaggatgatggaactgtcacagagttgctggaatcagtagagtgtagaagttcagatgaggatgttattaaggtgagtgacagatgcgactatgttttcgtgaatgggaaagagatgaaaggcaaggtgaacgtggtcgtgaattttacttatcagcacctgtcaagccctctcgaaatgaccgtctgggtgccacgcctgcccctgcagatcgaagttagcgataccgagctgaatcaaattaagggttggagagtgccaatcgtctctagcagaagacctgccggtgactctgaagaagaggaggatgacgagaggcgcggccgcggatgtactcttcagtaccagcatgctatggtccgggtgcttacccagttcgtggctgaggccgccggcccgggtgggcatctggctcaccttctgggctccgactggcaggtggacatcaccgagctcataaacgacttcatgcaggttgaggaacccaggatcgctaagttgcagggcgggcagattttaatggggcaagagttgggaatgaccacaatacagattcttagcccgctatctgatactatcctggcagaaaagacaattacagtactggatgagaaagtgaccattaccgacctcggggtccagttggtgaccggcctaagcctctctctgcagttgtcccctgggagcaaccgggccatcttcgccacagcagtcgcccaggaactgcttcagagaccgaaacaggaggcagccatctcttgctgggtgcagttttccgatggctcggtcacacccttggatatttatgatggtaaggacttctccctcatggccacctccttggacgaaaaagtcgtatctattcaccaggatccaaagttcaagtggcctatcatcgccgcagaaactgaaggtcaaggtaccctggtcaaggtggaaatggtaatcagtgagtcttgtcagaaatctaagaggaaatcggtgttggccgtcgggacagctaacatcaaagtgaagttcggacagaatgatgcaaatccaaacacgtccgactccaggcatacgggcgcaggcgtccacatggagaataatgtgagcgacagacggcccaagaagccttcacaggaatgggggtcccaagagggccagtattacggttccagttccatgggcctgatggagggaaggggaacaacgaccgatagatctatcttgcaaaagaagaagggtcaggagagcctactggacgacaactcgcatctccaaactataccctccgacctgacttcttttcccgcccaagtcgacctgcctagaagcaacggtgagatggatgggaatgacttaatgcaggccagtaaaggtctgtctgatctggaaatcggcatgtacgcgctgctgggcgtgttttgtctggctatacttgtgtttctcattaattgcgtgaccttcgctctcaaataccggcacaagcaggtgccctttgaagagcaagagggcatgtcgcatagccacgattgggtgggcctctccaaccgaacagaactcctggagaatcacataaacttcgcctcttcccaggacgagcaaataacagccatcgatcggggcatggatttcgaagagtcaaagtaccttctgtctacaaacagccaaaagagtataaatgggcagttgtttaagcccctggggccgataataatcgacggtaaggaccaaaagtctgagccacctacgagcccaacctcaaaacgcaagcgggttaaatttactaccttcaccgcagtcagttctgacgatgaataccctacccggaattccatagttatgagctctgaggacgacataaaatgggtatgtcaggatctcgaccccggcgactgcaaggagctccataattatatggagcgcctgcatgagaatgtgtag

SEQ ID NO: 31203 - DNA, 2955 bp, Artificial Sequence
  Description of Artificial Sequence: Synthetic coding sequence
atggcgccaggaatgtctggtagaggcggagctgctctactgtgcttgagcgcgctactagcccatgcatctggccggtcccatccagctagcccatctccacccggtccccaagcttctcctgtcctgccagttagctatcgtttaagccacacacgtctggcctttttcttacgggaggcacgacccccgtctcccgccgtggcaaactcctcgctccagcgaagtgaaccctttgtggtctttcaaacaaaggagttgcccgtgttaaatgtgagtctcggccccttttcgacgagtcaggtcgttgccagggagttgctgcagccctcatctacactggacatccctgagcgacttacggtcaattggaaggttcgggcctttattgtccgtagtcacgttcccgccagtcaacccgttgttcaggtgctcttctacgttgctggtcgggattgggacgattttggcgtcacagaaagactcccctgtgtgcgcctgcacgcttttagggatgccagggagcatccccttctgagaattggttcaatctcattatttagaccccctcccagacggaccctacaggaacataggttggacagtaatttaatgattcggctcccagatagaccgcttaagcccggagaagttcttagcattctcctctatcttgcccccaattccagctcaccaagctctcccagtgtagagcactttacccttagggtgaaagccaaaaagggcgtgaccctgctgggtacaaaaagccggtcagggcagtggcacgtgacatccgagcttttgaccggggccaaacactctaccgctactgtcgacgtggcatgggcccagtctacgcccctgccaccgcgggaaggccagggcccgctagaaattctacaactggatttcgagatggaaaatttcacctcccaatccgtaaagcgaagaattatgtggcacatcgactatcgcggacacggcgctctgccggatttagaacgggcggtgaccgagctgactgtgatccagagagacgtgcaggcgatcttgccccttgccatggacacggaaatcattaacacagctatcctaaccggcagaacggtcgcaatcccagttaaggttattgcaatcgaagtgaatggactagtcctcgatatatcagcattagtcgaatgtgagtccgataatgaagacattataaaagtaagcagttcttgtgattacgtcttcgtgagcggaaaagaatcgaggggatcgatgaatgcccgggtgacgttccgttacgatgttctgaatgcgccactggagatgacggtttgggtccctaagttgcccctgcatattgaattatcggacgcacgactctcccaggtgaaagggtggcgcgttccaatcctgccggacaggcgctccgtccgcgagagtgaggatgaagacgaagaagaagaggaaaggcggcagagcgcatcccgcggatgcacactgcaataccagcatgcgacgctgcaggtattcacacagttccacacaactagcagcgagggaactgaccaagttgtgacaatgcttggccccgattggctcgtagaggttacggatctggtgtctgatttcatgagagtgggggatccccgggtggcccatatggtggacagctctacactagccggcttagaaccaggaaccacaccttttaaagtggtctctccactaaccgaggcagtactcggcgagactctgctcaccgttacagaagagaaagtgtctatcacccagcttcaggctcaggtcgtggcaagccttgccttgagtcttcgaccatctcctggatcctcccatactatactggccacaacagcagcccaacaaaccttatctttcttaaagcaggaggctctcctgtctttatggctcagctactccgacggtacgaccgccccattaagtttgtactcccctcgcgactacgggctgctggtaagcagcctggatgagcacgtcgccacagtcacccaagatcgggcattccccctcgttgttgcagaggccgaaggttcaggagaattactacgcgccgaacttacgatagccgagtcctgccaaaagaccaagcggaaatccgtgctcgccacaacaccagtaggacttcgcgtccattttgggagagacgaagaggaccccacttacgactacccgggacctagccagccgggaccgggaggtggggaagacgaagcgcgcggcgccggtcctccaggatcagcactgccggcacccgaggcccctggccccggaaccgctagtcccgtggtgccaccaacagaggactttctcccactgccaacaggctttctacaagttcccagagggctcacagaccttgagatcggaatgtacgctctgctcggcgttttttgtctggcaatcctggtctttctgataaactgtatcgtctttgtactaagataccgccacaagcgaataccacctgagggccaaacctcgatggaccattcccaccactgggtctttctgggaaatggacagcccctgagggttcagggcgaactgtcccctcctgccggtaaccccctggagactgtgccagccttctgccatggcgatcaccactcatcaggaagttcacaaaccagcgtgcagtcccaggtccatggaaggggggacggttcatctgggggctccgctagagaccaggcagaggatcccgcctcatcccctacttcgaagaggaaacgggtaaagttcaccactttcactaccctcccatcagaagaactggcctatgatagcgttcccgctggtgaagaagatgaggaggaagaagaagatctggggtggggttgtcctgatgtggctggccctacccggcctacagctccccccgacctacacaactacatgcgacggatcaaagaaattgcctag

SEQ ID NO: 31204 - DNA, 390 bp, Artificial Sequence
  Description of Artificial Sequence: Synthetic coding sequence
atgacatctcaccactgtgtagggccaggcaaccacattagctggagtgggcacgagaaggaacatcgcctggattactgccccgaagtaacattccccctgaccaaaggcttccctctgggctacacactcttgtttaacttcgcaagctaccccttcctgttaccctccaagattaagactctcctgcgcaacaaagatagtttcctcaatattttgtgccccgcatgcctcctcctcattagaagatgcaatatcgaatactcttcgacaggcctgaacttcctcaatacctttactgttagtctgatcgtaacagtcatcccactgctccagaacgttcctgtgccgctggggaacaacgtcggaaaaatgcaggtttatgagtag

SEQ ID NO: 31205 - DNA, 588 bp, Artificial Sequence
  Description of Artificial Sequence: Synthetic coding sequence
atgtccgcagcccgtccccaattctccatcgatgacgcttttgagctgtcgttagaggacggaggccccggacccgagagctcgggcgtggcaaggtttggaccactgcacttcgagagaagagcccgtttcgaggtcgctgatgaggacaagcagtcccgcctgaggtatcaaaatttggaaaacgacgaggatggtgcccaagcttccccagaacccgacggtggagtaggaacacgtgactccagcaggacctcaatcaggagtagccagtggtcctttagtacaataagctcctccacccaaaggtcttataatacctgctgttcctggactcagcacccactcatacaaaagaatcgccgggtggtgctggcctctttcctccttctgctcctgggcctggtgctcatactggtcggcgtggggttggaagcaactccctccccgggggtgtcttccgccattttcttcgtgccaggatttcttttgctcgttcctggtgtatatcatgtgatctttatctactgcgcggtaaaaggccaccggggcttccagttcttttacctgccatatttcgagaaatag

SEQ ID NO: 31206 - DNA, 543 bp, Artificial Sequence
  Description of Artificial Sequence: Synthetic coding sequence
atgagcgcagctagaccccagttctctattgatgacgcattcgagctgtctctcgaggacggcggcccaggcccagaatcctctggggttgccagatttggacccctccatttcgagaggcgtgcacggttcgaagtagctgacgaggataaacagagccgactgaggtaccagaacctggaaaacgacgaagatggtgcgcaagcctcccccgagccagacggaggtgtcgggacaagggatagttcacggacgagtataagaagctctcagtggtccttctccactatttcctcctccacacaacgaagctacaatacttgttgtagctggacccaacaccctctgatccaaaaaaacagaagggtggttctagcctctttccttttgctactgcttgggctgggggtgagctctgcgatctttttcgttcctgggtttcttctcttggtgcctggagtgtatcacgtcatctttatctactgtgccgtgaagggccacaggggctttcaattcttctacctgccgtacttcgaaaagtag

SEQ ID NO: 31207 - DNA, 1377 bp, Artificial Sequence
  Description of Artificial Sequence: Synthetic coding sequence
atggccgccctgtctaaatctatcccgcacaactgctatgagatcggccacacatggcatcctagttgtagagtgtcattcctccagattaccggcggcgctcttgaagaatcgctcaagatctatgcaccactctatctgattgccgcaatcctacgtaaacggaagctggactactacctgcacaaacttttgcccgaaatcttacagagtgcttctttcctgaccgccaacggcgctttgtacatggccttcttttgcattctgcgcaaaatcctgggcaagttctatagctggacccctggctttggggccgccctgccggcatcttatgtggccatcttaattgagaggaaatcgcgcaggggcctgttgactatctacatggcaaatctcgcaactgaaacattattccgcatgggagttgctaggggaacaataacaactctgcggaacggagaagtcctgcttttttgtataaccgcagccatgtatatgtttttctttcgctgcaaggacgggttaaaaggtttcacattctctgctctgcgttttatcgttgggaaggaagaaatccctacccacagttttagtcctgaagccgcctacgccaaggtggagcagaagagggagcaacatgaagaaaagcccggaaggatgaatatgattggtctggttagaaagtttgtggattccatctgcaaacacggccctcggcatcggtgctgcaagcactatgaggacaactgcatttcttactgtatcaaggggtttattaggatgttttctgtcggttacctgatccagtgctgcctgcgaatcccttcagcgtttaggcatctgttcactcagccttctcggctgctgagtctcttttataataaagagaactttcagctcggggccttcctggggtcttttgtatccatttacaaaggaacgagttgtttcctgcggtggattcgcaacctggatgatgaactgcacgcaatcatagctggttttctcgccggtataagtatgatgttctacaagtcaacaactattagtatgtacctcgcaagtaaactcgtcgagactatgtatttcaagggcatcgaagccggaaaggtcccctatttcccgcacgctgacaccatcatctattcaatctcaaccgccatctgtttccaggccgccgtgatggaggtacaaaccttaaggccctcctattggaaattcctactgcgcttaacaaaggggaagtttgccgtaatgaacaggaaggtgctagatgtgttcggaacaggtgctagtaaacatttccaggactttatcccccgcctggatcccagatataccaccgtgactcccgagctgccaactgagttcagttag

SEQ ID NO: 31208 - DNA, 1311 bp, Artificial Sequence
  Description of Artificial Sequence: Synthetic coding sequence
atggctgccctgtctaagtctataccccacaattgctacgaaattggccacacatggcacccctcctgtagggtaagtttcctccagatcacaggtggagccctggaggagtcgcttaagatctacgccccgttgtatctcatagctgccattctgcggaaacgaaagctggattactacttgcacaagcttctgcccgaaatcttgcagtccgcctcctttttgaccgcgaacggggccttgtatatggccttcttttgcattctgaggaaaatcctggggaagttctatagttggactccagggttcggtgcagcactgccggcatcttatgttgccattcttatcgaaaggaaatctcgtcgcggcctgctgaccatatatatggccaatctggttctgcttttttgtattactgccgcaatgtacatgttcttctttcgttgcaaggatggtctaaaaggcttcaccttctccgctttgcgctttattgttggtaaagaagagatccctacccatagcttctccccggaagcagcttacgccaaggtggagcagaagagggagcaacacgaagaaaagcctggaaggatgaacatgatcggactggtccgcaaatttgtcgactctatctgcaaacatgggcctagacatcggtgctgtaaacactacgaagacaattgtatctcttattgtatcaaagggttcatccgaatgttctctgtcggctatctgatccagtgctgtctccgaatcccctcagcttttcggcatctttttacccagccaagccggttactgtctttgttctataacaaagagaactttcagcttggggctttcctgggctccttcgtgtctatctacaaaggcacatcctgtttcttaaggtggattcgcaatctggatgacgagctccatgccatcattgcgggattcctggccggcatctccatgatgttttacaagtccactacaattagcatgtacctagcttctaaactggtggagaccatgtacttcaaaggtatcgaggctggaaaagtaccatacttcccacacgccgacacgattatctatagtatatccaccgccatttgcttccaagcagcagttatggaggtgcagactctgaggcccagttactggaaattcttgctgcgactcaccaagggcaaattcgctgtcatgaatcgaaaggtgctggatgtatttggcaccggcgcttcgaagcactttcaggattttatcccccgattagaccccagatacactaccgtgacacctgaactgccgaccgagttctcgtag

SEQ ID NO: 31209 - DNA, 483 bp, Artificial Sequence
  Description of Artificial Sequence: Synthetic coding sequence
atggcagctcttagcaagtccatccctcataactgctatgagatcggtcacacatggcacccttcctgtagggtatcgtttctgcagatcacgggaggagccctcgaggagagccttaagatttacgcccccctctacctgatcgccgccatccttaggaaaaggaagttggactactacttacataagctactgccagagatcctgcagtcagccagcttcctaaccgctaatggagcactgtatatggcgtttttctgtattcttcgcaaaatcctgggaaagttttacagttggactccagggtttggcgcagcgctccctgccagctatgtggcgatccttatcgagcgcaagtcaaggcgagggctactcaccatttacatggctaacttaatggagagtcattgcctgccccaagccggagtcatctctgccccctgctcactctgcctgcccggttcgcgcgactcccctgcttag

SEQ ID NO: 31210 - DNA, 960 bp, Artificial Sequence
  Description of Artificial Sequence: Synthetic coding sequence
atgggcgttgcacggggaacaatcaccacactgcgtaatggagaagtgctgctgttttgtatcaccgccgcaatgtatatgttcttctttaggtgcaaggacggattgaaaggttttaccttcagcgctcttaggttcatcgtggggaaggaggagatccctacccatagtttcagcccagaagcagcctatgccaaagttgaacagaaacgcgaacagcacgaggagaagccaggtaggatgaatatgattgggctagtgcgaaagtttgtggactcaatctgcaaacatggccctaggcaccggtgctgcaagcattacgaggacaactgtatcagctactgcattaaaggattcattaggatgttttcagtgggttacctcatacagtgttgtttgagaatcccaagcgcgtttaggcacctttttacccagcccagcaggctgctgtccttgttttacaataaggaaaatttccaattaggtgctttccttggctcctttgtgtcaatctataagggaacatcttgcttcctgagatggattaggaacttggacgatgaattacacgcgataattgccggctttctggcggggatcagtatgatgttctataagtctactaccatctccatgtacctggcatctaaactcgtggaaaccatgtatttcaaagggattgaggcgggcaaagtgccgtattttcctcatgctgataccattatctactctatctctacagccatctgtttccaggccgctgtgatggaggtacagacactacgacctagttactggaaatttttgctgcgactgactaagggtaaatttgccgtcatgaatcgtaaggttctcgatgtctttgggaccggggcaagtaaacacttccaggactttatcccgcgcctcgatccaagatatacgacagtgacccccgagctacctactgagttttcttag

SEQ ID NO: 31211 - DNA, 888 bp, Artificial Sequence
  Description of Artificial Sequence: Synthetic coding sequence
atgtatatgttttttttcaggtgtaaggatggtcttaagggcttcactttctcggccctccgctttatcgtgggcaaggaagagataccgacacacagcttttcaccagaggccgcctacgcaaaggtggagcagaagagagagcagcacgaagagaaacccggacggatgaacatgattggactggtgcgaaaattcgtagattccatttgtaagcacggcccccgccaccgctgttgtaagcactacgaggacaattgtataagctactgtattaagggcttcatccgcatgttttctgtaggatatctgattcagtgttgccttaggatcccttctgctttcagacatctgttcacccagccatccagactcctgtccctattctacaataaagaaaacttccagctcggtgcttttttgggctccttcgtgagcatctacaaaggaacatcgtgttttctcagatggataaggaacttagacgatgagttgcacgctatcatcgccgggtttttagccggaattagcatgatgttctacaagagcacaacaatctcgatgtacctcgcttccaaactggtcgaaaccatgtacttcaagggaatagaagctggaaaggtgccctattttcctcacgctgatacaataatatattcaatttctactgccatctgctttcaggctgcggtcatggaggtgcagacactccggcccagctattggaaattcctactcaggttaacaaagggaaaatttgctgtaatgaaccggaaagttcttgatgtgttcggaaccggagcctccaaacatttccaagattttataccacggctcgatcccaggtatacaacagtgaccccagaactcccaactgaatttagttag

SEQ ID NO: 31212 - DNA, 804 bp, Artificial Sequence
  Description of Artificial Sequence: Synthetic coding sequence
atgactcagtgctgtttcctgcgggtgcatcccctttttttctggttctggtcattccatcacaggatggcacttgctctgtgcctgcaggtactatgctcgctgtgcggctggctgtctctgtacataagcttctgccacctcaataagcatcggagttacgagtggtcttgccgtctggtcacattcacacacggagttctcagcatcggcctcagtgcctacatcgggtttatcgacggcccgtggccattcactcaccccggttctcccaataccccacttcaggtacatgtattgtgtttaacactgggctacttcatattcgatttaggttggtgtgtgtatttccagtctgagggggcattgatgttagcacatcacacactgtcaatcctgggcataatcatggccctcgttcttggcgagtccggtacggaggtgaacgcagtactgtttggtagcgagctcactaatccactgctccagatgcgttggtttctgcgcgagactggacattatcatagttttaccggtgatgtggtagactttctgttcgtagcactcttcactggcgttaggattggggtgggggcttgcctgctgttctgcgagatggtgtccccgaccccaaaatggtttgtgaaggccgggggtgttgccatgtacgccgtgtcttggtgttttatgtttagtatttggcggttcgcgtggcggaagtccataaagaagtaccatgcatggcggtcgagacgctctgaggaacgtcaattgaagcacaacgggcacctcaagatacattag

SEQ ID NO: 31213 - DNA, 738 bp, Artificial Sequence
  Description of Artificial Sequence: Synthetic coding sequence
atggctcttgcgctgtgtctgcaggtcctctgtagtctgtgtggttggctgtccctgtatatatccttctgtcatcttaataaacataggtcatatgaatggtcctgtagattagttacatttacgcacggtgtcctgtcaatcggcctgagtgcttacatcggattcattgacgggccatggccattcacgcaccccgggtcccccaatactcccctacaggtgcatgtgctgtgcttaaccctcgggtattttatcttcgatttaggttggtgtgtgtacttccaatctgagggggccctgatgctggcccaccacacactctccatcttagggattatcatggcattagtgttaggagaaagtggcacagaggtgaatgccgtattgttcggttccgaactgacgaaccctctcttgcagatgcggtggttcttgcgggagaccggccattaccactcttttacgggcgacgtagtggattttctcttcgtggccctgtttacgggcgtgaggattggggtgggagcttgccttttgttctgtgaaatggtgtccccaacgcctaaatggttcgttaaggccggtggagtggcaatgtatgccgtgagttggtgcttcatgttcagcatctggagatttgcgtggaggaagtctattaaaaaataccatgcctggagatcccgacggtccgaggagcggcagctcaagcataatgggcacctgaagatacactag

SEQ ID NO: 31214 - DNA, 447 bp, Artificial Sequence
  Description of Artificial Sequence: Synthetic coding sequence
atgacccaatgctgtttccttcgggtgcacccccttttcttttggttttggtccttccatcaccgaatggcactcgcactgtgcttgcaggttttgtgctctctctgcggctggctcagcctctacatatctttttgtcatctgaacaagcatagatcttacgaatggtcatgtcgtttggtgacctttacacatggtgttttgtctatcggtcttagcgcctatattggcttcatcgacgggccgtggccctttacccacccaggatcacctaacacacctctgcaggtgcacgtgctgtgtttgacgctgggatattttatcttcgatcttgggtgtatttggcgttttgcttggagaaagtcaattaagaaataccacgcctggaggtctagacgctctgaggaaaggcaactcaagcataatgggcatttgaagatacattag

SEQ ID NO: 31215 - DNA, 651 bp, Artificial Sequence
  Description of Artificial Sequence: Synthetic coding sequence
atggtgccaatgcacctcctgggccggctggaaaaacctctgctcctgctatgttgtgccagttttctcctggggctcgctctgctgggcatcaaaaccgacatcacgcccgtggcctacttttttctcactctcggaggtttctttctgtttgcctatttgctagttcgcttcctggaatggggcctgcggagtcaactgcagtctatgcagactgaatctccagggccaagcggtaacgctagggataatgaggctttcgaggtcccggtttatgaggaggcggttgtcggtctggagagccagtgtaggccacaggaactggatcaacctccaccatattccactgtggtgataccacccgcccctgaagaagagcagccgtcccacccagagggctctaggcgtgccaagctggaacagcggcggatggcaagtgagggaagtatggcccaagagggcagcccaggaagggcgcccattaaccttagactgaggggtcccagggccgtgtcaacggcacctgacctgcagtccctagctgccgtgccaaccctggagcctcttaccccccctcccgcatacgacgtgtgctttggccacccagatgatgattccgtgttctacgaggataattgggcacccccttag

SEQ ID NO: 31216 - DNA, 651 bp, Artificial Sequence
  Description of Artificial Sequence: Synthetic coding sequence
atggttcctatgcatctgctcggccgattagaaaagcctttgttactcctgtgctgcgcatcattcctgctcggccttgcactgctcggaatcaagactgatataactccagtagcctacttttttttgaccctggggggtttctttcttttcgcatatttgctcgtgagatttctggaatggggcctgcgctcccagcttcagagcatgcagaccgagtccccaggcccctccggtaacgcaagagataacgaagcctttgaggtccccgtgtacgaggaggccgtggtgggattagaatcccagtgccgaccacaggagctcgaccagcccccaccatatagcacagttgtgatacctccagccccagaagaggagcagccttcacatcctgagggctcccgtagagctaaacttgagcaacgccggatggcttcggagggctccatggcacaggagggttcgccaggacgtgctccaatcaatctgcggctccgggggccgagagccgtgagcaccgctcccgacctccagtcattggcagccgtgcccacacttgagccgctgacccccccacccgcttacgatgtctgcttcggacaccccgacgacgactcagttttctatgaagataattgggcccctccatag

SEQ ID NO: 31217 - DNA, 651 bp, Artificial Sequence
  Description of Artificial Sequence: Synthetic coding sequence
atggtacccatgcatctcctcgggcgccttgagaagcccctgcttctactgtgctgcgctagctttctgctggggctggccctcctgggaataaaaaccgatatcacaccagtggcttacttttttctgactctcggcggcttctttctctttgcctacctcctggtgcgcttcctagagtggggcctgcgttcacagttacaaagtatgcaaactgagagccctggtccctccggaaacgctagagacaacgaagccttcgaggtgccggtctatgaggaggcagtggtaggtcttgagtcgcagtgccggccccaagagctcgaccagccaccaccttatagcaccgtggtgatcccacctgcccccgaggaagagcagcccagccatcctgagggatcgagacgggcgaagctcgagcagcggcggatggcgtccgaaggatcaatggcccaggaagggagccctggccgcgctcccatcaatctgaggctgcggggccctagggctgtttctacagctcccgacctgcagagtctggcagccgtgcccactctggaacctcttactccgccaccagcttacgacgtctgctttggacatcccgatgatgacagtgtcttctacgaagataattgggctcccccctag

SEQ ID NO: 31218 - DNA, 651 bp, Artificial Sequence
  Description of Artificial Sequence: Synthetic coding sequence
atggttcctatgcatctgttaggacggttagagaaaccactgctccttctgtgctgcgcgtcttttttgcttggactagccctgctggggattaaaactgatattacaccggtggcgtatttctttttaacacttggcggtttctttctgtttgcctatcttctcgtacgtttcctggaatggggcctgcggtcacagttacagagcatgcagacagagtcgcctggcccctccggcaacgctcgagataatgaagcgtttgaagtcccagtttacgaagaggcggtggtaggactcgagagccaatgccgaccacaagaactggatcagcccccaccctacagtacagttgtgatcccccccgctccagaggaggagcagccttctcatccagaggggagtaggcgggcaaagctggagcagagaaggatggcgtctgaaggaagtatggcacaagagggctctccaggacgcgcaccaattaacctcagactcagagggcctcgtgccgtctcaacggcacccgatctccaatcgcttgccgccgtgcccaccctcgagccattaacaccaccgccagcatatgacgtgtgttttgggcacccagatgacgacagtgtgttttacgaagataattgggcaccaccttag

SEQ ID NO: 31219 - DNA, 651 bp, Artificial Sequence
  Description of Artificial Sequence: Synthetic coding sequence
atggtgccaatgcatctgttgggcaggctagagaagcccctgctgctattgtgttgtgcaagcttccttctcgggctggctcttctgggaataaagacagacataactcctgtggcttatttttttttgaccttaggcggtttcttcctgtttgcttatctgctggtgcggttcctcgagtgggggttgcgaagccagctgcaaagtatgcaaacagaaagtccgggaccatcaggaaacgcgcgtgataatgaggccttcgaagtacctgtttacgaggaagccgtggtgggcctcgagagccagtgccgaccccaggaattagatcagccacctccgtattccacagtcgttatccccccagcgccggaggaggaacaacccagccatcctgagggatctcgacgggcaaagctcgaacagcgtaggatggccagcgagggttccatggctcaggagggctcaccggggcgcgccccaatcaatctgcgactgcgcggcccacgcgctgtgtctaccgctcctgatctgcagtcgctcgctgccgtgccaactctagagccattgacacctccccctgcttacgacgtttgctttgggcacccggacgatgacagtgtattttatgaagataactgggcgccaccttag

SEQ ID NO: 31220 - DNA, 558 bp, Artificial Sequence
  Description of Artificial Sequence: Synthetic coding sequence
atggctgggccccgtccacggtggagggaccaactgctctttatgtctatcatcgtgctcgttattgtcgtgatctgtttgatgttttatgcattgctgtgggaggccggtaacctgacagatctaccaaatcttaggattggattctataatttctgtctgtggaatgaggacacgtccaccctgcagtgccaccagttccccgaacttgaagccctgggcgttccgcgcgttggactgggactcgcccggctcggggtgtacggaagtctcgtgttgacccttttcgctccgcagccactccttttggctcaatgtaatagcgatgagagggcatggcggctggctgtaggttttttggcagtttcatctgttctgctcgcaggcgggctcgggttgttcctgagctacgtgtggaaatgggtcagactgtccctacctggccccggtttcctcgcgctcggaagcgcacaagcgctgctgattttgctgctcattgcgatggctgtcttccccctccgggccgagcgtgctgagtccaagctcgaatcatgctag

SEQ ID NO: 31221 - DNA, 447 bp, Artificial Sequence
  Description of Artificial Sequence: Synthetic coding sequence
atggccgggccaaggcccagatggcgtgatcaactgctgttcatgagtatcattgttttggtgatcgtggtgatctgtctaatgttctacgctcttctatgggaggcagggaatctgacagacctgcctaacctgaggatcggattctataatttctgtttgtggaatgaggatacatcaacgctgcagtgtcaccagtttcctgagcttgaagcgcttggggtccctcgcgtagggctggggctcgctagattaggagtatatggttccttagtgcttacactgttctttctgagttatgtgtggaaatgggtgcgactgtctctgccaggaccagggttcctcgcccttgggtctgcacaggcattactgattttgcttctcatcgccatggcggtctttcctctgcgcgcagagcgcgctgagtcgaagttggagagctgttag

SEQ ID NO: 31222 - DNA, 327 bp, Artificial Sequence
  Description of Artificial Sequence: Synthetic coding sequence
atggtgaacctaggtctgtcccgcgtggacgatgcggtcgcagctaaacaccccgggcttggtgagtacgctgcttgtcaaagtcatgccttcatgaaaggtgtgtttaccttcgttaccggaactggcatggcctttgggttgcaaatgtttatccaacgcaaatttccttacccacttcagtggtccctgctggtagctgtcgtcgcggggtccgtggtgtcatatggggtcactcgggtggagtccgagaaatgtaacaacctgtggctgtttctcgagactgggcagctcccgaaagatcgatcaaccgaccagcgatcctag

SEQ ID NO: 31223 - DNA, 1380 bp, Artificial Sequence
  Description of Artificial Sequence: Synthetic coding sequence
atgaccgtcgaactgtggcttaggctgcgtggcaaggggctcgccatgcttcacgtgacccggggagtgtggggtagcagagtgagggtgtggcccctgctccctgccctgctcggccctccaagggcactatctagtttggcagcaaagatgggagaatacagaaagatgtggaaccctagagagccccgggactgggcacaacagtatagagaacggtttattcctttctctaaggaacagctgttaagactcctgatccaggagtttcatagctcccccgccgaaaaggccgctcttgaggcctttagtgcacatgtagacttttgtacgctctttcattaccatcaaattctcgcgaggctccaggccctgtacgacccgataaatcctgatcgggagaccctggaccagccctcattaaccgatccacagagactgtcaaatgagcaggaagtcctccgcgcactggagcctctcctggctcaggcaaactttagcccgttgtcagaggatacccttgcatacgcactcgtggtacaccacccccaggacgaagtgcaggtcaccgttaatttagatcagtacgtttatatccacttttgggcgctggggcagagggtcgggcaaatgccactcaagagtagtgtgggctcccgcaggggcttctttaccaaactgcctcccgcggaacggcgctatttcaaaagggtggtgcttgccgcccgcacaaaacgtggtcacctggtgttaaaatctttcaaggatacacccctcgaagggctggaacagctgctccccgagctgaaggtccgtactcctactctgcaacgggcgctgctgaatttgatgttagtggtgtccggggtggctatttttgtaaatgtcgggatggtagtactaactgacctcaaagtcgcaacaagcctgttactgctgctgtttgccatctttatgggcctgcgcgccagtaagatgtttggtcaacgacgatccgctcaggcactagaactggcgcacatgctctactacaggagcacatctaataactctgagctgttaagcgcattagcgctgcgcgcccaagatgagcacaccaaggaggctctgctggcacactcctttctggctcgcagaccagggggaacccaaggatcccccgaagagaccagtaggtggctgagatccgaggtcgaaaactggcttttagctaagagtgggtgtgaagtgacgtttaacggaacgcgcgctctcgcccacctccaggcattgacccccagtatgggcttatatcctcctccgggatttcctaagctggaccctgtggcccctatcacatctgaaccaccccaagcaactccatcctccaatatatcgtag

SEQ ID NO: 31224 - DNA, 1080 bp, Artificial Sequence
  Description of Artificial Sequence: Synthetic coding sequence
atgactgtggagctgtggctgcggttgaggggtaaaggactggcaatgctgcatgtaacccgcggcgtgtggggttctcgagtacgggtgtggcctttgctccctgctttactaggtccaccgcgcgctctgagcagcctggcagctaaaatgggagagtatagaaaaatgtggaatccaagggagccacgggactgggctcagcagtatcgggagcgtttcatcccgttcagcaaggagcagctgcttaggctgctgatacaggtgacggtgaatctcgaccagtacgtctatattcacttctgggcactggggcaacgggtgggtcagatgccactgaagtcctccgtggggtccaggcgtggcttttttacaaagctgccccccgcagaaagaaggtatttcaaaagagtggttttagccgccaggaccaaacgaggacacctcgttcttaaaagcttcaaggatacgccactcgaagggctggagcagctgttgccggaattgaaagttcgtactcccaccctgcagcgagcacttttgaacctgatgcttgtagtcagcggagtggctatatttgtgaatgtaggcatggtggtcctgacagatcttaaggttgctacttccctcctcctgctgcttttcgccatcttcatgggcttaagagcttctaagatgttcggccagaggaggagtgcgcaggcgctggagctcgcgcacatgctttattatagatccacatctaacaattcggagctcctttctgctctcgcactcagggcccaggacgagcataccaaagaagcactgctggctcactctttcctggctagaaggccaggaggtacacaagggtcacccgaagaaacctctaggtggctccgttccgaggtagaaaactggctgctggccaaatccggctgcgaagtgacctttaatggaacgagggctctcgcccacctgcaagcattgaccccatccatggggctgtatcccccgcctggctttcccaaactcgaccccgtggctccaatcacgagcgaaccacctcaggcgacgccctcaagcaatataagctag

SEQ ID NO: 31225 - DNA, 1275 bp, Artificial Sequence
  Description of Artificial Sequence: Synthetic coding sequence
atgaccgtggaattgtggctcaggttgagggggaaaggattagccatgctgcatgtgacaagaggagtctggggcagcagggtgagagtctggcctctgctgcccgcactgctggggcccccacgcgccttgagttctcttgctgcaaagatgggcgaataccggaaaatgtggaacccccgcgagccaagagattgggctcaacaatatagggagaggtttatcccattttccaaagagcagcttctgcgcctactgattcaagccctgtatgacccgatcaacccagatcgggagacccttgaccaaccgtccctgacagatcctcagcgtctgtccaacgaacaggaggtgctacgggcattggagccactgctcgcccaggccaattttagtcctttgtccgaggatactcttgcttacgctctcgtggttcatcacccccaggacgaggtgcaggtaacagtcaaccttgatcagtatgtttatatccacttctgggccctcgggcagagggttggccagatgcctttgaaatccagtgtaggatcgcgtcggggcttcttcacaaagttgcctcctgccgaacggcgctacttcaagagggttgtattggccgccaggaccaagcggggccacctcgtgctcaagtcctttaaggacacacctctcgagggcctcgagcagctcttacctgagctcaaggttcgcacaccaacactgcagcgtgccctgctgaaccttatgctcgtggtgtcaggagtagccatatttgtgaatgtggggatggtcgtcttgactgacctcaaggtcgccacctcactgctgctcctactgttcgcaatcttcatgggtttgcgcgcaagcaaaatgttcggtcagagacgttcagcacaggcactggaactggcacatatgctgtactatcggtctacatccaacaactccgaattgctgtctgcacttgccttgagggcccaggatgaacatactaaagaggctctgctcgcccattccttcttggctcggaggcccggaggaacacaagggtcgcctgaagaaacttcacggtggctccgttctgaggttgaaaattggttactggctaagtcagggtgcgaagtaactttcaacggcactagggcactcgcccacctccaagctttaactccatctatggggctctaccctccccccgggtttcccaaattggatccagttgctccaattacgagcgagccaccccaagccactcccagcagcaacatatcctag

SEQ ID NO: 31226 - DNA, 1185 bp, Artificial Sequence
  Description of Artificial Sequence: Synthetic coding sequence
atgacagtcgagctctggctaaggcttcggggcaagggactggctatgctccacgtgacccgcggggtgtggggctcaagggtcagagtgtggcctcttctgccggcgctgttgggtcctccacgagctttgtcttctctcgctgccaagatgggtgaatacaggaagatgtggaaccctagagaaccacgcgattgggcccaacagtaccgggaaaggtttatacctttcagtaaagaacaacttctgaggctgctcatccaagaatttcatagcagtccagctgagaaggctgcattggaagccttctccgcacacgttgacttttgcacactcttccactaccatcagatcttagcccgcttgcaggtgactgttaacctcgaccagtacgtatacatccatttctgggcactggggcagcgggttggacagatgcccctcaagtctagcgtcggctcacgacgcggctttttcactaaactgccgccagctgagaggcggtacttcaagagggttgtgttagcagctaggactaaacgcggccatctggtcctgaagagctttaaggacacccccttggaaggcttagagcaactactccccgagctgaaggtccgcaccccgaccctccagcgtgctctcctgaatctaatgttggtggtgagtggtgtggccattttcgtcaacgtcggcatggtggtcctcaccgatcttaaagtcgccacttcccttctgttgctgcttttcgccatctttatgggccttagagccagcaaaatgttcggtcaacgcagatcagcccaggccctggagctcgctcacatgctgtattacaggtcaacttctaacaattcagagctgttaagtgcactggccttaagggcccaagatgaacatacgaaagaggccctcttagcccattctttcctggcccggaggccggggggaacgcaaggttcacctgaagagacaagtcgatggctccggagcgaagtggaaaactggctgctcgcaaagtcaggttgcgaggtgacgtttaacggcactagggctctggctcatctgcaggccctgacaccatctatgggcctctaccctccacctgggtttccaaaactggatcctgtcgcgcccattacttcggaacctcctcaagcaactcctagttctaatatctcatag

SEQ ID NO: 31227 - DNA, 1050 bp, Artificial Sequence
  Description of Artificial Sequence: Synthetic coding sequence
atgcggcgcaggttgaacgacagcagagccctggcaaaggctctctatgacccaatcaaccctgatcgcgagacattagaccagcccagcctcactgatccgcaaaggttatcaaacgagcaggaagtgctgagagccctggagcccctcctggctcaggccaacttctctcctctgtccgaagatactctcgcttacgcgttagtggtgcaccacccgcaggacgaggtgcaggtgaccgtcaacctcgatcagtatgtgtatatccacttttgggcccttggacagcgggtgggccagatgccattgaaaagctctgttggatccagacgggggttttttacaaaactgccaccagcggagagacggtatttcaaacgggttgtcctcgccgcaagaaccaagcgaggccacctcgtgctgaaaagcttcaaggatactccactcgaaggactggaacagctgctcccagaactcaaggtgcggactccaactctgcagagggcgttgctgaatcttatgctagtggtgagcggcgtggcgatattcgtgaatgtcggaatggtagtcctgacagacctaaaagttgccaccagcctgttgctgttgctgtttgctatattcatgggcctgcgcgcttctaaaatgtttggccagcggcgctcagcccaggctctggagttggcccatatgctatactacaggagcacttcaaataacagcgagttactgagcgctcttgccttaagagcacaagacgagcataccaaagaagccctgctggctcattcgttcctcgctcgcaggcctgggggtacacaggggagccccgaagaaaccagccggtggttgagatcagaagtcgagaattggctgctggcaaaatccggctgtgaagtgacatttaacggcacaagggccttggcccacttgcaagccctaactcccagcatgggtttgtacccaccgcccggctttcccaagttggatcctgtggccccaattacctccgagccgccccaagccaccccatcttccaacatctcctag

SEQ ID NO: 31228 - DNA, 1038 bp, Artificial Sequence
  Description of Artificial Sequence: Synthetic coding sequence
atgagcaacaacggagccgacctaacatttggctacatttcctgttttgtcgccattctcctgtttggcagcaattttgtgccactgaaaaaatttgatacgggagacggcatgtttctccagtgggttctttgcgccgctatctggctcgtggcccttgtagtgaatctgatactacactgcccgaagttctggcccttcgccatgctaggaggatgtatctgggctaccggaaacatcgccgtggtgccaatcatcaagactattggcctcgggctcggaattctgatttggggctcgtttaatgctctcactggatgggctagctccagattcggctggtttggcctcgatgccgaggaggtgtccaatccccttctgaactatatcggcgctggcctttctgtggttagtgcctttatcttcctgttcattaagagtgaaataccaaacaatacttgctcaatggatacaacccctctgatcactgaacatgtgatcaacaccacacaagacccatgctcctgggtagataaactgtccacagttcaccaccgcattgtcggatgttccctggctgtcatcagcggagttttgtatggatcgacctttgtgcccattatatacatcaaggaccattccaaacggaacgatagcatttacgcaggggcttcccaatatgacctggactacgtgtttgcccacttttcaggcatattcctaacaagcaccgtctacttcttagcttactgcattgcgatgaagaatagtcccaagctctaccctgaggccgttctacctggcttcctctctggagtactgtgggccatagccacgtgctgttggtttatcgctaatcatagtctatccgccgtggtaagcttcccaattattaccgccggcccaggatttattgcagcgatgtgggggatattcatgttcaaagagatcaaaggcctgcagaactatcttcttatgatcctcgctttttgtatcattttgactggtgcattatgtaccgctttttctaagatttag

SEQ ID NO: 31229 - DNA, 234 bp, Artificial Sequence
  Description of Artificial Sequence: Synthetic coding sequence
atgagtaacaatggggccgacctgacatttggttacatctcttgctttgtagctattctgctattcgggagcaactttgtgcccctgaagaagtttgacaccggcgacgggatgttcctgcagtgggtgctttgcgccgccatatggctcgttgccctcgttgtgaacctaatcctccattgcccaaagttttggcccttcgccatgctgggggggtgcatctgggccacctag

SEQ ID NO: 31230 - DNA, 333 bp, Artificial Sequence
  Description of Artificial Sequence: Synthetic coding sequence
atgagtaacaatggagccgacctcaccttcgggtatatttcttgttttgtcgctattctcctatttggctctaacttcgtcccactgaagaagtttgacacaggtgacggaatgttcctccaatgggttttgtgcgcggcaatctggctcgttgccctggtggtgaacctgatactccactgcccaaagttttggccgttcgctatgttgggaggatgcatctgggccacaggaaacatagcggtggtccctattattaagacaatcgggcttggactgggtattctcatttggggctcctttaacgcactcacgggctgggccagtagttag

SEQ ID NO: 31231 - DNA, 414 bp, Artificial Sequence
  Description of Artificial Sequence: Synthetic coding sequence
atgtctaataatggggctgacctgactttcggatacatctcctgcttcgttgcaattttgctcttcggatcaaacttcgtacctttgaaaaaattcgacacgggtgatggcatgttcttgcagtgggtactttgcgccgcaatctggctcgtggctttggtggtgaacttgatcctccattgtcctaagttttggccatttgccatgctgggagggtgtatttgggctaccgggaacatcgccgtagtccctattatcaaaacaatcggactgggactggggattcttatctggggctcctttaacgccctgaccggttgggcctcttcccgctttggctggttcggcctggatgctgaggaggttagtaaccccttgctgaactacatcggggccggtttatcggtggtgtag

SEQ ID NO: 31232 - DNA, 234 bp, Artificial Sequence
  Description of Artificial Sequence: Synthetic coding sequence
atgtccaataacggtgccgacctgacgtttgggtatatttcatgctttgtcgccatcctcttatttggatccaattttgtgcctctcaagaagttcgacacaggagacggcatgttcctgcagtgggttctctgcgccgctatctggctggtggcattggtggtcaatcttattttgcactgtccaaaattctggcctttcgctatgctgggtggctgcatttgggctacttag

SEQ ID NO: 31233 - DNA, 264 bp, Artificial Sequence
  Description of Artificial Sequence: Synthetic coding sequence
atgagcaataacggggcagacctcacatttggatacatctcatgtttcgtggcaattcttctgttcggatctaatttcgtaccgctgaaaaaattcgacacaggggacggtatgtttttacagtgggtcctctgtgctgccatctggctggtggctttagtcgtgaacttgatcctgcactgccccaagttctggccttttgccatgttgggtggatgcatctgggccactggaaatattgctgtggtccccattattaaatag

SEQ ID NO: 31234 - DNA, 504 bp, Artificial Sequence
  Description of Artificial Sequence: Synthetic coding sequence
atgtctaacaatggcgccgatctgacttttggctacatttcatgctttgtcgcgatcctcttgtttggatcaaatttcgttccactcaaaaaatttgataccggcgatgggatgttccttcagtgggttttgtgtgccgctatttggctggtggctctggtggttaatctgatcttacattgccccaagttctggccattcgccatgttgggggggtgtatctgggccacgggtaacatcgcagttgtcccgatcattaagactatcggcctggggctggggattctgatctggggatcctttaacgcactgaccggctgggctagcagccggttcggctggtttggactcgacgccgaggaagtctcgaatcccctgctgaattatattggcgctggcctgagtgtggttagtgcatttatcttcctttttattaaatcggaaattcccaataacacatgcagtatggatacaaccccccttattaccgagcacgtcatttag

SEQ ID NO: 31235 - DNA, 33 bp, Artificial Sequence
  Description of Artificial Sequence: Synthetic coding sequence
atgagcaataatggcgcagatctcactttttag

SEQ ID NO: 31236 - DNA, 264 bp, Artificial Sequence
  Description of Artificial Sequence: Synthetic coding sequence
atgtctaataacggagctgacctcacattcggctatatctcttgctttgtcgccattctgcttttcggatccaactttgtacccctgaaaaaattcgacactggagatggcatgtttctgcagtgggtgctgtgcgctgccatttggttggtggccctggtcgttaacctcattctgcactgccctaagttctggccctttgcaatgctgggtggttgcatctgggctactggaaacatcgccgtggttcccataatcaaatag

SEQ ID NO: 31237 - DNA, 510 bp, Artificial Sequence
  Description of Artificial Sequence: Synthetic coding sequence
atgagcaataatggtgcggatttaacattcggttatatctcctgctttgtagcaatactgctgttcgggtctaactttgtgcctctcaagaagtttgacactggggatgggatgtttctccaatgggtactgtgcgcagccatatggctcgttgccctcgtagtcaaccttattctgcactgccccaaattctggccctttgccatgcttggcggctgtatctgggccactgggaatattgcagtggtgcccatcatcaaaacaatcgggctgggcctcggaattcttatctggggtagttttaacgctttaaccgggtgggcctctagccggttcggttggttcggccttgatgcagaagaggtgtccaatccattgttaaattacattggggccggtctgagcgttgtgtctgcttttattttcttgtttatcaagtccgaaatacctaataatacgtgttccatggacacaacccctttgattacggagcacgttagcattgtatag

SEQ ID NO: 31238 - DNA, 276 bp, Artificial Sequence
  Description of Artificial Sequence: Synthetic coding sequence
atgagcaacaatggtgcagacctgacattcggttatatctcctgtttcgtggccatcttgctgtttggctctaattttgtgccgttgaaaaagttcgatacaggggacgggatgttcctgcagtgggtcctctgcgccgcaatctggcttgtagccctggtggtgaacctcattctgcactgccccaaattttggccctttgctatgttgggggggtgcatctgggccacaggcaacattgccgtagtcccaataatcaagacaatcggtctgtag

SEQ ID NO: 31239 - DNA, 1482 bp, Artificial Sequence
  Description of Artificial Sequence: Synthetic coding sequence
atggagccactccgagccccagcactgcggcgtctcttgccaccactactgctgcttcttttgtctctcccccctagggcccgtgccaagtacgtcagaggtaatttgtcttcaaaagaggattgggtcttcttgacacgattctgtttcttatccgattacggtaggctcgattttcgtttcaggtaccccgaagctaaatgctgccaaaacattctcctttacttcgacgacccaagccaatggcctgctgtttacaaggcaggggacaaggattgccttgccaaggagtcagtaattaggcccgagaataaccaggttatcaacctgacgacccagtatgcttggagcgggtgccaagttgtatccgaggaggggacacgctacttgtcttgtagctcagggaggtcattccggtcgggcgacgggcttcagcttgagtatgaaatggtgctgaccaatggtaagtctttttggactaggcacttttccgcggacgagtttggtattctagagaccgatgtcacatttttactgatttttatcctgatcttctttcttagctgctatttcggatatctgttaaagggacggcagctgcttcacacaacttataaaatgttcatggccgccgcaggcgtggaggtgctatcattacttttcttttgtatatattggggtcaatatgcaaccgatggcataggtaacgaatcagttaaaattctcgccaagctcctattctctagctcctttttgatcttcttgctgatgctgattctcctgggcaagggttttactgttactcggggcaggatctctcacgccggctctgttaagctgtcagtctatatgaccctgtacactctgacccacgtggtcttgctgatttacgaagcagagttcttcgatcccggacaggtcctgtacacttacgagagcccagcaggctacggattgataggcctgcaggtcgccgcctacgtgtggttctgctatgccgtccttgtctctctccgacattttcccgaaaagcagcccttctacgtgccattctttgcggcgtacacactatggttctttgccgtgccagtgatggccctgatcgcaaattttggcataccaaagtgggcaagggaaaagatcgtgaacggtatacagttgggaattcacttatatgcgcatggcgtgttccttattatgaccaggccctccgctgccaataaaaatttcccctaccacgtgcggacttcccaaatcgcctccgctggcgtccccggcccaggtggctctcagtccgctgacaaggccttcccgcagcacgtttacggaaacgtgactttcatctcggattccgtcccaaattttaccgaattgttttcgatcccgcccccagctacaagccctcttcctagagccgcccccgattccggcttgccactttttagagacctacggcccccgggaccgctgagagatctatag

SEQ ID NO: 31240 - DNA, 1404 bp, Artificial Sequence
  Description of Artificial Sequence: Synthetic coding sequence
cgcctgcgtcactgtacccctacgtgggctacagagcctgacagcgtcaagaagaaacggaatcgtaagcgaagcggagccgttgctcacaactgtaatctgaagcactttggccgccctcgttgggaggaccacctgtgtccggggatctgggaccagaggggcaacattattgagtttctgaccggagaattcatttatcgaatgtacactatagacatgcacagccagcttgagcttactgcgtccctgatcccacagcccggtaccagtctgattccccttgtgatggtctcgaatccccactccctcggcttccaggccacattctacgaaaacggttatacttctgacggtaatacaaagtataagttggacatctttttaaaacaacagcaacattggggccggactgattcaaactttacttcgtctctcaagaaagcaacgatgtccaccctgaccgtggatatcgctaataaggaaatctcctgcgtggatatcaagccactcagcactctgataagcgtcgggtgcgacttggataagaagattgttatacagaacaaggtcagtgcgtgttcaatgggtatcctcgaccccctgaccctgcaggacaactacagctttattatcgagaaagagttctatgatccaggatttcaaggtcaacagagttcagaggacctgcacgttttctacagttatcagcagctgggttgtcctctcctggtatactacgatacgttgtggaaacccgttgtcgaactttggcgcaaagactcattccaagaggtgattgatgccgagtatgtgctcttggaggtgaacgggcagtttagctattcttattccctgactgcccaaagcgccatgtgtacatcacagccccagaactggaccaccatgattaaagaatttggtgggcctttcttctggaatagagaaaactatgtgtcatgtcacgatccgaacaataatgcgccgttgaggtggcctgatgtgcagtatcagatcttgggcggcaggaccgccaaccaaattatctttggccataatgggttctatgtattctacatatcaatagttgatccttactactcctattgccagttggaaacgatctttagtatctacgtgtacggtgcttttccagtccaactggtatctgctggggttgtgattttgcttatcatctcctcaatcctgggttctgtctggctagcttataagacaccgaagttgctccgtaccgcccgagggaggcggattaagaaatgcgccacccagttgtgcagaaggtgcaagactgtctgccagtttcgagccagtgccactgccagagcaggtaccgagcctccggggcggcatagaactccacacggtggcaggagcgaccactag

SEQ ID NO: 31241 - DNA, 1080 bp, Artificial Sequence
  Description of Artificial Sequence: Synthetic coding sequence
atgtttagaagtccaggcactctggagatcttgacgccactccgagatacggcattccctgcgtttgattttcagaaatgtctggtgaacatccaggccctcttgatggacccagagcttcatgtgggcaagtgtaaaattgagtttctcacgggagagtttatatatagaatgtacacaattgatatgcacagccaactcgagctgacggccagtctgattcctcaaccgggtacttccctcattccgctcgttatggtatctaacccccacagcttgggctttcaggctaccttctacgaaaacgggtacacgtccgacgggaataccaaatataagctggatattttccttaagcagcagcaacattggggcaggaccgattctaattttacatccagtctcaagaaagcaaccatgagcactctgacagtagatatcgccaacaaggaaatctcttgcgtagacataaaacctttgtctacactgatatcagtcggatgtgaccttgataagaaaatcgtaattcagaacaaggtgagcgcatgctcaatgggaattttggacccactaacactccaagataattacagctttattattgaaaaggagttttacgatcccggattccagggacagcagtcaagtgaagacctccatgtgttttatagttatcaacagctaggctgccccttactggtctactacgacaccctctggaaacctgttgtggagctgctggaatccagcgggatgaataccgtgcattgtagcctcaacctccccgggtctagcgggccccctgcatcggcttcacaggttgctggcactgccgtcgcatatcacaatgcccggttgatttttttcttttttttcttttttttttttctgcgtcagagcttggctctctctccccgccttgagtgcagcggcgtgatactggcccatcggaagctctgcctgccaggatctaggcacagcccggcatcagcttctcgtgtggccgggattacaggcgccagacactgtgccagattgatctttttcatcttcagcagagatcgggtttcaccctgctag

SEQ ID NO: 31242 - DNA, 2397 bp, Artificial Sequence
  Description of Artificial Sequence: Synthetic coding sequence
atgctgatgctgatgttggtcgccgccgtgacaatgtggcttcgacctctcgtgacagcccagctctgtcgcagtaggacagtccgaacagggaaggtcttcaacctcattcaagacgtacaaggagaccggttatattttcacccaacgaccactagactcatcaaacacccctgcgagaagaatatcgcattgtatcttggaaaacaggtgttcttcaccatggacaactttgagacttctttgctgccattcaccatccctacatcaatgcaggtcggggtccccgaagtgaccagtgcccacttcgccggatctcttctcttgctggtcgttgaccagaaggtttatatatacgattacgaaaataactcttggagtatgagcctaggaatcaagcacccagttacccacgtgtcaggcgacaactgttgctacacgggctcactgttctgtgtccacgtgtcaaacctggtcttcgcctacttcaggggtgaccaaatttcccaaacttacatctactacagcaatactggtgggttttctttctggaagtatcactacgatagacaggccgaaatcatcgggtcattgggcggaatcttccatttctttagcctgtctcaagtggcgatgctagtagtaaaccaggggaaagggatgtttaagtattccgaccatcctctgaacagaagtttcggacttagtttcgactataatggaaccctagatatattgatcgctcctggccagcgcggaatcttgctgctatggttcgaaaacagtctgctttttagccacaatgcgggacagctggtcgatacagtgcgcgtcaagaaaggcgaccaaaccttgttctccagcatctttgaggctaagattactattcacaacattgctgtcacagagaatgagctggccgtgatcacaagagaggataacctgtactacgggaacctaggaatagttccttctagcattatcaagttcgccgaccagtacatctggtccgaagacgtagcgctgatgtttaggagtccaggaacactcgaaatcctcactcctttgcgtgacacggcctttcccgcctttgattttcagaaatgcctggtgaatattcaagccctgctgatggatcctgaattgcatgttggtaaatgcaagatcgagttcttaaccggagagtttatctatcgcatgtatacgattgacatgcactcacagctggaattaaccgcatcccttatccctcaacccgggacgtccctgatcccactcgtgatggtgtccaatccacacagtctcgggttccaagcgaccttttacgaaaacggttatacttctgatgggaatacgaagtacaagctcgatatatttctgaaacaacagcagcattggggtcgcacagacagcaatttcacgagttctttgaaaaaggcaaccatgtcaacccttactgttgacattgcaaacaaggagatcagctgcgttgacattaagccgctgtccaccctcattagcgtggggtgtgatttggataagaagattgtcattcagaataaagtttccgcctgctcaatgggaatcctggaccccctcactctgcaggacaactattccttcataatcgaaaaagaattttacgacccgggctttcaaggtcaacaaagtagtgaagacttgcatgtcttttattcctaccagcagcttggttgtccccttttagtgtactacgatactctgtggaaaccagttgtggagctctggcggaaagattccttccaggaagtaattgacgctgaatacgtgctgctggaggtgaatggacaatttagttacagttacagcttgacggcacagtccgctatgtgtacatctcagcctcaaaattggactaccatgatcaaggagttcggggggccctttttttggaaccgggagaattacgtatcctgtcacgatccgaacaacaacgcgcccctacggtggccagatgtgcagtaccaaatcctgggtggaagaactgcaaatcaaataatttttggacacaacggcttttatgtgttctacataagtatcgtcgatccctattactcatactgccagcttgagaccattttcagtatttatgtttacggagcctttccagtgcagctcgtctctgcgggcgttgtgattctgttaatcatctcaagcattctcggctctgtgtggcttgcatacaagaccccaaagctgctcaggaccgctcgtggccgaaggattaagaaatgcgcgacgcagctgtgcagacgctgcaagacagtgtgtcagtttcgagcaagcgcaactgctagagcaggcactgagcctcccggccgccacaggactccccatggaggaagaagcgaccattag

SEQ ID NO: 31243 - DNA, 777 bp, Artificial Sequence
  Description of Artificial Sequence: Synthetic coding sequence
atggcatccgccgccgcggctgaagcagaaaagggatcgcctgtggtagtgggtttgctggtcgtagggaatattatcatattgttgtcaggactaagcctgtttgccgaaaccatctgggtgaccgcagatcagtaccgcgtgtaccctctgatgggcgtttcggggaaggacgatgtttttgccggggcttggatcgccatcttttgcggtttcagtttttttatggtggctagctttggagtcggtgccgccctgtgccgacgcagaagcatggtattaacctatcttgtgctgatgctcatcgtctatatttttgaatgcgcgtcatgtatcacctcctatacgcaccgggactacatggtctcaaacccttctctcattaccaaacagatgctgacgttctattccgctgataccgaccagggccaggagttaactcgactttgggatagagtgatgatcgagcaggagtgctgtggaacctcgggccccatggattgggtcaattttacgtccgcctttagagcagcaactccagaagttgtctttccctggcctccactgtgctgtcgcagaacagggaactttatccctctcaatgaagagggctgtagactcggacacatggattacctgtttactaagggatgctttgagcacataggtcacgcaatagattcatacacctgggggataagctggtttggctttgccattttgatgtggactctacccgttatgctcattgcgatgtatttctacacgatgttgtag

SEQ ID NO: 31244 - DNA, 528 bp, Artificial Sequence
  Description of Artificial Sequence: Synthetic coding sequence
atgttgtttctggcgaccttttttcctacatgggagggtgggatctacgatttcataggtgagttcatgaaggcatccgtagatgtcgccgacctgatcggcctcaatctggtgatgagccgaaacgcgggcaagggcgaatataaaatcatggtagcggctttggggtgggcaacagccgaattgatcatgagcagatgtatacccctttgggttggtgcaaggggtattgaatttgactggaaatacattcagatgagtattgattctaacatcagtttagtccactacatcgtggctagtgctcaagtatggatgatcacacggtatgatttgtaccatacatttaggcccgctgtgctgctgcttatgttcctctccgtctacaaggcatttgtaatggagaccttcgtgcacctgtgctccctgggttcctgggcagcccttttggcccgggcagtcgtgactgggctgctggctttatcaacgctggccctgtacgtagcagtggtaaacgtacattcttag

SEQ ID NO: 31245 - DNA, 555 bp, Artificial Sequence
  Description of Artificial Sequence: Synthetic coding sequence
atgactttgtttcactttggcaattgtttcgccctcgcgtattttccctactttataacgtataagtgctcaggcttatctgagtataacgcattttggaaatgtgttcaagctggggttacctatctcttcgttcagctgtgtaaaatgctcttcctcgctaccttctttcccacgtgggagggcgggatttatgactttatcggcgagtttatgaaggcctcagtggatgtcgcagacctcattggacttaacctggtgatgagtcggaacgctggaaaaggcgagtacaagatcatggtcgccgcactaggctgggctacagcggaacttatcatgtctaggtgtataccactctgggtgggcgccagaggtattgagttcgactggaaatacatccagatgtccatcgactcaaacataagcctggtgcactacattgtcgcctccgcacaggtgtggatgataacgagatatgacctatatcacacgttccgccctgccgtattattacttatgttcctgagcgtgtacaaggcctttgtcatggagtag

SEQ ID NO: 31246 - DNA, 96 bp, Artificial Sequence
  Description of Artificial Sequence: Synthetic coding sequence
atgagaccgggatggtctcacctgccgctatgtcctactctccaggacgcagtgctcgggcatttcttgtcccaccttggacgacgccacctatag

SEQ ID NO: 31247 - DNA, 1098 bp, Artificial Sequence
  Description of Artificial Sequence: Synthetic coding sequence
atgtctctgatccgaaagaagggcttttataagcaagacgttaacaagaccgcgtgggaactgccaaagacctatgtttcacccacacatgtgggtagtggcgcatacggaagcgtgtgctccgcaattgataagagaagtggcgagaaggtggcaattaagaaactctcaaggccctttcagagcgagatttttgccaaaagggcctacagagagctgctgttattaaaacacatgcagcacgagaacgtcattggcctgctagatgtcttcacacccgcttcgtctctccgaaacttctacgacttttacctggtgatgccattcatgcagaccgatctacagaaaattatgggcatggaattctctgaggaaaagattcagtacttagtctatcaaatgcttaagggacttaaatacatccattcagctggggtggtgcacagggacctaaagccaggtaatttggcagtaaacgaggactgtgagttgaaaattctggacttcggcctcgcacgacatgcagatgctgagatgaccggatatgtcgtaacccggtggtatcgcgcacccgaagttatcctgagctggatgcattacaaccagacggttgacatctggtccgttgggtgcatcatggcggaaatgctgaccggcaagaccctgttcaagggcaaggactatttagaccagctgactcaaattctgaaggtaacaggggtacctggcacagagtttgtccagaagttgaacgacaaggccgctaagtcttatatccagtctctccctcagaccccccggaaggattttactcagctcttcccacgggcatcaccacaagccgccgatctcctagagaaaatgctcgagcttgacgttgataagcggttgaccgcagcgcaggccctgacccatccgttctttgaaccttttagggatcctgaagaagagactgaagcacagcagcccttcgacgactccctggaacacgaaaagctgacagttgacgagtggaaacaacacatctacaaagagatagtcaatttctccccaatcgcgcgaaaagactctcggaggcggtcaggcatgaagctttag

SEQ ID NO: 31248 - DNA, 243 bp, Artificial Sequence
  Description of Artificial Sequence: Synthetic coding sequence
atggagaagccactcttccccctggtcccacttcactggtttggattcgggtatacagccctcgtggtgagtggtggcatcgtgggttacgtgaaaaccgccgctacctctgtgacattcgtgggcgtgatgggtatgcgctcttactactacggtaaatttatgccagtcggcttaatcgccggtgcctccctgctcatggcggcaaaggtcggcgtgaggatgctcatgacatccgattag

SEQ ID NO: 31249 - DNA, 345 bp, Artificial Sequence
  Description of Artificial Sequence: Synthetic coding sequence
atggaaaagcccctcttccctctcgtgccacttcactggtttggctttggctacacggctctcgtcgtaagcggaggcattgtgggctacgtgaagactggttccgttccatcacttgctgctgggctgctgtttgggtccctggccggcctcggtgcctatcagctataccaggacccaagaaacgtgtggggcttcctggcagctacctcagtgacattcgtgggggtgatgggaatgagaagttactattacgggaaattcatgccggtcggcctgatagccggggcttcactcctgatggcagcgaaggtgggagtgcggatgttaatgacaagtgactag

SEQ ID NO: 31250 - DNA, 345 bp, Artificial Sequence
  Description of Artificial Sequence: Synthetic coding sequence
atggaaaagccgctcttcccactcgtgccgctgcattggttcgggttcggctacaccgctctggtagtttcgggggggatagtgggatacgtgaaaacaggatccgtgccgtctttggcggctggtctgctgtttgggtccttggctggcctcggcgcttaccagctttatcaggacccacgaaacgtgtggggttttcttgcagccacctcagtgacttttgtgggagttatgggcatgcggtcatactactatggtaagtttatgcccgtaggcctgattgccggggcctccctacttatggctgccaaagtgggagtcagaatgctaatgaccagtgattag

SEQ ID NO: 31251 - DNA, 408 bp, Artificial Sequence
  Description of Artificial Sequence: Synthetic coding sequence
atggaaaagccactgttcccactcgtcccactgcactggtttggcttcggctacactgccctggtagtgtccggcgggatcgtgggttatgtgaaaacgggcagtgtaccatctctggccgctggattgcttttcggaagcctggccggactcggggcataccagctatatcaggatcctaggaacgtttggggatttctggctgctacgtcggtgacattcgtaggagtcatgggaatgcgtagctactattatggcaaatttatgccggtggggctgattgctggcgccaggtatttccactccataacacttctgtaccacgtcgagttttccttattgccccgcattctttacgcttttaagactttactggtttcggagtatcttatgctgtgtatcaactag

SEQ ID NO: 31252 - DNA, 2151 bp, Artificial Sequence
  Description of Artificial Sequence: Synthetic coding sequence
atggaggatagcacttcccctaagcaggagaaggaaaatcaagaggagctcggggaaacacggaggccttgggagggcaagacagcggcctcaccacagtatagcgaacctgagagcagtgagcccttagaggccaaacaaggtcccgagactggcaggcagagcagaagctcacgcccatggagtccccagtctcgcgctaagaccccccttgggggaccagccggtcctgagaccagcagtcctgcacctgtgtccccacgcgagcccagctccagcccatcccccctcgcgccagctagacaggacctcgctgcaccccctcagagcgacagaacaacctctgtcatcccagaggcggggaccccttaccctgaccctctagaacagtcatccgacaaacgtgaaagtacccctcaccacacgtctcagagcgagggaaacacattccagcagagccagcagcccaagcctcacctatgtggtcgccgggatgtcagctataacaacgccaagcagaaggagctccggtttgatgtgtttcaggaggaagacagtaattccgattatgacctacagcaaccagcacctgggggtagcgaggttgcaccttccatgttagagattaccatccagaatgccaaggcgtacctgcttaaaacaagctccaattctggattcaatttgtacgatcatctatcaaacatgttaaccaaaattctcaatgagcgccccgagaatgcagtggacatcttcgagaacatctcacaggatgtaaagatggcacactttagcaaaaagttcgacgcgttgcaaaatgaaaatgaattgcttccaacgtacgaaatcgctgaaaaacaaaaagcattgtttcttcagggacatttagagggagtcgaccaggagctcgaggatgagattgctgagaatgctctgccaaacgtgatggagtccgctttttacttcgaacaggccggggtgggactcggcactgatgaaacatacagaatttttttggcccttaaacaactgaccgatacccaccccatccaaaggtgtaggttttggggcaagatcctcgggctggaaatgaactacatagttgctgaggtcgagtttagagaaggggaagatgaagaagaagtcgaagaggaagatgtggcggaggagcgagacaacggagaatccgaagcgcatgaggatgaagaagatgagttacctaagtcattctacaaagcccctcaggctatacctaaggaggagagccgaacaggagccaataaatacgtttattttgtctgtaatgaaccaggcaggccctgggtgaaactgccacccgtgatcccagcccaaatcgttattgcccgaaagatcaaaaaatttttcacaggccggctagatgcccccatcatctcttacccgccctttccgggaaatgagagcaactacctcagagcacaaattgcacgaatatccgcaggcacccatgtgtccccactgggattctatcagttcggcgaggaagagggggaggaggaggaagaagctgaaggcggccgaaacagtttcgaagaaaaccctgacttcgaggggattcaggtgatagacctggttgagtcactatcaaactgggttcaccatgtgcagcacatcctctcccagggtcggtgtaactggtttaactctatccagaagaacgaagaggaggaggaagaggaggatgaggagaaggatgactccgactacatcgaacaggaggtaggcctgcccctgctcactcccatctccgaagatctggagatacagaatatcccaccctggacaacccgtctcagttccaatctcatccctcaatacgccattgccgtgctgcagtccaacctctggccaggcgcatacgcgttttcaaatggcaagaaatttgaaaatttctatataggctggggtcataagtacagtccagacaactatacaccaccagtgccgcctcccgtctaccaggagtacccaagcggcccagaaataacagaaatggacgatccatccgtagaggaagaacaggccttccgcgcagcccaggaggcagtcctgcttgctgcagaaaatgaagaatccgaggaggatgaagatgaggaggacgattacgactag

SEQ ID NO: 31253 - DNA, 315 bp, Artificial Sequence
  Description of Artificial Sequence: Synthetic coding sequence
atgcaagatacgggctccgtggttccactccactggttcggcttcgggtacgccgccttggtcgcctccggcggtattatcggttacgtgaaggctggctctgtgcccagtctggcagccggactactgttcgggtctttggccggactcggcgcatatcaggttagcggctctaaggagagacttggcttccccagctatatctggtatctgggctggcattacggaaatgaggtcttgcccttgtggaaaattcacgcgtgcagattcaactgccgttgtcaatttgcagacgggagacagtcctggagctag

SEQ ID NO: 31254 - DNA, 339 bp, Artificial Sequence
  Description of Artificial Sequence: Synthetic coding sequence
atgcaagatactgggtctgttgtacctctgcattggtttggttttgggtacgctgcacttgtggcttcaggcggcataattggatacgtgaaggcggggtctgttccctcgttggccgccggtcttctttttgggagcctcgctggacttggagcctaccagttgtcccaggatcctagaaacgtctgggtattcctcgccacatccggaactcttgctggcattatgggtatgagattctaccatagcggtaaatttatgccagctggtttgatagcaggcgcctcactgcttatggtggccaaagtgggagtgagcatgttcaacagacctcactag

SEQ ID NO: 31255 - DNA, 378 bp, Artificial Sequence
  Description of Artificial Sequence: Synthetic coding sequence
atgcagatggatcccggaccacaggtacctctgtactggctggggttcgtgtatgctgccctggcagcactcggtggaatatccggatacgcaaaagtaggtagtgtgcagtctccatctgccgggttttttttcagcgagctggcaggactcgacgcctcacaaccgtccaggaacccaaaagaacacctgtcaagcccagtgtacatctgggatctcgccaggtattatgcgaacaagatcctaacactgtggaatatttacgcttgtggctttagctgtcgttgcctgctcattgtgagcaaactgggtagcatgtatggagagcaaatcctaagcgtcgtggccatgtcacagctagggttgatgaaaaactag

SEQ ID NO: 31256 - DNA, 657 bp, Artificial Sequence
  Description of Artificial Sequence: Synthetic coding sequence
atgtacgccctgtggagaaccgggccaacaacctcgcccgctctgctgacacttctcagcaagggagtcccccgccctgctgccccttggactatgtccccatcttccgtagccctgatctgcctgctccgatacggccagctcctcgaacagtcgcgtcattcatgggtgaatactactgctttgattacaggctgtaccaatgccgccggccttctcgtggtcgggaacttccaagttgaccatgccaggagcttgcactacgtgggcgcgggggtcgcattccccgcagggctgctgttcgtttgcctccactgtgcactttcctaccagggggccacggcgccacttgaccttgccgtggcatatttgcggtcagttctggccgtgatcgctttcattactcttgtgctgtcaggggtcttttttgtgcatgagagttcccagctgcaacacggagccgcactttgcgagtgggtgtgcgtaatagacattcttattttctatgggacatttagctacgagtttggggccgtgtcaagcgacaccttggtagctgcactgcaacccacccccggccgtgcttgtaaaagctccgggtccagtagtacatcaacacacctaaactgtgcaccagagtcgattgcaatgatttag

SEQ ID NO: 31257 - DNA, 816 bp, Artificial Sequence
  Description of Artificial Sequence: Synthetic coding sequence
atgaccgcatggattttactcccggtcagcctgagtgctttttcaatcacgggaatttggaccgtgtacgctatggccgtgatgaatcaccatgtgtgcccagttgaaaactggtcatataacgagtcgtgtcctccggatcctgccgagcagggggggccaaaaacctgttgcaccctggacgacgtccctcttatttcaaagtgcggctcctacccacctgaatcctgtttatttagcctgataggcaacatgggcgccttcatggtcgccctgatctgcctgctgaggtatgggcaactgctcgagcagtccaggcactcctgggtgaacactactgctttaattacgggttgcaccaatgcagcaggactgctggtcgtggggaactttcaggttgaccacgcgaggagcttacattacgtcggagcaggggttgcatttcccgctgggctccttttcgtctgcctccactgtgcactatcctaccagggcgccactgctccacttgacctcgcagttgcctacctgaggagtgtcttggccgtgatcgcgttcattacgctggtcctttccggagtgtttttcgtccatgaatcaagccagctgcaacatggagctgctctgtgtgagtgggtgtgcgttattgatatcttgattttctatgggacctttagctacgaatttggggccgtcagctcggacactctggtcgcagctcttcagcctacaccgggacgcgcatgtaagagttctggatctagtagcacttccacacatttgaactgcgcacctgaatcgattgctatgatctag

SEQ ID NO: 31258 - DNA, 816 bp, Artificial Sequence
  Description of Artificial Sequence: Synthetic coding sequence
atgaccgcatggattctgttgccggtgagtttatcagcttttagcattaccgggatttggacggtttacgcaatggccgtgatgaatcaccatgtgtgccccgtcgaaaattggtcttacaacgagagctgcccgcctgacccagctgaacaggggggacccaagacgtgctgcactctggacgatgttccattgatttctaaatgcggcagctaccctccagagtcttgcctgtttagcctcattggaaatatgggggcattcatggtcgctctgatatgcctgctgaggtacggccagttattggaacagtctcgacattcttgggtgaatacgaccgctctaatcaccggatgcacaaatgcagcgggccttttggtggtggggaacttccaggtggaccacgcacgctcactgcactacgttggcgcaggcgtagctttcccagcaggtctcctgtttgtctgtctccattgtgcccttagttaccagggcgccaccgcaccactggatttggccgtggcctatctgcggtcagttctggccgtgatagcctttatcaccctcgtcctttcaggggttttctttgtgcatgagagtagtcaacttcagcacggcgcggccctctgcgagtgggtatgcgtaattgacatactgatcttctatgggaccttttcttacgagtttggggctgtgtcctccgacacactggtagcagccctccagccaacgccaggaagagcgtgcaagtcgtctggcagttcctctacctctactcatctgaattgtgcgccagagagcattgccatgatctag

SEQ ID NO: 31259 - DNA, 204 bp, Artificial Sequence
  Description of Artificial Sequence: Synthetic coding sequence
atgtatgccctttggcgaacgggacccactacctctcctgcgttactgactctcctgtctaagggagttcctcgaccggccgcaccatggacaatgtctccatcctcggtcgctctgatctgtctattgcgttacggccagctgctggaacagagccgacattcttgggtaaataccactgctctgattactggctgtacctag

SEQ ID NO: 31260 - DNA, 702 bp, Artificial Sequence
  Description of Artificial Sequence: Synthetic coding sequence
atgtggggctacctgtccttaatgccggtgtttttggctgtttgggccatttccggtgtgtggattgttttcgcgatagcagtaactaacagaacagtcgatttgtccaagggtttcccctatataagcatttgcggttcattcccacctcagagttgtatcttctctcaagtcctgaacatgggcgccgcgttagctgcttggatatgtatcgttcggtatcatcagcttcgcgattggggtgtccgacggtggcccaaccagctcattctgtggaccggcctcttgtgcgccttggggactagtgttgtcggcaacttccaagaaaagaaccagagacccacccacctggccggggcgttcctagctttcatcctggggaacgtttatttctggctgcagctgttgctgtggaggctgaagcgcctcccacagcctggcgctgcatggatcggcccattacgactgggattatgcagcgtatgtaccattctgatcgtggctatgatcgtgctgcacgcatgtagcctacgatccgtgagcgctgcctgcgagtgggtggttgccatgctgctcttcgctctattcggcctcctcgccgtggatttctccgctctggagtcttgcactctgtgcgttcagccgtggccatcgctgagccccccacccgcaagtcctatcagtctccctgttcagttgtag

SEQ ID NO: 31261 - DNA, 702 bp, Artificial Sequence
  Description of Artificial Sequence: Synthetic coding sequence
atgtggggttatctgtcattgatgccagtgtttctggctgtgtgggccatttcgggagtgtggatcgttttcgcgatcgcagtgaccaatcgcacggtggatctcagcaaaggttttccatatatatctatctgcgggtccttcccccctcagagctgtatcttttcccaggtgttgaacatgggcgccgcgttggctgcatggatttgcattgtacgatatcaccagctgagggattggggagtacgtagatggcctaaccagctgatcttatggaccggtctgctttgcgccctcggcacgagcgtggtggggaattttcaggaaaagaatcaacgcccaacacacctcgccggagcgtttttagcattcatcctgggaaacgtgtatttttggctccagctgctcctgtggaggctgaaacgactcccacagcccggggccgcctggatcggacctctcaggctgggcttatgttccgtgtgtacgatactgatcgtggccatgattgtgctgcacgcgtgttcgctgcgcagtgttagcgctgcctgtgagtgggtcgtagcaatgttattgtttgcgctgttcggactcctggccgtggacttttcagcactcgaatcatgtaccctgtgtgtgcagccttggccgagcctctcaccaccccctgcctctccaatttcactaccagtgcaactgtag

SEQ ID NO: 31262 - DNA, 750 bp, Artificial Sequence
  Description of Artificial Sequence: Synthetic coding sequence
atggacggaaaaaaatgttccgtctggatgttcctacctctggtgttcaccctttttacttcagcaggactgtggatcgtgtacttcattgctgttgaggatgataagattttacctctgaattcagccgaacggaaaccgggtgtgaagcacgcgccatatattagcattgctggtgacgaccctcctgccagttgtgtcttctcgcaagtgatgaatatggctgctttcctcgcattggtagtggccgtgctgcggtttatacagttaaaaccgaaggtgctcaacccctggctgaacatcagtggtctggtcgccttatgtttggcgagttttgggatgacccttctgggcaatttccagctgacaaatgacgaggagatccataatgttggcaccagcctgaccttcggcttcggaaccctcacatgctggatacaggccgctctaactctcaaggtaaacatcaagaacgaaggccgccgggtgggcatcccacgcgttatcctgtccgcttctattactctgtgtgtggtcttgtactttatcttgatggcgcagtccattcatatgtacgcggcgcgtgtacaatggggactcgttatgtgctttctgagctatttcggaacctttgctgtcgagttccgtcactaccggtacgaaattgtgtgcagcgagtatcaggaaaactttctttctttctccgaatccctttccgaggcctcggagtaccagacggatcaggtctag

SEQ ID NO: 31263 - DNA, 204 bp, Artificial Sequence
  Description of Artificial Sequence: Synthetic coding sequence
atggatgggaagaagtgctccgtctggatgttcctccccctcgtgttcaccctcttcacgtctgctggtctctggattgtgtacttcatcgcagttgaagacgacaaaattctgcctttgaacagcgcagagcgcaaaccaggcgttaagcatgccccttacatcagtatcgcaggagacgatcctcccgccagctgcgtttag

SEQ ID NO: 31264 - DNA, 750 bp, Artificial Sequence
  Description of Artificial Sequence: Synthetic coding sequence
atggatggaaaaaaatgctctgtgtggatgttcctccccttagtgtttacactgtttacgagtgccgggctctggatagtctattttatcgcagtagaggatgacaaaattcttcctctgaacagtgcagagcggaaaccaggggtcaagcatgccccctatatctccatcgccggagacgatcctcccgcctcctgcgtttttagccaggttatgaatatggcagccttcttggctctggtagtggccgtgcttcgattcattcagttgaagcccaaggttctcaacccgtggctgaatatcagcgggcttgtggccctctgtcttgccagcttcgggatgacactcctgggaaactttcaactgacgaacgacgaagagatccacaacgtggggacgtctttgacttttggatttgggacactcacatgttggatacaggctgccctgacccttaaggtgaatataaaaaacgagggcagacgtgtggggattccaagggtgatactgtctgcaagcattaccctgtgtgtggtgctttatttcattctgatggctcaatctatccacatgtacgccgccagggtccagtgggggctggtcatgtgctttctatcctactttgggactttcgccgttgagtttaggcactataggtacgagattgtgtgttccgagtaccaggagaattttctgtccttcagcgagtccctctcagaagctagcgagtatcagacggaccaagtgtag

SEQ ID NO: 31265 - DNA, 1407 bp, Artificial Sequence
  Description of Artificial Sequence: Synthetic coding sequence
atgcctgaggacggtgccggggacggaggtgaggttccagcccttatccctgacggcgaaccacttagagaagagcagcgtcctctgaaacagtccctaggctcgtctctgtgtagggagagtcactggaaatgtctcttgctgactctactgatccatgcctgcggagccgtcgtggcgtggtgcaggctcgccaccgtgccacgcctggtgttggggcctgaagctgcactggcccgaggagcgggcggacctccccctacatatccagcttcaccatgctctgatggttatctgtacattccgctggcttttgtctcccttctgtacctcctctatcttgccgagtgttggcattgccacgttagaagctgccaggcgccacggaccgatgctcacacagtgctagctttgattaggcggctgcagcaggctcccccctgtgtgtggtggaaggccacctcttaccattacgtgcgccgtaccagacagattactagatacaggaatggtgatgcgtatacaaccacccaagtgtatcacgagcgagctgatagtcgaaccgctcggggggagtttgactactctgcccatggcgtgcgcgatgtgtctaaggaactcgtaggacttgctgagcacgccgccacgcgcctgcgtttcactaaatgcttcagctttggatccgcggaggctgaagcttcctatctgacccagcgggcaagattttttagcgccaacgaaggattagacgactacctcgaggcccgcgaagggatgcatctcaaggatgtggattttcgcgaaagtctgatggtgttcgccgacccaaggtctcctccctggtacgcccgagcttgggttttttggctcgtatccgctgccactctgtcatggcctctccgagtggtggctgcctacggcaccgcacacgttcactaccaggtggagaagctgtttggtgcctcaagcccacccccaggtgcagtgccttctgggccgccgctctcaagggttgccactgttgatttcaccgaactcgagtggcacatctgttctaataggcagctcgtgccctcttactccgaagcggttgtgatgggtgcaggcagcggggcttacctacggggatgtcagaggtgcagacgcagcgtgtcttcaaattcacttccgcctgcaaggcctagcggacctcgcctgcccttcagccgctcaagactctcactgggtgcaggagggcgcgcaacaccaggggtcttccggagcctcagtggcggccctctgggacggcggggtgaggacactgagccgctggaatctcccccctgctacgaggacgccttgtacttcccagtcctgattgtgcatggcgactcaggatgccaaggggatgggcagggggctctttag

SEQ ID NO: 31266 - DNA, 669 bp, Artificial Sequence
  Description of Artificial Sequence: Synthetic coding sequence
atgagtccgccaggcagtgcagcaggagaatccgccgctggcggggggggtggaggtggcgggccaggagtgtctgaagaactaacagcggcggcagccgcggctgccgctgacgagggtccagcaagagaagaacagcgccccatccaaccttcgtttacaaaaagcttatgtcgggagtcgcattggaaatgcttattattgtcccttctcatgtacggttgcctgggggctgtggcatggtgtcacgtcacaacggtcacccgactgacctttagctcagcttaccaggggaacagtctgatgtaccatgatagcccctgctccaacggatatgtgtacatccctcttgcattcctgctgatgttgtatgctgtgtacctggttgagtgctggcactgccaggcgcgtcatgagctccaacaccgggttgacgtgtccagtgtgcgcgagagggtgggccgcatgcagcaggctacaccatgtatctggtggaaggcaatctcctaccattacgtcaggagaactcgacaagtgacccgatataggaacggcgatgcatataccaccacacaagttcccggttgcctgggttcccaggtcgtgcccctgaggtcgccatggcgcaacgcacagctggacgccggatctgacgaggagcctgcctag

SEQ ID NO: 31267 - DNA, 1701 bp, Artificial Sequence
  Description of Artificial Sequence: Synthetic coding sequence
atgtccccgccaggatcagcagcaggggagagcgctgccggcgggggtggaggtggggggggccccggagtgtccgaggagttgactgcagctgcggccgccgcggctgccgatgaaggtccggcgcgcgaggagcagaggccgatccagccgtcatttaccaagtcactgtgccgcgaatcacattggaaatgtttgttattgagtcttttgatgtacggttgtctcggcgccgtggcttggtgccacgtcaccacagtgacccgcttgacgttttctagtgcttaccaggggaactcactaatgtatcacgatagcccctgtagtaacggctatgtgtatatccccttagcttttctgcttatgttgtatgctgtgtatctggttgagtgctggcattgtcaggcccggcatgagctccagcaccgggtggatgtatcttctgtccgagagagggtgggcaggatgcagcaggcgaccccgtgcatttggtggaaggctattagctaccattacgtccgccgaacccggcaggttaccaggtataggaacggcgatgcctacacaacaacacaggtgtatcatgaacgggtcaacacccacgtggcagaggcagagttcgattacgctcgatgtggtgtcagggacgtgtctaaaacacttgtcggactggagggagcccccgccacccgacttcggttcactaagtgtttttctttcgctagtgtggaggccgagaacgcttacctgtgtcagcgggccaggttctttgccgagaacgaggggctggatgattacatggaggcccgggagggaatgcacttaaagaacgtcgacttcagggaatttatggtggcattccctgatcccgcccgccccccctggtatgcctgcagcagtgccttttgggccgccgccttactcaccctgtcctggccactgagagtgctggccgagtaccggaccgcctacgcccattatcacgtagaaaaactgttcgggttggaaggcccgggcagcgcatcttcagcgggagggggcctgtcaccaagtgacgagctgttacctccccttacacatcgattgcccagggttaataccgtcgatagtacggagttggagtggcacatccggagcaaccaacagttggtgccttcttattcggaagctgttctgatggatctggcaggcttaggtacccgctgtgggggcgcagggggcggatatgctccgagttgccgctacggcggagtcggtggccctggcgctgctggagtggctccttacaggcgatcctgcgagcactgccaaagggctgtgtcatcatcgtccatctttagtcggtcagccctgtcaatttgtgcctcaccaagggccggacccggacctggcggaggcgcaggttgcggcggcagcaggttttctttaggaaggttatacggaagccggagatcctgtctgtggaggtctcgttcgggatcagtgaacgaagcctcatgtccaacggaacaaacgcgattgagcagtcaggctagcatgggcgacgacgaggatgatgatgaagaagaagctggccctccccctccctatcacgacgccctgtactttcctgtactgattgtgcatcgacaagagggttgccttggccattcacacagaccactgcaccggcatgggtcctgcgttgaaacctcgctttag

SEQ ID NO: 31268 - DNA, 552 bp, Artificial Sequence
  Description of Artificial Sequence: Synthetic coding sequence
atgcaggcccccagggcagccctagtctttgccctggtaatagccctggttcccgtcgggcgcggtaactatgaggagctcgaaaattctggtgacacaaccgtcgaatccgagagaccaaacaaagtgaccattccaagcacctttgcagccgtgacgatcaaggagaccctcaacgcaaacataaattccacaaacttcgctccagacgaaaatcaactggagtttatcctgatggtcttgattcccttgattctgttagtgttactcctgctaagcgtcgtcttcttggccacctattacaaacgcaagaggaccaaacaggagccgagtagtcaaggcagccaaagcgcccttcagacttacgagctaggttctgagaacgtcaaagttcccatatttgaggaggatacccccagtgtgatggaaatcgagatggaggaacttgataaatggatgaattctatgaacaggaacgccgatttcgagtgtctgccaaccctcaaggaagaaaaagagagtaaccataatccgagtgacagtgaatcctag

SEQ ID NO: 31269 - DNA, 378 bp, Artificial Sequence
  Description of Artificial Sequence: Synthetic coding sequence
atgcaggccccccgggctgctttggtctttgctcttgtgattgccctggtgcctgtcggacgcgggaactacgaggaactggaaaactctggcgatacaaccgtcgaatcagaacgccctaacaaagtgacgatccccagtacttttgccgctgtaacgattaaagaaactctaaacgccaacatcaattctactaattttgctcccgacgagaaccagctcgagttcatcctcatggtcttgattcctctgatcctactggtgctgctgctcctgagtgtagtgttcctcgccacctactataagcgcaaacggaccaaacaagagccctcctcacagggatctcagtccgctcttcagacttaccttttggtgtag

SEQ ID NO: 31270 - DNA, 891 bp, Artificial Sequence
  Description of Artificial Sequence: Synthetic coding sequence
atgacaaagaccgctctgctgaaattatttgtggcgattgtgattactttcattctaattttgcctgaatattttaagacgccgaaggagcgcaccttagagctgtcctgcctggaggtctgccttcaatctaattttacttacagcttgagctctctgaacttttcattcgttacctttcttcagcccgtccgagaaacccagatcatcatgaggatcttccttaatccttcaaatttccgcaacttcacaaggacttgtcaggacataacaggcgagtttaaaatgtgctcatcatgtttggtgtgcgaatcaaagggaaacatggacttcatctcccaggagcagacaagtaaggtgctcatcaggcgcgggtccatggaggtgaaagcaaacgattttcattctccttgccagcactttaatttctcagtggcacctctggtagatcacttggaagagtataacaccacatgtcatctcaaaaatcacaccggcagatcaaccatcatggaagacgagcccagcaaggaaaaatcaatcaattatacttgccgcattatggagtaccccaatgactgcattcacatcagccttcatctggagatggacataaaaaatataacttgttcaatgaagattacttggtacatcctggtcctgcttgtgttcatatttttgatcatcctcactattagaaagatcttggaaggacagcgccgcgtgcaaaagtggcaatcgcaccgagataaacctactagtgtactgttgaggggctctgacagtgaaaaactcagggctctgaatgtgcaggtcctgagcgccgagacgacacagcgactgccattggatcaggttcaggaggttcttccccccatcccggagctgtag

SEQ ID NO: 31271 - DNA, 567 bp, Artificial Sequence
  Description of Artificial Sequence: Synthetic coding sequence
atgggtgggggttggtggtgggcgcgcgcggctagacttgcacgcctgcgctttcggcggtcgcttctgccgccgcagcggccgaggagcggcggcgctcggggcagctttgctcctggccatggaccaagggcgggggccagccctccacctgtttctgagcttgacagggcagacgcctggctactcagaaaagctcatgaaacagcctttctgtcctggtttaggaacggcctgttagccagtggcattggggtgatatcctttatgcagagcgacatgggtcgagaggcagcgtacgggttttttctccttggaggcctctgtgtggtttggggctctgcttcgtacgcagtcggcctggcagcgttacgtggccctatgcagctgaccctgggaggtgctgccgtaggcgccggggcggtcttggctgctagtctgctctgggcctgcgctgtaggattatacatgggacagctcgaattggacgtggaactggttcctgaggatgacggaaccgcttccgctgaaggccctgatgaggctggcagaccaccacccgagtag

SEQ ID NO: 31272 - DNA, 1440 bp, Artificial Sequence
  Description of Artificial Sequence: Synthetic coding sequence
atggcagtgctgggagttcagttggtagtcacactactgactgccacattgatgcataggctcgcaccccactgcagctttgcacgctggttactgtgtaatgggtccctcttccgttataagcacccttctgaagaagaactgcgcgcactagccggaaaacctagaccgaggggccgaaaagagcggtgggccaatggactctctgaggagaaaccactgagcgtgccacgggatgccccatttcagctggagacctgtcccctgaccacagttgacgcactggttttgaggttcttcctagagtaccaatggttcgtggattttgcagtgtattctgggggagtgtatctcttcactgaagcttactattacatgttgggaccagccaaggaaacgaacatagccgtgttttggtgtctcctgacagtgacatttagtattaagatgtttctgacggtaactcgtctgtacttcagcgctgaggagggcggagagaggtccgtgtgtcttacctttgcgtttcttttcctgctgctagccatgcttgtccaggtcgtccgggaagagacccttgagcttggtcttgaacctggtctagctagcatgactcagaatcttgaaccgctgctgaaaaaacaaggctgggactgggcccttcccgtagctaaactagctatccgggtgggcctggccgtcgttgggagtgtgcttggtgcgtttctaacattccccggactgcgactcgcacaaacgcaccgggatgctctcaccatgtcagaggatagaccgatgctacagtttctcctccacacctcttttttatctccgctcttcatcctgtggctgtggaccaagcctattgcaagagattttctccaccagccaccattcggagagacccgattttccctcttgtctgattccgcatttgattccggcaggttgtggttacttgtggtgctgtgcctgctccgcttggccgtgacacggccccatctgcaggcatatctatgtcttgccaaggctcgagtcgaacaactccgacgcgaagctgggcgaatagaagcccgtgagattcagcaaagggtagtgagagtctactgctatgtcaccgtagttagcctgcagtacctcacaccgctaatcctgaccctgaactgtacgctgctgctgaagactttgggcggctacagctggggcctaggacccgccccactgttatcccccgatccatcatctgcaagcgctgctccgattggaagtggggaggacgaagtgcagcagacagccgcaagaattgcaggcgccttaggcggacttctcactccccttttccttagaggagttttggcgtacttgatttggtggacagccgcttgtcagcttctggcctccttgtttggtctgtacttccatcagcacctagccggctcttag

SEQ ID NO: 31273 - DNA, 1131 bp, Artificial Sequence
  Description of Artificial Sequence: Synthetic coding sequence
atggccgtgctgggggtccagctggttgtgaccttactgacggccacgctgatgcatagattggccccacattgttcatttgctaggtggctgctgtgtaatggatctctgttccggtataaacacccttccgaagaggagcttagggccctcgccggcaagccccgtccaagagggagaaaggagagatgggccaatggtttgtcagaggagaagcctctgtccgttccgcgcgacgccccttttcagctggagacttgcccgctcacaacggtagacgccctagggctggctagcatgacgcagaatctggaacctctactcaaaaagcagggctgggattgggctttgcctgtggcaaaattggcaatcagagtgggcctggcggtcgtcggcagtgtgctaggcgcattcctcacattccctgggttgagactggcgcagactcatagggacgcgcttacaatgagcgaggatcggccaatgctgcagtttctcctccacacgtccttcctgagcccgctgttcattctctggctctggacaaaacccatcgcgcgtgatttcctgcatcagcccccatttggtgaaactcgattttctttactgtccgactccgcctttgatagcgggcgcctgtggctgcttgtggttctgtgtctactgcggctcgcagtgaccagaccacacttgcaggcatatctgtgtctggccaaagctcgcgtagagcagctcagacgcgaggccgggaggattgaggcgagagaaatccagcaacgagtagtgcgggtatactgttatgtaacagttgtgtccctccagtatctgaccccccttatactgacccttaactgtactctgctgctcaagactctggggggatacagttggggtctgggtccagcccctctgctcagccctgacccttcaagcgcatccgcggccccaataggctctggcgaggacgaagtccagcagactgctgccagaatcgccggggcccttggcggcctgctcacgcctctgtttcttcgaggagttctcgcgtatttgatttggtggacagccgcttgccagctcctcgcaagcttgtttggactgtatttccatcaacacttagctgggagctag

SEQ ID NO: 31274 - DNA, 1464 bp, Artificial Sequence
  Description of Artificial Sequence: Synthetic coding sequence
atgggggtaattggtatacaactggtagtcacgatggtgatggcatcagtgatgcaaaagatcataccacattacagtcttgctaggtggctgctgtgcaacgggagtctgcgttggtaccagcacccgacggaggaggaattgcggattctggcgggaaaacagcagaagggaaagaccaagaaagatcggaagtacaacgggcacattgagtcgaagcctctgacgatacccaaggatatcgatctgcatctagagaccaagtccgttaccgaagtggatacgttagctttacactacttccctgagtaccaatggcttgtcgacttcacagtggccgcgaccgtcgtatatcttgtgacagaagtctattataatttcatgaaacccacacaagagatgaacattagtctcgtgtggtgcctgctggtgctcagctttgcaatcaaggtgctcttctccctgactacgcactattttaaggtggaggatggaggggagcgatccgtgtgcgtgactttcgggtttttctttttcgtcaaagcgatggcggtccttattgtcacagaaaactatttagagtttggactggagacaggcttcacgaacttctccgattccgcaatgcaattcctggagaaacagggcctagaatcacagagtcccgtatccaagctgacattcaaatttttcctggcgatcttctgttcatttataggagcctttcttaccttccccggtctaaggctcgcacagatgcacctggatgctctgaaccttgcaacggaaaaaatcacacaaaccctattacacatcaatttcttggcccccctttttatggtcctcttgtgggtgaaaccaattaccaaggactatattatgaatcctcctctgggtaaggaatctattcctctgatgacagaagccacatttgatactcttaggctgtggctcattattcttctctgtgccttgagactggccatgatgcggtctcacctacaggcatatctaaacctggcccagaagtgcgtggatcagatgaaaaaggaggctggcaggattagcacagttgaactccagaagatggtggccagagtcttctattatttgtgcgtgatcgccttacaatacgtggcgccactcgtgatgctcctgcatacaactctcctgctgaaaacactcggcaaccatagttggggaatttacccggaaagcataagtacactgcccgtggacaatagccttctctccaattccgtttacagcgaactgcccagtgccgagggtaagatgaaggtcaccgtgacccagatcacggtcgccctaagctcactgaaaaatatctttacaccactgctgttccgcggactcctgagcttcctcacatggtggatcgccgcgtgcctgttcagcactagcctgttcggactcttctatcaccagtatctgaccgtggcctag

SEQ ID NO: 31275 - DNA, 924 bp, Artificial Sequence
  Description of Artificial Sequence: Synthetic coding sequence
atgggagtaatcgggatacagttggtggtgaccatggtgatggccagcgtaatgcagaaaatcatccctcattactccctcgctcgatggcttctgtgcaacggctctctcaggtggtaccagcatccgacagaggaggaactgcgtatactcgccgggaagcagcagaagggtaaaaccaaaaaggataggaagtataacggtcacatagagagtaaacccctaacaatacccaaggatatcgacctgcacctggaaacaaagtctgtcacagaggtagatactctcgctctgcactattttccagagtatcagtggctggttgacttcaccgtagcggccacagttgtgtatcttgttactgaggtgtactataatttcatgaaacccacacaggagatgaacatcagcctggtctggtgcctgttggttctgagctttgctatcaaggtgctatttagcctgacaacacactattttaaagtcgaggacggaggcgagcggagtgtttgtgtgacctttgggttttttttcttcgtgaaggctatggctgtcttaattgtgacggagaactacctagagttcggactggaaacaggctttaccaactttagcgactccgcaatgcagttcctcgagaagcaaggactggagtcgcaatctcccgttagcaaattaacattcaaattctttctggcaatcttttgtagttttatcggcgccttccttactttccctggcctccgactggctcagatgcatctagatgccctgaatcttgcgaccgagaagattactcagacactattgcacattaacttcttggcacctttattcatggttcttttatgggttaagcccatcacgaaggactatattatgaaccccccgctcggtaaagagatttcccccagtggcagatag

SEQ ID NO: 31276 - DNA, 870 bp, Artificial Sequence
  Description of Artificial Sequence: Synthetic coding sequence
atggagcccgcggcagggatccagaggcgatcctcacaaggcccgactgtacccccaccaccccgggggcatgcaccccctgccgccgcgcctgggcccgcgcctctgagtagcccggtaagggaaccgccgcagctcgaggaagaaaggcaggtgaggatctcagagtcgggtcagttctcagacggactcgaggataggggcttactggagtcgagtactaggctgaagcctcacgaggctcaaaactatcggaagaaagccctgtgggttagttggttctccattatcgttaccctggcactggcggtagctgcgttcaccgtgagtgtgatgaggtactccgccagtgcatttggcttcgcctttgacgccattctggacgttctgagctccgcaatcgtgctttggaggtatagtaacgctgctgctgttcacagtgcccaccgagaatacattgcttgtgttatactgggtgtgatctttctgctgtccagcatctgcatcgtagtgaaggccatacacgatctatcaactaggctgctccctgaggttgatgacttcctgtttagcgtgtcaatcctctctggcattttgtgctcgatcctcgccgtgctcaagtttatgctgggtaaggtgctaacaagcagggcacttatcacggacggctttaattcgttagtaggtggtgtgatgggtttttctattctcctgtcagctgaggtgttcaagcacgactccgccgtgtggtacctggatggatcaatcggcgtactgattggactaactattttcgcatatggtgtcaagctgctgattgacatggtcccccgcgtgcggcagacacgccactatgaaatgtttgagtag

SEQ ID NO: 31277 - DNA, 279 bp, Artificial Sequence
  Description of Artificial Sequence: Synthetic coding sequence
tgtggcatgtcacgcagcggacttctcgagtcaagtactcgacttaagccccatgaggcacaaaactaccgcaagaaagccctctgggtgagctggttttcaatcatcgtcaccctagctcttgccgtggccgccttcacggtgtcggttatgagatacagtgctagtgccttcggcttcgcttttgacgctattctcgatgtactgtccagtgcgatagtactgtggcgctactccaacgctgctgccgtgcatagcgcccacagggagtacatgtag

SEQ ID NO: 31278 - DNA, 777 bp, Artificial Sequence
  Description of Artificial Sequence: Synthetic coding sequence
atgtcccgctactcttaccagtcacttctggactggctgtacgggggggtggacccctcgttcgcagggaacggagggcccgactgtgcagcgtttctttcttggcaacagcgtttactcgaaagtgtagtggtgctcacactcgccctgttagagatacttgtcgcattgaggcatatactgaggcagacaaaagaggacggccgggggagtccaggcagtcagcctgaacaggttacgcagcgacccgaggaagggaaagaatccctgtctaagaatttactgctggttgcactctgcctcacatttggggtcgaagtgggattcaagttcgccaccaagaccgtgatatatcttctcaacccctgccatctggtgacaatgatgcacctgccctttgaactagagatttactacatacagcatgtaatgctctatgttgttccaatttatttgctgtggaagggaggcgcctacaccccagagcccctatcatcatttcgctgggctttgctttccaccgggctcatgttcttttaccatttcagtgttctgcagatcctaggcttagtaacagaggtcaaccttaataacatgctgtgcccagctatctcagacccgttctacggaccctggtacaggatctgggcatctggacaccagaccctcatgactatgactcatgggaagttagtgattctgttttcctatatggccggccctctgtgtaaatatcttttggacctgctccgcctgcccgctaaaaaaattgattag

SEQ ID NO: 31279 - DNA, 894 bp, Artificial Sequence
  Description of Artificial Sequence: Synthetic coding sequence
atgagtcgctattcttatcagtcattactagactggctttacggtggagtcgatccaagttttgccggaaacggcgggcccgattgtgccgccttcttgtcctggcagcagaggctgctggaatcagtggtagtgctgaccttagccctgctggagatcctggtggctctgcggcacattcttaggcaaacaaaggaggacggtagaggctctcctgggtcccagcctgaacaggttacccagagacccgaggagggcaaagagtccctgtcaaaaaacctgttgcttgttgctctgtgtcttacttttggcgtggaggtcggttttaagttcgcaacaaaaactgtgatttatctcctaaacccttgccacctagtgactatgatgcacatctttctgctggcctgtcctccctgccgaggggctattgtggtgtttaagctgcagatgcacatgctgaatggggcactgttggcactcctgttccccgtggtgaacacccggcttcttcccttcgagctcgagatctattatatacagcacgtgatgctctacgtggtgccgatttacctgctatggaagggcggggcttacactccagagcccctgtcgagtttccgctgggctttattatccacggggcttatgttcttttaccacttcagcgttcttcaaattcttgggttggtaactgaggtgaatttgaataacatgctctgccccgcaatcagcgaccccttttatgggccctggtatcgcatttgggctagcggccatcaaacactgatgacaatgacgcatggaaagttggtgattctcttcagctacatggcagggccactatgtaagtaccttctcgacctgctgcggctccccgccaaaaagatcgattag

SEQ ID NO: 31280 - DNA, 447 bp, Artificial Sequence
  Description of Artificial Sequence: Synthetic coding sequence
atgcacatgcttaatggggccttgctcgctctgctcttccctgtggtgaataccaggctcttaccctttgaattagaaatttattacatccagcatgtgatgctctatgttgtcccaatctacctcctgtggaaaggcggagcatacaccccagaacccctgagctcgtttcggtgggccctcctgtctaccggacttatgtttttctaccacttctctgtcttgcagatacttggacttgtgactgaagtcaatctcaataacatgctgtgtccagccattagcgaccccttctacggcccctggtaccggatttgggccagcggacaccagacacttatgactatgacacacggcaaacttgtcatcctctttagctacatggcgggcccattatgtaagtacctccttgatctgttgaggcttccggcaaaaaagattgactag

SEQ ID NO: 31281 - DNA, 894 bp, Artificial Sequence
  Description of Artificial Sequence: Synthetic coding sequence
atgagcaggtactcttaccagagcctgctcgattggttgtacggtggggtggatccttcgtttgctggtaatggaggccctgactgtgcggcgttcctgtcttggcagcagagacttctcgaaagcgtcgtcgttttaaccttagccctactggagatcctcgtagcgctgcgccatatcctcagacagaccaaagaagatggcagaggatctcccggatcccagcccgagcaagtgacccagcggcctgaagagggcaaggaaagcctcagcaaaaacctattactagtcgctctgtgcttgacctttggggtggaggttggcttcaaatttgcaaccaaaacggtcatctatctcttaaatccatgtcatttagttaccatgatgcatattttcttgcttgcctgtccaccctgtcgcggggcaatcgttgtctttaagcttcagatgcatatgttgaacggagccctgctcgcattgctgtttcccgttgtgaatacccgtctgttgccctttgagctcgagatttactatatccagcacgtgatgctctacgtggtgccaatctatttgctgtggaaaggaggcgcgtacacccctgagcctttgtcttctttccgttgggctctgctaagtactgggctcatgttcttctatcacttcagcgttttacagatactgggactggttactgaggtgaacctgaacaatatgctttgccctgccatctcagatcccttctacggaccatggtatcggatctgggccagcggacaccagacactgatgactatgactcacggcaaactggtcatcctgttcagctacatggctggccctctctgtaagtaccttctggatttgctgcgcttaccagcaaagaagatcgattag

SEQ ID NO: 31282 - DNA, 777 bp, Artificial Sequence
  Description of Artificial Sequence: Synthetic coding sequence
atgtcccgatattcctatcagtccctccttgattggctttacggaggggtggacccttcttttgcaggtaacggaggaccggattgtgcagccttcctctcctggcagcagaggctgctggagagcgtagtggtgctgactctggccctgctggaaatcctcgtcgctttgagacatattctgcgacaaactaaggaagacggaagagggagtcccggatcccagcctgaacaggttactcaacggccagaggaaggaaaggaatccctgagcaagaacctgcttttggttgctttatgcctcacctttggggtcgaggtcggatttaagtttgccacaaagactgtgatctatcttctgaatccctgccacctggtaacgatgatgcacctgcctttcgaactcgaaatctactacattcagcatgttatgctctacgtagtacctatctaccttctttggaaagggggtgcttacacaccggaaccactgagtagtttccggtgggcgttgctgtcaactggactgatgtttttttatcatttttctgtgcttcagattctcgggcttgtgacagaggtgaacctgaacaatatgttatgcccggcaatctccgacccattttacggaccttggtatcgtatctgggcaagcggacaccagacactgatgaccatgacccacgggaaactggtaatactgttctcctatatggccgggccactttgcaaatacctgctggatctactgaggctcccagctaagaaaatagattag

SEQ ID NO: 31283 - DNA, 975 bp, Artificial Sequence
  Description of Artificial Sequence: Synthetic coding sequence
atggccgccgcagccccgggcaacggccgtgcttccgctcccaggctcctattgctgttcttggtgcctcttctgtgggccccggctgcggtgagggccggtccagacgaggacctgagtcacaggaataaggagccccccgcccccgcccagcagctccaaccgcagcctgtcgcggtccaggggcccgaacctgcaagggtcgagaagatttttactccggccgcccctgtccacacaaacaaagaggatccggcaacacagacgaatttagggttcattcatgccttcgtcgcagcaattagcgtgataattgtcagcgagttaggcgataaaaccttttttatagctgcaattatggctatgcggtacaatcgcctgacggtcttagcaggcgccatgttagcgctgggcctcatgacctgcctatccgtcctgtttggttatgccaccaccgtcattccaagagtttatacttactatgtgtctacggttctcttcgccatattcggtattagaatgctcagagagggcctcaaaatgagccctgacgaaggtcaggaagaacttgaagaagtccaggctgagctaaagaaaaaggacgaggaattccaaagaaccaaactactgaacggaccaggagatgtggagacaggtacctccatcacagtgccccaaaagaaatggctgcactttattagtcccatttttgtgcaagccctgaccttgacattcttggcagagtggggtgacagatcacagctgactactattgtcttggccgcacgtgaggatccgtatggcgtggccgtgggagggactgtcggccactgtctctgcactggtctggctgtaataggcggtcggatgatcgcccagaaaatcagtgtgcggaccgtaaccattattggggggatcgttttcctggcttttgcatttagcgctctcttcatcagcccagacagcggcttctag

SEQ ID NO: 31284 - DNA, 786 bp, Artificial Sequence
  Description of Artificial Sequence: Synthetic coding sequence
atggaaatccccatgcaaaaaatatttactcccgcagctccagttcatactaataaagaggatcccgccacccagacgaacctcggctttatccatgccttcgtcgccgctatatccgttataatcgtcagcgagctgggcgataagactttttttatcgcagccattatggctatgaggtacaatcgcctcactgttttggcaggtgcaatgctggcactaggcttgatgacttgtttatccgtactctttggatatgcgacaacagtgatccctagggtgtacacttattatgtcagcaccgtgttgtttgctattttcggcattcgcatgcttcgggaaggcttgaaaatgagccctgatgaggggcaggaggaactggaggaggtgcaggctgaactgaagaagaaggatgaagaatttcagcggaccaagctgttgaatggcccaggcgacgtggagaccggaacatccatcacagtgccacaaaagaaatggctgcatttcatctcccccatttttgtgcaggctctgaccctgacatttctggccgaatggggggaccggtcacagctcacaacaattgtgctcgccgcccgagaggatccttacggcgtggccgtcggcgggacggtcggacattgcctatgcactggtctcgccgttatcggaggtaggatgatagcacagaaaatttcggtaaggactgtaaccatcatcgggggcatcgtgttccttgcattcgcattcagtgccttattcattagtcctgacagcggattctag

SEQ ID NO: 31285 - DNA, 219 bp, Artificial Sequence
  Description of Artificial Sequence: Synthetic coding sequence
atgagtgctatcttcaacttccagagtctgctaactgtgattcttctgttgatctgcacctgcgcctatatcaggtcactggcgcccagcctgctggataggaacaagacaggcctgctgggaattttctggaagtgcgctcggattggcgaaaggaaatcaccatatgtggccgtgtgctgcattgttatggcttttagtatcctctttatccagtag

SEQ ID NO: 31286 - DNA, 225 bp, Artificial Sequence
  Description of Artificial Sequence: Synthetic coding sequence
atgacaaatgtgtattctctggatggtatacttgtgtttgggctgctgttcgtttgcacctgcgcatacttcaaaaaagtgcccagattaaaaacctggctgctctccgagaaaaagggcgtttggggagtgttttacaaggctgccgttatcgggacaaggctgcatgcagctgttgccatcgcatgcgttgtgatggcattttacgttctctttattaagtag

SEQ ID NO: 31287 - DNA, 2094 bp, Artificial Sequence
  Description of Artificial Sequence: Synthetic coding sequence
atgtgcaaaagccttcgttactgcttttcccactgcctttacctggctatgactcggctggaagaggttaacagagaggtgaacatgcactcctccgttagatacttgggatatctggcaagaattaatctgctcgtagccatatgcctgggtttatacgtccgctgggaaaagaccgcgaactcgctgatccttgtgatattcattctaggcctatttgtgctgggtatagcttctatactgtactactatttttctatggaggcagcctccctgtccctgtctaacctctggtttggcttcctgcttgggctcttgtgcttccttgataattcctcatttaagaacgacgtcaaggaagagagtactaagtatcttctgttgacctcaatcgtgttgaggatcttgtgctccctggtagagagaatcagcggctacgttagacaccggcccacactgctgactacggtggaattcctagagcttgtcggattcgcgattgcgtctaccactatgttagtcgaaaaatcgttgagcgttatcctgctggtggtggcccttgctatgttgattattgacctccggatgaagtcgttcctcgcgatcccaaacctcgtgatattcgctgttctgctatttttttcaagtttggagacacccaaaaacccaattgccttcgcctgcttctttatatgtcttattacggatccattcttggacatctacttttcaggcttaagcgttactgaacgctggaaaccgttcctgtaccgtggccgtatctgccgtcgtctatctgttgttttcgctgggatgatcgagctcacgttcttcattttgagtgcatttaaattaagagacacccatttatggtactttgtgatccccgggttctcaatatttggaatcttctggatgatttgtcacattattttcctgctcaccctgtgggggttccataccaagctgaacgattgccataaagtgtattttacccacagaacagactacaatagtctggataggatcatggcttcaaaaggcatgcgacacttctgcttgattagcgaacaattagtctttttcagcctgctggctacagccatccttggagccgtctcctggcaacctactaacggcattttcttgtccatgtttctgatcgtgcttcctctcgagtcaatggcccacggtctgttccatgagctgggcaattgtcttgggggaacaagcgtcgggtacgctatcgtgatcccaacaaatttttgcagcccggatggacaacctacgctcctaccccccgagcatgtgcaagagcttaatctgcgaagcacaggaatgctaaacgctattcagcggttttttgcataccacatgatcgagacctatggttgtgactactccacctctggtctttctttcgacaccctgcacagcaagctgaaggctttcctggagctcaggacggtcgacggtcctcgtcacgacacttatattctgtactacagcgggcacacccatggcaccggtgaatgggccctggcagggggcgatacactgcggttagacaccttgattgagtggtggagggagaaaaacggcagtttctgcagtaggctgatcatagtccttgattcggagaattctactccatgggtgaaggaagtcagaaagatcaacgaccagtatatcgctgtccaaggtgctgaactgatcaagaccgtggatatcgaggaggcggaccccccccagctgggagattttactaaggactgggtagagtataattgcaacagttcgaataacatctgttggaccgaaaaggggaggaccgtgaaggccgtctatggcgtgagtaaaaggtggagtgactataccctgcatctgcccactgggtcagacgtcgccaagcactggatgttgcattttcctagaatcacttatccactggtgcatctggcaaactggctctgcggtcttaacctgttctggatttgcaaaacatgtttccgctgcctgaaaaggttaaaaatgtcttggttcctcccaaccgtactggacacaggacaagggttcaagctggtgaaaagttag

SEQ ID NO: 31288 - DNA, 942 bp, Artificial Sequence
  Description of Artificial Sequence: Synthetic coding sequence
atgtttctgatcgttctacccctggaatcgatggcccacgggctgtttcacgaattggggaattgcctggggggaacaagcgtaggctatgccatagttataccaaccaacttttgctctcctgacggtcagccaacattgctgcccccagaacacgtgcaagaactgaacctgaggagtacagggatgcttaatgcaatccagaggtttttcgcctaccacatgatcgaaacctatggctgtgactatagcacaagtggtctgtccttcgacaccctgcatagcaaactcaaagccttcctggaactgcggaccgtggacggccctcgacacgatacatacatcctgtattactctggtcacactcacggaacaggcgagtgggctcttgctggcggcgacactctgcggctggacacactcattgagtggtggcgggagaagaacggttctttctgcagcagactgatcatcgttctggactcggagaactcaaccccctgggttaaagaagttcgaaagatcaacgatcagtacatcgcggtccagggcgctgaactcatcaagacggttgacattgaggaggccgaccctccccaacttggcgacttcaccaaggattgggtggagtacaattgcaattcttctaacaatatctgctggacagagaaggggaggacggttaaggccgtgtatggcgtgtctaagcgctggtccgattatactctccacctccccacaggcagtgacgtcgcaaaacactggatgctgcacttccctagaataacatatccccttgtgcacttggctaattggctgtgtggcctcaacttattttggatatgtaagacctgtttcagatgcctgaaacgattaaagatgtcttggttccttcctaccgtgctggacacaggacagggttttaaattagttaagtcctag

SEQ ID NO: 31289 - DNA, 2094 bp, Artificial Sequence
  Description of Artificial Sequence: Synthetic coding sequence
atgtgtaaaagcctaaggtactgcttcagccactgcctgtacctggcgatgaccagactggaggaggtgaaccgggaagttaatatgcactccagtgtgagataccttggctacctggcacgtatcaacctgttggtagcaatatgcctgggcctgtatgtccgctgggaaaagaccgctaattctcttatcctggtcatctttatcctgggtctattcgtgcttggcatcgcctcaatactgtactactatttctcaatggaggctgcctccctctccctgtcgaatttgtggttcggtttcctactgggccttctctgctttttagacaattccagtttcaagaatgatgtaaaggaggagtccacaaagtatttgttgctgaccagtatcgtcttgcgcatcttgtgcagcttggttgagagaatctctgggtacgtgaggcatcgaccaacgctgctcaccaccgtggaatttctcgaactggtgggctttgctatcgcctctacaaccatgctggtggagaagtctttgtccgtcattctgttagtcgtggcgctcgcaatgttgatcattgacttgcgcatgaaatctttcttggctattcctaacctggtgatcttcgccgtgttgctgttctttagcagccttgagacccccaagaatcctatcgcattcgcgtgcttttttatctgcttgattactgatccatttcttgatatctacttttccgggctgagtgttactgagagatggaaacccttcttgtatcggggaaggatctgcaggagactcagtgtcgtctttgccggtatgatagagctgactttcttcatattgtccgcgttcaagctccgagatacacacctgtggtattttgtgatcccgggtttttccatatttgggatcttctggatgatctgccatattatctttctgttaacactctgggggtttcataccaagctgaacgattgccacaaagtatactttactcaccgaaccgactacaactcacttgataggataatggcctctaagggcatgagacacttctgcctgatcagtgagcagttggtgttcttctcattgctggccacagcaatactcggcgctgtgagctggcagcccaccaatggaatctttctctcgatgtttctgatcgtactcccactggagtcgatggcacatggactctttcacgaactggggaactgcctgggcggtacttctgtgggctatgccatcgtcatccccacaaacttttgctcccctgacggccaacctactttactcccccctgagcacgtacaggaattaaatctccgtagcactggcatgctgaatgcgatacagagattctttgcctaccacatgatagaaacatatggttgtgactattccacctctggcctatcttttgacaccctgcactctaagctgaaagcattcctggaactcaggacagtagacgggcctcgccatgacacttatatactgtattactccggtcatactcatgggacaggtgaatgggcactagccggtggcgatacactgcggctcgacacactaattgagtggtggagagaaaaaaatggttccttctgcagtcggttaatcattgtcctggattctgagaattccacaccctgggtgaaagaagtgaggaaaataaacgaccagtatatcgctgtgcagggcgctgagctcatcaagaccgttgatatcgaagaagccgacccgccccagctgggggactttacgaaggactgggttgaatataactgtaatagctctaacaatatctgctggaccgaaaaggggagaacagtgaaagctgtttacggggtctcaaagagatggtctgactataccttgcacttaccaaccggctccgatgtagccaaacactggatgctccacttccctcgcatcacttaccccctggtgcacctggcaaactggctttgcggcctcaacttattctggatttgcaagacctgctttcggtgccttaaacggctcaagatgtcctggttcctgcctacagttctggataccggccaggggttcaaactcgtgaagagctag

SEQ ID NO: 31290 - DNA, 894 bp, Artificial Sequence
  Description of Artificial Sequence: Synthetic coding sequence
atggaggaacccaccgcagtggaggggcaagttcagttgccatcgccccatcagggttctctgcgcaaggccgtggcagccgcgttggcacttgacggcgagtctactatgggccaccggaagaaaaagagaaaggagagtcggcccgaatccattattatataccgatctgacaatgaaaagaccgatgaagaacccggggagagtgaaggaggggatcaaccgaaagaggaggagggagatgatttccttgattatccagtggacgacgacatgtggaatctccctctggatagccgttatgtgaccctgacaggtaccattacgcgtggcaaaaagaagggtcaaatggttgacatccatgtaaccctgactgagaaggagttacaagagttaacaaaaccaaaagagtccagtcgagagacaactccagagggtcgcatggcctgtcagatgggcgccgatagaggacctcacgttgtgctgtggactctgatctgtttgcctgtcgtttttatcctgagctttgtagtgagcttctattacggaacaatcacttggtataacatttttctggtctacaacgaagaacgcaccttttggcataagatctcctattgtccatgcctcgtgctgttttaccccgtgcttatcatggctatggcaagttcccttggcctatacgcagctgtggtgcagttaagctggtcctgggaagcatggtggcaggccgccagagacatggagaagggattttgcgggtggctgtgtagcaaactcggtctcgaggattgttctccatattccatcgtagagctgctggaaagcgacaatatctccagcaccttgtccaacaaggatcctatccaagaagtggaaacttccacagtttag

SEQ ID NO: 31291 - DNA, 894 bp, Artificial Sequence
  Description of Artificial Sequence: Synthetic coding sequence
atggaggagccaactgccgtggaaggccaggttcaactgccctctccacaccaagggtcgctcagaaaggccgtcgccgccgcactcgctctagatggtgagagcactatgggtcatcggaagaagaagagaaaggagagccggcctgaatctattattatttacagatccgataatgagaagacagatgaagagccaggcgagagtgaagggggggatcagcctaaggaggaggagggcgatgacttcttagactaccctgttgacgacgatatgtggaacctccccttggactcgcggtatgtcaccttaaccgggaccatcacacggggcaagaaaaaagggcaaatggtcgacattcatgtcaccctgaccgagaaagaactgcaggagttgaccaaacctaaggagagcagcagagagactacccccgagggtagaatggcttgccaaatgggagccgaccgagggccgcacgtggtgctctggacactgatttgccttcccgttgtgtttatactgtcctttgtcgtatcattttactacggtaccattacttggtacaacatattcctggtgtacaatgaagagcgtaccttctggcacaaaatttcttactgtccctgcctggtgctgttctacccagtgctcatcatggcgatggccagctctttgggcctatatgcggcagtcgtacagctctcctggagttgggaagcctggtggcaggctgcaagggatatggagaagggtttctgcggctggctatgctccaagttaggacttgaggactgcagcccatacagtatcgtggagcttctagagagtgacaatatcagtagcaccttgagcaacaaggatcccatccaggaagtggaaacctcaacagtgtag

SEQ ID NO: 31292 - DNA, 351 bp, Artificial Sequence
  Description of Artificial Sequence: Synthetic coding sequence
atggaggaaccaacagccgtcgaaggtcaggtgcagctgccttctcctcatcagggcagcctccgcaaggcagttgccgcggctttggcccttgacggggaatctaccatgggccacagaaagaaaaaacgtaaggaatccaggcccgagtccataatcatttatcggtccgataatgaaaagactgacgaggagccgggggagtccgagggcggggaccagccgaaggaggaggagggtgatgacttcctcgattatcctgtggacgatgacatgtggaacctgcccctggatagccgatatgtgaccctgacagggactatcactaggggaaaaaagaaagggcagtag

SEQ ID NO: 31293 - DNA, 894 bp, Artificial Sequence
  Description of Artificial Sequence: Synthetic coding sequence
atggaagaacctacagctgttgaggggcaggtgcagctccccagcccacaccagggatcactgcgaaaagccgtagccgccgctttagcgctagacggggaaagcaccatgggacatagaaaaaagaaaaggaaagagagccgaccagaaagcattatcatataccgatcagataacgagaagactgacgaggagccaggagaaagtgagggcggcgatcagcccaaagaggaggaaggcgatgatttcctagactaccccgttgacgacgatatgtggaaccttccactggacagccgttacgttacgctgacggggactattacgaggggcaaaaagaagggccagatggtggatatacacgttactctgactgagaaagaactccaagagctcaccaaacccaaagaatcctcccgcgagacaacaccagaaggcagaatggcctgtcagatgggcgctgatcgcggtccacacgtggtgttgtggaccctgatttgcctccctgtcgtgttcatcctgtccttcgtcgtctccttttactacggaaccattacctggtacaacatcttcctggtctacaacgaggaacggacattttggcacaagatctcttactgcccttgcctagtgttattttaccccgtgctgatcatggccatggcgagctctctcggtctttatgccgcggtggtacagctttcttggtcttgggaagcctggtggcaagcggctcgggacatggagaaaggattctgcgggtggctctgtagtaagttagggctcgaggactgttccccatacagtattgtggagctgttagaaagcgataacatctcctccactttatcaaacaaagatccaattcaggaggttgaaacctccacagtgtag

SEQ ID NO: 31294 - DNA, 894 bp, Artificial Sequence
  Description of Artificial Sequence: Synthetic coding sequence
atggaggaacccacagcagtagaaggacaggtgcagctgcctagcccgcatcagggctcactccgaaaagcagttgcggcagcactggccctggacggggaatccacaatgggtcatcgcaaaaagaaacggaaagagagcaggccagaatcgattattatctacaggtccgacaatgaaaagacagatgaagagccaggcgagtcagaggggggtgatcagcctaaagaagaagaaggcgacgattttctagattaccccgtcgacgatgatatgtggaacctgcctctcgacagtcggtatgtcactctcacaggcactataacacgaggtaagaagaagggccagatggtggacattcacgtgaccctgacggagaaagaactgcaagaactgacaaaaccgaaagagtcaagtagggagacaactccagaggggcggatggcgtgtcaaatgggcgccgacaggggtcctcacgttgtgctctggaccctgatttgcctccccgtcgttttcatcctgtcatttgtggtcagcttttattacgggacgatcacgtggtataatatcttcctggtttacaacgaggaacgtacgttctggcataagattagctattgtccctgcctggtcttattctatccagtactgataatggccatggcttcctcactggggttgtacgccgcagttgttcagctctcctggtcctgggaggcctggtggcaggcggccagggatatggaaaagggcttctgtgggtggttgtgcagcaagctcgggctggaggactgttcaccttattcaattgtggagctcctcgaatctgataacatctcaagtacgcttagtaacaaggaccctattcaagaggtggagactagcaccgtctag

SEQ ID NO: 31295 - DNA, 309 bp, Artificial Sequence
  Description of Artificial Sequence: Synthetic coding sequence
atggaggagcctaccgccgtggagggccaagttcagttacccagccctcatcaggggtctcttaggaaggctgttgctgccgcactagctttggacggtgagtccactatgggacaccgtaagaaaaagagaaaggaaagccgccccgagtccatcattatctatcgtagcgacaatgagaagaccgacgaggagccgggagagtcggaagggggagaccaacctaaagaggaagaaggtgacgacttcctggattacccagtagatgatgatatgtggaacctacctctggactctcgctacgtctag

SEQ ID NO: 31296 - DNA, 597 bp, Artificial Sequence
  Description of Artificial Sequence: Synthetic coding sequence
atggagttaccggatccagtgcgtcagcgcctgggtaactttagtagggctgtatttagtgatagtaatcgtacgggccccgaatcgaatgagggccccgaaaacgagatggttagctctttggcgctgcagatgtcactttatttcaacacctactatttccctttgtggtgggtcagctctattatgatgctccacatgaagtacagtattttacccgattattataagttcatcgttataaccgtgattatcctaattactctaattgaggcaatacgcttgtacctcggttacgtgggcaatctgcaggagaaagtcccagaactggcaggcttctggttgctgtctctgcttctgcagcttccactaattctgttcttgctgttcaatgaagggctcacaaacctacctcttgagaaggccattcatattatattcacattgttcctcgccttccaggtcgtggcagctttcctgacacttcggaaaatggttaaccaactcgccgtgcgttttcacctgcaggactttgacaggttgagtgccaacagaggcgatatgcgcagaatgcggagctgtatagaggaaatctag

SEQ ID NO: 31297 - DNA, 435 bp, Artificial Sequence
  Description of Artificial Sequence: Synthetic coding sequence
atggaaagggaaggttccggcggatctggaggctccgcaggactgctccagcagatcctctccctcaaagttgtgccccgcgttggcaacggtactctgtgccccaacagcacaagtctatgttcttttcccgaaatgtggtacggcgtgttcctgtgggcactggtgtcgagtttgttctttcacgtgcccgctggcctgcttgcgttgttcactttgcgacaccacaaatacggccgtttcatgtcagtttccatcctgctaatgggcattgtgggtcctattaccgccggcatcctgacatcagcagccatcgcgggggtgtatcgtgccgctggcaaagagatgatcccattcgaagctttgaccctgggtacaggccagacattttgcgttcttgtagtgtctttcctcagaatcctggcaaccctatag

SEQ ID NO: 31298 - DNA, 435 bp, Artificial Sequence
  Description of Artificial Sequence: Synthetic coding sequence
atggaaagggagggatctggaggcagcggggggagcgctggcctgctgcagcagattctctccttgaaagtggtgccccgggtcggcaatggaacattgtgccctaactctacttcactttgctcctttcctgagatgtggtacggagtctttttgtgggctctcgtttcctcattgtttttccatgtgcccgccggtctgctcgcacttttcaccctccgccatcataaatacggccggtttatgagtgtctccatcttgctcatgggaatcgttggaccaataacagccgggatacttaccagcgccgccatagctggcgtgtatcgagcagccggtaaggaaatgatcccgtttgaagccctgactctggggacagggcaaaccttttgtgtcttagtggtgtcattcctgcgcatacttgccacactgtag

SEQ ID NO: 31299 - DNA, 399 bp, Artificial Sequence
  Description of Artificial Sequence: Synthetic coding sequence
atgaaggccgaaggaggggatcattcaatgattaatctttctgttcagcaggtgctgagcttgtgggcacatgggactgtgctgaggaacctgaccgagatgtggtattggatattcttgtgggctctcttctcatctctttttgtccacggcgcggcaggggtcctgatgtttgtgatgctacagcggcatagacagggacgagtaataagtgtgatcgccgtcagcattgggtttctcgcaagcgtcaccggcgctatgattacctccgcagctgttgccgggatataccgtgtcgccggcaagaatatggcacccttagaagctttggtgtggggggtcgggcagacagtcctgactctaataatctccttctccaggatcttggccaccttgtag

SEQ ID NO: 31300 - DNA, 399 bp, Artificial Sequence
  Description of Artificial Sequence: Synthetic coding sequence
atgaaagcagaaggcggagatcattcaatgatcaatctgtcagttcagcaggtgttaagtttatgggcacatgggactgttttgagaaatctgacagagatgtggtactggatattcttatgggccctgttttcctcattgtttgtgcacggcgcggcaggtgtgttgatgtttgtgatgttacagcgccaccggcagggaagagttattagcgtcatcgcagtgagcatcggctttttggcatcggtgaccggtgccatgattacaagcgcagctgtggctggaatctacagagtggctggcaaaaacatggctccgctagaagcactggtttggggagtcggacaaacggttttgaccctcatcatttcattttccagaatcttagctacactctag

SEQ ID NO: 31301 - DNA, 972 bp, Artificial Sequence
  Description of Artificial Sequence: Synthetic coding sequence
atgagtccagcagcagccgcggagcccgacggggatcagcaggaccgtcacgtctcaaaactgattttctgtttcttcgtgttcggcgcggtgctgttgtgtgtgggtgtccttctgagtatcttcgggtttcaggcctgccagtacaagccactccctgattgtccaatggttttgaaagttgctgggcctgcatgcgccgtggttggcctgggcgctgtgatactcgcacgctctcgggctcagctacagttgagagcaggactccagcgcggacagcagatggatcctgatcgcgcctttatctgcggagaatcccgccagttcgctcagtgtctgatttttggttttctgtttcttacttcaggaatgctgatctccgttctcgggatctgggtgccaggatgtgggtccaactgggcgcaggagccccttaacgagacagacaccggggactcggaaccacgcatgtgtggtttcctgtctctccagataatgggaccattgattgtcctggtcgggctttgcttttttgtggtcgctcatgtgaagaaacgcaacactctgaacgccggccaagatgcttcagagcgagaggagggccagattcagatcatggagcctgtgcaggtcaccgtgggcgacagcgtgattatttttcctcccccacccccgccatactttcctgaaagttccgcttcggcggttgctgaaagccccggtacaaattcacttctgcccaatgaaaatcctccctcctattacagcattttcaattacggaactcccacatcagagggagctgcaagcgaaagagattgtgaatccatctatacgatttcagggacaaactcatcatccgaggcctcccacaccccacatctgccaagtgagcttccaccgagatatgaagaaaaagagaatgccgcggctaccttcctgccacttagttctgagccttccccaccatag

SEQ ID NO: 31302 - DNA, 975 bp, Artificial Sequence
  Description of Artificial Sequence: Synthetic coding sequence
atgagccctgccgcagccgcagagcccgatggagaccagcaggaccgacacgtctcaaaactgatcttttgtttttttgtgtttggggccgtgttgctgtgtgttggcgtgctcctgagcatttttggcttccaggcctgccagtacaaaccattaccagattgtcccatggttttgaaagtggccggacctgcatgtgccgtggtgggactgggtgccgtgatcctggcaagaagccgggcacaattgcaactgcgtgccggactgcagcgcgggcagcagatggacccagaccgggctttcatttgcggcgaatctcggcagttcgcacagtgtctgatttttggattcctgtttctcacaagtggtatgctgatctctgtgcttggcatatgggtaccaggatgcggcagcaattgggcccaggagcctcttaacgaaaccgacaccggtgacagtgagcctaggatgtgtgggttcctcagtctccagatcatggggcccttaatagtgctcgtaggcttgtgtttcttcgttgttgctcacgttaaaaagagaaacacactgaatgctgggcaggacgccagcgagagggaagagggtcagattcagatcatggagccagtgcaggtaaccgtaggtgactcagtgatcatcttccctccccccccccccccttatttccctgagtcttccgccagcgctgtcgcagagtcaccaggtaccaattccctgcttccgaacgagaatcctccatcatactatagcatctttaattatggaaggacacccacatccgagggagccgcgagtgagagagattgcgagagtatttacaccatcagtgggactaattcatcgtcagaagcatcacatacgccacaccttccttcagaactgccgccaaggtatgaggagaaggaaaatgccgcggctacattcctgcccctctcttctgagccaagtccaccttag

SEQ ID NO: 31303 - DNA, 732 bp, Artificial Sequence
  Description of Artificial Sequence: Synthetic coding sequence
atggagcaaggttcaggtcggctggaggacttccctgtgaacgtgttctcagtcacaccctacaccccatcaacagctgacattcaggtgagtgatgatgataaggctggtgcaactttgctgttttccggcatcttcctcggtttggtaggaattacatttacggttatggggtggatcaagtatcagggggtttcccattttgagtggacgcaactcttgggcccagtcctgctgtctgtgggcgtaacctttatcctgatagcagtgtgcaagttcaaaatgcttagctgccagctgtgtaaggaatccgaggagcgagtccccgattctgaacaaaccccagggggcccaagttttgtgtttaccgggattaatcaacccattacctttcatggcgcaaccgtagtgcaatatattccaccaccttacggctcccctgagccaatgggcattaacacatcttatctgcagtcagttgtgtcaccatgtggtctgattacctctggaggggccgctgccgcgatgtcttctccccctcaatattataccatctacccgcaagataactccgcttttgtagtggacgaaggatgcctgtcctttacagatggaggcaatcaccgtcccaacccggatgttgaccagttggaggagactcagcttgaggaagaggcgtgcgcctgcttttcaccccccccatacgaggagatttactcgctccctagatag

SEQ ID NO: 31304 - DNA, 1515 bp, Artificial Sequence
  Description of Artificial Sequence: Synthetic coding sequence
atgtcccaaccgagaacccccgaacaagcccttgacactcctggcgactgcccacccggtcgccgcgatgaagacgccggcgaaggcatacaatgctcacagcggatgctctctttctccgatgcactcctctctatcatcgcaactgttatgatcttaccagttactcacacagagatctctccagagcaacagttcgatcggtctgtgcagcgcctccttgctacaagaatcgcagtttacctgatgacatttctgattgtgacagtggcctgggcagctcacacgaggctctttcaagtggttgggaagacggatgacacgctggctcttctgaatttggcttgtatgatgaccataacattcttgccctatactttcagtcttatggtgacctttcccgacgtccctctgggcatttttctcttttgcgtttgtgtgattgccatcggcgtcgtccaggcgctcattgtgggatatgcgttccatttccctcatctcctgtctccccagatccagcggagcgcgcacagggccttataccgtcgacacgtgttagggattgtcctgcagggacccgccctgtgtttcgctgcagccatcttttcattattctttgtgcctctgtcttatctgttaatggtgactgtgatccttttaccttacgtctctaaagttaccggatggtgtcgcgatcgtctcctcgggcatcgggagccatctgcacatccggtggaagtgttttccttcgatctgcacgaacctctctcaaaggaaagggtcgaggcgtttagtgacggtgtttacgcaattgtggcaaccctacttatcctggacatttgcgaagacaatgtccctgacccgaaagacgtgaaggagcgcttttctgggagcttagttgcagctttgtccgctactgggccacgtttcctcgcttactttggtagcttcgccacggtgggactcttgtggttcgcccaccactctctgtttctccacgtccgcaaagccactagagcgatgggacttctgaatacactatccctggcctttgtgggggggctgcctcttgcctaccaacagacaagcgccttcgcaagacaacctagggacgaactagaaagagttagggtgtcgtgtaccattatctttcttgcgtccatcttccagctggctatgtggacaaccgccctcctgcatcaagctgagaccctgcagccgtccgtctggtttggaggccgggaacacgtgctaatgtttgccaagttggcactatatccgtgcgcctctctgctggccttcgcttcaacctgcctgctctcccgcttcagcgtgggcatttttcacctcatgcagatagctgttccttgtgcctttctgctgctgaggctcctggtggggctggcactggctactcttagagtcctgcgtggactggcccggcccgaacacccccctcctgccccaactggtcaagatgatcctcaatcacaactcctgccagccccttgctag

SEQ ID NO: 31305 - DNA, 798 bp, Artificial Sequence
  Description of Artificial Sequence: Synthetic coding sequence
atgacattcctcatcgtgaccgtggcatgggctgcgcacacacggctgtttcaggttgttgggaagacagatgacaccctagccctcctcaatctggcgtgcatgatgacaataactttcctcccatatacctttagcttgatggtcacattccccgacgtgccactgggcatcttccttttctgcgtgtgtgtaattgccatcggagtggtgcaggcccttatagtggggtacgcctttcactttccccatctgctttccccccagatccaaaggagtgctcacagggcgctgtaccggcggcatgtgctgggaattgtcctgcagggaccagccctttgtttcgctgctgcaatcttcagcctcttctttgtgcctttgagctaccttctgatggtcaccgtgattctgctgccctatgtgagcaaggtgaccggctggtgcagggatagactgctgggacatcgggagcccagcgcccacccggtggaggtgttctctttcgaccttcatgaacccctttcaaaggagcgggtagaggctttcagtgatggcgtgtatgcgatcgtggctacactgctgatcctggacatctgcgctcctcacagatttgccgccccccctgctccgttcggatggcttctgcttccatcaagcgtttgctcctcggccgctagctccgcttcttcctccgtacgtgcacgtgtgtcctcacagtctagccggttctggttcctatggggttttttcttcttcttcctgaggcagagttgttgcgtagcccaggccggggtctag

SEQ ID NO: 31306 - DNA, 405 bp, Artificial Sequence
  Description of Artificial Sequence: Synthetic coding sequence
atgagccaacctagaacaccagagcaggcactagatacccccggggactgcccccccgggcggagagacgaggacgccggggagggtattcaatgttcccagcggatgctgtctttcagtgatgcactcctctctatcatcgccactgtaatgattctgccggtgacacacactgagatatcacccgaacagcaatttgatcgcagtgtccagcgccttctggccacgcgaatcgccgtttaccttatgaccttcctgattgtgaccgttgcctgggctgcacacaccaggctcttccaggttgtgggcaaaaccgacgatactctcgcactcctcaacctggcttgtatgatgactatcactttcctcccctacacattttccctgatggtgacatttccctag

SEQ ID NO: 31307 - DNA, 1167 bp, Artificial Sequence
  Description of Artificial Sequence: Synthetic coding sequence
atgatgacaatcacattcctgccctacacgttcagtcttatggtaacctttcccgatgtgcccctcgggatcttcttgttttgcgtctgtgtaatcgccatcggagtggtgcaggctcttattgtgggatatgccttccacttcccacatctgctttcaccccagatccagagaagcgcacatcgagctctctataggagacatgttttggggatcgtcctacagggccccgccctctgttttgcagctgccatattttccctcttcttcgtcccactgagttacctcctaatggtcactgtgatcctattgccctacgtctcaaaagtgactggctggtgccgagacagactacttggacaccgtgaaccatcagcccatccagtcgaggtgttcagtttcgatctccatgagccactgtctaaggagcgtgtggaggcgttctcagacggcgtgtatgctatagtggccactctgcttattctggacatatgcgaagacaatgttcccgaccctaaagatgtgaaagaaagattttctggaagcctcgtggccgccctttctgccactggcccaaggttcttggcatattttggttcattcgcgactgttggtctgctgtggtttgcgcatcattccctattcctgcacgtgcgcaaggctactagagcaatgggacttttgaatactcttagtttagctttcgtggggggcctcccactggcttaccagcaaacctccgctttcgctcgccagccccgggacgaacttgaacgagtgcgagtgagttgtacaatcatattcctggcgtctatctttcagttggcaatgtggacaactgctctcctgcaccaagccgagaccctccaaccttctgtgtggttcggtggacgggagcacgtcctgatgttcgcaaagctggccttatatccgtgcgcctccctgcttgcattcgcctccacctgtctgttgagccgctttagtgttgggattttccatctgatgcaaattgccgttccgtgcgctttcttactcctgcggttgctggtcggcctcgcattagcaacattacgggtacttaggggactggccagaccagaacaccctccaccagctcctaccggacaggatgacccacagtcccagcttctccctgccccgtgctag

SEQ ID NO: 31308 - DNA, 708 bp, Artificial Sequence
  Description of Artificial Sequence: Synthetic coding sequence
atgggcactgcggattctgacgaaatggctccagaggcgccacagcacacccacattgatgtccacatacaccaggaatctgcccttgccaaattgctgctaacgtgctgtagcgcactccgtcctagagccactcaagctcgcgggagctctcggctgcttgttgcatcctgggttatgcagattgtgttgggcatcctgtcagctgtcctaggagggttcttttacattcgtgattatacacttctggtcacttccggtgctgctatctggactggagcagtggctgtcctcgctggagccgctgcctttatctacgaaaagcgcggggggacgtattgggccctacttagaaccctgctcaccttggccgcattttcaaccgccattgccgccctgaagctttggaacgaagactttcggtacgggtatagctattacaattctgcctgccgaatctcgtcctcatctgactggaacacacccgccccaacacaaagcccagaagaagtgaggcgcctccacctttgcaccagttttatggatatgctgaaagcattattcagaactctgcaggctatgttgcttggtgtgtggattctgcttctgcttgctagcttaactcccctctggctatactgctggaggatgtttcctacgaaaggaaagcgcgaccaaaaagaaatgcttgaggtatccggaatctag

SEQ ID NO: 31309 - DNA, 708 bp, Artificial Sequence
  Description of Artificial Sequence: Synthetic coding sequence
atgggtaccgcggactctgacgagatggctccggaagctccacaacacacccatatagatgtgcacattcaccaggagtctgcactggctaagctgctgttaacttgctgctccgccctgaggccacgcgcaactcaggctcgaggtagttcgcggcttctggtagccagctgggtcatgcaaattgtcctcggcatcttgtcagccgtgctgggggggtttttttacattcgggactataccctgttggtgacgagcggtgccgctatctggacgggcgccgtcgccgttttggccggggctgccgcatttatatatgagaaaaggggcggcacatactgggcactcctgagaaccctgctgactctggcagccttttctaccgcaatagccgctctgaaactttggaacgaggattttcggtatggctattcctattataacagtgcttgccgcatttcaagctcctctgactggaacactccagctcccacccagagcccagaggaggtgagaaggcttcatctatgcacgtctttcatggatatgttgaaagcgctgtttagaaccctgcaggctatgctgcttggtgtatggatcctgcttcttcttgcgtcgctcacacctctatggttgtattgttggcgcatgttccccaccaaagggaaaagagatcagaaagagatgttggaagtgtcaggaatttag

SEQ ID NO: 31310 - DNA, 813 bp, Artificial Sequence
  Description of Artificial Sequence: Synthetic coding sequence
atgacacagaataccgttattgtgaatggagtggctatggcttcccggccgtctcagcccacgcacgtgaacgttcacatccatcaagaatctgcactaactcagctgcttaaggcaggcggctccctcaaaaagttcctgtttcaccctggagataccgtcccttccacagccaggattgggtacgagcagcttgctcttggagtgactcagatccttctcggcgtggtttcttgcgtgttgggcgtgtgtctttcactggggccatggactgttctttctgcttccggttgcgccttttgggcgggtagtgtggtgattgcggctggcgctggggctatagtgcacgaaaagcatccggggaaactggccggctatatcagttcgctgctaacgctggcaggctttgcgaccgccatggccgctgtcgtgctgtgtgtgaactccttcatctggcagactgagccatttctctacatagacaccgtctgcgatcgctctgatcctgtcttccccaccactgggtataggtggatgaggagatcacaggagaaccaatggcagaaggaagagtgcagggcatacatgcaaatgttgcggaagctcttcaccgccatcagggctctcttcctagccgtatgtgttctgaaagttatcgtctcgctggtgagcctgggtgtggggctcagaaacctttgcggtcaaagcagtcagcccctaaacgaagagggcagtgaaaagagacttctgggcgagaattccgtgccaccaagcccatctcgcgaacagacatccactgcaattgtgctgtag

SEQ ID NO: 31311 - DNA, 813 bp, Artificial Sequence
  Description of Artificial Sequence: Synthetic coding sequence
atgacgcagaatacggtaattgttaacggcgtggcaatggctagcaggccaagccagcctacccacgtgaacgtccatatccaccaggaaagcgccctgacccaacttctgaaggccggtggcagtcttaaaaagtttctgtttcacccgggggacaccgtaccgtctacggctcgcattggctatgaacagttggcacttggagtgacccagatcctgctgggcgtggtgagttgcgtgcttggggtgtgcctatcactaggaccctggactgttctttctgcctccgggtgcgctttttgggcaggcagcgtcgtcattgcagcaggcgccggcgctattgtgcatgagaaacacccagggaagctcgctggatatataagctccttgttgactcttgctggatttgccaccgctatggcagccgtggtgctctgcgtaaatagtttcatatggcagacagagccatttctgtatattgacacagtttgcgaccgaagcgaccccgtgttccccacaacaggttataggtggatgagaagatctcaggagaatcagtggcagaaagaagaatgtcgggcttatatgcaaatgctgcggaaattattcacggcaatccgggcccttttcctagctgtctgtgtgctgaaggttatcgtgtctctggtgtcattgggcgttggccttcggaatctctgcggacaaagttcacagcccctgaatgaagagggctctgaaaagcgccttctcggcgaaaactcggtccctccgtcaccctctcgtgaacagaccagcaccgccatagtgctctag

SEQ ID NO: 31312 - DNA, 813 bp, Artificial Sequence
  Description of Artificial Sequence: Synthetic coding sequence
atgacacaaaatactgtaatcgtgaacggggtggctatggctagtagaccgtcccagcccacccacgtaaacgtgcacatccatcaagagtccgccctcacacagctgctgaaagcaggagggagcctgaaaaaattcttgttccacccaggggacactgttccgtctactgcaaggattgggtacgagcagttggccctgggcgtgacccaaattcttctcggcgtggtcagctgcgtgctgggggtctgccttagcctcgggccctggaccgtgctgagtgcaagtggctgtgcattttgggcaggctctgttgtcatcgccgctggcgcaggcgcaattgtgcacgagaagcacccaggtaagcttgccgggtacatttctagcttactgactttggctgggttcgcaactgcaatggccgccgtagtgttgtgcgttaactcatttatttggcagaccgaaccattcctctatattgatacagtttgtgacagatccgaccctgtttttcccacaactggttaccgctggatgcggagatcgcaggagaatcaatggcagaaagaggaatgtcgggcttatatgcagatgttgagaaaacttttcacagctatcagagctctgtttcttgccgtttgcgtgctgaaggtgatcgtgtccttggtatcacttggagtcggcttacgcaatctctgtggacagagtagtcagccgctcaatgaagagggctcagaaaagcgcctccttggagaaaactccgtgccgccatccccaagtagggagcagaccagtacggccattgttctctag

SEQ ID NO: 31313 - DNA, 813 bp, Artificial Sequence
  Description of Artificial Sequence: Synthetic coding sequence
atgacacaaaacactgttatcgtcaatggcgtagctatggcctcaagaccctcccagcccacgcacgttaacgtgcatatccatcaggagtccgccctcacacagctgctcaaggctgggggctccctgaagaagtttctgtttcatcctggtgacacagtccccagtaccgcgaggattggctacgagcaactagccttgggtgtgacacagattttactcggagtcgtttcttgtgtgctcggcgtctgtctgtccctgggcccatggactgtgctgtccgccagcgggtgcgctttttgggcgggatctgttgtgatcgcagctggcgcaggtgccatcgtgcatgaaaagcatccgggaaagttggcaggctacattagctctctcctcacccttgcggggtttgctaccgccatggcggctgtagtcctctgcgttaactcatttatctggcaaacagagccgtttctgtacatcgatacagtttgcgaccgttcagatccggtcttccctaccaccggctacaggtggatgcggcgcagccaggagaatcagtggcagaaagaagaatgccgggcctatatgcaaatgctgcggaagttatttaccgcaatacgagcattattcctggctgtgtgcgttttaaaagtcattgttagtctggtatcgttgggtgtgggcctcagaaacctctgtgggcagagcagtcaacctctcaacgaagaaggttctgagaaacggctcttgggggaaaatagtgtgccaccctccccttccagggaacaaactagcacggctatcgtgctgtag

SEQ ID NO: 31314 - DNA, 702 bp, Artificial Sequence
  Description of Artificial Sequence: Synthetic coding sequence
atgactcagaacaccgtcatcgtaaacggcgtggccatggccagcagaccaagccagcctacgcacgtcaacgtgcacattcaccaggaaagcgctctcactcagttgctgaaggctgggggcagcctgaaaaaatttctttttcaccctggggacactgtcccaagcaccgcaaggattggctatgagcagcttgctctcggagtgatcgcagccggcgccggggccattgttcacgagaagcaccccggaaagttggctgggtacattagttctttgctcacactggctggcttcgccaccgctatggctgccgtggtgctgtgtgtgaattctttcatctggcaaacagagccctttctgtacatcgacaccgtctgcgatcgctccgatcctgtcttcccaaccaccggctacagatggatgaggagatcacaggaaaaccagtggcaaaaggaggagtgccgcgcctacatgcaaatgctgaggaagctgttcaccgctatacgagcgctctttctggccgtgtgcgtgctgaaggtgattgtctccctcgtttccctcggagtggggctgcgcaacctgtgcggacagagctcacagcccttgaatgaggagggatcagaaaagaggctcctcggggaaaactctgtgccaccttctccgtcacgggaacagacatcgactgccattgtattgtag

SEQ ID NO: 31315 - DNA, 813 bp, Artificial Sequence
  Description of Artificial Sequence: Synthetic coding sequence
atgacacaaaataccgtcattgttaatggcgtcgctatggctagcaggccaagccagcccacgcatgtgaatgtccacattcaccaagaatctgctctcactcagttgctgaaggccggcggcagtcttaaaaaattcctgttccacccaggggacaccgtgccttctaccgcaaggatcgggtatgaacagctggcattgggggtgactcagatcctactcggcgtggtcagctgcgttcttggggtatgtctgtctcttgggccttggaccgtactctctgcgtcagggtgtgcattctgggccggatccgtcgtgatcgccgctggggcgggcgccattgtccacgagaaacacccaggcaagctggccggttacatcagctcactgctgacactcgcaggctttgccaccgcaatggctgcagtggttctctgcgtgaatagctttatatggcagactgagcctttcctgtacatagacactgtctgcgaccgcagtgaccccgtctttcctacaactgggtaccggtggatgagacggtctcaggaaaaccagtggcagaaagaggaatgtcgggcatacatgcagatgctgcgtaaactcttcaccgcaattcgcgcactgtttttagcggtgtgtgtgctgaaggtgattgtttcactcgtgtccctgggtgtaggtctgagaaacctttgcggccagtcaagccagcctctcaacgaagaggggtcagagaagcggctgctaggcgagaactcagtccccccttctccatcgagggagcaaacctcaactgcgatagtcctgtag

SEQ ID NO: 31316 - DNA, 813 bp, Artificial Sequence
  Description of Artificial Sequence: Synthetic coding sequence
atgacacaaaacactgtgatcgtgaatggcgttgcaatggctagcaggccgtcccaaccaacacatgtcaacgttcatatccatcaggagtccgctcttacccagctgttgaaagcgggagggtcactcaaaaaattcctgtttcatcctggggacacagtcccaagcacggctaggatcgggtatgagcagctagctctcggagttacacagattctgctgggtgtcgtgtcatgcgttttgggagtctgtctctccttagggccctggaccgtgctttcagccagtggatgcgcgttctgggcaggctcggtggttatcgccgcaggtgctggcgcaattgtgcacgaaaagcatccgggaaagctggcaggctacatcagcagcctcctcactctggctgggttcgctactgccatggcagcagttgtcctgtgtgtgaacagctttatctggcagacagagcccttcctgtatatcgatactgtctgcgatcgatccgacccagtttttccaacgactggctatcggtggatgagacgcagtcaggagaatcaatggcaaaaggaagagtgccgagcctatatgcagatgttaaggaagctgttcacagccatccgggccctgtttttagcggtgtgtgtgcttaaagtcattgttagcctggtgtccctgggggtggggttgaggaacctgtgtggacaaagttcccagccactcaacgaagaaggcagtgagaaacggctgctgggagaaaatagcgtaccaccgtctccgagcagggagcagacctccaccgccattgtgctgtag

SEQ ID NO: 31317 - DNA, 936 bp, Artificial Sequence
  Description of Artificial Sequence: Synthetic coding sequence
atggcaggcccactgtggagaacggctgcctttgtacaaagacaccggaccgggctgctggtgggcagctgcgccggcctcttcggtgtccccatcagttatcatttatttccggaccccgtcgtgcagtggctgtaccagtactggccccagggacaacccgcaccactgccaccacagctccagagcctctttcaggaggtgctgcaagatatcggcgtaccttcagggcattgttataagcctttcaccacctttacgtttcagccagtaagcgccggattccctcggctacctgctggggccgtagtggggattccagcctccttcttaggggatctggtcatcaacacaaatcaccccgtggtgattcatgggcacaccgttgattggcggagtccagctggcgccagactgagagcctcactaaccctgtctagggaagctcagaaatttgccctcgccagagaggtggtgtacttggaatcatcgactactgcagtccatgcactcctggcccccgcttgtctcgcagggacatgggccctaggggtcggtgctaaatatactctcgggcttcatgccggacctatgaatcttcgtgccgccttctccctggtggcagctgtcgccggatttgtggcctatgcattttctcaggatagcctgactcatgcggtagaatcatggctggacagacgcactgctagtctctctgcagcgtatgcttgcggcggcgtggagttttacgagaaacttctgagcggaaatcttgcactgaggtcactgctgggaaaagatggcgagaagctgtacacaccgagcggcaacatcgttcccagacatctttttaggatcaagcacctgccctacacaacaaggcgagattctgtcttgcagatgtggcggggcatgttaaatccaggcagatcatag

SEQ ID NO: 31318 - DNA, 936 bp, Artificial Sequence
  Description of Artificial Sequence: Synthetic coding sequence
atggctggacccctgtggcggacagctgcgttcgtgcagagacatcgcacgggcctgctggttggtagctgtgctggactcttcggtgtgcccataagctaccatcttttccccgaccccgtcgtgcaatggctctaccagtattggccccagggccagcccgcccctctcccaccgcagttacagagtttgttccaagaggtcctgcaagatatcggagttccgagcggacactgctataagcctttcactactttcacttttcagcccgtgagcgccgggtttcctagattgccggcaggtgccgtcgtcgggattcctgccagctttctcggcgatttggtcatcaacactaaccaccctgtggtgatccatggacacaccgtggactggcggtctcccgcaggcgcaaggttacgcgcttctctgactctcagtcgtgaagcacaaaaatttgcattagccagggaggttgtgtacctggagtcttctacaaccgcggtgcatgcactgctcgccccggcttgtctggctggcacgtgggccctcggcgtgggggcaaagtataccctagggctgcacgccgggcccatgaatcttagggccgcattttcacttgtcgccgccgtcgctggcttcgttgcctacgctttttctcaggattctctgacccatgcggtggaatcctggctggatcgacgaacagcttcactttctgccgcttatgcctgtggaggggtcgagttctatgagaagctcctgtccgggaatctggctttgaggagtctgctgggtaaggacggagaaaagctatatacccctagcgggaacatcgtgcctagacatttattccgcatcaaacatctaccatacaccacccgcagagattctgtgctgcagatgtggcgagggatgttgaacccgggtcgatcttag

SEQ ID NO: 31319 - DNA, 753 bp, Artificial Sequence
  Description of Artificial Sequence: Synthetic coding sequence
atggccggacctctgtggcgaacggccgcttttgtccagcggcataggaccggacttctcgtgggcagctgcgccggcctctttggggttcccatcagctaccatcttttccctgatcctgtggtgcagtggctctatcaatattggccacagggacaacccgccccattgccacctcaactgcaaagcctgttccaggaggtcctgcaggatataggagtgccgagcgggcactgctataagccattcaccactttcacatttcaacctgttagcgctgggttcccaagactgccggcaggcgctgttgtggggatacctgccagtttcttaggcgacctggttataaacacaaatcaccccgtcgtgattcatgggcacaccgtggactggcgtagccctgcaggtgcccggctcagggcgtctcttacactatcaagggaagcacagaagtttgcgctggcaagggaagtcgtctatctagagagttccaccactgcagtccacgcactcctggcacccgcatgcctcgctggaacatgggctctaggtgtcggcgccaagtacaccctcggcctccacgccggacctatgaacctgcgagctgcaagcttaagtgcagcatacgcttgtgggggggtcgagttctacgagaaattattgagtggtaatctcgctttgaggagcctgctgggcaaagacggggagaagctacagatgtggcgcggcatgctcaaccccggccggtcttag

SEQ ID NO: 31320 - DNA, 936 bp, Artificial Sequence
  Description of Artificial Sequence: Synthetic coding sequence
atggccgggcctttatggcgaaccgcagccttcgtgcagcgacatcgaaccggcctgctggtggggagttgtgccggcctcttcggagtccccatttcctaccacctgtttccagaccccgtcgttcagtggctgtatcagtactggccgcagggtcagccagcacctctacctccacagctccagtcgctctttcaggaagtccttcaggacatcggagtgcctagtggacattgctataaacctttcactacatttacctttcaacctgtgagtgccggattcccacgtctcccagccggagctgtagtgggcatacctgcctccttcctcggtgatctagtcatcaataccaatcaccctgtggtgattcacggacacacagtcgactggagatctcccgcaggcgcgcgactccgggccagcctaactctgagcagggaagcccagaagtttgccctggcgagggaggtggtttacttggaatcctctactaccgcagtgcacgctcttttggctcctgcttgccttgcgggtacttgggccttgggggtgggggctaagtacactttggggcttcatgccggaccgatgaacttgagagcagcatttagcctcgtggcggcggtggctggattcgttgcttacgctttcagccaggacagtctgacacacgccgtcgaatcttggctggaccgacgaacagcaagtctctccgccgcttacgcttgtggaggcgtggagttttacgaaaagctgctgagcggaaatttggcactccgttctttactgggaaaagatggcgaaaaattatacaccccctccggcaacatcgttccccgccatttgttcagaattaagcacctaccatataccactcgccgcgattccgttcttcagatgtggagggggatgttaaaccccggaagatcctag

SEQ ID NO: 31321 - DNA, 345 bp, Artificial Sequence
  Description of Artificial Sequence: Synthetic coding sequence
atggcaggtccactgtggcgcacagccgcctttgtccagagacacaggaccggcttgcttgtgggctcttgtgcgggcttgtttggagtgcccatctcttaccacctgtttcccgacccagtggttcaatggttgtatcagtactggccacagggccagcccgcgccactcccgccgcagctgcagtctctgttccaagaagtactccaggatatcggggtacctagtggtcattgctataagccgttcacaacgttcacctttcagcccgtgtcggctggcttccccaggttacccgcaggcgcggtcgtgggcattcccgcgtcatttctgggcgacctttag

SEQ ID NO: 31322 - DNA, 894 bp, Artificial Sequence
  Description of Artificial Sequence: Synthetic coding sequence
atggaacctcgcgccctggtgaccgcactgtccttaggcctgtcactgtgcagcctcgggctcctggtgaccgccatttttacagatcactggtacgaaacagaccctaggagacacaaggaatcgtgtgaacgctcgcgcgccggagcggatcctccagaccagaaaaataggttgatgcccctctcccacctgccactgcgagattctcctccactgggtaggagactgctgccaggaggaccggggcgggcagacccagagtcttggcgttcgctgttgggcttggggggcctcgacgcagagtgtggaagaccactgtttgccacttattcagggctctggcgcaaatgctatttcctgggtattgaccgggacattgacaccctgatactgaaaggaattgctcagagatgcaccgctatcaaataccacttctcccagcccatccggcttcggaacattccgttcaacctgacaaagactattcagcaggatgaatggcatttactccacttacggaggatcacggcgggtttcctgggcatggcagtggccgtgcttctatgcggctgtatcgtggccaccgtctccttcttctgggaggaatctctgacccagcatgtcgcggggctgctatttctgatgaccgggattttctgcactatttcactgtgcacatacgccgcatcaatcagctatgatctcaatagactgcctaagctgatttactccctgccagccgatgtggagcatggatactcatggagcatcttttgcgcttggtgtagtctcggattcatcgtggctgccggaggattgtgcattgcatacccttttatctctaggactaaaatcgcccagttgaaaagcggtagagactcaaccgtgtag

SEQ ID NO: 31323 - DNA, 336 bp, Artificial Sequence
  Description of Artificial Sequence: Synthetic coding sequence
atggagccccgcgctttggttactgcattgagcctgggcctaagtttgtgcagtctaggcctgttagttaccgcaatattcacagatcattggtacgagactgatcctcgaaggcacaaagaatcttgtgagaggagcagagctggtgccgaccctccagaccaaaaaaatagactgatgcccctgtcacatctgcttggaccactggaagaagtacttctacccgggcatagaccaggacataggcatcctcatcccgagcgctactgcgcggcaatgcacgggcaccaggttcctctcttctccgcccatcccttggcgaaacattctttctag

SEQ ID NO: 31324 - DNA, 594 bp, Artificial Sequence
  Description of Artificial Sequence: Synthetic coding sequence
atggccctaaacaatttcctgtttgcacaatgcgcttgttacttcctggcattcttgttcagcttcgtcgtcgtggttccactgtccgagaacggacacgatttccgaggccgctgtctgctgtttaccgaaggaatgtggttgtctgccaatctgactgttcaggagagggagcgcttcactgtccaggagtggggccccccagcggcttgccgattctcattgcttgcctccctgctctcactattactcgcagccgcccatgcctggcggactctgttcttcctatgcaaagggcacgagggatcgttcttcagcgcctttctaaatttactggtctctgccttcgtggtgtttctcgtattcatagcctctaccattgtttcagtggggtttacaatgtggtgcgacactatcacagaaaagggtactgtgcctcatagttgcgaggagctgcaggacattgatctggagttaggggttgataatagcgcattctatgaccagtttgccatcgcacaggtggggggaagtggacaagagggccggctggccatgctggggggaggacacctgctgctagatatttgttag

SEQ ID NO: 31325 - DNA, 702 bp, Artificial Sequence
  Description of Artificial Sequence: Synthetic coding sequence
atggcactgaataactttctcttcgcacagtgtgcgtgttactttttggctttcctgttctcattcgttgtggtggttccattgtccgaaaacggacatgacttccgtggccggtgcctgctatttacagagggcatgtggttgtcggcaaatttaacggtgcaggagagggagcggttcactgttcaggagtggggccccccggccgcgtgtagatttagtctgctcgcctctcttttgtctttactccttgccgccgcgcatgcttggcgtaccttgttctttttatgtaaaggtcatgaaggatccttcttttccgctttcctgaacctcttagtctccgcatttgtagtatttctcgtcttcatcgcctcaaccatcgtgtccgtcggcttcactatgtggtgtgatactattacggagaagggcaccgttcctcattcatgcgaggaactacaggatatagatttagaactgggagtggataatagtgcattctatgaccagtttgcgatcgcccagttcgggctgtgggcctcctggttggcgtggctcgctataacgacactggcctttctgaaagtgtatcacaattaccggcaagaagacctgctcgactctctcattcacgaaaaagaactgctgctggctagaccctcacctcgcacaagctttcaagaggagaaaagcgctgttatctag

SEQ ID NO: 31326 - DNA, 660 bp, Artificial Sequence
  Description of Artificial Sequence: Synthetic coding sequence
atggcactttcctggctacagcgcgtcgaactggctctttttgcagctgcttttctgtgtggggccgtggccgcagccgctatgacaaggacccaagggagcttttccggccgctgcccactctatggggtggccaccctcaacggttcttctctcgccctcagccggccatcagctccgagtttgtgttactttgttgccggtgctagcggcctgctggctctgtattgcctgcttttgctgctattttggatctactcaagttgcattgaggactctcatagaggagcgatcgggctgcgcatcgccctggctatttccgccatcgcagtgttccttgtcctggtaagtgcttgcatcttgcggttcgggaccaggtctttgtgtaatagcatcatttcattgaataccacaattagctgctcagaagcacagaaaatcccatggacacctccaggcacagccctacaattttattctaacctccacaacgccgagaccagctcttgggttaacctggtgttgtggtgcgtagtccttgtgttacaggtggtccagtggaagtcagaggcaacgccataccgacccctcgagcgaggtgatcccgagtggtcaagtgagacagatgctctggttgggagcaggctcagccactcttag

SEQ ID NO: 31327 - DNA, 1554 bp, Artificial Sequence
  Description of Artificial Sequence: Synthetic coding sequence
atgggcctaggccagcctcaggcctggctgctcggactgcctacagcagttgtatatgggtcactcgctctcttcaccaccattctgcacaacgtcttcctactgtactatgtggatacgtttgtgtccgtctataaaataaacaagatggctttttgggtaggagaaacagtgttcctgttatggaacagcctgaatgatccactcttcggatggctaagtgacagacagtttctgtccagccagccacggtccggtgccgggttgtcctctagagcggtggtgctagcacgtgttcaggctctgggctggcacgggcctttgttggctctttcattcctagctttctgggtgccatgggcccctgccggactgcagtttctgctttgcctctgtctgtacgatgggtttctcacactcgtggacttacaccatcatgcactactagcagatttagctctgtccgcccacgacagaacacatcttaacttctactgcagcctgttctcagcagctggcagtctgtcggtgttcgctagctatgccttttggaataaggaggatttcagctctttcagagctttttgtgtcaccctggcagtcagtagcggtttggggtttctgggcgcaacccagttactccgccgaagagtcgaggccgctcgaaaggatcccggctgttcagggcttgtcgttgactcaggcttgtgtggggaagaacttctcgtggggtcagaggaagccgatagcattactctcggtcgctatctccggcaattggctagacacagaaatttcctgtggttcgtgagcatggacctggttcaggtcttccactgccatttcaactctaatttttttcctctctttcttgagcacctattaagcgaccacatctctctgagcacagggtcaatcttgctgggcctgtcatatgtcgcaccacatctaaacaacctctacttcttgtccctgtgtcgtagatggggtgtgtacgccgtggtaaggggcttatttctcctgaagctagggttaagtctgttgatgctactcgccgggccagaccacctgagcctgctctgcctgttcattgctagtaatcgggtgttcactgaggggacttgcaagttgcttacactggtggttacagacctggtggacgaggatctggttttaaatcaccggaagcaggccgcaagtgccctactttttggtatggtagccctggtgactaagcctggtcagacatttgcgcctctgctgggtacttggctgctttgcttctacactggacatgacctgttccagcagtcccttattactcccgtgggctccgctcacccctggccagagcctcctgcacccgctccggctcaagctccgacactccgtcagggctgtttttaccttttggttcttgtccccattacctgtgcgctcttgcaattattcacctggagtcaattcacgctgcatggccgacgattgcatatggtgaaggcccaacgccagaatttgtcacaggcccagactctggatgtgaagatggtgtag

SEQ ID NO: 31328 - DNA, 741 bp, Artificial Sequence
  Description of Artificial Sequence: Synthetic coding sequence
atggacctggtccaagtgttccactgtcactttaattctaactttttccccctttttttggagcacctactgtccgatcatattagcctgtccacaggatctatcctcttggggctttcctacgtcgctccccacctgaataatctatatttcctaagcctctgcagacggtggggtgtttacgccgtggtgaggggcctgtttcttctgaagctggggctatctctcttgatgctcctggcaggacccgaccacctatcactgctttgtctctttattgctagcaatcgggtgtttactgaaggaacttgcaaacttttgacccttgtcgtgactgatctcgttgacgaagatctggtattaaaccatcggaaacaggcagcctcggccctgctatttggtatggtggccctggtaacaaaacctggtcaaaccttcgccccattacttggaacttggctgttgtgtttctacacaggccatgaccttttccaacaaagcctcattaccccagtcggcagcgcacacccttggccagagccacctgcaccggcacctgctcaggccccaacactgagacagggatgtttttaccttcttgtgttggtgcccatcacttgtgcattactccaacttttcacttggtcccaattcactttgcatgggcgcaggctgcatatggtgaaggcccagcgccagaacctgagtcaggctcaaacactggacgtgaaaatggtatag

SEQ ID NO: 31329 - DNA, 741 bp, Artificial Sequence
  Description of Artificial Sequence: Synthetic coding sequence
atggatcttgtgcaggtgtttcactgtcatttcaactcaaacttcttcccactgttcctggagcacctgcttagcgatcacatttccctgtccacgggttctattctgcttggtctttcttatgtggctcctcacctgaacaacctctattttctaagtctgtgtaggcgctggggagtgtatgcggttgttcgagggctattcctgttgaagctcggactgtccctgttaatgcttctggcgggcccggaccatctgtctctactgtgcctgttcatagcatctaatagagttttcaccgaggggacttgtaagctgttgacattagtagtgaccgatcttgtggacgaagaccttgttctgaaccaccggaaacaagcagcgtcagccctactgttcgggatggtggccctggtgactaagcctggccagaccttcgctcctctgctgggaacctggttgctttgtttttataccggacatgatctgtttcagcaaagcctcatcaccccagttgggagcgcccatccatggcctgaacctcccgcgccggcccctgcccaagccccgacattacgtcagggctgcttctacctcttagtgctcgttcccatcacatgtgcactgttgcagctgttcacatggtctcagttcaccctccacgggagaagactgcacatggtgaaagcacagaggcagaacctctcccaggcccaaacattggatgtaaaaatggtgtag

SEQ ID NO: 31330 - DNA, 462 bp, Artificial Sequence
  Description of Artificial Sequence: Synthetic coding sequence
atggggcttggacaacctcaagcttggctgctcgggttacctacagcagtcgtgtacggcagcttagctctgtttaccaccatcctacacaatgtgttcctcctgtactatgttgatacattcgtttcagtgtataaaattaataagatggccttctgggttggggaaaccgtatttctgctatggaactcccttaatgatccactgttcgggtggcttagcgatcgccaatttctgtctagccagcctcgactgtgtggtgaggagctgctggtcggcagtgaagaggcagattccattacccttgggcggtatcttcggcagttagcaaggcaccggaatttcctgtggttcgtctccatggacctggttcaagttcagtggctaactcccgttatccccgccctgagggacgccaaggttgaacgccccctcgagcccagaagcagtcggctccagtag

SEQ ID NO: 31331 - DNA, 948 bp, Artificial Sequence
  Description of Artificial Sequence: Synthetic coding sequence
atgggactcggtcagccgcaggcctggttactgggtctgccaaccgctgttgtctacggctccctagcactttttaccacaattctgcataatgtgttcctcctgtactatgtcgacaccttcgtgtccgtgtataagataaataaaatggccttttgggtcggcgagactgtcttcctgctgtggaactctctgaacgaccctctctttggctggctgtccgatagacaattcttgtccagtcagcctcggttgtgtggtgaggaattacttgtaggatctgaagaagccgactccatcacgttgggccgatatttgcgccagctggccaggcacaggaattttctgtggttcgtgagcatggatctggtacaggtgtttcattgtcactttaacagcaactttttcccactattcctggagcacctactcagcgaccacatcagcctcagcaccgggtcaattttactaggtttgtcctacgtggcgccccatctgaataatttatacttcctgtccctgtgcaggcggtggggagtctatgccgtcgtacgtggcctatttctcctgaagctggggctgtctctgctgatgttgcttgcagggccggaccatttatcactgctgtgtctgtttattgcaagtaatcgagtgttcacggaaggcacatgcaagctgctaaccctcgtggtaacagatttagtagacgaagatctcgtcctgaaccaccgtaaacaggcggccagtgctttgctgttcggcatggtcgctctggtcaccaaacccggccagacatttgctccgcttctagggacatggttgctctgtttctataccggatgggatcttggctacgccctggcacactctctcctgaaccaggctggcccccgcagtagaatggctcaggatcagcctaggggggggttgccaaccagtaccacatag

SEQ ID NO: 31332 - DNA, 402 bp, Artificial Sequence
  Description of Artificial Sequence: Synthetic coding sequence
atgcgaggagaacataatagcaccagctatgatagtgcggtaatttacagggggttttgggctgtcctgatgttgctgggggtggttgccgtcgtcatcgcgagctttctgatcatctgcgcagcccctttcgcgtcccactttctgtataaagccggggggggctcatacatcgctgcaggcattctcttctctctggtggtaatgctctatgtcatttgggttcaggctgtggccgacatggagagttaccgcaatatgaaaatgaaagattgtcttgatttcaccccatctgtgctgtatggttggagcttctttctcgcccctgcgggaatcttcttttccctgctagccggtctattattcttggtagtaggctggcacatccagattcaccattag

SEQ ID NO: 31333 - DNA, 690 bp, Artificial Sequence
  Description of Artificial Sequence: Synthetic coding sequence
atgagactgaatatcgctatattcttcggggccctgttcggggcactcggagtgttgctgtttcttgttgcctttggcagtgactactggctcctcgccactgaggttgggcgctgtagtggtgagaaaaacatcgagaatgtaacattccatcacgaaggattcttttggaggtgttggtttaatgggattgttgaagaaaatgattctaatatctggaaattctggtacaccaaccagccaccttccaaaaactgcacccacgcttacctctctccttatccctttatgcgcggcgagcataacagtacaagctatgacagtgcagtgatatacagaggtttctgggcagttctgatgttattaggcgtggtggcagtcgtgatcgcctccttcctgatcatctgcgccgcacctttcgcttctcactttctgtacaaagctggtggaggctcgtatatcgccgctgggatcctgttttcactggtggtcatgttatacgtgatatgggtgcaggcggtggccgatatggaatcttaccgcaatatgaagatgaaggattgtcttgattttactccttctgtcctttacggttggagctttttccttgccccagcaggaatctttttctcactgttggctggcctgttgtttctggtggtggggtggcacattcagatccaccattag

SEQ ID NO: 31334 - DNA, 1131 bp, Artificial Sequence
  Description of Artificial Sequence: Synthetic coding sequence
atggctcgcgggccagggccccttgggcgtccaaggccagacaccgttgccatgcctaagcgtggcaagaggctgaaatttagagcccacgacgcatgctcggggcgggtcacggtggcagactacgcaaactccgacccggccgtggtgaggtccgggcgggtgaagaaggctgtcgcaaacgccgtgcaacaggaggtgaagagcctgtgtggactagaggcaagtcaggttccggctgaagaagccctgagtggagcaggtgaaccttgtgatataatcgattcaagtgatgagatggatgcacaggaggaaagcatccatgagcgaacagtaagccggaaaaaaaagtctaagagacacaaagaggagctggacggagcaggtggtgaagagtacccaatggacatctggttgctgctggcgtcctatattcgtcccgaagatatcgtgaatttctctctgatctgcaagaacgcttggactgtgacctgcaccgcggcattttggaccagactgtataggcgccactacacgctggacgcttctctgcctcttcgtctgcggccggagtccatggagaagcttaggtgtctgcgagcttgcgttatccgctccttgtaccacatgtacgaaccgttcgcagcacggatttccaaaaaccctgcaattcccgagagtacacctagtacattgaaaaactccaaatgcctcttattttggtgcagaaaaatagtcgggaatagacaagaacccatgtgggagtttaattttaagtttaaaaagcaatcgccaaggctgaagtccaagtgtacaggcgggcttcagcccccagttcaatacgaggatgtccatacaaatcctgatcaggattgctgcctgctgcaagtgactacgctgaattttatcttcatcccaatagtgatgggaatgatttttacactcttcacaataaacgtgagcacagacatgcggcatcacagagtcagactcgtgttccaggactcacccgtgcacggtggacggaagctgagatctgagcaaggggtacaggtgattcttgacccagtgcatagcgtgcggctattcgactggtggcatccccagtaccccttttccttaagggcctag

SEQ ID NO: 31335 - DNA, 1242 bp, Artificial Sequence
  Description of Artificial Sequence: Synthetic coding sequence
atgtccaatgtgtcgggtattctggaaactgcgggcgtacccctggtcagtgctaactggcctcagccctctcccccaccagcagtgccagcaggcccccagatggaccatatggggaatagcagccagggggctccatggttgttccttacctcggctctcgccaggggggtttccggaatctttgtctggactgcactggtattgacatgccatcagatttatctgcacctgcggagttacacagttccgcaggaacagcggtatatcatacgtctgttattgattgtcccgatatatgctttcgactcctggctttcgcttttacttctgggcgatcatcaatattacgtgtacttcgactcagttcgcgactgctacgaggctttcgtgatctactctttcttgtcattgtgcttccagtatcttggcggagagggagctattatggcagaaattcgaggtaagcctatcaagagcagttgcctgtatggcacctgctgtcttagggggatgacctattcaattgggttcctgaggttctgcaagcaggctactctgcaattttgcctggtaaagcctgtgatggcagtgacgacgatcatcctacaagcattcgggaaataccatgacggcgatttcaacgtccgtagtgggtatctgtatgtcacgcttatctacaacgcttcagtgtccctggctctgtacgcgctctttcttttttacttcaccactcgggagttactgaggcctttccaacccgtgctgaagttcctgacaatcaaggccgtcatcttcctgtctttctggcagggactgctcctggcaatccttgagagatgcggggtgattccagaggtggagactagcggaggtaataagctgggagccggaacacttgccgcaggataccagaatttcattatttgcgtggagatgttgtttgccagcgtagccctacgctacgctttcccttgccaggtctacgcagaaaaaaaagagaattcaccagctccacctgctcctatgcagtctataagctctggaattcgcgaaacggtgagccctcaggacatcgtgcaggatgcaatccacaatttttcgcctgcctatcagcattacacccagcaggcaacacacgaagctcctcgccctggcactcacccatcaggggggtctggcgggtcgcgcaaatcccgatccctggagaaacgcatgctgattcccagtgaggacctgtag

SEQ ID NO: 31336 - DNA, 528 bp, Artificial Sequence
  Description of Artificial Sequence: Synthetic coding sequence
atgtccaacgtttccgggatattggaaactgcaggtgtgccgttagtttccgctaattggccccaacccagtcccccacccgccgtaccagctggtccgcagatggatcacatgggcaacagctctcagggcgcaccttggctgtttttgacatctgcccttgctcggggcgtcagcggtatctttgtctggactgcccttgtcctcacatgccaccagatatacctacacctgaggtcatatactgtgccacaagagcagcgctatattattcggcttctgctgattgtcccaatttacgcgtttgattcttggctgtctctcctgttgctgggggatcatcaatactacgtttattttgattccgtgcgggactgttacgaggcctttgtcatttactctttcctgtccctgtgttttcagtatctgggcggcgaaggagctatcatggctgagatccggggaaaacccattaaatcctcatgtctttacggcacgtgctgcctgagaggcatgacctacagttag

SEQ ID NO: 31337 - DNA, 420 bp, Artificial Sequence
  Description of Artificial Sequence: Synthetic coding sequence
atgtcaaatgtttccgggattctggagactgccggtgtgcccctggtcagcgccaattggcctcagccgtcacccccccccgccgtgcccgccggccctcagatggatcacatgggcaatagtagccagggagccccatggctattcctgacatcagcactagctaggggcgtgagtggaatttttgtctggactgctctggttctgacctgtcatcagatctatctgcatctcagaagttacacggttccccaggaacagcgatatattatccgtctgctcttgatcgtgccaatctatgccttcgactcttggttgagtctccttctcctgggggaccaccagtactatgtctattttgattcggtaagggattgctacgaggctttcgtgatctacagctttttaagtctgtgctag

SEQ ID NO: 31338 - DNA, 477 bp, Artificial Sequence
  Description of Artificial Sequence: Synthetic coding sequence
atgtcaaatgtgagcgggatcctggagaccgctggcgttcctctcgttagcgctaactggcctcagccgtcacccccccctgcggtgccggccggcccacagatggaccacatgggcaattcttcacaaggcgctccttggctgtttctaactagcgccctggcccgcggggtatccggcatctttgtctggaccgccctggtcttgacctgccaccaaatttaccttcacctgcggagttacaccgttccacaggagcaacgctacatcataaggctgttgctgattgtgcctatctatgcatttgacagctggctcagtctgcttttgcttggggaccatcagtattacgtctattttgattctgttagagactgctacgaggccttcgtcatctactcttttctatctctctgttttcagtatctgggcggggagggagctatcatggctgaaattcgcgggaagcccatctag

SEQ ID NO: 31339 - DNA, 1224 bp, Artificial Sequence
  Description of Artificial Sequence: Synthetic coding sequence
atgacagtgagaggcgatgtcctggcccctgacccagccagcccaacaacagccgcagcatcaccgtccgtctccgtcattccagaagggtcaccaacagccatggaacaaccagtctttctgatgaccactgctgcacaagccatctctggtttcttcgtgtggactgcactgcttatcacctgtcaccaaatctatatgcacttgcggtgttactcatgccctaatgagcagcggtatatcgtccgcattctgtttattgtgcccatatatgcatttgatagctggttatctctgctgtttttcaccaatgatcaatattacgtttactttgggactgtgcgcgattgttacgaggccctggtcatttacaactttttgagtctgtgctacgagtatcttgggggggagtcatcgatcatgtctgaaattaggggcaagcccatcgagagtagttgtatgtacgggacctgctgcctgtggggtaagacttattctatcggattcctgagattctgtaaacaagccacgctacagttctgcgtggtaaaacctcttatggccgttagtaccgtcgtacttcaggcatttggcaaatacagagatggggatttcgacgtcacctcaggatatctctatgtgacaatcatatataatatcagtgtgtcactagccctttatgcgctcttcctgttttattttgctacgagagagcttctgagtccttattcaccagtgctgaagttttttatggtgaaatctgtaatctttcttagtttctggcaaggtatgttgttggcaattttggagaagtgcggtgccatacctaaaatacacagtgcccgcgtttcagtgggggagggaactgtcgcagctgggtatcaggatttcattatctgtgttgaaatgttcttcgctgcattggccttgagacacgcattcacatataaggtgtacgcggataagcgccttgacgcccaaggacggtgcgcacctatgaagagcatcagtagttcactaaaggaaaccatgaatccccacgacatagttcaggatgctattcacaacttttcacctgcctatcagcagtacacacagcagtctacactggagccagggcccacttggcgcgggggagcacacggcctgagtcggtcacactcactgagcggagcacgcgataatgaaaagaccctcctcctatcgtccgatgatgaattttag

SEQ ID NO: 31340 - DNA, 1224 bp, Artificial Sequence
  Description of Artificial Sequence: Synthetic coding sequence
atgaccgtgcggggcgatgtactcgctcccgaccccgcgtcccctaccacagctgctgcctcaccatcagtgagcgtaattcccgagggctcccccaccgcgatggagcagccagtctttttgatgaccacggcagcccaggccatttctggcttttttgtgtggactgcgctcctgatcacttgtcaccagatttatatgcacttgaggtgttattcttgtcctaacgaacagagatacattgttaggatattgtttattgtgcctatctacgcatttgattcctggctttctttgctcttttttaccaacgaccaatactacgtttacttcggcacggttagggattgttacgaagccctagtcatatacaactttctgtctctgtgttacgaataccttggaggcgagtctagcattatgtcagagataagagggaagcctatcgaatcaagctgcatgtatgggacctgctgtctgtggggaaagacctacagcattgggtttttgaggttctgtaagcaagctacgcttcagttctgtgttgtaaagccactgatggctgtgtcgactgtggtgctgcaggcattcgggaaatacagggatggagactttgacgtgaccagtggctacctgtacgttacaataatctacaatatttccgtgtctctagccctctatgctctttttctcttctacttcgccaccagggaactgcttagtccatactctcccgtgctgaagtttttcatggtgaagtctgtgatcttcctgtccttctggcagggtatgctgctggctattttagagaagtgtggcgctatccccaagatccacagtgcaagagtttccgtgggagagggaaccgtggccgccgggtaccaggactttatcatctgtgtagagatgttctttgccgccctggccctgaggcacgcattcacgtataaagtgtacgcggataagcgcctggatgcccagggacggtgtgcacccatgaagtcaatttcgagcagcctgaaagagacgatgaaccctcatgatatcgtgcaggacgctatccataacttcagccctgcatatcagcagtacacccagcagagtacattggagcctgggccaacgtggcgtggaggcgcacacgggctctcccggtcccatagcttatctggggcccgcgacaacgaaaaaacactccttctgagctccgacgacgagttttag

SEQ ID NO: 31341 - DNA, 420 bp, Artificial Sequence
  Description of Artificial Sequence: Synthetic coding sequence
atgcatctgcgctgttattcatgtcccaacgaacagcggtacattgtgagaatcctgttcatcgtgcctatctacgcctttgacagttggttgagtcttctcttttttactaacgatcaatactacgtctatttcggcacggtgagggactgctacgaagcgttagtcatatataacttcttgagcttgtgctatgagtacttggggggggagagcagtattatgtctgaaatccgcggcaagccaatcgaaagttcttgtatgtatggcacttgctgtctctggggcaagacctactctatcgggttcctgcgcttctgtaagcaggccaccctgcagttctgtgttgtgaagcctctgatggcagtgagcacggttgtactccaggcatttgggaaatacagagacggggatttctag

SEQ ID NO: 31342 - DNA, 219 bp, Artificial Sequence
  Description of Artificial Sequence: Synthetic coding sequence
atgaccgttcggggcgacgttctggcacctgatcctgcctcacctacaactgcggctgcttcccccagcgtctcagttattccggaaggcagcccgacagccatggagcaacccgtctttctcatgaccacagctgcacaggctataagtggattcttcgtatggactgccttactgattacgtgtcatcagccgcgtgcaagactgggccaagtatag

SEQ ID NO: 31343 - DNA, 1053 bp, Artificial Sequence
  Description of Artificial Sequence: Synthetic coding sequence
atgaatccccgtgggctctttcaggacttcaatccttctaagttcctcatctatacatgcctgttgctcttcagcgtgctcctgcccctccgtcttgacggtataattcagtggtcctactgggccgttttcgcccccatctggctttggaagcttctggttgtggccggcgctagcgtaggagccggggtttgggcgcgtaaccccagatacaggacagagggggaagcctgtgtggagttcaaagcgatgctgatcgccgtgggaatccatttgctgcttctaatgttcgaagttctcgtctgcgacagggtggagagggggacccacttttggctactagtatttatgccgctcttcttcgtgagtcctgtgtccgtcgctgcttgtgtatggggttttagacacgatagaagcctggaactggaaattctttgcagtgttaatattcttcagtttatcttcattgctcttaagctggatcgcatcatccactggccatggctggtagttttcgtccccttgtggattctgatgtcattcctgtgtcttgtagtgctgtactacattgtatggagtcttctcttcttgaggtccctggatgtggttgcagagcagcgtaggacccacgtgacaatggccataagttggatcacgattgttgtacccctacttacgtttgaggtgctcctggtccatcgcttggatgggcacaatactttctcttatgtctcaatctttgttcctctgtggctgtcgctgttgacactcatggcaacaacctttagacggaagggcggaaatcattggtggttcggaattaggagagatttctgccaatttttacttgaaatttttccgtttctgcgggagtacgggaacatcagctatgacctgcaccacgaggattctgaggacgccgaagagacgtcagttcccgaagcgcctaagatcgcgcctatcttcggaaagaaagcccgcgtggtgattacacaatcccctgggaagtacgtgccaccacctcccaagcttaacatcgacatgccagactag

SEQ ID NO: 31344 - DNA, 642 bp, Artificial Sequence
  Description of Artificial Sequence: Synthetic coding sequence
atggcggcgcttttgagagcagttcggcggtttagagggaaggctgtttgggagcgaccgctgcacggcctgtggtgttgtagtggccaggaggaccccaagagatgggtgggttccagcagccctattagcaaagagaaacttcctaatgcagagaccgagaagttttggatgttctaccgattcgacgccattcgcaccttcggattcttgagtcgcctgaagctcgcccagacagccctcacagttgtggcgctgccaccgggatactatctgtattcgcagggtctcctcactctcaacacagtgtgcctgatgtcgggcatctccggcttcgcactgaccatgttatgctggatgtcttacttcctcagacgactggtaggcattctctatctgaatgagtccggtaccatgctacgtgtggcccatctgaacttctggggatggcgccaggatacctattgccctatggctgacgtgattcccctgacagagacgaaagatcgccctcaggagatgttcgtcaggatccagcggtatagtggcaagcagaccttctacgtcaccttgaggtacggtcgcattctggacagggagaggtttacacaggtgttcggagtgcaccagatgctcaaatag

SEQ ID NO: 31345 - DNA, 786 bp, Artificial Sequence
  Description of Artificial Sequence: Synthetic coding sequence
atgaatcctgaatggggccaggcttttgttcatgttgctgtagccggaggactgtgcgccgttgccgtgttcacaggcatctttgattccgtcagcgtgcaagtaggctacgagcactacgccgaagcaccagttgccggactacctgcctttctcgccatgccatttaattcactggtgaacatggcttacaccctgctgggtttaagctggctgcacagggggggggcgatgggccttgggcctaggtaccttaaggacgtcttcgccgcaatggcgctgctgtatggccctgtacaatggctccgactttggacccagtggagaagggccgcagttctggatcagtggctgaccctgccaatctttgcttggcccgtggcctggtgtttgtacttggaccgtggatggcgtccctggctctttctgtctctggagtgtgtgtccctagctagctacggcctggctcttctgcacccccagggctttgaggttgctctgggagctcacgtggtcgctgccgtaggtcaggctcttaggacccataggcactatggatcaaccacctccgccacataccttgctttaggagtgttgtcctgtctcggttttgtggttctcaagctttgcgaccaccaactcgcccgctggcggcttttccagtgtctgacagggcacttttggagcaaagtgtgtgacgttctgcagttccacttcgctttcctcttcctgacgcactttaacactcaccctcgatttcacccaagcggtggtaagactagatag

SEQ ID NO: 31346 - DNA, 201 bp, Artificial Sequence
  Description of Artificial Sequence: Synthetic coding sequence
atgaatcctgaatggggccaggcctttgtgcatgtggcagtggccggaggtctctgcgccgtcgctgtgttcactgggatttttgactctgtctcagttcaggttggctatgagcactatgcagaggcccccgtggccggcttaccggcgttcttggccatgccattcaatagcctggtcaatatggcctataccctgtag

SEQ ID NO: 31347 - DNA, 102 bp, Artificial Sequence
  Description of Artificial Sequence: Synthetic coding sequence
atgaacccggaatggggacaagcgttcgttcatgttgcagtggctggaggattatgcgcagtcgctgtttttactgggattttcgacagtgtgtctgtttag

SEQ ID NO: 31348 - DNA, 144 bp, Artificial Sequence
  Description of Artificial Sequence: Synthetic coding sequence
atgaactccttggaacaggccgaggatcttaaggcttttgaacgcaggctgacggaatacatccactgtttacagcctgccaccggacggtggaggtcagtcttattgcacatcatcatggaaagccccatattccatcactag

SEQ ID NO: 31349 - DNA, 378 bp, Artificial Sequence
  Description of Artificial Sequence: Synthetic coding sequence
atgaattcactagagcaggcagaagatctgaaggcatttgagcgtcgtctgacagagtacatccactgtctccaaccggcgacaggccgatggcggatgctgctaattgtcgtcagtgtatgtaccgccactggtgcctggaactggctgattgacccggagactcagaaggtctctttctttacaagtctctggaatcatccattctttacaataagttgcattaccttaatcggcctgttttttgccggcatccacaagcgagttgttgccccatccatcattgctgctcgctgccggactgtgcttgccgagtataacatgtcatgtgatgacaccggaaagctaatcttaaagccgcgcccacatgttcagtag

SEQ ID NO: 31350 - DNA, 429 bp, Artificial Sequence
  Description of Artificial Sequence: Synthetic coding sequence
atgaactctctagagcaggctgaggcaccccgtgtggtgtcgctgatccccgccgttgttagcggtaactgtcaggacctgaaggcttttgagcgacgcttgacagagtatattcattgcctacaaccggccacgggccggtggaggatgttgctcatcgtggtaagtgtctgcaccgccacgggcgcgtggaattggctgatcgacccggagacccagaaagtgtcttttttcacttcgctctggaaccacccgtttttcaccatcagttgcatcactcttattggcttattcttcgctggcattcataagagggttgtagcaccatcaataatagcagctaggtgtcgcaccgtcctagccgagtacaacatgtcctgcgacgacacgggtaagctcatactaaagcctcgaccgcacgtgcagtag

SEQ ID NO: 31351 - DNA, 804 bp, Artificial Sequence
  Description of Artificial Sequence: Synthetic coding sequence
atggcaggggctgagaattggcccggccagcagctcgagctggacgaagacgaagcctcttgctgcaggtggggcgcccagcatgcgggagcaagagaactcgctgcactgtactcccctggcaagagattgcaggaatggtgtagcgtcatactttgtttcagtcttatagcacacaacctagtccacctgctgctgctcgcacggtgggaagataccccgctggtcattttgggggtggtggcaggcgccctcatcgctgatttcctttctggattggttcactggggggctgatacctggggaagtgtggagctgccaatcgcattcatacgcccttttcgcgaacaccacatcgatcctactgcaatcactcgccacgactttattgagaccaacggggacaactgcctggtaaccttattgcctctcctgaatatggcttacaaatttcgcacccattcccctgaggccctggagcagctgtacccttgggagtgtttcgtcttctgccttatcatcttcggcacctttaccaaccagattcacaaatggagtcatacgtattttggcctccctaggtgggtgacactgttgcaggattggcacgtaattctgccacgcaaacatcatcgtatacatcatgtgtccccacacgaaacctatttttgcattactacaggttggctcaattacccattggaaaagattgggttctggcggaggctggaagacttgattcagggcttgacgggtgaaaagccacgggcggacgatatgaaatgggcccagaagattaaatag

SEQ ID NO: 31352 - DNA, 813 bp, Artificial Sequence
  Description of Artificial Sequence: Synthetic coding sequence
atggccggggctgaaaactggcctgggcagcagctagaactagatgaagacgaagcatcttgctgtaggtggggtgcccagcatgccggggctagggaactggcagctctgtattctcccggtaagagacttcaggagtggtgcagcgtgatcttatgtttcagcttgattgctcacaatctggtgcacctcctactcctggccaggtgggaagacactccactcgttattttgggtgtggtcgcaggggctcttattgccgattttttgtctggactggtgcattggggggctgatacctgggggagcgttgagcttcccattgtcggaaaagcttttattcggccatttcgggagcaccacatcgatcccaccgcgatcacccgacatgactttatagagactaacggcgacaactgccttgtgaccttgcttccgctgctaaacatggcctataagttcagaacacatagtccagaagctttagagcagctgtacccatgggagtgcttcgtgttttgtttgataatcttcgggactttcactaatcagatacacaagtggagccacacctactttggtctacctagatgggtgacgctgcttcaggactggcacgtgattctgcctcgtaagcaccaccgaattcaccacgtctcccctcacgagacctatttctgcattaccactggctggctcaattatccactcgaaaagataggtttctggaggcggctggaagacttaattcaaggactgaccggagagaagccgcgcgccgatgacatgaagtgggcccaaaaaatcaaatag

SEQ ID NO: 31353 - DNA, 588 bp, Artificial Sequence
  Description of Artificial Sequence: Synthetic coding sequence
atgaatgaacgagccattgcaggagcgttgatcgcggacttcttgagcgggcttgtccattggggggcagatacatggggaagtgtggagcttcctattgttggtaaagcatttatccgaccctttagagagcaccacatcgacccaacagccataactcgccatgacttcatcgagactaacggcgacaattgtcttgtgaccctgctgcctttgcttaatatggcctataaattcaggacacacagtcctgaagccctggaacaactctacccctgggagtgttttgtcttttgcctgattatctttggcaccttcactaaccagatccataagtggtcccatacatattttgggcttccgcgctgggtaactctgctgcaggactggcacgttatcctgccccggaagcaccatcgcattcaccatgttagtcctcacgagacatacttctgcatcactacaggatggctgaactaccccctcgaaaagataggattttggcggagactggaagatttgatacagggcttgactggcgaaaagccaagggctgacgatatgaagtgggcgcagaagatcaaatag

SEQ ID NO: 31354 - DNA, 1113 bp, Artificial Sequence
  Description of Artificial Sequence: Synthetic coding sequence
atggccggggcggagaactggccagggcagcagctcgagttggatgaggacgaggcctcgtgttgccgatggggcgcccaacatgcaggcgcaagggaactggccgcattgtactcccccggtaaacgacttcaggaatggtgtagcgtgatcctgtgcttttccctaatcgctcacaatcttgtacacctccttctattggctagatgggaggataccccactggtcatcctcggcgtcgtcgctggtgcattgatcgctgacttcctctctggtctggttcattggggagcagacacttggggctcggttgaactgcccatcgtcggcaaggcctttatccggccatttagggaacaccatattgacccaaccgcgatcacacggcatgacttcattgaaactaatggggataattgcttggttacactgctcccccttctgaacatggcctacaagtttcggacccacagcccggaggccctagagcagctgtatccctgggaatgtttcgtattctgtcttatcatcttcggaacattcaccaaccaaattcacaagtggtcgcacacatattttggcctgcctcgctgggtaaccttactgcaggattggcacgtgatactgcctcgcaaacaccacagaatccaccacgtgtctccacatgagacatatttctgcatcacaactggcgtgaaggtgccacgtaactttcggttactcgaggaattggaagagggtcaaaagggtgtgggcgacggcaccgtctcttggggcctggaggatgatgaagacatgacccttactcgctggaccggcatgatcattgggccacctagaactatctatgaaaatcgcatttacagcttaaagattgagtgtgggcctaaataccctgaggccccaccttttgtgcggttcgtgaccaaaattaatatgaacggggtgaacagcagtaacggtgtggttgaccctcgggcaatatcggtgttagctaaatggcagaattcatatagcatcaaagttgtgctccaggagctcaggagactgatgatgtcgaaggagaatatgaagctgccgcagcctccagagggtcagtgttactcaaactag

SEQ ID NO: 31355 - DNA, 1011 bp, Artificial Sequence
  Description of Artificial Sequence: Synthetic coding sequence
atgactgaccttaacgacaatatttgtaagaggtatatcaaaatgatcactaacatcgtaatcctgtctctcatcatttgcatttccctggctttctggatcatcagcatgacagccagcacctattacggcaatctgcggcctattagcccctggaggtggctttttagtgttgtggttccagttcttattgtttccaatgggctgaagaagaagtcgctggatcatagcggagccttaggtggactggtcgtggggtttattctaactattgccaatttttctttttttacctccctcctgatgttttttttgagttccagtaagctgactaaatggaaaggagaggttaaaaaaagactggactcggagtataaagagggaggtcaaaggaattgggtgcaggtattctgcaacggtgccgtgccaaccgaacttgctctgctgtatatgatcgagaacggtcccggagaaatacccgtcgactttagtaagcagtattcagcgtcttggatgtgtttgtccctgttggccgcgctggcttgctcagccggagacacatgggccagcgaagtgggccccgtcctctccaagtcttctcctcgactcattacgacttgggagaaggtcccagtaggcaccaatggcggcgtgaccgtggtggggctagtgagtagcctgttggggggtacattcgtgggcattgcttatttcctaactcagctcatttttgtgaacgatctggatatctctgctccccaatggcctattatcgcatttggcggtcttgccgggttactgggctccatcgtagacagctacctaggcgccactatgcagtatacagggctggatgaatcgactggcatggtggttaactctcctacaaataaagcccggcatatcgccggtaagccgattctggacaacaatgccgtcaacctgttttctagcgtgctgatcgccttgctcttgcccaccgcagcatggggcttttggccccgcggctag

SEQ ID NO: 31356 - DNA, 1011 bp, Artificial Sequence
  Description of Artificial Sequence: Synthetic coding sequence
atgaccgatctcaacgacaatatctgcaagaggtacattaagatgatcactaacatagtcatccttagcttgatcatatgtatcagtcttgccttttggatcattagcatgaccgcatccacgtattacggcaatctgcggcccatcagtccctggaggtggctgttcagcgttgtggtccctgtcctgatcgttagtaatggccttaagaaaaaatctttggaccatagcggagctttgggcggccttgtcgtcgggttcattctcaccatcgccaacttttctttttttacctctctactgatgtttttcctgagctcaagcaagctgactaagtggaagggcgaggtgaagaagcgcctagactcggagtacaaagaaggcgggcagcgtaattgggtgcaggtgttttgcaatggcgcagtcccaacagaactagcgctgctgtatatgattgagaatggacccggagagatcccggtagacttctctaaacagtatagtgcaagttggatgtgcctcagcctcctcgctgccctggcctgctctgccggtgacacctgggcatctgaagttggccccgtattgtctaagtcatctccacggctgatcacgacttgggagaaagttccagtgggcacgaacggtggtgtgacggtagtaggcctggtgagtagcctgctgggcgggacattcgtcggcatcgcttatttcctgactcagttaatcttcgttaatgacctcgacatcagtgcacctcagtggccaataattgctttcgggggactggctggcctgttagggtctatcgtggactcctatctgggcgcaactatgcagtatacaggactggatgagtctactggcatggttgtgaatagtcctactaacaaggcaaggcacatcgcgggaaagccaatacttgataataacgctgtgaacctgttctctagcgtgctgatcgccctgctgctacccacggcagcctggggcttttggccccgcggttag

SEQ ID NO: 31357 - DNA, 897 bp, Artificial Sequence
  Description of Artificial Sequence: Synthetic coding sequence
atgaccgatctcaatgacaatatctgcaagcgctatatcaagatgatcaccaatatcgtgatactatcactgattatctgcatctctctggcgttttggataatttctatgacagcatctacatattacgggaaccttagaccaatttctccctggcggtggctgttctcagtggtcgtgcccgttctgatcgtgtccaatgggttgaagaagaagagtctggaccactccggggccctcggaggacttgtggtcgggttcatcctgactatagccaacttttccttctttaccagtctcctgatgttttttctgagttcttcgaaactgaccaagtggaagggtgaggtgaagaagcggctcgattctgagtacaaggaaggcgggcagaggaattgggtccaggtgttttgcaatggcgctgtgcccacagagttagctctgctctatatgattgagaacgggccaggggaaattccggttgatttttcaaagcaatattccgcgtcctggatgtgtttgagcttgttggccgctcttgcctgttcagctggagatacctgggcttccgaagtgggccctgtgctctccaagtccagcccaagactgatcaccacatgggagaaggtcccagtggggaccaatggcggtgtgactgtagtcggcctagttagcagcttactcgggggcacgttcgtgggcatcgcgtactttctgacccagctcatctttgtcaacgatttagacattagcgctcctcaatggccaatcattgcattcgggggcttggccggccttctgggaagcatcgtggactcatatctgggtgccaccatgcagtacaccggaaagaatatcccttcctttctgcagctaataggcatgctgaaaaaatag

SEQ ID NO: 31358 - DNA, 513 bp, Artificial Sequence
  Description of Artificial Sequence: Synthetic coding sequence
atgacagacctaaacgacaacatttgcaagcgatatattaagatgatcacaaatatagtgattctgtcactgatcatatgcatttccctcgcgttctggatcatcagcatgaccgcgtcgacttattatggtaatcttaggcctatatccccatggcgctggctgttttcagtcgttgttccagtgttgattgtatccaatggcctaaaaaaaaaatccctagatcactctggcgcgctaggagggctggtcgtcgggtttattttgacgattgctaacttctccttttttaccagcctcctgatgttcttcctgtcatccagcaagcttaccaagtggaagggcgaagtaaaaaaacgccttgattcagagtataaagagggcggtcagcgtaactgggtgcaggtattctgtaacggcgctgtgcctactgagctcgcactgctgtacatgatcgagaatggcccaggtgaaattccagtcgattttagtaaacaatactccgcttcttag

SEQ ID NO: 31359 - DNA, 459 bp, Artificial Sequence
  Description of Artificial Sequence: Synthetic coding sequence
taagatacgtgggcgtctgaagtggggccagtgttgtctaaatcctctcctcgccttattaccacctgggagaaggtgccggtgggaactaacgggggcgttaccgtggtggggctggtgagttccttgctggggggtacatttgttggcattgcttactttctaacacagctgatctttgtgaatgacttggacatttccgcccctcagtggccaattatagccttcggaggcctcgcagggctactgggctctatcgtggacagttacctgggggccacaatgcaatacactggcctcgatgaaagcactggaatggtggtaaattcccccacaaacaaggctcggcatatcgccggcaaacccatattagataacaatgccgtgaatctgttcagctccgtgctaatcgcgttactgctgcccacagcggcctgggggttttggcccagagggtag

SEQ ID NO: 31360 - DNA, 534 bp, Artificial Sequence
  Description of Artificial Sequence: Synthetic coding sequence
atgcttggctgcggcatccctgctttggggctgttgcttctgctgcagggaagcgcagatgggaacggaattcagggctttttctatccttggagttgcgaaggagatatctgggaccgcgagagctgcggcgggcaggccgcaattgacagccctaatctctgcctgcggttgaggtgttgctacaggaacggggtgtgctatcatcaaagaccagacgaaaatgtccgtcgaaagcatatgtgggctctggtgtggacttgtagcggccttctattattatcctgcagcatctgcttgttttggtgggctaagaggcgcgacgtgctgcacatgcctggctttctggcaggtccgtgcgacatgagtaagtcagttagtctactttctaaacacagaggtacaaagaagacaccttcaacagggtctgtgcctgtggccttgtctaaagagtcccgggacgtcgaagggggcactgagggggagggcaccgaagaaggggaagagaccgagggcgaagaggaagaggattag

SEQ ID NO: 31361 - DNA, 816 bp, Artificial Sequence
  Description of Artificial Sequence: Synthetic coding sequence
atggcggccggtggtcgtatggaggacggctcacttgacataactcagtccatcgaggatgatccactcctcgatgcccagctgctgcctcatcattcactccaggctcacttcagacccagatttcacccactgcccaccgttatcatcgtaaatctgctttggtttattcatctcgtgttcgtcgttctagcgtttttaaccggtgttctgtgcagctaccccaatccgaatgaggataaatgtcccgggaactataccaatcctctcaaggtgcaaacggtcatcatcttgggcaaggtcattctgtggattcttcatctcctcctggagtgctacattcagtatcatcattctaagattcggaatcgcggttacaatctgatttatcgctctacacgacatctaaagagattggctcttatgatccagtcatccgggaatactgtgctccttctgatcctttgcatgcagcattccttccctgagccaggtagattataccttgaccttatcctggctatcctggctctggaattgatttgctcactcatttgcctgctgatctacaccgtcaagatcaggaggtttaataaagccaaaccagaaccagatatccttgaagaggagaaaatttacgcctatcccagcaatatcacctccgagacggggtttaggacaatttcctccctggaggagatcgttgagaaacagggagacacgatcgaatatcttaagcgtcacaacgctctgctaagcaagcgcctgctggcccttacctcctctgatctaggctgtcaaccatcccgaacatag

SEQ ID NO: 31362 - DNA, 804 bp, Artificial Sequence
  Description of Artificial Sequence: Synthetic coding sequence
atgaacaaggccaccggctctttagatataacccagtccatagaagacgatcctcttctggacgcccagctgctgcctcaccatagcctccaggcgcactttagacccagattccaccccttacccacagtcataattgtgaacctgctctggttcattcatctagtttttgtggtcctggcatttctgacaggagttctgtgttcctaccctaaccccaatgaagataaatgcccaggcaactatacaaaccccctcaaggtgcaaacggtaattatcctgggcaaggtcatcttatggatcctgcaccttttactagagtgctacatccaatatcaccactccaagatcagaaaccgtgggtataacctgatttatcggtccacgagacacctcaagcgccttgcactgatgatacaatcaagtggaaacacagtcttactgctcattttatgtatgcagcactcatttcctgagcccggccgcctgtacctggaccttatccttgccatactggcactcgagctgatctgctcactcatatgcctcctcatttataccgtgaaaatccggcggttcaataaggccaagcccgagcccgatattctcgaggaagagaaaatctacgcttaccccagcaacattactagtgagactggcttccgcacaatttcctctttggaagagattgtggagaaacagggggacactatagagtacctgaaaaggcataatgccctgctgtcaaagaggctgctcgctctgacttctagcgatctcgggtgccaacccagtaggacatag

SEQ ID NO: 31363 - DNA, 1335 bp, Artificial Sequence
  Description of Artificial Sequence: Synthetic coding sequence
atggccggaggcatgaaggtggcagtgtccccagctgttgggcctggaccttgggggtctggcgtgggtggaggcggaacagtgcggttattgctgatcttatctggctgtcttgtgtacggcacagccgagactgatgtcaatgtggtcatgttacaggagagccaagtgtgcgaaaagcgtgcttcacagcaattctgttatacgaatgttttgatcccgaaatggcatgatatttggacgaggattcagatcagagtaaattcatccagactggtgcgagtgacacaggtggagaacgaagagaagctaaaggaattagaacagttctctatctggaacttcttttctagttttctgaaggagaagctgaatgacacttacgtgaatgtaggtttgtactctacaaagacatgtcttaaggtcgagattatcgagaaggacaccaaatactctgtgattgtgatccgtagattcgaccccaagttgttcctcgtgttcctgctcggcctgatgctgtttttctgtggagatctcttgtcacggagccaaatcttttactactccactggcatgaccgtgggaatcgtcgcttctctgcttattatcatctttatcctgtctaaatttatgcctaagaagagccccatttacgtgatcctggtgggaggttggtccttttccctatacctaattcagttggtgttcaagaatcttcaagagatatggcggtgttactggcagtaccttctcagttatgtactgactgtggggttcatgagttttgccgtttgctataaatatggcccattggagaatgaacggagtatcaatctcctgacatggacccttcagcttatggggttatgctttatgtacagcggtattcaaattccacatattgcattggccatcatcatcattgctctgtgcacaaaaaatctggaacaccccatccagtggctctacataacctgccgaaaggtttgcaaaggcgcagagaaaccagtgccccctcgcctgctgaccgaggaggagtacaggatccagggtgaggttgaaacccggaaggccctagaggagctcagagaattctgcaactcaccagactgcagcgcctggaaaacggtgagccggatccagtctcctaagagatttgccgatttcgttgagggatctagccatttaacgcccaatgaagtgagcgtccatgagcaggaatacggactcgggagcataatagcccaagatgaaatctatgaggaagcttcctctgaggaagaagatagttacagccgctgccccgccatcacacagaacaacttccttacctag

SEQ ID NO: 31364 - DNA, 1116 bp, Artificial Sequence
  Description of Artificial Sequence: Synthetic coding sequence
atggctggcggcatgaaagtagctgtgagcccggctgtcgggcccggcccatggggctcaggagtgggcgggggtggcacagtgagactgctgctcattctgtctgggtgtctcgtgtacggcacagctgagacagacgtgaacgtggtaatgttacaggaatctcaggtatgcgagaagcgtgctagccaacaattttgttacacaaatgttttgatccccaagtggcatgatatttggacacggatacagattagggtcaactcctcccgcctcgttagagtgacccaggtggagaacgaggagaagctcaaggaactggaacagtctcaaatcttctactacagcaccggcatgaccgtcggaattgtggctagcctgctgatcataatcttcatcctttcaaaatttatgcctaaaaagagccctatttacgtcatactggtcggaggttggagcttctcactgtacctcatccagttggttttcaagaacttgcaagaaatctggcgttgctactggcagtaccttctatcatacgtgctgaccgtcggattcatgagcttcgctgtctgttacaagtacggacccctggaaaacgagagaagcattaatctgcttacctggacactacagcttatgggcctgtgcttcatgtacagcggcatccaaattcctcacatcgctttagcgatcatcattatcgcactgtgtacaaaaaatttggagcaccctattcagtggttgtacatcacctgccggaaggtttgtaagggggctgagaaaccagtcccccctagactgctcacggaagaggagtacaggatccagggggaggttgaaactagaaaagctctggaagaacttagggaattttgcaactctcctgactgtagcgcctggaaaacagtatcccgcatccagtccccgaaacgtttcgccgatttcgttgagggcagctcccacttgacacctaacgaagtttcagtgcatgaacaagagtacggtctggggtctatcatcgctcaggacgaaatttacgaggaagccagttctgaggaggaagactcttacagcagatgtcctgccatcactcagaataattttttaacctag

SEQ ID NO: 31365 - DNA, 519 bp, Artificial Sequence
  Description of Artificial Sequence: Synthetic coding sequence
atgtgtacctcgggccaaatcatcgggtcccttttagtgttaagcgttctcgagattgggctcggagtgtccagcgtggccgtaggcgcagtgagcttctctctggctctgagggaacacaaaccacagttgggggactctagccccttccttctctgcgggatctgcggcattctgtgtgcgaaaaaaaaatccggtctggtgatgattctcttttctgcctgctgtatttgtgggcttattggtgggatactgaattttcaattcctgagagctgtcactaaaaagacaagttccctttatccactacacctcgcctcaatgtccctggcctgcatcgggattggaggttgtacactctcttcttggctcacctgtcggctggcatcctacgagcagaggaggatgttcagcgagcgtgaacacagtctgcatcactcccacgagatggccgagaaggagatcaccgataacatgagcaatggaggccctcagctgattttcaatggacgcgtctag

SEQ ID NO: 31366 - DNA, 270 bp, Artificial Sequence
  Description of Artificial Sequence: Synthetic coding sequence
atgattctgttttccgcctgttgcatctgcgggctgattggtggtattctgaattttcaatttctgagagctgtgactaagaagacctcaagtctataccccctgcatctcgccagtatgtctctcgcctgtatcggaatcggcgggtgcaccctgagcagttggctgacatgccgccttgcttcatacgaacagcgaagaatgttttcggagagagaacactcactgcaccacagccatgagatggccgagaagattgaagggtattag

SEQ ID NO: 31367 - DNA, 1083 bp, Artificial Sequence
  Description of Artificial Sequence: Synthetic coding sequence
atgcccggcacagtcgccaccctgcgattccagctgctccccccagagcctgacgatgctttttggggcgcgccttgtgaacaacctttagagaggcggtaccaagctcttccagccctagtttgcatcatgtgttgcctgttcggcgtcgtgtattgcttcttcgggtatcggtgctttaaagctgtgctgtttctgaccggcttactgtttgggagtgtagtgatttttctcctttgctatcgggagagagtgcttgaaactcagctttctgccggcgcctcagcaggaatcgctctgggaatcggactcttatgtggtctggtcgccatgctagtgcgcagcgttggtctgttcctggttggactcctattggggttgctcttggccgcggctgccctgctaggctctgctccctactatcagccaggctcggtttggggtccactgggactcctgctgggaggcggactcttatgtgccctattgacactgagatggccacggcctcttacaacgttggcaaccgctgtcacaggtgccgctctcatcgcaacagctgcagactattttgctgagttgcttttgctaggccgctatgtcgtggaaaggctacgagccgcacccgtacccccgctttgctggcgttcttgggccctcctggctctgtggccccttctaagcctaatgggagtactggtacagtggcgcgttaccgctgagggggactcccatacggaagtcgtgatttctcgccagagacgccgggttcagctgatgagaatcagacaacaggaggaccgcaaagaaaagaggcgtaagaaaagacctccacgtgctcctctgagaggcccacgtgcaccccctcggcccggaccccccgaccctgcctaccgcagaagacccgtgcctataaagcgcttcaatggggatgtgttgtcaccctcttatattcagagtttccgggatcggcagacaggaagcagcctctctagtttcatggcaagccccacggatgctgactatgagtacggatcacgggggcctctgaccgcctgctccggcccacctgtgcgggtgtag

SEQ ID NO: 31368 - DNA, 1083 bp, Artificial Sequence
  Description of Artificial Sequence: Synthetic coding sequence
atgccagggaccgtcgccaccctaaggtttcagctattgcctcctgaacctgatgacgctttttggggggcgccctgtgagcagccacttgaacggagataccaggcactgcctgctctggtctgtatcatgtgttgtttgttcggcgtcgtctactgttttttcggctacaggtgctttaaagcagtcctcttcctaaccggcctccttttcggttcagtggttattttcctgctgtgttacagggagcgagtactggaaacacaattgtcggctggtgccagtgcaggaattgcgcttggaatcggcctgttatgcggcctggtagccatgttagtcagaagcgtcggactgtttctcgtggggttgttgctcgggctcttgctcgcagctgcggccttgctcggatccgccccatattaccagcccggatctgtgtggggccctttgggccttctcttgggaggcgggttgctctgtgcgttacttaccctgcggtggcctcgcccactgacaacactggcaaccgctgtgaccggagccgcactgatagcgaccgctgccgattatttcgctgagctgttactgcttggacgttacgtggttgagaggcttcgcgccgcccccgtgcctcccctgtgctggcggagctgggctctccttgccctgtggcctctcctgtctttgatgggtgtcctcgtccagtggagggttacagccgaaggagacagccatactgaagttgtgattagtcgtcagcgccgtagagtgcagttaatgaggattcggcagcaagaagacagaaaggaaaaaagaagaaagaagcgcccaccacgcgcccccctccgtggcccgcgcgcacccccgaggcctggacccccagatccggcttacaggcgccggccagtgcccatcaaaaggtttaacggagatgtacttagtccatcctatattcaatcttttcgggaccggcagaccggatcaagcttgagttcctttatggcctcacccacggacgcagactatgagtacggtagcagaggtccccttactgcctgctcagggccaccagtgcgcgtttag

SEQ ID NO: 31369 - DNA, 684 bp, Artificial Sequence
  Description of Artificial Sequence: Synthetic coding sequence
atgcctggtaccgtagcaacgctacgcttccagctcctgccccccgaacctgacgatgcattttggggcgccccctgcgaacagcctctcgaacgacggtaccaggcactgcccgccctggtttgtatcatgtgctgtcttttcggcgtagtttactgtttcttcggttaccgctgtttcaaggccgttctgtttctgacgggcttgctgtttggatcagtggttatcttcctcctgtgttacagagagcgcgttctcgaaactcagctgtcagccggcgctagcgccggcattgctcttggaattggtctcctgtgtggcttggtagccatgcttgtgcggtccgtgggcctgtttctcgtgggcctgctgttaggtttgcttctggcggccgcggccctgttaggctcagctccatactaccagccaggctcagtgtggggtcctttggggctgcttttgggaggcggcttgctgtgcgctcttttgacattgaggtggccccgccccttaacaactctggccacggctgtcaccggcgccgcactgattgccacagcggctgactattttgccgagctcctcctcctagggagatatgtcgtcgaacgtctccgtgctgcccccgtgcctcccctgtgttggcggagctgggccctattggcactctggcccctgttatag

SEQ ID NO: 31370 - DNA, 627 bp, Artificial Sequence
  Description of Artificial Sequence: Synthetic coding sequence
atggcctcttcactactggcaggcgagagactggtcagagctttgggccctggcggcgaacttgaacctgagcgcttaccacgcaaattacgtgccgaactggaggctgctctgggaaagaagcataaaggaggggactcttcttccggccctcagcgtttggtctcttttaggctcatcagagacctgcaccagcatctgcgcgagcgcgatagcaagctctacctacatgagctgcttgaaggctcagagatttatttacccgaagtcgtgaaaccgccgcgaaatccagagctagtggcacggttagagaagatcaaaatccagcttgcgaatgaggaatacaagaggattaccagaaacgtaacatgtcaggacactcggcacggtgggacattgagcgatctgggaaagcaggttagaagtctgaaggctctagtaatcaccatctttaacttcattgtaacagtggttgctgcgtttgtgtgcacttacttgggatcgcagtacatatttacggaaatggcctcaagagtgttggccgccttaatagtggcctctgttgtaggactagcggagctatatgtgatggttcgtgcaatggagggggagcttggggaactttag

SEQ ID NO: 31371 - DNA, 900 bp, Artificial Sequence
  Description of Artificial Sequence: Synthetic coding sequence
atggccagctcactgttagctggcgagagactggttcgagccctgggccccggaggggagctcgaacccgaaaggctgccacggaaactgcgggctgagctggaggcagccttggggaaaaaacataagggtggcgacagctcttcggggcctcagcgccttgtgagctttaggctgattagagatttgcaccagcacctgagagaacgggactccaagttgtatctgcatgagctcctggagggaagcgagatttatttgccagaggtcgtcaagcctccaagaaatcccgagctcgttgccagactggagaagattaagatacaattagctaatgaagagtacaaaagaatcaccaggaatgtgacttgtcaggatacaaggcacggcggcacgttgtccgacttaggaaagcaggtgagatcattgaaggccctggtcattaccatctttaattttattgtgactgtcgtcgcagcattcgtgtgtacctatctcggctcgcagtacatcttcactgaaatggcttctcgaccccgaggggcccattgggctggccgcgacccggagcccggcgagggaactcgtacgaggagggccggagctgagtgggtgcgtcacctgggagctcatgtccaggcgtttggaggggacatgccagaggctggaggaggcaggcgacctggccgcggagccgtcctagtacccccgcacgggccccgggcggccgcacccctgcgcgctggcgctggtcaactgagagccgctcggggccctgggggggccgcaactcatgggcgggaggcgcggtcgcgggtggccttgccggcgaggctcctgcagggcgggagggcagcttttgctgccagattacctagaagtagcggagtcggcgattag

SEQ ID NO: 31372 - DNA, 1476 bp, Artificial Sequence
  Description of Artificial Sequence: Synthetic coding sequence
atgatagcaactggtggagtaatcactggacttgccgcgcttaaacgccaggattctgctcgatctcagcagcatgtgaatctgagccccagtcctgctactcaggagaaaaagcccatccgtagaaggccacgtgctgacgtcgtggtcgttcgaggcaaaatccgactgtacagcccctcggggtttttcctgatcctcggcgtgttaataagtataataggaattgcaatggcggtgctggggtattggccccagaaggagcactttattgacgcggaaacaaccttgtctacgaacgaaacacaagtgatcagaaatgaggggggtgtcgtggtgcgcttctttgaacagcatctgcactctgacaagatgaaaatgctggggccattcaccatgggcataggaatcttcatttttatctgtgccaacgccatactccacgagaatcgcgacaaggagactaagatcatccacatgcgagatatttactcgacagtgatcgacattcatactctcagaatcaaggagcagaggcagatgaatgggatgtacacaggcctgatgggcgaaacagaagttaagcagaacggctcgtcctgcgcaagccgcctcgccgctaacaccattgccagtttctcaggatttagatcctcctttcgcatggattcgtctgtggaggaagacgagctgatgctgaacgaagggaaatccagcggccatctgatgccgcccctactgtccgatagttcagtgtctgtttttgggctttatccaccaccctctaaaaccaccgacgataaaactagcgggtctaaaaaatgcgagaccaaatcaatcgtaagcagctcaatcagtgcctttaccctccctgtgatcaagctgaataattgtgttatcgacgagccgagtattgacaatatcacagaagacgccgataatctgaagagcaggagcaggaatctatctatggatagcctggtcgttcccctcccaaatacaagtgagagctttcagccagttagcaccgtcctgccccgaaataatagcataggcgaaagcttgtcaagccaatacaagagcagcatggccctaggcccaggggctggccaactcctgagtccaggagctgctcggagacagtttggctcgaacacatcccttcatttactgtctagccactccaaatcccttgatctagatcgtgggccaagtacactcacggtccaggcggagcagcgcaaacatcccagttggccccggcttgaccggaacaactctaaaggctacatgaaactggaaaacaaggaagatcctatggaccgcttactcgtgccccaggtggcaatcaagaaggactttacaaacaaggagaaactgctgatgatttccaggtctcacaataatctgagtttcgagcacgacgaattcctgagtaataatctgaaacgtggaactagcgaaactagattttag

SEQ ID NO: 31373 - DNA, 1476 bp, Artificial Sequence
  Description of Artificial Sequence: Synthetic coding sequence
atgatcgctaccgggggagttatcactggtctggctgcccttaagagacaagacagtgcacgctcacaacagcacgtgaatctctcaccctctccagctacgcaagagaaaaagcccatcaggcggcgccccagggcagatgtcgttgtggttcgggggaagatcaggctctatagtccctcaggcttcttcctgatactcggcgtcctcatcagcatcataggaatcgccatggcagtcttaggctactggccacagaaggagcacttcatagatgcagaaacaactctgtcaacgaacgagacacaagtgatcaggaacgaggggggggtggtggttcggttcttcgagcaacatttgcactcagacaaaatgaagatgctgggaccctttaccatggggatcggtatttttatttttatttgtgctaacgccatcctgcatgagaatagagacaaggagaccaagatcattcacatgagagatatctattccacagtgatcgacatacacaccctgaggattaaagaacagcggcagatgaatggcatgtacacggggcttatgggtgagacagaggtcaaacagaatggctcctcttgcgcctcgcgcttagccgcgaacacaatagcttcttttagcggattcaggagtagttttcgcatggactcaagcgtcgaagaggacgagctaatgctcaacgagggcaaaagcagtggccacctaatgcccccactcttgagcgactcctcagtgagtgtgttcggcctgtaccctccaccaagcaagacaaccgacgataagacatccggttctaaaaagtgtgaaaccaagtcaatcgtatcatcatcgatcagcgccttcacgttgcctgtgatcaaacttaacaactgtgttatcgacgagccctctattgataatattacagaagacgccgacaatctaaagagtcgcagtagaaacttgtctatggattcactcgtcgtccctctgcctaatacctccgagagcttccagccagttagtaccgtgctgccaaggaacaactctattggcgaaagcttatcaagtcaatataagtcttcaatggctctcggcccgggtgcaggtcagcttctgtcccctggagccgcgagacgacagtttggctccaacacctccctgcacctgctgtcctcacactcaaagtccctcgatcttgaccgcggaccttcaacactgaccgttcaagctgagcagaggaagcacccttcatggcctcgcctcgatcgtaataactctaaaggctatatgaagcttgagaataaagaggaccccatggaccgtttgctggtgccgcaggtggctataaaaaaggattttaccaacaaagaaaaactgcttatgatctctcggagccataataatttatccttcgaacatgacgaattcttgtctaataatctgaaaagggggacaagtgagacccgcttttag

SEQ ID NO: 31374 - DNA, 1476 bp, Artificial Sequence
  Description of Artificial Sequence: Synthetic coding sequence
atgatcgctacgggcggcgtaatcacagggcttgccgccctgaaacgccaggactcagctcgaagccagcaacacgtaaatttaagtcctagccccgccacacaggaaaagaaacccattcggcgaagacccagggccgacgtggtcgtcgtgagagggaagatccgtctatattcccctagtggcttctttctgatcctaggggtcctcatttctataattggcatcgccatggccgtcttgggctactggccccaaaaagagcatttcattgacgccgagacaaccctatctactaatgaaactcaagtgattaggaatgaagggggcgtcgtagtacgcttctttgagcaacatctacactctgacaagatgaagatgcttgggcctttcactatgggcatcggaatcttcatctttatctgtgccaatgcaattcttcacgagaacagagacaaagagactaagatcattcacatgagagacatctattccaccgtgattgacatccacactctccggatcaaagagcagaggcagatgaacggaatgtataccggtctgatgggcgagaccgaagtcaaacaaaatggatccagctgcgctagtcggctcgccgcaaacactatagcgagcttctccggattcaggtcgtcatttagaatggattcttctgtggaggaggacgagttgatgctaaatgaggggaagagcagcggccatttgatgccacccctcctgtcggatagctccgtgagcgtgttcggtttgtatccacctccatcaaagacaactgacgacaagacatctggctcaaagaagtgtgagacaaagtcaatcgtgtccagtagcatttccgctttcaccctgccagtgatcaagctcaacaattgcgtgatcgatgagccaagcatcgataacataactgaggacgccgacaatcttaagtctaggtcaagaaacctcagtatggacagtctggttgtaccactgcccaacacgtcagaatctttccagcccgtgagcactgtattgcccaggaataacagtataggagaatctctgtcgagtcagtataaatcatccatggcattgggccccggcgcaggccaactgttgtcaccaggcgccgccaggcgccagtttggctcaaatacatccttgcacctattatcctctcattccaagagcctggacttagatcgaggcccgtctacacttacagttcaggccgaacagaggaagcacccttcctggccgagactggacagaaataatagcaaggggtacatgaaactcgagaacaaagaagatcccatggataggttgctcgtgccacaagttgctatcaaaaaggattttacaaataaggagaaattgcttatgatcagtcgctcccataacaatctgtcatttgagcatgacgagtttctctccaataatttaaagcgcgggacaagtgagacacggttttag

SEQ ID NO: 31375 - DNA, 924 bp, Artificial Sequence
  Description of Artificial Sequence: Synthetic coding sequence
atgacggccggtagccctgaagagtgcggcgaagtccggagatcccctgaaggtcgggttagccggctcggccgaaggctcggacggaggagaagacccaggtcacctccagagccgctgagagtgcgggcccggcttagactgcggtccccgtccggcgcattcgctgccttgggggccctggtcgtccttgtcgggatggggatcgcagtggccggttactggcctcacagggcaggggcaccggggtccagggcggctaacgcatcaagcccacagatgagcgaactgcggagagaggggcggggtggaggccgtgctcacggccctcacgagaggctgcgtttactcggaccggtaattatgggggtcggcttattcgtatttatttgtgcaaacacgctgctctacgaaaaccgcgatctggaaaccaggaggttgcggcagggagtgctgcgagcccaggcactccgaccaccagatggcccaggctgggactgcgctctgctcccatctcccgggcccaggagtccccgggcagttggttgcgccgaacccgagatatgggacccatctcccagacgtggcacatcccccgtacccagtgtccgctcgctgagatccgaaccggcaaacccacgtctgggactgccagcactgcttaattcatatcccctcaaaggcccaggactgcccccaccatggggtcccaggacgcaaactggccatgtcatcattaccgtgcaaccatcaggttcttgtatagaacactcgaaatccttggaccttgggctcggtgagctcctcctgggcgctcctgccgccagagactgtgcacataggtcttggccaagattggatcgcctgagtctcggcgggtacgcaaagcttgggggcggaggcgacctgggggcccgagtgtag

SEQ ID NO: 31376 - DNA, 924 bp, Artificial Sequence
  Description of Artificial Sequence: Synthetic coding sequence
atgacagccggttctccggaagaatgtggggaggtgcgtcgttctccagaaggccgagtcagtcgcttaggacgaaggctgggaaggaggcgcaggcctaggtcgcctccagaacccttacgggtccgagctcgtctcaggctgaggtccccaagtggagcgtttgcggctctgggagccctggtcgtcttggttggtatggggatagctgtggccgggtactggccccatcgcgctggcgcaccaggctcaagggcggccaatgcttcttccccacaaatgagtgagctgcgcagagagggccgtggtgggggccgcgcacatggtccacacgagcgtctgagattactgggtccggtaataatgggtgtgggcctcttcgtctttatctgtgccaacacccttctctatgaaaatagggatctggaaactaggcggcttcgacagggcgtgttgcgagcacaggccctgaggcccccagatggtccaggttgggattgcgctctcctgccgtctcctggccctcgttccccaagggccgtcgggtgcgcagaaccagagatctgggaccccagccccagacgaggaacatctcccgtgcccagcgtacggagtctcagatccgagcctgctaacccccgactgggtctccccgccctgttaaactcgtatccgctgaagggccctggtctcccgcctccctggggcccgcggacgcagaccggccatgtaattatcactgtgcagcccagtggttcatgcatcgagcactccaaaagcctggatctgggactaggggagctgctgctgggtgctccagctgctcgcgattgtgcccacaggagttggccaagactcgatagactgtcgctcgggggatatgccaaactggggggcgggggcgacttgggagcgagagtctag

SEQ ID NO: 31377 - DNA, 1866 bp, Artificial Sequence
  Description of Artificial Sequence: Synthetic coding sequence
atgattgccaccggcgggcttctgcgcatcagtgcgaggaaacaggacccacttcgtcctccgtcccagataccaaagcggaagaggaaggcaaagaagcggagaaagaacgatgtggtggtagtgaaaggcaaactgaagctgtgcagcatttcgggtctcatcgcattgtgcggcattctcgtgctactggttggcattgccatggccgttgtgggctactggcccaaagccaccggcactaatcgtgaaggtgggaaacaactgccacctgcaggcagcagtcatcgtgttcccacgaccgcgaattctagctcctctggctctaagaatcgaagtagaagtcacccccgggcccctggcggggtgaactcatccagcgctggagcacctagaagtactccccccgccagagcggcgtcacccagctcctccagcacatctgtcggcttcttctttcggatcttttcaggctatctacacagcgacaagttaaaggtgttcggaccgctcatcatgggaatagggatttttcttttcatctgtgctaatgctgtcctgcatgagaatcgggataagaagaccaagatcatcaatctccgggatctttattccacggtgattgatgtgcattccctccgagctaaggacctcgcagcggccgctgcagctgctgctgctgccgcggccagtagcagtagtagcgcacccgccgccgcacctccaggcgctattcctctcaatggctttctgtcctacgtccagtctcggggactggagctcaaacccgggggatgcggaggctctggcgatgcgttcggcgcagccgcaatgcttgctaagggatcttggcctccccacccagccgctccgtccggcggacgaccacggggcgctgctagtccgcctgacctggcatcttctccgcgctgtccacgggagcccccctcattagccgaagccgtatacagcgtctatcgggagcgctccggagtggctggatcgcgtagagccgctgcggcgaccgctgccgccgctgcttcatcctgttctagcccagccccgtgctcacctcccgagagttgggggcggcagtcaactgcctcttctttcgtggattcgagcctgagtgcgtttgcactgctgcctctacaaggaggccgcgatcgcgggggtgatgcagagggcgcttcgtgttcgtggcaacggcctcccggggaacgcggctcacaggaaattccaagaggagagttagacctgtctatgacaaatcttcggggtgcggaagggagtatgaggggagcacgaagagaaccagaggagccggagggggccgtggcggccagagcagctcgaggccagggaggtagactccccagaacagggcgttacgctgccctgcgaaggcggagtacctctggcctccccgattatagagctcctccgagccctgaacctcctccatctccaggaagtgccgacccggatagctctccactcgctaaggccgcttctccttctccccctctccgattggagggtagcccaccaactaggcgcgactctgggagctcccagtctgatgaccccagctcttccaataagggttacacacctctgagggaggcgggtaccagtactgaatctgtcttagatgcagtggccgggcagacccgggatagcgccgtagctgcgcctgttcttggtgccgagcagtcaagccctgaaggggcatcacaggagccccccacggccgagcagcctcagcctgtccagcgacagttcactaataaggaaaagttaataatgatctccagaagtcacgctattggggttgaagaggagcttgagtccactggaatctag

SEQ ID NO: 31378 - DNA, 1866 bp, Artificial Sequence
  Description of Artificial Sequence: Synthetic coding sequence
atgatcgctacaggcgggttgctccgtatttctgcaaggaagcaagatcctctacgacctccttctcagatcccaaaacgcaagcgcaaggcgaagaagcggcgcaagaacgatgttgttgtggttaagggtaagcttaagctgtgcagtatttccggactgatcgctctgtgtggaattctggtgttgttggtagggatcgcaatggccgtggtggggtattggcccaaggccaccggaacgaaccgagagggcgggaagcagctaccacccgccggatcaagtcacagagtcccaaccactgccaatagcagctctagtggaagcaagaacagaagccgatctcacccacgagccccaggcggcgttaactcatctagtgcgggtgccccacgctccacgcctcccgcacgcgccgcgagcccatcttcgtccagcacttccgtcgggttcttttttcggatcttttctgggtatctccattccgataagctcaaagtgttcggccccctgattatgggaatcggaatattcctgtttatatgcgcgaatgcagtcctgcatgaaaatagggacaagaagacaaaaatcattaatttgagagacctttatagcacagttatcgacgtacacagtttgagagctaaagacctcgcagccgccgcggccgctgccgctgcagctgcagcatcctcctctagtagcgcacctgccgctgccccacctggggcaatcccactaaatggttttctttcttatgttcagagccgcgggctggagctgaaacctgggggttgcgggggttctggggacgcctttggcgccgccgctatgctggccaagggctcctggcctcctcatcccgcggccccttccggggggaggccaaggggggcggcatcgccccccgatctggcatcatctcctagatgtccacgagaacccccctccctggctgaagcagtctactccgtctaccgggagagatccggggtggcaggtagcaggagggcagccgcggcgactgccgcagccgcggcctcaagctgctccagccccgcaccatgctcaccacctgagtcttggggccgccagtctaccgcctcctctttcgtcgattcctccttgagcgccttcgccctgctgcctttacaaggcggcagagaccgtggtggagacgcggagggtgcttcttgcagctggcaaaggcctcctggagagagaggctcccaggaaattccccgcggcgagctggacctctccatgaccaacctgcgtggggcggaagggtccatgaggggggcaaggcgcgagccagaggagcccgaaggcgccgtagccgctagggctgccaggggacaggggggcagactcccaagaacaggccgttacgccgctctgcgccgtcgatcaacatccggcttaccagactatcgggctccaccctcccccgaaccgccgccatccccaggttccgcagatccagactctagtcctctagccaaagctgcctccccctcccccccgctacgtctggagggaagccctcccactcggcgcgactcagggtcctcccaaagtgacgaccccagcagtagtaataagggttatacgcctctgagagaagctggcacgtcaaccgaatctgttttggacgccgtggccggccagacgcgggactctgcagtggccgccccagtgctgggcgctgagcagtcatcccctgagggagcctctcaggaaccccccaccgccgaacagcctcagccagtgcagaggcagtttactaacaaagaaaaactgattatgatcagtcgcagtcatgcaattggtgtggaagaagaactcgaatctactggcatttag

SEQ ID NO: 31379 - DNA, 1179 bp, Artificial Sequence
  Description of Artificial Sequence: Synthetic coding sequence
atggagggcgtctcggcgctactagccaggtgtcccactgcaggccttgccggtggtctcggcgtgaccgcatgtgccgcagctggagtacttctgtacagaatcgcaagacggatgaagcccacccacacaatggtgaattgttggttttgcaaccaagacaccctggtcccctatggaaataggaattgctgggactgtccgcattgcgagcaatacaatggctttcaggagaatggcgactataataagcccatacccgcacagtatctggaacacctgaatcatgtggtctctagtgccccgtcccttcgcgaccctagccaacctcagcagtgggtatcctcccaggtgctcctctgtaagcgctgtaaccaccatcagacgactaaaatcaaacagctggcagcttttgctccccgcgaagagggccggtacgacgaagaagtagaggtttaccggcaccacttagagcagatgtataaattgtgtaggccttgtcaggccgctgtggagtactatattaagcaccagaaccgccaactgcgcgcactactcttgtcacaccagttcaaaaggcgggaggcagaccagacccacgcacagaatttctcttcagccgtgaagagcccagtgcaggtgattctgctgcgagcgctggcctttcttgcctgcgcattcctcctgacaactgcactgtacggagcttctggacattttgcccccggcacgaccgtaccgctcgcgttaccccccggaggcaatggctctgccactccggataatgggacaacccctggtgcagaaggctggcggcagttgctaggcctcctgccagaacacatggcagagaaattgtgcgaggcctgggctttcggtcagtcccaccagacaggcgttgtcgcactcggcttgctgacttgcctactggccatgctgttagccgggcgcattcgcctgagacggattgacgccttttgcacttgtctgtgggctctcttgctaggcctgcacttagcagagcaacacctgcaggctgcgagtcctagctggttggacaccttgaagttttccaccacgtcactgtgctgcttggtgggcttcaccgccgccgtggcgacaagaaaagccacaggccctagacgctttagacccaggaggagcgagaaacagccttag

SEQ ID NO: 31380 - DNA, 2001 bp, Artificial Sequence
  Description of Artificial Sequence: Synthetic coding sequence
atggagggagtttccgctctgctggcaagatgccctaccgccggcctcgccggtggtctgggtgtaaccgcttgcgccgccgctggcgtgttgctgtacaggatagccaggcgcatgaagcctacacatactatggtgaactgctggttctgtaatcaggataccctggtaccgtatggcaaccgcaactgctgggattgcccccactgcgagcagtataacgggtttcaggagaacggagattataacaagcctattcccgctcagtacctggagcatctgaatcacgtagtgagttccgcaccgtcactgcgagacccatcacagccgcagcagtgggtgagtagccaagtgctactgtgtaaacgctgcaatcaccatcagaccacaaagatcaaacaactggcagccttcgctccccgggaggagggcaggtacgacgaggaggtagaagtctatcggcaccacctggagcagatgtacaagctgtgtcggccctgtcaggcagccgttgagtattatatcaaacaccagaaccgacagctaagagccctactgttatcccaccaatttaagaggagagaggccgaccagacccacgcgcaaaatttctcgagcgctgtcaaaagccccgtgcaagttatcttgctgcgtgcactggcattccttgcttgtgccttcttgctaacaactgccctctatggagccagtggccatttcgctccgggtacgacagtgcctctcgctctccccccagggggcaacggtagcgcaacgcctgataacggtaccactccaggggcagagggctggcgtcaactgctcgggcttttgccagagcacatggccgagaaactctgcgaggcctgggcattcggacaatctcatcagaccggtgtggtggccttgggcctgttaacctgtctcctcgctatgctgctcgctgggagaatccggctgcggcgtattgatgcgttttgcacgtgtctgtgggcacttttgctgggtctgcacctcgcggagcagcacttgcaggccgcttctccttcctggctcgatactctgaaattttccaccacctccctttgttgcctggtgggcttcacagcggccgtagccaccagaaaagccaccgggcctagacgcttccgtccccgaaggttttttccaggagatagcgccggtttgtttcccacaagcccaagtttggcaattccccacccatcggttggtgggtcacctgcctctctgtttattccctctccgccttccttcctccccctggctaatcagcaattgtttcgctctccgaggaggacatccccctcttcgcttcctggtcgactgtcaagagccctgtccctcgggaccatcccctctctaacgcgggctgatagcgggtatctcttttccggaagcaggccaccttcacaagtgagccgtagtggagaattcccagtttctgattacttctctcttctttctggtagctgcccaagctcccctctcccatcaccagcgccttctgtagccggaagcgttgcatcctcctctggcagtctgagacatcggcgtccactgatctcccccgcacggctgaaccttaaagggcagaagctgcttctgtttccatccccccctggggaagctccaacaacgccaagttctagcgacgaacattcaccccacaacggctctttgttcactatggaacccccccacgtgcccaggaaacctcccctgcaggacgtgaaacacgctctcgatctccgatccaaattggagagaggctcagcctgcagcaatcgatccataaagaaagaagatgacagctctcagtcttctacctgtgtcgtggataccaccactagaggctgctcagaagaggccgccacttggaggggcaggtttgggccatccttggtgagaggcctcctggctgttagtttggccgccaatgcactgttcaccagcgtcttcttgtatcagagcttacgctag

SEQ ID NO: 31381 - DNA, 1929 bp, Artificial Sequence
  Description of Artificial Sequence: Synthetic coding sequence
atggagggcgtgtccgccctgcttgcccgatgccctaccgccgggcttgccggaggcttgggtgtgacagcttgtgccgctgcgggggtgcttctgtaccggatagcccgacggatgaaacctacacacaccatggtgaactgttggttctgcaatcaagacaccttagtgccttatggcaaccggaactgctgggactgcccccactgcgaacaatacaatggtttccaggagaatggtgactataacaaacctattcccgcgcagtatctggaacacctcaaccatgtcgtcagttctgcaccaagtctgcgtgatccttctcaaccgcaacaatgggtaagtagccaagtgctgctgtgcaagcgctgcaatcatcatcagacgactaagataaaacagctggcagccttcgccccaagagaggaaggaagatacgacgaagaagtggaggtctatagacaccatttggagcaaatgtacaaactgtgtaggccgtgtcaggctgccgtggaatactacatcaagcaccaaaacaggcagcttcgggctctgcttctgagccatcagtttaagaggcgagaggccgatcagactcacgctcagaacttcagttcagcggtgaagagcccagtgcaagtgatcctccttagggcacttgcctttctcgcttgcgcgttcctgctgacaaccgcactctacggagcaagcggtcactttgctccagggacgacagtgcctttggcactgccacccggggggaatgggtcagccacacccgacaatggcaccacgcccggtgcagagggatggcgtcagcttttaggtttgctcccagaacatatggctgagaaactctgtgaggcatgggctttcgggcagtcccaccagactggcgtggtcgccttaggactccttacatgtctgctggctatgctcctggcgggccgtatccgacttagacgcatcgatgctttctgcacgtgcctttgggccctgctcctgggacttcatctggctgagcaacatctccaagcagcctccccatcctggctggacacacttaagttctctacaacctctctgtgttgcctcgtggggtttacagctgccgtggccacaaggaaagctactgggccccggaggttcaggcctagacgtttcttccccggggacagcgcgggcctgtttcccacaagcccatctctggccattccgcatccttcagtaggaggttccccggctagtttgttcattcctagcccaccatcgttcctgcctttggctaatcagcagctgttccgttctccaagaagaacttccccctcttctctgcccggacgcctgagccgagcgcttagtctgggcaccatccccagcctgacacgggctgactacttcagcctgctgtcgggtagttgtccttcgtctccgcttccctccccagcccctagcgtcgctggaagtgtggcgtcatcatcgggaagtctgaggcaccggagaccactgattagtcccgcgcgtctcaatctcaaggggcagaaactactactcttcccaagcccccccggggaagcacccacaacgccaagttcaagcgatgagcatagcccacacaatggcagcctgttcaccatggagcctcctcacgttcccaggaagccaccgctgcaagatgtgaaacatgccctggatttgaggtcaaaactggaacgcgggtctgcatgtagcaacagatcgatcaagaaagaggatgatagttcccaatcatctacctgcgtcgtcgataccacaacacgaggctgcagcgaagaggccgccacttggagaggccgtttcgggccctcactggtgcggggccttttggcggtctccctggccgcgaacgccctctttacctcagtgttcttatatcagagcttgcggtag

SEQ ID NO: 31382 - DNA, 411 bp, Artificial Sequence
  Description of Artificial Sequence: Synthetic coding sequence
atgttgttctcgttgcgagagcttgttcagtggctcggttttgccactttcgagatatttgtacaccttcttgctttacttgtgttttcggtgctgctggctctccgggtcgatggcttggtgcctgggctttcctggtggaatgtcttcgtaccatttttcgctgccgatggattaagcacctacttcactaccatcgtctccgttcggcttttccaggacggcgaaaaacgactggcggtgcttaggttattttgggttctaaccgtacttagcctaaaatttgtttttgagatgctgctgtgtcagaagttagccgagcagacccgcgagttgtggtttggattgataactagcccgcttttcatcctcctgcagctgctgatgatcagagcttgtcgcgtcaactag

SEQ ID NO: 31383 - DNA, 411 bp, Artificial Sequence
  Description of Artificial Sequence: Synthetic coding sequence
atgctgttctcactccgggagttggtgcagtggctaggtttcgctacatttgagatctttgtgcacctgctagctctcctggtgttcagtgtcttactggcccttcgggtggacggactggttccagggctgtcctggtggaacgtatttgtaccattcttcgccgctgatgggctttcaacctacttcacgacaatcgtgtccgtccgcctgtttcaggatggagagaagcgcctcgccgtcctcagacttttttgggtactcacagtgctgtccctaaaattcgtattcgaaatgctgctgtgccagaagctggcggaacagacacgggagctgtggttcgggctgatcacttccccactgttcatactgctccagctgttaatgatcagggcctgccgcgtaaactag

SEQ ID NO: 31384 - DNA, 681 bp, Artificial Sequence
  Description of Artificial Sequence: Synthetic coding sequence
atgaccgtgcagcgcttagtagcggcagcagtcttggtggccctcgtctccctcatcctgaataacgtggctgctttcaccagcaactgggtctgtcaaacactggaagacgggcgaaggcgatcggttggtctgtggcgaagctgttggttagttgaccggacccgcggggggcctagccccggagcccgcgcaggtcaggtggatgcacacgattgcgaggctttgggatggggtagtgaggccgccggcttccaggagagtaggggaaccgtgaaacttcagttcgacatgatgagagcctgcaacctggtggcaaccgccgcgcttaccgccggtcagctcaccttccttctagggctggtaggactccccttactctctcctgacgcaccttgctgggaagaagcaatggccgcggccttccagctggcctccttcgttcttgtaattggattggttaccttctaccggattgggccatataccaatctctcctggtcctgttacctgaacatcggtgcttgccttctggctactttggcagctgcaatgctgatctggaacattctgcataagcgagaagattgtatggccccacgtgtaatcgtgattagtagatctctgacagcacgctttaggagaggcctggacaacgactacgtggagagtccctgctag

SEQ ID NO: 31385 - DNA, 681 bp, Artificial Sequence
  Description of Artificial Sequence: Synthetic coding sequence
atgacagttcaacgccttgtcgccgctgcagttctcgtggcactggtgtctttgattcttaataatgtcgcagcttttacatccaactgggtgtgccagactttggaggatgggcgccggcgctccgtgggcctgtggagatcctgttggctggtcgaccggactagaggaggccccagccctggggctcgagccggccaggtcgacgcccatgactgtgaggcgctgggttggggaagcgaagcagctggcttccaagagagccgcggaaccgtgaagctgcagttcgatatgatgagagcctgtaatctcgttgcgaccgccgcccttaccgccggtcaattaacattcctgctgggactcgttgggctccctcttttgagtcctgatgctccgtgttgggaagaggcaatggccgctgccttccagctggcttcttttgtccttgtgatcggcctggtgacattttataggatcggcccatatacaaacctctcttggtcctgttatctgaatattggggcatgtctcctggccacactggctgccgcgatgcttatctggaatattcttcataagagggaggactgtatggcccctagagtcatcgtcatctcccggtcactcactgcccggttcaggcgggggttggacaacgactacgtcgagtccccttgctag

SEQ ID NO: 31386 - DNA, 1053 bp, Artificial Sequence
  Description of Artificial Sequence: Synthetic coding sequence
atgattagacaggagcggtccacgtcataccaggaactgtctgaggagttggtccaagtggtcgaaaacagtgagctcgcagacgagcaggacaaagagactgtgcgcgtgcaaggcccgggcatactgccaggtctggatagtgagtcagcttcatcctccataaggttctccaaggcgtgtctgaaaaatgtctttagcgttctgctgatctttatctacctgctcctgatggcggtggccgtgttcttagtttaccgcactatcactgacttccgcgaaaaattaaagcaccccgtcatgtccgtttcatataaggaggtcgatcggtacgacgcaccagggattgccctctatcccggccaagcccagctcctgtcctgcaagcaccattacgaggttatcccccccctcaccagtccaggtcagcctggagacatgaattgtacaacccaacgtataaactacacagaccctttttcaaaccagactgtcaagagcgctcttattgtgcaggggccacgcgaagtgaaaaagagggagcttgtgtttctacagttcagactgaataagagctctgaggatttctcagcaattgattacctgctgtttagctctttccaggagttcttacagagtcccaaccgagtgggtttcatgcaagcgtgtgagagtgcctactcctcctggaagttctctggtggatttaggacctgggtcaagatgagtctcgtgaagactaaagaagaggatggccgggaggctgtggaattcaggcaggagacatccgttgttaactacatcgatcagcgccccgcagcaaagaaatccgctcagctgtttttcgtcgtgttcgagtggaaggatccttttatacagaaggtgcaagatatcgtgaccgcgaatccctggaacacgatcgcccttctgtgtggtgcctttctcgcccttttcaaagccgctgagttcgcaaaactgagtatcaagtggatgatcaagatcaggaaacgctacttaaaacgccgggggcaggctacctcacacatttcttag

SEQ ID NO: 31387 - DNA, 1236 bp, Artificial Sequence
  Description of Artificial Sequence: Synthetic coding sequence
atgatccgacaggaacgctctacgtcctaccaggaagcagttagacccgccttgcccagtagtaaaccatgcctgctaactagcccagccgtcttagtcaagctactctcttcctccgccagtactagccgtcctccaaacctcggccatctgtggcagccctctagttccgttccacttcatagggcggcgtcactggctaaagtccgccagtttcagctgagtgaagagctggtacaggtggtagaaaatagtgaactggctgatgagcaggacaaggagacagtgcgggtacaaggaccagggattttgcccgggctggattcagaaagtgccagtagtagcatcaggttttcaaaggcatgcctgaagaacgtgttctcagttcttttgatatttatctatctacttctgatggctgtagccgtgttcctggtttacaggaccattacggattttcgtgagaagctcaagcacccagtcatgtctgtgtcatataaagaggtggaccgatacgatgcccccgggatcgctctgtatccaggccaggcccagctgctttcttgtaagcatcattacgaggtgattccccccctgacatcgcccggtcagcccggggacatgaattgcaccacccagcgcatcaattataccgaccccttctctaatcagacagttaaatctgctctgatcgtgcaaggaccgagggaagtgaaaaagagagaattagtctttctgcaattcagactcaataaatcatcagaggatttcagcgctatcgattacctgctgttcagttcattccaggagtttttgcagagccctaaccgagtaggctttatgcaggcctgcgaaagcgcatatagcagctggaaatttagcggaggattcaggacctgggtgaagatgagtctagtgaagacgaaggaggaagacggcagagaggcagtcgaattccgacaggaaacttccgtcgtgaattacattgaccaacggcccgctgccaaaaagtctgctcagctattttttgtggtcttcgagtggaaggaccctttcatccagaaggtgcaggacatcgtgactgctaacccttggaataccatcgccctgctatgtggggctttccttgctttattcaaggctgcagagttcgctaaacttagtatcaaatggatgattaagattagaaaaaggtatttgaaaaggcgcggccaagccacatcccatattagttag

SEQ ID NO: 31388 - DNA, 441 bp, Artificial Sequence
  Description of Artificial Sequence: Synthetic coding sequence
atgtcaaggtctaggctctttagtgttacatcagcgatctcgacaattggcatcctgtgtctgcccctgtttcagcttgtcctgtccgacttgccttgcgaggaggatgaaatgtgtgtcaattataacgatcaacatccaaacggatggtacatctggatacttttgctattggtgctggtcgctgcactgctgtgtggagcggtcgtgctctgtctccagtgctggctaagaaggccacgcatagactctcatagaagaaccatggctgttttcgccgtcggcgacctggattcaatttacggcactgaagctgcggtttctcccaccgttgggatacacctccaaactcagactcccgatctttacccagtccccgccccttgcttcggtcccctggggtccccccccccgtatgaggaaattgttaagaccacttag

SEQ ID NO: 31389 - DNA, 522 bp, Artificial Sequence
  Description of Artificial Sequence: Synthetic coding sequence
atggcacccaagggaaaggttggaacccgcgggaagaaacagattttcgaggagaaccgcgaaaccttaaaattttacctgagaattatcctgggcgcgaatgccatttattgcctggttacactcgtttttttttacagtagtgccagcttctgggcttggttagctcttggcttttcactggctgtatatggagcctcctaccatagcatgtctagcatggcaagggctgcttttagcgaagacggtgcccttatggatggcggcatggacctaaacatggagcagggaatggccgagcacctcaaggatgtgatactgctaaccgcaattgtacaggttctgtcttgctttagcctctacgtgtggagcttttggcttcttgcaccaggtagagcactctacttgttgtgggtaaacgtgcttggcccgtggttcaccgcagactccggaactccagctcctgaacacaacgaaaaaagacagaggcgacaggaaaggagacagatgaagcgcctgtag

SEQ ID NO: 31390 - DNA, 1557 bp, Artificial Sequence
  Description of Artificial Sequence: Synthetic coding sequence
atgcaaggtgaggcccaccctagcgcttcactaattgatcggaccatcaagatgcggaaagagactgaggcccgtaaggtcgtcctggcctggggcctcctgaatgtaagtatggccggcatgatctacaccgagatgacaggcaagctgatttcttcttattacaatgtgacttattggccactctggtacatcgagctcgccctcgcaagcctattctctctcaatgccctctttgacttttggcgttacttcaagtatacggtggcacctacctccttggttgtctctcccggccagcagaccctcctcggcctcaagacagcagtcgtgcaaacaacgccccctcatgacctggcagctacccagattccacctgcaccccctagcccctcgattcaagggcagtccgttctatcttactccccctcacggtcaccatccaccagccccaagtttacgacatcctgtatgaccggatatagcccgcagctgcagggcttgtcatctggaggcagcggttcgtatagccccggagtgacgtattcaccagtcagtggttacaacaagctcgcctccttctctccatctccccccagtccctatccaaccaccgtcggcccagtggaatcgagcgggctgcgaagccgctatagatcttcaccgaccgtttacaatagccccacggacaaggaagattatatgactgaccttcgcaccctcgatacattccttcgctctgaggaggaaaaacagcacagggtgaaactggggtcacccgactccacctcgcccagctcatctcccactttttggaattactccaggagtatgggcgattacgcccaaacgctcaagaagtttcaatatcagctagcttgtagaagccaggccccatgcgcaaacaaggatgaggcagacctgtcgtccaaacaggcagcagaagaggtctgggcccgtgtggcaatgaatcggcagctcctggaccacatggactcatggaccgccaagtttaggaactggataaacgagaccatcctagtccctctggtgcaggagattgagtctgtatctacccaaatgcggagaatgggatgtcccgaattacagattggggagttaagccagggtgggtgtatgtcctcttttagatggaacagaggaggagacttcaaaggcaggaagtgggacactgacctgcctaccgacagtgccattattatgcacgtgttttgtacatatctcgatagcagactccctcctcatccaaaatatcccgatggaaagaccttcaccagccagcacttcgtacaaacccccaacaagcccgatgtgacaaatgagaatgtgttttgtatctaccagtccgcgataaaccctcctcactacgagcttatctaccagcgccatgtgtacaatctaccaaaaggacgtaataatatgtttcacaccctgctgatgtttctctacattatcaagacgaaagaaagtggaatgctgggaagagttaacctcggattgagcggggtaaacatcctgtggatcttcggggaatag

SEQ ID NO: 31391 - DNA, 1686 bp, Artificial Sequence
  Description of Artificial Sequence: Synthetic coding sequence
atgatgcaaggggaagcccatccaagcgccagtctgatcgacaggactattaaaatgagaaaagaaaccgaggcgaggaaggtggttttggcatggggtctgctgaacgtgtctatggccggcatgatctatacagagatgacaggcaagctgataagctcttattataacgtgacgtattggccactttggtatattgagctagccctggcctctctgttcagcctgaacgctctcttcgatttttggaggtatttcaaatataccgttgcccccacttctctggtggtctcccccggtcagcagactttgctcgggctgaagacagccgtcgttcagactactccgccccatgatctagctgccacacagatcccacccgcaccgccgtcaccctctatccaaggacagagcgtgctgagctactctcccagccgctccccgagtacctctcccaaatttacaacttcttgcatgacgggctacagtccgcagttacaaggtctctcaagtggaggttcaggttcatactctccgggagtgacatattcaccagttagcggctacaataaattagcgtccttcagtccttctcccccctcaccctatcccaccacagttggccccgttgaatcatcggggctcaggagccggtatcggagtagccccacagtgtacaattcaccaacagataaggaagattatatgaccgatctgcggacattagacacgtttctgcggagtgaagaggagaagcaacaccgcgtgaaactgggatcacctgattctacttcccctagttcatctcccacattttggaactattccaggtcaatgggggattatgcgcagacattgaagaagttccagtaccagctcgcatgtcgatctcaggcaccatgcgcgaataaggatgaggccgatttgtcttcaaagcaggccgccgaagaggtctgggctcgcgttgccatgaacagacaactgctggatcatatggactcctggaccgcgaaatttaggaattggattaacgagacaatccttgtcccactggttcaagagatagaatccgtttcgacacagatgcgccggatgggctgcccagaactgcaaatcggagaagcctccatcacatccctgaaacaggctgcgttggtaaaagcccccttgatacctaccctgaacaccatcgtccagtatttagacctcacacccaaccaggaatatctgttcgagaggatcaaggagttgtctcagggcggctgtatgtcgtcttttagatggaatcgtgggggggacttcaaaggccgcaagtgggacaccgatcttcccacagacagtgcaatcattatgcatgtattttgtacgtatttggatagccgcttaccaccgcacccaaagtacccagatggaaaaacctttacatcgcagcactttgtgcagaccccgaataagccggatgtgacgaacgaaaatgtgttttgcatatatcagtcggcaatcaaccctccgcattatgagctcatttaccagcggcatgtctacaacttacccaagggccgcaacaacatgttccacacgctcctcatgtttctttatattatcaaaactaaagagtccggaatgctcggtcgcgtgaatctcggcctgtctggggtgaacatcctgtggatattcggcgaatag

SEQ ID NO: 31392 - DNA, 1683 bp, Artificial Sequence
  Description of Artificial Sequence: Synthetic coding sequence
atgcaaggcgaggctcatccttccgccagtctaatcgatagaaccattaaaatgagaaaggaaacggaggcgcgcaaggtcgtcctggcctgggggctacttaacgtgtctatggccggtatgatctatacggagatgaccgggaagctcatcagctcctactataatgtaacatactggcccctgtggtatatcgagctggctctggcatcactgttctctctgaatgccctctttgacttttggagatactttaaatatacagtggcccccacatcattggtggtaagcccaggacaacagacccttctgggacttaaaacagctgtggtgcaaactacacccccacacgatctggccgcgacccaaattcctcccgcacccccatcacctagcattcaaggacagtccgttctgagctactccccctccaggtccccttcaacttccccaaaatttacaactagttgcatgacagggtatagtccgcagttgcagggcctttcctcgggaggcagcggctcatattcccctggggtcacctattcccctgtgtcaggctacaataaactagctagctttagcccctcccctcctagcccctaccccaccaccgtaggaccggtggaaagttcaggcctgaggtccagatatcgtagcagtcctaccgtctataatagcccgaccgacaaggaggattatatgactgatttgagaaccctcgacaccttcttgaggagtgaagaagagaaacagcatagggtgaaactaggctcccccgactctacctcaccttcctcctcccccacgttctggaattattccagatccatgggtgattacgctcagaccctgaagaagttccagtaccaacttgcctgcaggagccaggctccatgcgcaaacaaagatgaggctgacctctcatctaagcaggctgccgaagaggtctgggcccgagtggcaatgaataggcagctgctggaccatatggatagttggacggccaagttcaggaattggattaacgagactattttggtcccactggtgcaggagattgaaagcgtgtctacccagatgcggaggatgggctgcccagaactgcagattggcgaggccagcatcacgtctctcaaacaagccgcactggtgaaagcacccctgattcctactctgaacaccatcgtccagtacttggatctcacaccaaaccaggagtatctcttcgaacgcattaaagagttgtcccaggggggttgtatgtcatcctttaggtggaaccggggaggcgattttaaagggcggaagtgggatacggacctgcctaccgattccgctattatcatgcacgtgttttgtacgtacttggatagccgactacctccccatcctaagtaccccgatggcaaaacctttacgagtcaacacttcgttcaaacccctaataagccagatgtaactaatgaaaatgtcttctgcatttatcagagtgctattaaccccccacactatgaactcatttaccagcggcatgtgtataacctgccgaaaggccgtaataacatgtttcacaccttgttgatgttcctgtacattataaagacaaaggagagtggcatgctgggacgggttaacctcgggctgtctggggttaatattctgtggatctttggggagtag

SEQ ID NO: 31393 - DNA, 171 bp, Artificial Sequence
  Description of Artificial Sequence: Synthetic coding sequence
atgcagggggaagcacacccaagtgcaagtcttatcgaccggacaattaaaatgcgaaaagagaccgaggcccggaaggttgtgctagcgtggggactgttgaatgtgagtatggctgggatgatttacaccgaaatgactggaaaattaatttccagctattataattag

SEQ ID NO: 31394 - DNA, 1560 bp, Artificial Sequence
  Description of Artificial Sequence: Synthetic coding sequence
atgatgcagggcgaggctcaccccagtgccagcctgatcgatagaactatcaagatgagaaaggagaccgaggccagaaaagtagtgcttgcctgggggctgcttaacgtaagcatggctggcatgatctatactgagatgaccgggaagctcatctctagctattacaacgtgacatactggcctctctggtatattgaattagcgctggcttccctcttttctcttaacgccttattcgacttctggcgctacttcaaatatactgtcgctcccacctccctcgtggtttcccctgggcagcaaaccttactggggctcaaaaccgcggtcgttcaaactactcctcctcacgatctagcagccactcagatacctccagccccgcctagcccctcaattcagggacagtctgtgctcagctactctcccagtcggagtccgtcaacctctcccaagttcaccacaagctgtatgaccggctatagtccccaattacaaggactttctagcggaggttccgggagctactcccccggcgtgacatattctccagtatcagggtacaataaactggccagcttctccccgtctccgcctagcccttaccccacaacagtggggcctgttgaaagctccggcctgagatcgcgctaccggtcaagccccacagtttacaattccccaactgacaaggaagactacatgactgatctgaggactctcgatacttttctgaggtcggaggaagaaaagcagcatagagttaaactgggcagtccggactctaccagtcccagctcaagccctaccttctggaactattcccgctccatgggcgactatgcccagacccttaaaaaattccagtatcagctcgcttgtcggagccaggctccctgtgcaaacaaagatgaagcggacctttcctcaaagcaggcagcagaggaagtctgggccagagttgccatgaacagacagcttctcgaccacatggactcgtggaccgccaaattccggaactggattaacgaaaccatcctagtgcctctggttcaagaaatcgaatctgtgtctacacagatgcgccgcatggggtgtcccgagcttcagatcggagaattgagtcaaggaggctgtatgtcttcattcaggtggaatcggggcggggactttaagggtcgcaaatgggatacagatctgcccactgactccgccatcattatgcatgttttttgcacatatctggattctaggctgcccccacaccctaagtaccctgacggcaaaaccttcacgtcccagcatttcgtccagacaccgaataagcctgacgtaacaaatgagaacgtattttgtatttatcaatctgccattaacccacctcactacgaattgatctatcagcgccatgtatataacctgcctaagggccgcaataatatgttccataccctgctgatgtttctgtatataattaagactaaggagtccggcatgctcggccgcgtcaatttaggattaagcggggtgaacatactctggatctttggcgagtag

SEQ ID NO: 31395 - DNA, 612 bp, Artificial Sequence
  Description of Artificial Sequence: Synthetic coding sequence
atgatgcagggagaggcgcacccatccgcatcattaatcgaccgtaccatcaagatgcggaaggagactgaggctagaaaggtcgtgcttgcatgggggctgcttaacgtgagtatggcaggcatgatatacactgaaatgacgggcaaactgattagctcctactataacgtgacctactggccgctctggtacattgaactggctttggcctccctgtttagcctgaatgcacttttcgatttttggagatactttaaatacactgtcgccccaacctctctggtggttagccccgggcagcaaacactcctgggcctcaaaaccgcagtggtccaaacgactccgccccatgatctcgccgccacccagatcccgccagcaccaccgtccccttcaatacaggggcagtctgtgctatcttactctccatcccgaagcccatcgacaagtcccaaatttaccactagctgcatgacgggctatagtccccagttacaaggtcttagtagcggcggaagcggctcttattctcctggcgttacatactcccccgtttctggatataataaagtgatgacactgtttagctgcctggttaccctgttctag

SEQ ID NO: 31396 - DNA, 390 bp, Artificial Sequence
  Description of Artificial Sequence: Synthetic coding sequence
atgctcctgggggggtggctcctgctggcctttaatgctatcttcctcctgtcatgggctgtcgcccctaaaggactgtgccctcgtcgatcctctgtaccaatgcctggggtccaggcagtggccgctacagccatgattgtaggcttgttgatattccctattggtttggcttccccattcattaaggaggtgtgtgaagcctcctccatgtattacggcggaaaatgtcgcttgggctggggatacatgacagcaatcctcaacgcagtgctggctagccttttgcccatcatttcttggccccacacaactaaggttcaggggcggacaattattttttcaagcgctaccgagagaattatctttgtgccagaaatgaacaagtag

SEQ ID NO: 31397 - DNA, 390 bp, Artificial Sequence
  Description of Artificial Sequence: Synthetic coding sequence
atgcttctcggtggatggcttctgctggcctttaatgctatctttcttctctcgtgggcggtggctcctaaaggcctgtgcccaaggaggagcagcgtccccatgcctggagtccaagcggtggctgcaaccgctatgatcgtcggcctactgatttttcctataggccttgcatcccccttcattaaagaggtgtgtgaggcatcgagtatgtattatggcggaaagtgcaggctgggctggggctatatgacagccattctgaacgcggttcttgcctccctcctgcccattataagttggccccacactaccaaggtgcaagggaggactattattttttcatctgcaaccgagcggataattttcgtcccggaaatgaacaagtag

SEQ ID NO: 31398 - DNA, 603 bp, Artificial Sequence
  Description of Artificial Sequence: Synthetic coding sequence
atgctgtcttcagtgtgggttgcactgggactgtcattgacttgtacctccgctttcagcctgattagcccggcatggttccagacgcctaccttcagtttcggaatccttacttattgtagctggccacaggggaactcttggaatcagtcgtgtgtgactttttcctctctggaggatatcccagattttgcctggaaggtgagtgctgtgatgctgcttggaggctggttgctactggctttcaatgccatcttcttgctttcctgggccgtggccccaaaaggtctgtgcccaaggcgctcttctgtccccatgcccggcgtccaggctgtggcggcaacggccatgatagtgggactcttaatattcccaatcggactggcgtctccattcattaaagaagtgtgcgaagcatctagtatgtactacggcggaaagtgtcggcttggatggggatatatgaccgctatactcaatgccgtcctggcgtccctgctgcccatcataagctggccacacacgactaaggtgcagggcagaacgatcatcttttcaagcgctacggagaggataatctttgtccctgaaatgaataaatag

SEQ ID NO: 31399 - DNA, 474 bp, Artificial Sequence
  Description of Artificial Sequence: Synthetic coding sequence
atggtgtttcctcctaacacacaacataagttcacttccggacgtgtggctttccagctgcttcaggtgggcgtggacagtcctgccgccggaaccaggcataattccgctgggcctgcccatctccaccgcgccctgtcgacggcgtcctcgatgcagagactgccagcagccacccgcgccaccttgatactctcccttgcttttgcctctctgcactcagcttgcagtgcagcgagttcgagtaactcttcctctttgacagcccaccaccctgatcctggtaccctggagcagtgtctaaatgtggatttctgcccccaggccgcccgatgctgcagaactggagtcgacgaatatggctggatcgcagcagccgtcggatggtccctctggtttttaaccctaattttattgtgtgtggataagctcatgaaactgactccagatgaacctaaagatttacaggcatag

SEQ ID NO: 31400 - DNA, 324 bp, Artificial Sequence
  Description of Artificial Sequence: Synthetic coding sequence
atgcaacggttgccagcagccacacgcgctactctaatactgagcctggcatttgcctccctccatagcgcatgttcagctgaagcctcatcctcaaactcatcatctctgactgcccaccaccccgaccctgggactttggagcaatgcttaaacgttgatttttgtccacaggccgcaagatgctgcaggactggggtggatgagtatggttggattgctgctgctgtggggtggtccctgtggtttttgaccttgatacttctgtgcgtggacaaactcatgaagctgaccccagatgaacctaaggaccttcaggcatag

SEQ ID NO: 31401 - DNA, 2070 bp, Artificial Sequence
  Description of Artificial Sequence: Synthetic coding sequence
atggctacaaagaccgccggggtcggtcggtgggaagtggttaaaaagggacgcagaccaggagtgggagctggcgccggcggcagggggggtggccggaacaggcgggccttgggcgaagccaacggggtgtggaagtacgatctgacccccgcaatccagaccaccagcacattgtatgagaggggcttcgaaaatatcatgaagcggcaaaataaggagcaggtgcctcctcccgcagtcgaacccaaaaaacccgggaataaaaagcagcccaaaaaggtggcaacccctcccaaccaaaaccagaagcagggccggtttaggtccctggaggaggccctcaaggcactggacgtggccgacttacagaaagaacttgataaatcccagtccgtcttcagcgggaacccatctatctggctgaaggatttggcatcatacctgaactacaagctgcaggcccccctgtccgagccgacactgtctcagcatacgcacgactatccctactccctggttagcagggagctcaggggtattatacgcggtcttcttgctaaggcagccgggtctttggagttgtttttcgaccactgcctattcaccatgctccaggaattagataaaaccccaggtgaaagcctgcacgggtatcgtatctgcattcaggccattctgcaggacaagcctaaaatagctacagcgaatctaggtaagtttcttgagctgctccgctctcaccagagccgaccagccaaatgccttacaattatgtgggctctcggccaggcgggcttcgccaatctgactgaaggcctgaaagtgtggctgggaataatgctgcccgtgctgggaatcaagtccctttcaccatttgccattacatacctggataggctgttacttatgcatcctaatctcacaaagggttttggtatgataggccctaaagatttcttccccctgctggatttcgcatacatgccaaataatagtctcaccccatcgcttcaggagcagctgtgtcagttataccctcggcttaaagtgttagcctttggagctaagccagacagcacccttcacacttacttcccaagttttctttcacgagctacacctagttgcccccctgaaatgaaaaaagagctgctgtccagtctgaccgagtgtttgaccgtcgatcccctgtccgcatcagtctggcgccagctgtacccgaagcacctgtcccagtcatcgctgcttctcgagcacctgctcagtagttgggagcagatccctaagaaggtacagaaaagtctgcaggagactatacagtccctgaaattaactaatcaagagctgctaagaaagggctcttctaataatcaggatgtagtcacctgtgacatggcatgtaagggcctcctacagcaagtgcaggggcctaggttaccttggaccagacttttgttattgctgcttgtcttcgcagtgggctttctgtgccatgatctgaggagccattcaagcttccaggccagtctgaccggacgcctcctgagaagcagcggattcctgcctgcgagccagcaagcttgtgcaaaactctactcatattcactgcagggctattcttggttgggtgagacgctgccactgtgggggagccatctgctgactgtggtgagaccttcgctgcaactcgcctgggcacataccaacgccacagtctcctttctgtccgcccattgcgccagccatctcgcctggttcggcgatagcctaaccagtctctcgcaacggctacagattcagctgcccgatagcgttaaccaactcctgcgttacctgcgtgagctccccctgctgtttcaccagaacgtcctgctgccattgtggcatctgctgctggaggcccttgcctgggcccaggaacattgccacgaggcatgtcgtggagaggtgacgtgggattgcatgaagacccagctctcagaagcagtgcattggacgtggctgtgccttcaagacattaccgtcgcgtttctagattgggctctggccttgatttctcagcagtag

SEQ ID NO: 31402 - DNA, 2070 bp, Artificial Sequence
  Description of Artificial Sequence: Synthetic coding sequence
atggccactaaaacagccggcgtcggaagatgggaggtggtgaaaaaaggtcgacggccaggagtgggggcgggagctggtggacgcggcggcggccgcaaccgacgagcgctcggcgaagccaacggggtctggaagtacgatctgacacccgctatacaaactacgtctactctctatgaacgggggttcgaaaatatcatgaagagacaaaataaagagcaggtccctcctccagccgttgaaccgaagaaaccaggaaataaaaagcagcctaagaaagtggcaaccccccctaatcagaatcagaagcaggggcggtttcgcagccttgaggaggccctgaaagctctggatgtggccgatttacagaaagagttagacaagtcccagtctgttttttccggcaacccatccatttggcttaaggaccttgcttcttatctgaactataaactccaagcccccctgagtgagccgaccctgagtcagcacacccatgattatccttactccctggtgtcccgagaactgcgtggcatcatcaggggacttctggccaaagcggccggcagcctcgagttgttcttcgaccattgcctgttcaccatgctgcaggaactggataagacccctggtgaatccctgcatgggtatagaatctgcatccaggccatcttacaggataagccgaagatcgccaccgccaatctgggtaaattcctggagctcctaagaagccatcagagccggcctgccaaatgcctaactattatgtgggcactcgggcaagccggctttgccaatctcaccgaaggactgaaagtttggctgggcatcatgctgcccgttttgggaattaagagcctgtctccattcgccatcacgtatttggacaggctgctactcatgcatcccaatttgaccaaaggtttcggtatgataggcccaaaggatttctttccgctccttgattttgcttacatgccgaacaatagcctcactcccagcctacaggaacagctttgccagttatatcccagactgaaagtgctggcattcggcgcaaagccagacagcaccttacatacatatttcccatccttcctgagtcgcgcgaccccctcctgcccccccgaaatgaaaaaggagctgctaagttccttgactgaatgcctgaccgtagatcccctttccgccagcgtgtggcggcagttgtatcctaagcatttgagccagtctagcctgctattggagcaccttctttccagctgggagcagataccgaagaaagttcagaaatccctgcaagaaacaattcagagcctcaagctcaccaaccaggaactgctgcgcaaagggagctccaataatcaggatgtggtcacatgcgacatggcatgcaaggggctgctgcagcaggtgcaggggcctcgccttccttggactagactcctcctgctgttgcttgtgtttgctgtcggcttcctgtgtcacgacctgcggtctcactcctcattccaggctagcctcacagggcggttgctgagatcttctggctttttgcctgccagccagcaagcttgcgccaagctgtattcatactcactgcagggatactcctggctaggcgagacattacctctctggggatcccatttactcacagtagtgcgaccatctctgcagctggcctgggctcacaccaacgcaactgtaagcttcctgtccgcccattgtgcatcccatctcgcctggttcggggacagcttgacatccttgagccaaaggctccaaatccagctgcctgatagcgtcaatcagcttctgcggtaccttcgagaactcccactgctgttccatcagaatgttctgctgccactgtggcacctcctgctggaggctctcgcctgggcccaggagcattgtcacgaggcatgccgtggggaagtcacatgggactgtatgaaaactcagctgtccgaagccgtccactggacttggctgtgcctgcaggacattaccgtagctttcttggactgggccctggctctgatcagtcagcaatag

SEQ ID NO: 31403 - DNA, 1935 bp, Artificial Sequence
  Description of Artificial Sequence: Synthetic coding sequence
atggccacgaagacagccggcgtcgggcgctgggaggtagtgaaaaaaggcaggcgccccggagtgggcgccggagcaggagggcgcggaggcgggcggaaccgtagggctctcggcgaggctaacggagtctggaaatatgatttaacacctgctattcagactacttcaactctatacgagcgcggattcgaaaatattatgaaacgccaaaataaggagcaggtgcccccccccgctgtggaacccaagaagcccggaaataaaaagcagcctaaaaaagtggccaccccacccaaccagaaccagaagcagggtcgatttcgatcactcgaggaagctcttaaggccctcgacgtagccgacctgcagaaggaattagacaagagtcagtctgtttttagtggaaaccccagcatttggttgaaggatctggcctcctacctgaactacaagcttcaggcgccattgtcagagccgacgctgtcccaacacacgcacggagagtctttgcatggctacaggatatgcattcaggcaatattgcaagacaagcccaagatcgcgaccgctaacttaggcaagtttttggaattgctgaggtcacatcagtcccggccggccaagtgtcttacgataatgtgggctctagggcaagcggggttcgcaaatttgacagagggcctgaaggtgtggcttgggataatgctccctgtcctcggaattaagagtctgtccccctttgccatcacgtatctagataggctgctcctgatgcaccctaacctgacaaagggctttggcatgatcggaccaaaagatttctttccgctgctggatttcgcctacatgccaaacaactctctgacgccttccctccaggaacaactgtgtcagctctacccacgtctgaaggtactggccttcggtgccaaaccggatagtaccctgcacacttactttccaagcttccttagtagggctactcccagttgccctccagaaatgaaaaaggagctgctgtcaagcctgaccgagtgtctgaccgttgacccactatcggcttcagtatggagacagctttacccgaagcatctttctcaaagctctttgctgctggaacatcttttgtcctcatgggagcaaatcccaaagaaggtgcaaaaatcactgcaggaaaccatccaatccctgaaacttacgaaccaagaactgctgcgcaaaggaagctccaacaatcaggacgtggtgacctgtgatatggcctgcaaaggccttctgcagcaggtccaagggccccgactgccttggacccgcctgctgctgcttttgttggtctttgctgtcggctttctttgccatgatctgaggtcccattcctctttccaggcctctttgacaggacgactgttgcgctctagcggttttctcccagctagtcagcaggcctgtgctaagctgtacagctattctttacaaggttacagctggctcggagagacccttccgctctggggctcccatttgctgacagtggtgaggccatctttacaactggcgtgggcccatacaaacgcgacagtgagcttcctcagcgcccattgtgctagtcatctggcttggtttggggactctctgacctctctgagccaacgattacagatccaacttcccgactccgtcaatcagctgctacgctatctccgagaactgcctctgttatttcaccaaaacgtgctgctaccgctctggcacttgctgctagaggcactcgcctgggcccaggaacactgtcatgaggcatgtcggggggaggtgacatgggattgtatgaaaacacagctgtccgaggcagtacactggacttggctttgtctgcaggatatcactgtcgcatttctagattgggccttggccctgatctcccagcagtag

SEQ ID NO: 31404 - DNA, 483 bp, Artificial Sequence
  Description of Artificial Sequence: Synthetic coding sequence
atggctaccaagacagccggggtcgggcgctgggaggtcgtgaaaaagggcagaaggcccggagtcggcgccggggcaggaggccgcggtggcggcaggaaccggcgagcactgggcgaggcaaacggagtatggaagtatgacctgacacccgcaatccagaccactagtacgctgtatgagcgcggattcgagaacattatgaagagacagaacaaagaacaggttccaccaccagctgtcgagccgaaaaaaccgggaaacaaaaaacaacctaagaaggtcgccacacctccgaatcaaaatcaaaagcagggacgctttcgtagtctggaagaggccctgaaagctttagacgttgccgatcttcagaaagaacttgataaatcacagtcagtattctcaggtaaccctagcatctggctcaaagatttagcgtcttatctgaactataagctgcaggcccccgagcagcccgattag

SEQ ID NO: 31405 - DNA, 1290 bp, Artificial Sequence
  Description of Artificial Sequence: Synthetic coding sequence
atgtgggcattaggacaggccggattcgcgaatctgacagaaggactcaaagtatggctagggatcatgctgccagttcttggaataaagtccctctccccgttcgccataacctacctggacagactgctcttgatgcacccaaacctgacaggcctgcggcacgattggccgcagggccttctgcccacttctgggctctgcttgtacgcggagcagctccccgacacacaacccgctggtgcctgccagttataccccagacttaaggtgcttgctttcggtgcgaaacctgactccacactacatacatacttcccctcatttctgtcgcgagccactccctcgtgcccacccgagatgaaaaaagaactgctctcttctctcacagaatgtttgactgttgatcctctttcagcctctgtgtggaggcagttgtaccccaagcacctaagccagtcctctctgttgctggaacatcttctgtcgtcctgggagcagataccgaaaaaggtacagaagtccctccaggagactatccaatccctgaagctcaccaaccaggaactgcttcgaaaaggctctagcaacaaccaagatgtcgtgacctgtgacatggcgtgcaaagggctgttgcagcaggtgcagggccctcgattgccgtggacgcgactgctgcttcttcttctagttttcgcagttggtttcctctgtcatgatctgagatcccatagtagcttccaggcatctctgaccggccgtttgttacggtcttccggcttcctgccagcatctcagcaagcatgtgccaaactctactcatacagtctgcaggggtatagttggctgggggagacactgcctctttggggcagccacctattaaccgtcgtcagaccatccctccagcttgcctgggcacataccaacgccaccgtgtcattcctctcagctcattgcgcttctcacctggcctggttcggcgattctctaacgagcctatcacagaggctacagattcagctccccgactcagtgaaccaactgcttagatacctgcgcgagctcccgctgcttttccaccagaatgtgcttctgcctttgtggcacctattgctggaagccttggcctgggcacaggagcattgtcacgaagcctgtaggggagaagtcacctgggattgcatgaagacgcagctctccgaagcagtgcattggacctggctgtgtctgcaagacattaccgtcgcgttcctggactgggccctggcactaatctcccagcagtag

SEQ ID NO: 31406 - DNA, 708 bp, Artificial Sequence
  Description of Artificial Sequence: Synthetic coding sequence
atgagaccggatgatataaatcctcggaccgggctggttgtcgccctggtgtctgttttcctcgtgttcggattcatgttcactgtcagtggcatgaagggagaaacgctgggaaacatccccctgctcgcaatcggccctgctatatgtctgcctggaattgctgcgatagctcttgctcggaagactgagggatgcaccaaatggcccgagaacgagttgttgtgggtccgaaaactcccctgttttcgcaaacccaaagataaagaggtcgtcgaactgttgagaacacctagtgacctggaatccgggaagggatcatcagatgagctggccaaaaaggccggccttcgcgggaagccccccccccagtctcagggggaggtctccgtggcctcttcaattaattcccccaccccgacagaagagggggagtgccagagcttggtgcagaacggccatcaagaggaaactagtaggtatctcgatggatactgcccaagtggctctagcttgacctactcggcacttgacgttaaatgttccgcccgcgaccgctccgaatgtcctgagcctgaagatagcatcttctttgtccctcaggacagtataatcgtttgcagctacaaacagaattccccttatgacaggtactgttgttacatcaaccagatccagggacgttgggaccatgagaccatagtgtag

SEQ ID NO: 31407 - DNA, 690 bp, Artificial Sequence
  Description of Artificial Sequence: Synthetic coding sequence
atgaagcaacaacagtggtgcgggatgacggccaaaatgggcaccgtcctgagcggtgtgttcactattatggccgtagatatgtatttgatcttcgaacagaaacatctgggaaatgggtcatgcacagaaatcacacccaagtatagaggcgcctcaaacattattaataacttcattatatgttggtccttcaaaattgtcttattcttatccttcattaccattttgattagttgcttcctgctgtacagtgtttacgcccaaatctttcgaggactagtgatttatatagtctggatctttttctatgaaacagccaacgtggttatccagattctcacaaataacgacttcgacattaaggaagttagaataatgaggtggttcgggctcgtcagcaggactgtaatgcactgtttttggatgttcttcgtgattaattatgctcatattacttataagaaccgctctcagggcaatattatttcttacaagcgacgaattagcacagcagagattctccacagccgtaacaagcggctgtccatatcctctggcttcagcgggtctcatctcgagtcccaatacttcgaaaggcagagctttcacacatcgattttcacatgtttgtcaccggttcctagcagcgccccctctacttgccggtacacgattgatgtttgttag

SEQ ID NO: 31408 - DNA, 636 bp, Artificial Sequence
  Description of Artificial Sequence: Synthetic coding sequence
atgaagcagcaacagtggtgtgggatgaccgccaagatgggaactgttctcagcggagttttcacaatcatggctgtggacatgtacctgatatttgagcaaaaacatcttgggaacggctcctgcacagagattactcctaagtaccggggagcttcaaatattataaataacttcattatctgttggagcttcaaaatcgtactgtttctgtctttcataaccatcttaattagctgcttcctcctgtactcagtatatgcacagattttccgaggactggtgatttacattgtttggatttttttctatgagacggcaaatgtggtcattcagattctcactaacaacgacttcgacattaaggaagtgaggattatgaggtggtttggcttagtgtcaaggaccgttatgcactgcttctggatgttttttgtcattaactatgcccatatcacctataaaaataggtcacagggtaacattatatcttataaaaggcgcatttccacagcagagatcctacattctaggaataagcgtctctccatctccagcggattttccggtagtcacctggagagccagtacttcgaacggcagcgtaggtgttcaggaaagacatcgataaagtag

SEQ ID NO: 31409 - DNA, 348 bp, Artificial Sequence
  Description of Artificial Sequence: Synthetic coding sequence
atggccggcactgttttgggggtgggggccggagtatttattctggctctcctatgggtggctgtgttactgctgtgcgtcctcctaagtagggcttcaggcgcggctcgcttctctgtgatcttcttgttcttcggggccgttattatcacctccgtacttctgttgttcccacgcgcgggagagtttcctgcccctgaggtggaggtaaagatcgtggacgacttctttattgggagatacgtacttcttgcatttcttagtgctatctttctgggaggtctgtttctggttttgatccactacgtgcttgagcccatctatgctaaacccctacactcttactag

SEQ ID NO: 31410 - DNA, 348 bp, Artificial Sequence
  Description of Artificial Sequence: Synthetic coding sequence
atggcaggtaccgttcttggagtaggtgctggcgtgtttatactggccttactgtgggtagctgtgctgctgctgtgtgtgttgttgagcagggcctccggagccgctcgcttctctgtcattttcttattttttggcgctgtaatcataacaagcgtgcttttgttgttccctagggcaggggaattcccagctcccgaggtggaggtcaagattgttgatgacttcttcatcgggaggtacgttctgttagcattcctgtccgcaatctttctcggtggccttttcctcgttctcattcattatgtgctcgaacccatttatgcaaaacccctacacagctactag

SEQ ID NO: 31411 - DNA, 348 bp, Artificial Sequence
  Description of Artificial Sequence: Synthetic coding sequence
atggcgggcaccgtgctaggagtcggtgctggcgtgttcatcctggcactgctctgggtggctgttttgctcttgtgcgtgttactcagccgggcctccggcgctgcacggttctcagtgatattcctatttttcggagcggtgatcataacgtccgtactgcttttgttcccacgagcaggcgaattccccgccccggaagtggaggttaagatagtggatgatttcttcatagggcgctacgttttgctcgcttttctatccgccatatttctagggggcctcttcctcgtgttaattcattatgttttagaacccatctacgccaaacccctgcactcatattag

SEQ ID NO: 31412 - DNA, 348 bp, Artificial Sequence
  Description of Artificial Sequence: Synthetic coding sequence
atggccggcacagtgctgggagtgggggctggcgtgtttatacttgccctgctgtgggttgccgttctactcttgtgcgttctgctgtcgcgggccagtggagctgctcgctttagtgttatatttctgtttttcggggctgttatcattacaagtgttctgctgctgtttcctagggccggcgagtttcccgcgcctgaggtggaagtgaagatcgtagacgatttcttcattggccgctacgtactgctcgcattcctaagtgcaatcttcttgggtgggttattcttggtgctaatccattacgttctagagcccatatatgcaaaacccctgcactcttattag

SEQ ID NO: 31413 - DNA, 348 bp, Artificial Sequence
  Description of Artificial Sequence: Synthetic coding sequence
atggccgggacagtactgggcgtgggtgctggcgtttttattcttgccctgctttgggtggcagtgctcctgctctgcgttctccttagccgcgcgtccggagccgctagattcagtgttatcttcctcttcttcggtgctgtgattattacgtccgttttgctgctgttccctcgagcaggcgagttccccgcccccgaagtggaggtgaagattgtggatgatttctttattgggcgctatgtgctgctggcatttctgagtgccatttttctggggggtctcttcctggtgttgatccactacgtactggagcccatatacgctaaacccttgcacagttattag

SEQ ID NO: 31414 - DNA, 348 bp, Artificial Sequence
  Description of Artificial Sequence: Synthetic coding sequence
atggccggtaccgtccttggggttggggcgggggtattcatcttagccctgctgtgggttgcagtgttactgttgtgtgtactgttatcacgcgctagcggcgccgcaaggttctcagtgatcttcctgtttttcggtgccgtgatcattaccagtgtattgttgctgtttccaagagccggagagtttcccgcacccgaggtggaagtgaagattgtcgacgatttcttcattggaaggtatgtcctgttggcgtttctgagtgcaatattcctgggaggactcttcctggtcctcatccactacgttctcgagcctatttatgctaaaccgctgcatagctactag

SEQ ID NO: 31415 - DNA, 348 bp, Artificial Sequence
  Description of Artificial Sequence: Synthetic coding sequence
atggcaggaacagtcctaggagtcggggcaggagtgttcattttagccttgctgtgggtggcagtgctgctactctgtgttctactctctcgcgccagcggcgctgcgcgcttttctgtaatctttttgttcttcggcgccgtgataattacttctgtcttgttactgttcccacgggcgggagagttccctgcacctgaggtcgaagtcaagatagtggatgacttttttatcggccgatatgttctcttggcattcctcagtgcgattttcctgggtggcctgttcttagtcttgatacactatgtgctggagcccatatacgccaagcctctgcactcatattag

SEQ ID NO: 31416 - DNA, 348 bp, Artificial Sequence
  Description of Artificial Sequence: Synthetic coding sequence
atggcggggaccgtgctcggtgtcggtgcaggtgtatttatcctagcgctcttgtgggtggctgtcttactactttgcgtattgctgtcacgagccagtggagctgcgagattcagcgtgatattccttttctttggagccgtcatcattactagcgtgttacttctgtttcccagagcgggagaattccccgccccggaggtggaggtgaagattgtagacgacttctttatcggaaggtacgtgctgctggcttttttgtcagcaatcttcctgggagggcttttcctagtcctgatccactatgtactcgagcctatctacgccaagcccctccactcctactag

SEQ ID NO: 31417 - DNA, 723 bp, Artificial Sequence
  Description of Artificial Sequence: Synthetic coding sequence
atgggaaactgtcaggccggacataatctgcatctatgtctggctcaccacccaccccttgtgtgtgctactctgattctgctgctgcttggattgagcggtttggggctaggaagtttcctcctgactcaccgaacaggactccgttcccccgatatacctcaggactgggtgagcttcttgcgatcgttcggccaattgacactgtgtcctagaaacggaaccgtgactgggaagtggaggggaagtcatgtcgttgggctgctgacaactctgaacttcggcgatggccctgatcggaataaaaccagaacatttcaggccaccgtattgggaagccagatggggcttaagggaagctccgcaggtcagttggtgctgattaccgcaagagtgaccaccgagaggacagccggtacttgtttgtatttttccgcagtccctggaatcctgccatcatctcagccacctatctcgtgtagtgaggagggcgccgggaatgccactctctccccaagaatgggcgaggaatgtgtcagcgtgtggtcccacgaaggtctagtgttgaccaagctgttgaccagcgaagagctcgctctttgcggcagcaggttactggtgctcggttcttttttgctactcttctgtggacttctctgctgtgtaaccgccatgtgcttccatccacgccgggagagccactggtccagaacacgactgtag

SEQ ID NO: 31418 - DNA, 723 bp, Artificial Sequence
  Description of Artificial Sequence: Synthetic coding sequence
atgggaaactgccaagcgggccacaacttacatctttgcctagctcatcatccgccgttggtatgcgctacgcttatccttttgcttttaggcctgagtggcttgggtcttggctctttcttgcttacgcaccggaccgggctgcggtcacccgatattccacaggactgggtgagtttcctcaggtcatttggccaactcactctgtgtccacggaacggcactgtgactggcaaatggcgcggtagccatgtagtgggcttattgacgaccctaaatttcggagacggtcctgaccgaaataaaaccagaacttttcaggcaacggtgctcggatctcaaatgggtttgaaaggatcctctgcaggacagctggttctcatcaccgcccgggtaacaactgaacgcaccgctgggacttgtctatattttagtgccgtgccaggcatcctgcccagtagtcagccacctatctcttgctcagaagagggtgcaggcaatgccacattaagcccgcgcatgggagaggagtgtgtgtccgtctggagtcacgaagggttggttctcaccaagctgctcacaagcgaggagcttgcactgtgtggcagtcgcttgctcgtgctcgggtcgttcctgttactgttttgtgggctcctgtgctgcgttacagccatgtgtttccacccgagacgcgaatcccactggagcagaacaagactgtag

SEQ ID NO: 31419 - DNA, 1239 bp, Artificial Sequence
  Description of Artificial Sequence: Synthetic coding sequence
atggacacaagccctagcagaaaataccccgtcaagaaacgagtcaagatccaccccaacaccgtgatggtgaaatatacaagtcactatccccaaccaggcgacgatggatatgaggaaattaacgaggggtacgggaactttatggaagagaatcccaaaaagggtctgctctctgaaatgaaaaaaaaagggcgtgcctttttcggtacaatggataccctgccgcccccaaccgaagatcccatgattaatgagattggccaattccagagtttcgctgaaaagaatatttttcaaagtagaaagatgtggatcgtcctgtttgggtctgccctcgcccatggatgtgtggccttgatcaccaggctggtgtcagacaggtccaaagttccctcactggaattgatcttcatccggagtgtttttcaagtgctcagtgtcctggtcgtatgttactaccaggaggcaccatttggaccatctgggtataggcttagattatttttttatggtgtttgcaacgtcatcagcatcacatgcgcctatacctccttttcaatcgtaccccctagtaatggtactactatgtggcgcgctacaaccaccgtgttctctgccattcttgctttcctgctggtcgacgagaagatggcctacgtggatatggccaccgtggtgtgtagcatcctaggcgtttgcctggtgatgataccaaacattgttgacgaggacaactccctgctcaacgcctggaaggaagcatttggctatacaatgaccgtaatggctgggctgaccacagctctctctatgatcgtatatcgctccatcaaagagaagatctccatgtggactgccctgtttactttcggatggaccggcacgatttggggcatatctacgatgtttatactccaggagcccatcatcccactagatggtgagacatggagctatcttatcgcgatttgcgtgtgtagtactgctgctttcctgggagtgtattacgccttagacaagttccacccagccctggtcagcaccgtgcagcaccttgaaattgtggttgccatggtgctgcagctgttagttttacatatatttcctagcatatatgatgtatttggaggggtcatcattatgatcagcgttttcgtactcgctgggtacaaactgtactggaggaaccttcgtaagcaggattatcaggagatcctggatagcccaatcaagtag

SEQ ID NO: 31420 - DNA, 1239 bp, Artificial Sequence
  Description of Artificial Sequence: Synthetic coding sequence
atggacacctcaccgagtcgtaagtaccctgtgaaaaagcgagtgaagatccatcccaacacggttatggttaagtatacctcccactatccacaacccggcgacgatggctatgaagaaataaacgaaggctacggcaatttcatggaagaaaatccaaagaaggggctgctgtcggaaatgaagaagaaaggacgtgccttcttcggtactatggacactcttccaccacctactgaagaccctatgatcaacgagattgggcagttccaaagcttcgcagaaaagaatatatttcagtcacggaagatgtggattgtgctattcggctccgctttggcccacgggtgcgttgccctgatcactcggttggtgagtgataggtctaaggtgcccagtctggaactgatttttatccggtctgtattccaggtcctaagcgtcctggtggtgtgttattaccaggaagctccttttgggcccagcggataccgccttcgtctattcttttatggtgtctgtaatgtcatctccatcacatgtgcgtacacaagctttagcattgtgcccccttccaatggcacaaccatgtggagggcaactaccacagtcttcagcgccatcctggcctttctactagtggacgagaagatggcatatgtggacatggctaccgtggtgtgttcgatattgggcgtgtgcctcgtgatgattcccaatatagtcgatgaggacaacagtttgttgaatgcctggaaggaggccttcggctacacgatgacggtgatggccggcctcaccactgcgcttagtatgatagtttaccgctcaattaaagagaaaattagcatgtggacagctctgtttacttttgggtggaccgggactatttggggtattagcacaatgttcattctccaggaacctattattccactcgacggcgagacctggtcttatttaatcgctatctgcgtgtgctcaacagcagcctttctgggcgtttactacgctctcgataagtttcatcccgctctggtatctactgttcagcatctcgagattgtggtagcgatggtcctccagttgttggtgcttcatatttttccgagtatttacgacgtttttggaggagttatcatcatgatctctgtattcgtactcgctggatacaagttgtattggagaaatctgcggaagcaggattaccaagagattttagattcaccgatcaaatag

SEQ ID NO: 31421 - DNA, 483 bp, Artificial Sequence
  Description of Artificial Sequence: Synthetic coding sequence
atggcccccgctctatggcgtgcctgcaacgggctgatggcagcgttttttgcccttgccgccctggttcaggtcaacgatccagacgccgaggtttgggtggtcgtgtacaccattcccgccgttctgaccctgctggttggcctgaaccctgaggtgaccgggaatgtaatctggaaatcgatttcagctattcatatcttgttctgtaccgtgtgggcggtgggtttggcatcatacctcctgcaccgaacacagcagaatatactccatgaggaagaaggtcgggagctgagtgggttagtcataattactgcctggatcattctgtgccactcctcatcgaagaatcccgtcggggggcgaatccagctcgccatagccattgtaattaccctgttcccgttcatcagttgggtttatatctacatcaacaaagagatgcgaagctcgtggccaactcactgtaaaacagtcatttag

SEQ ID NO: 31422 - DNA, 453 bp, Artificial Sequence
  Description of Artificial Sequence: Synthetic coding sequence
atggcccccgccctctggcgagcttgcaacggactcatggccgcctttttcgcactcgctgcactcgtgcaggtagtctatacgatcccagcagttttaacattactggtcggtcttaaccccgaggtcacagggaacgtcatttggaaatctatcagtgctattcatatcctgttctgtaccgtgtgggcagtcggcttagcttcctatctgctacaccgaacccagcagaatatcctacacgaggaagagggccgagaactctctggcctcgttatcatcacggcttggatcattttgtgtcacagttcatcaaaaaaccccgtgggcggtcgaatccagttagcaattgccattgtgatcacactattcccctttatttcctgggtctacatttatataaacaaggagatgcggtcaagttggcctacacactgcaaaacagttatttag

SEQ ID NO: 31423 - DNA, 603 bp, Artificial Sequence
  Description of Artificial Sequence: Synthetic coding sequence
atgaaacagtaccagggctccgggggggtggccatggatgttgaacgctcgaggttcccgtactgtgttgtctggactcccatccccgtgctgacatggttcttccccatcataggacacatgggcatttgcacatctaccggagtcatcagggacttcgctggaccatattttgtaagcgaggacaacatggcattcggtaagcctgctaagtgccacctccaggaggcattctctcaccctattctcgtccggtcaggatgccacaacaagatttcctcaattggttattggaagctggacccagcacaggtatatgcttccggacccaatgcttgggacaccgcggtgcacgacgcaagtgaggaatataagcataggatgcacaacctgtgctgtgacaactgtcactcgcacgtggcgctggcgctgaacctaatgcggtacaataactccacaaattggaatatggtgaccctttgtttcttttgtttgttgtatgggaagtatgtttcggtgggggcgttcgtgaaaacatggttgccctttattttgctcctcggcatcattctgaccgtgagcctggtgtttaacctgcgctag

SEQ ID NO: 31424 - DNA, 627 bp, Artificial Sequence
  Description of Artificial Sequence: Synthetic coding sequence
atggcggaggccgaagggtccagcttgttactcttgccaccccctccacctcctcctcgcatggccgaggtggaagccccgacagccgctgagacagatatgaagcagtaccagggcagcggcggagtggctatggacgtggaaaggtctcgatttccctactgcgttgtctggactccaattcctgtattaacctggttcttccccattatagggcacatgggaatctgtacaagcaccggtgtcattcgggattttgccgggccctattttgtatcggaagacaacatggctttcggaaaacccgccaagtactggaaattagaccccgcccaagtttacgcctctggaccaaatgcctgggatacagcagttcacgacgctagtgaagagtataagcacaggatgcataatttatgctgtgacaactgtcatagccacgttgcactcgctttgaatctgatgcgttacaacaactcgaccaactggaatatggtgactctttgcttcttttgcttactatacgggaaatacgttagcgtaggggccttcgtgaagacatggctgccttttatcttattgctcggtataatcctcaccgtgtccctggttttcaatttgaggtag

SEQ ID NO: 31425 - DNA, 609 bp, Artificial Sequence
  Description of Artificial Sequence: Synthetic coding sequence
atggcagccccctggagacgatggccaaccggcctgctggccgtcctgagaccactcctcacttgccggccccttcaaggcactactttgcaaagggacgtgttactctttgagcacgacaggggcaggttcttcacaatactgggccttttttgcgcaggacagggcgtgttttgggcttcaatggctgtcgccgccgtctccaggcccccagtcccagtgcagccgctggatgcagaagtgcccaacaggggacctttcgatctgaggagcgcactgtggcgctacggactggcagttggctgtggtgccatcggagctttggttctcggggccggtctgcttttcagtctcaggagtgtgcgctcggttgtgttgcgggctggcgggcaacaagtgaccctcacgacccacgctccgtttggcctgggcgcccattttactgtacccttgaagcaagtttcatgcatggctcatcggggtgaggttccggcaatgcttccccttaaagtcaaaggcagacggttctactttcttctcgataagacaggccacttccccaataccaagttgtttgataatactgtgggggcataccggtccctctag

SEQ ID NO: 31426 - DNA, 678 bp, Artificial Sequence
  Description of Artificial Sequence: Synthetic coding sequence
atggtccacgtttctaatagaagtatccagggtatgaatatcctgttctcctcctgggccgtggtcctaatggtcatgggaattacactcgacaaatgggttgaactgatctccgaggacgagagggctaaaatgaatcacagcccttggatgatgtgctgccccgctctatggcctgaagatgacttgaaggtggtcagaatcatgatgacgagctctctgggtctgtcttttctgctcaacttaattctgggcatgaagttcacctacctgattccccaaaacaagtatatccaactcttcaccacaattttatctttcttttctggcatcagcctgctgtgggctttgatattataccataacaaacttaaacaggggcaaagcatgcacttttcgaattacaggattacttggattatgtacacagcctatctaaatgtattttttctgagtgtttgtggcgtcttaagtttgctggaatgtaaactgtctacttcatcatgcacctgtctgaatatccataaaagtgacaacgagtgcaaagagtctgaaaatagcatcgaagacatttcacttcccgagtgcacggccatgccccggagcattgtgagagctcacactgtgaactccctcaacaaaaaggtgcagacacggcatgtgacttgggccctctag

SEQ ID NO: 31427 - DNA, 1143 bp, Artificial Sequence
  Description of Artificial Sequence: Synthetic coding sequence
atggctggttcggatgtggactctgaggggccggcccgacgcggcggagccgcacgaagaccgggagctcctggggggccagggagcgaggctgccgctggctgtccagaacctctctcgaccgctgaagcccctgctgaaagcgcaacgcttccagcttggatgcgactgtacttttatggcatgcacggtataactttagacgtgctcgtgtcctccgctcgcagattcgccaggagtcctgatcttagaatgttgggcttcagctccccctaccgctgcctgctccattccctgactcacttcgccttggagaaggtctatttgcagcagcgcagatgtcctaacgcattcgttttcaacttccttctatatccatccgcgcacgtgggccttcagactctagctgggcaggccctcttgctctccctggggggaggggccggggtcgctgtcgctccaggggcactcgacctggccctgcagtatgtgctagcactgtaccactgtcaggtatttctgaagagattcctgaggctgcggtacgggcgccaacggaggcgtcagcagcagcagcaacagcaacaacagcagcagcagagaaggggagccttgcccgtgccgcccggtgctcgggtgccgacagctgccggcgctagacgacgccgaccaaggggccctaggggggcaggaggagccccctctcagggcctgccagacctcccaaggtttctgttcttcggtatgcatgggtttctggacgagatctttttcaccttcttctttaatgttctgggccagggggacggtactacgagcggacacacgtcactgtggtcttttttcatgtacgggtcttgttcattcgtcgtggagaaactctactttcaccttcattactcccgcggctggggcacctggaagcgagtacctatctatgtaattttcatatacgtgtgggagttgtcttggggcctcggattacggacttgtggcgcctgctcttgggactactcacattaccccctaaacttcatgggactaatcaccttgatgtacttgcccgggtggatctttctctctgtctatcaggaccttatcagcaatgtactgtggcgggttcagtatgtccccgcaaattag

SEQ ID NO: 31428 - DNA, 504 bp, Artificial Sequence
  Description of Artificial Sequence: Synthetic coding sequence
atggccagcgccgaacccttgacggcccttagtcgctggtacctgtatgcaatacacgggtacttctgcgaggtcatgtttactgccgcttgggagttcgtcgtcaatcttaattggaagttccccggcgtgacatcagtgtgggctttatttatctatggcacttcaatcttgattgtggagcgcatgtacctgaggctgcgcggtagatgcccacttttactgcgatgcctcatctacactctgtggacctatctgtgggaatttacaaccggttttattctgcgccaattcaacgcctgcccatgggattattcccagttcgactttgatttcatggggttaatcacactcgaatacgccgtgccttggttttgtggagccctgatcatggagcagttcattatccgaaatacgctgaggctgagatttgacaaggatgctgagcccggtgagccttctggagctcttgctctggctaatggtcatgtgaagacagactag

SEQ ID NO: 31429 - DNA, 405 bp, Artificial Sequence
  Description of Artificial Sequence: Synthetic coding sequence
atggcctctgccgagcctctgacggctcttagccggtggtacctgtacgctattcacgggtatttctgcgaagtgatgtttacagccgcatgggaattcgttgtcaatttaaattggaaattccctggcgtcacctccgtctgggctctgtttatctacggaacctcaattctcatcgtggagaggatgtacctgagacttagagggcgctgcccattgctcttaagatgcctaatctatactctgtggacatacctgtgggagtttactaccgggtttatcctacgtcaatttaacgcctgcccctgggattactcccagtttgactttgatttcatggggctcatcacccttgaatacgcggtgccttggttttgcggcgccctcatcatggagcagttttag

SEQ ID NO: 31430 - DNA, 240 bp, Artificial Sequence
  Description of Artificial Sequence: Synthetic coding sequence
atggccagtgcagaacctctgaccgcattgtctaggtggtatctgtacgctatccacgggtacttctgcgaggtgatgttcaccgcagcctgggaattcgtggtgaatctcaattggaagttccccggtgtcactagcgtgtgggcactgtttatctacggaacgtctatattaatcgtggaacgcatgtacctgcgtctgcgcggccggtgccccctgttgctgagatgtctgatttag

SEQ ID NO: 31431 - DNA, 504 bp, Artificial Sequence
  Description of Artificial Sequence: Synthetic coding sequence
atggccagcgctgaacccctgacagccctgagcaggtggtatctttatgcgattcatggttatttctgtgaggtgatgttcaccgccgcctgggagtttgtcgtgaatctgaactggaagttccccggggtgacttcagtctgggccttgttcatctatggaacttctattctgatcgtggagcgcatgtacctccgtctgcgagggcgttgcccccttctattgcgctgcctcatctacaccctatggacctatctctgggaattcactacaggtttcattcttcgacagtttaatgcctgcccctgggactattcccagttcgacttcgacttcatggggcttattactctagagtacgctgtgccctggttttgcggggctttgataatggagcagtttatcatacgtaatactttgcgtctcaggtttgataaagatgccgagcctggggagccatcaggagccctggccttggccaatggacacgtgaagaccgattag

SEQ ID NO: 31432 - DNA, 171 bp, Artificial Sequence
  Description of Artificial Sequence: Synthetic coding sequence
atggcctctgcagagcccttgacggcactgtctcgctggtacctgtacgcaatacatggatatttttgtgaggtgatgtttactgccgcttgggagtttgtagttaacctgaattggaagttccctggcgttacttccgtctgggcgctcttcatctacggcacttcgtag

SEQ ID NO: 31433 - DNA, 504 bp, Artificial Sequence
  Description of Artificial Sequence: Synthetic coding sequence
atggcgtctgccgaacccctgaccgcactatcccggtggtatctttatgccatccatggatacttttgcgaggtgatgttcacagccgcatgggagttcgtcgtcaacctgaactggaaatttcccggcgtaacttccgtgtgggcactgtttatttatggaacctccatccttatagtcgaacggatgtacctgaggctgagagggagatgccccttgctcctcagatgtttgatctatactctgtggacatacttatgggagtttaccaccggcttcatattacgtcaatttaacgcttgtccttgggactactctcagtttgacttcgacttcatggggctcatcacgctcgagtatgcagtaccctggttctgcggtgctctgatcatggagcagttcatcattcgcaacacattgagattgcgcttcgacaaggacgccgaacccggggagcctagcggtgctctggcgcttgcgaatgggcatgtaaagacggactag

SEQ ID NO: 31434 - DNA, 168 bp, Artificial Sequence
  Description of Artificial Sequence: Synthetic coding sequence
atggcctccgcagaacctcttactgctctgagccgctggtatttatacgcaattcatggctacttttgcgaagtcatgttcacagccgcatgggagttcgtagtcaatctcaattggaaatttcccggcgtgacttcggtgtgggcgctattcatttatggaacctag

SEQ ID NO: 31435 - DNA, 951 bp, Artificial Sequence
  Description of Artificial Sequence: Synthetic coding sequence
atggccctgtatgaactcttttcccaccctgttgagcggagctacagggctggcctttgttcgaaagctgccctgttcctcctgctggccgctgccttgacctatatccccccactgctggtggctttcagaagtcacggcttttggctaaaacgttcatcctatgaagagcagcccaccgtaagattccagcatcaggtactccttgtcgcgctcctgggccccgaaagcgatggattcctcgcctggagcacattcccagccttcaacagactacaaggggaccgtcttagggtgccgctggtctctacacgcgaggaggaccgaaaccaagacggaaaaacagatatgctgcattttaagctggagctgcccctgcagtctaccgagcacgtactgggggtccaattgattctcacattcagctatcgactgcacagaatggctactctggtgatgcaatctatggctttcctgcagtcaagtttccctgtgccgggcagccagctatacgtgaatggtgatctgaggcttcagcaaaagcagcccctctcatgtggaggactggatgcgcgttacaatatttctgtgataaacggtacaagtccttttgcatacgattatgatttgacccacattgtcgccgcataccaagaaagaaacgtgaccaccgtgttgaacgatccaaacccaatctggctggtcgggcgcgcggccgatgctccattcgtcataaatgctatcattagataccctgtggaggttattagttatcagccaggattttgggaaatggtgaagtttgcctgggtccagtatgtgagtatcctgttaatctttctctgggtgttcgagaggatcaaaatctttgtctttcaaaatcaggtggtcacaacaatccctgtcacagtgactccacggggcgatctgtgcaaagagcatctcagctag

SEQ ID NO: 31436 - DNA, 1038 bp, Artificial Sequence
  Description of Artificial Sequence: Synthetic coding sequence
atgtcctcatccctgacgagatcttcagccgtgaccgcaagggggtccgctccaaagcctcggtgctcatgctgttggcctttacggtccagaactagccgccgctgctggtggccttctggtgcaacggtgagcctgcctaggcctctgtgccacgaggcccccagagcccgctcggctagggcgggcctacctaacagactccccaccgctctgtttaatagcggcttttggctgaagcggagctcatatgaggagcagcccacagtgcgtttccaacaccaggtacttctcgtggccttactcgggccagaatctgacggttttctggcctggtccacattcccagcattcaaccgcctacagggggaccgactgcgggtgccactggtgagcacaagagaagaagatcgtaaccaggacggtaaaactgatatgcttcactttaaactggagctgcctctccaatcaaccgaacacgtgcttggagtccaactgatccttactttttcatatcgcctgcacagaatggccactctcgttatgcaaagcatggcgtttcttcagtcaagttttcccgtgccagggagccagctctatgtaaacggcgacctcagactccagcaaaagcagcctctcagctgcggaggactggacgccaggtacaacatttcagttattaatggaacctccccctttgcttacgactacgatctcacacacatcgtggccgcctaccaggagaggaatgttacaacagtgttgaatgatcctaaccccatttggctcgtgggacgcgcagctgatgccccttttgttattaacgccatcattcgataccctgtggaagtgatctcctatcagcccggtttttgggaaatggtaaaattcgcttgggtgcagtacgtgagcatactgttgatcttcctgtgggtctttgaaagaattaagattttcgtgttccagaatcaggtggtaactactatccctgttaccgtgacaccacgaggcgacctgtgcaaggaacacctgtcttag

SEQ ID NO: 31437 - DNA, 1521 bp, Artificial Sequence
  Description of Artificial Sequence: Synthetic coding sequence
atgaatatgcctgtcaacaaatcacctatgatcaatacgtgcgggggaatatcatctccctaccatgaggaactgtggaagctgaactttcagcatctgtctggagagagaggtcataagagcagacctaccttttccattacaaaggaattcatcctgaggtttaaccaaacccagaattctaaagaaaaagaagagcttcttgagttagcacgcaagattattctgagatgcaaacgaaaactaggcctcaaaacacttggaagcggtcgacacgtgcatctgcccgccgcttggaccgaggtgatctacctcgcgcagtgcaagggtgagatccaggacgaaagcttgaacatgctgtacgcctccctggaccatgcctcatttgactacgaccacctgccagctttattcttcgttgccgaatctgtactctacagactgtgttgtgacgcgtcgttgaaaacctatctctattctgtcgagattaaactcgcaaaaatcggatacctggtgtttcttcgcctattcatattcttcctgcacgggcatctcgagagtttcaagcaacacttgctgagactgcagccttacctctatgccctgagcttctccggtgcttcataccacaagtatcccaatatcttttccaatgtgcagttcatcctgaaagcctctgaaatcatcggtaagcgagagctgcgttccgagtccatatttcgaccggtggaggataaaaaacggtacgagaatacagattcagatatgggagggtacgagattaatcacctcctttggcattgtgtggcagcatggagttgtgtccagaataactcaccccagctgaacaacgtcctggaacacttagtgtttcacaagactcagctccaaaaaaaatgttggttggatagcgtgttggccttgctggttctgggagaggccgccaaattgaacatggcatgtctgaaagcccttatggatgtagtaagagactttgtctcttccatcatgtctgtgcagaaccaggaggagtcctgtaaagtggatgacttctcatgggcctggaacgtggtgtatatatataccgtgatcctggcagaaatctgcttatatgcagcgaccagcgatctgcgtaagaccgctctgatcgggttctgtcattgcaagtcgagtcagaaaaacatcctttacctggataagtccgtgccccctgagctaaaagaaactagcatcctgtctcttctagaatactttagttctaagatgagtgaaaactgcgatcaggtggtttggaccgggtattacggtctcgtgtataacttggttaagattagttgggagctgcaaggcgacgaagagcaggacggactgaggaacatgatttggcaaacccttcaaaagactaaggattatgaagaagatgtgcggatccagaatgcaatcaacattgcccagggcacatcattctgcatcaggaactcccacgtcagtatttcacgctttcttcaccagggacgctag

SEQ ID NO: 31438 - DNA, 1974 bp, Artificial Sequence
  Description of Artificial Sequence: Synthetic coding sequence
atgaacatgccagtcaacaaaagcccaatgatcaatacttgcggcggtatttcctcaccttaccacgaagagctgtggaagctcaattttcaacacctgtccggtgaaagaggccataaatcacgtccaaccttctccattaccaaagaatttattctcaggtttaaccaaacccagaacagcaaagaaaaagaagaacttctcgagctcgctcgtaagattatcctccgttgcaagcggaagttgggtctgaagacccttggtagtggtcggcatgtgcacctccctgccgcctggactgaagttatttacttggcccaatgtaaaggtgagattcaggatgagagcctgaatatgctctatgcctccctcgaccacgcctcttttgactatgaccacctcccggccctttttttcgtggctgagtcagtgctatacaggctttgctgtgatgcttccctgaaaacatacctctactcagtggaaatcaagctagctaagattggctatctcgtatttctcagattgtttatttttttcctacatggacacctcgagagcttcaagcaacatcttctgcgcctgcagccttacctctacgccttgtccttctctggagcgagctaccacaagtatcccaacatcttttcaaacgtccagtttattctcaaggcctccgagataatagggaaacgggaattgcggtcggaatccattttccgacccgtagaggataaaaagagatatgagaatacagattcagacatgggaggatatgaaattaatcatctgttatggcactgtgttgccgcatggtcatgcgtgcagaacaactccccacagctgaacaatgtgctagagcatctagtattccacaagacacagcttcagaagaagtgctggctggacagcgtgctggcgttgctggtgttaggtgaggctgctaaactgaatatggcatgcctcaaggctctgatggacgtggtcagggactttgtgtcaagcattatgtccgttcagaatcaggaggagagttgtaaggtggacgatttttcttgggcctggaacgtcgtttatatttatacagtaatcctggccgagatctgcctgtatgccgcaactagtgatctgagaaagaccgcactgattggattttgtcactgtaagagttcccaaaaaaacatactctatctggacaagagcgtccccccggaactcaaagagacctccatactgtccttgctcgagtacttttcctccaagatgtctgaaaattgcgaccaggtggtctggacaggatactacgggttagtttacaatttggtgaagattagctgggagctgcagggcgacgaagagcaggatggactgaggaatatgatctggcagaccctccagaaaaccaaagattacgaagaggatgtcaggatccagaacgcaatcaatattgcccaagcagaactgaacgatccaaccgatccgtttacacgctacagcaccaacattagctctaatgtgggcgaggaagtgttcagtaagtatataggatggcgcatcgccaacaccctgtctaagctatttttcccgcctatcgaggcccactttctgccactgaaaaagcccagcatcaaaaaagaccagaccaagtacccaaataaaaagctggagagcgtgaagaaacaagtgctccattttactgttcgcgaacatcccagtgtctccgagatcccgatgttcccatacccggacttctttacaaaagctgataaagagctcgccaagatcatcgatcaccactggcaggaggagctgaaaattcgcgaaaaggaagacgcgatttgcaaggcccaagaattgaaagataaaaagctggcagaaaagaatcacttccaggaggtgatgaaaaaaagggaggagaaactacacaagcagaccaagccttatgaactgccttatcgcaaggaggtgatttag

SEQ ID NO: 31439 - DNA, 330 bp, Artificial Sequence
  Description of Artificial Sequence: Synthetic coding sequence
atgtcccagtacgccccctcaccggactttaaaagggctcttgatagtagtccagaggccaacaccgaggacgacaagaccgaagaggatgtccccatgcctaaaaattatctgtggctgaccattgtgagctgtttttgccctgcctatccgatcaacatcgtggccttagtgttctccattatgagcctcaattcctataacgacggtgactatgaaggggcacgcaggctgggacgcaacgcaaagtgggtggcaatcgcctcaattatcatcggattgctaatcatcggtatatcctgcgcagtacacttcacccgcaatgcatag

SEQ ID NO: 31440 - DNA, 423 bp, Artificial Sequence
  Description of Artificial Sequence: Synthetic coding sequence
atggccgctagccttgggcaagtcctcgctctggtgctagttgctgccctttgggggggaacacagccattgctgaagagagcgtctgctggtcttcagagggtccacgagcccacatgggctcagcagctgcttcaggagatgaaaacgctgtttcttaataccgagtacctgatgcccttcctactgaatcagtgtggttctcttctgtactacctgaccctcgcatcgacagacttaaccctcgccgtgcctatatgcaacagtctggccataatttttactttgatcgtcggaaaggcccttggggaggacatcggaggcaaaagagctgtggccgggatggtcttgacggtgatcggtatctctctgtgcatcacctcttctgtcagcaagactcaaggacagcagagtacgctttag

SEQ ID NO: 31441 - DNA, 495 bp, Artificial Sequence
  Description of Artificial Sequence: Synthetic coding sequence
atggctgcttcactcgggcaagtgctcgctctggtgctggtggccgcactgtgggggggcactcagcccctcctgaaacgggcttcagccggcctgcagcgagttcatgagcccacatgggcccagcagctcctgcaggaaatgaaaaccctctttctgaacaccgagtacctaatgcctttcctgctcaaccagtgcggctcattactatactacctgaccctggcatctactgacctgacactggccgtgcccatctgcaactccctcgcaattatattcaccttaatcgtaggtaaagcactcggggaggacataggagggaagagagcggtggccggcatggtgctcaccgtcatcggtatttcactgtgcattacgtcttcagttccctggactgccgagctgcagttgcacggcaaaggtcagctgcaaaccttgagccagaagtgcaagcgagaagctagcgggacacagtctgaaaggtttggatag

SEQ ID NO: 31442 - DNA, 495 bp, Artificial Sequence
  Description of Artificial Sequence: Synthetic coding sequence
atggctgcttccctcggacaggtcctggctttggtgttggtggctgcgctctggggcggcacacagccacttctgaagagagcctctgctggccttcagagagtgcatgagcctacctgggcacaacagctgttgcaggaaatgaaaaccctgttcttaaacactgagtaccttatgcctttcctgctgaaccagtgtggctcattgctatattatctgacattggcttctaccgatcttaccctggctgtgccgatttgcaactctctggccatcatctttactctgatagtgggcaaggctctgggagaggatatcgggggaaaacgagcagtcgctggaatggtgctgacagtgatcggaatttcactgtgtattaccagttcagtgccatggactgccgagttgcaactgcatggaaaggggcagcttcagacactgtcacagaagtgtaaacgcgaggcctcaggaactcagtctgagcgattcggatag

SEQ ID NO: 31443 - DNA, 495 bp, Artificial Sequence
  Description of Artificial Sequence: Synthetic coding sequence
atggccgcgagtcttggacaggtgttggcactggttctcgtagctgctctctgggggggtactcagcctctgctgaagcgcgcttctgccgggctgcaacgggtgcatgaaccaacatgggcacaacagttgctccaggagatgaagactcttttcctgaacacggaatatttaatgcccttcttactcaaccaatgtgggagcctgctctactatttgaccctggcaagcacagacctaactctggctgtaccaatctgcaattcactggccatcatttttaccctgattgtcgggaaggccctcggggaagatatcgggggtaagagggctgtggccgggatggtgctgacagttataggaatttcactgtgcatcaccagcagtgtgccctggaccgcagagttgcagctgcacggtaagggtcagctgcaaaccctctcccagaaatgcaagcgagaggcctccgggactcagtctgagcgctttggttag

SEQ ID NO: 31444 - DNA, 495 bp, Artificial Sequence
  Description of Artificial Sequence: Synthetic coding sequence
atggcagcgtcactgggtcaggtccttgccctcgttctggtggccgccttatggggaggtactcaaccactgctgaaacgggctagtgctggtctccagagggtgcacgaacccacttgggcccagcaattactgcaagagatgaagaccctcttccttaatacagagtacctgatgccattcctcctcaaccagtgtgggtccctcctgtattatcttaccctggcatccaccgatttaacattggccgtgccgatctgtaactctctggctatcatatttactctgatagtgggaaaagcactgggggaggatattggcgggaagcgggctgtggcaggtatggtgctgaccgtcattggaatctctctctgcatcacttcttctgtcccatggactgccgaattgcaactccatggaaaagggcagctgcagacgctgagtcagaagtgtaaacgtgaggcatccgggacgcagtccgagaggttcggctag

SEQ ID NO: 31445 - DNA, 486 bp, Artificial Sequence
  Description of Artificial Sequence: Synthetic coding sequence
atggccgcctccctcgggcaggtgttggccttagtgctcgttgccgccctttgggggggaacccagcctctgctgaaaagagcatctgctggcctccagcgggttcatgagcctacctgggcacagcagctcctgcaggaaatgaaaactttgtttttgaatacggaatatttgatgcccttcttactgaatcaatgcggatcactgttgtattacctgacgctggcatccacagatttgacgcttgccgtgcccatttgtaatagcctcgccatcatcttcacactgatagtgggcaaagcgctgggtgaagatattggaggaaaacctgtgctcttaccctgtggtcatcaaagctccttgcccttagactcgctcgagaaggacagaggctggggtttgggactcaaaacaagaccccacttatcccccagcagctctcctgttcctgcacctaccggaatggctgaactgcggcccagttag

SEQ ID NO: 31446 - DNA, 591 bp, Artificial Sequence
  Description of Artificial Sequence: Synthetic coding sequence
atggcccgactgggggccctcttgctcgcggccgcacttggagcccttctctccttcgcattgctcgctgccgcagtcgcgtccgactattggtacatcctggaggtggcagacgccggcaatggatctgcctggcctgggagagcggagctcttgagctcacattccgggctgtggcgtatctgtgaggtgcttcaccgcgccgtcattgtggttctgcccctgtccttagtgttactagtgtgtggttggatatgtgggctgttgagctccctcgcgcagtccgttagccttttactgttcacgggctgttattttctacttgggtcagtcttgactctggcaggggtgagtatttacatttcttacagccatctggcctttgctgagaccgtgcagcaatatgggccacagcatatgcagggagttcgcgtgtctttcgggtggtcaatggcactcgcgtggggcagctgcgcccttgaggccttttctggcaccctgctcctgagtgccgcctggactctgagcctttcgccgccaatatgtggtcacctatctccacaacaggttggcgggagggggggggactag

SEQ ID NO: 31447 - DNA, 1185 bp, Artificial Sequence
  Description of Artificial Sequence: Synthetic coding sequence
atgccctcgggctggagctcgggcctaatccaaacacgcacacctggcccagctagggcccggctgctgtgcttccaagaacacggttgggttgtgctgttaccaggtcggcctagttcttggggacgtagtctcgctgacccaccgtctagctcccaggccctacatagtccagcaaggcaggtgcacctcgtatggttacttcgaagccgggggttccgtgaaatcaaggaacgggcccagggccccggtgcaagcccttgggggaggtgggattggtccccgagcccccggtttgctgcgcggctctcaacatcatctccttttcctcaaggaagggcccagcggccacaacgcggtggtgtcgacttgcccgccactcctggagggccccggggacagtgcgcaggccgatccggtgatgtgctccgccgtgcaggccggcgccgggcaagaccacccccggttcctcgcttgcccgcaccacgtgctccccggcgccctagaggcccggctacaccagatccctcccctcctgcaggcagacctcacggtcctgccggacgcgcagctccagggcggaggcctggatgcactgctcagctgcgtgcaccagggaggcgaggcaggcagcggctgttagttcaccccggcggtggaggaagacggcagtggcaacggctggctcgggcgaggagagcggccctgttagccttaggcgctctagcacaccttaggcggtgcccagatacaggcgggggacagcatctgcaccaactgctcgcccctgggctatgtggtgacggtgctgctgtctggcccgccgcacacgcgggccgtccccgacaactcaggcttgtgcatggccctggtttaggcttgctgtgtctgggcgggatacagcggaatccaccggctcttagctgccttgacccccagccagaacctcctaacctgtggtccagtgaatcgcccgctggtggtagagagagagggaggctgcgccctcgcgccgctgaaggccccactcaaatagcctggcgccagcgagatgcagtgagcggacagggccttccaggattatgctccgtgcatagtccacgtcgggccggactggtggagaaaaggctgatgcggggtcctgagtctccaagcgacctgcaggggtggggagcccgttcttag

SEQ ID NO: 31448 - DNA, 453 bp, Artificial Sequence
  Description of Artificial Sequence: Synthetic coding sequence
atggcccgactgggagcccttctgctggccgccgctctgggcgccctgctgtcctttgcactgttggctgcagcagtggcatcagattattggtacatcctcgaggtagctgatgcagggaacgggtccgcctggccaggccgcgctgaactgctaagttcccactccggattgtggcgcatttgtgagggggttctcacacttgccggtgtgagtatctacatctcctactcacatctggcttttgctgagaccgttcagcagtatggacctcagcacatgcaaggcgtacgcgtctcctttggctggagtatggccctggcctggggcagctgcgccctggaggcattcagtgggactcttttactgtccgccgcgtggaccttgagcttgtcaccgcccatatgtgggcatctgagtccacagcaggtggggggacggggcggagattag

SEQ ID NO: 31449 - DNA, 591 bp, Artificial Sequence
  Description of Artificial Sequence: Synthetic coding sequence
atggccaggttaggcgccctgctgctcgctgccgcgctcggagcgctgctgagctttgctttgttggccgctgccgttgccagcgattactggtacatactggaggtggccgacgccgggaatggctctgcctggcccggaagagccgaattgttatcatcccacagtggactttggcgaatctgcgaggttctccatagggccgttatcgtggtcctgccactctcccttgtcctgttagtctgtggatggatatgcggcttgctttcatcccttgcgcagtctgtgtccctgctgctgttcaccggatgctattttctattgggaagtgtcctgactcttgcgggagtaagcatttatatctcctactcccacctcgcttttgccgaaactgtgcagcaatacggacctcagcacatgcaaggagtgcgagtgtcttttggatggtcaatggccctcgcctgggggtcttgcgctttggaagcgtttagcggcaccctgctcctgagcgctgcttggaccctctctttgtctccccctatctgcggtcatctgagcccccagcaggtgggtgggaggggcggagactag

SEQ ID NO: 31450 - DNA, 672 bp, Artificial Sequence
  Description of Artificial Sequence: Synthetic coding sequence
atggctcgcttgggagcactccttttggccgccgccctaggggccctgctgagtttcgccctgcttgctgcagccgttgcatccgattactggtacatccttgaggtggcagacgccggcaatggctccgcatggccgggcagggctgagctgctgtctagccactctggtctttggcggatatgtgaaggccaaaatggctgcattccacttgtggaccctttcgctagcgagagcctggacgtaagcacgagtgtacagcatcttattttactacacagagcggtaatcgtggtgctgcccttgagccttgtgttgctggtttgcggatggatatgtgggctgctatcatcacttgctcagagtgtcagcctgttgttgttcacgggttgctattttcttctgggcagcgtgctgactttggcaggcgtgagcatatatatttcctactcacatttagcttttgccgagactgttcagcagtacgggccccaacacatgcagggagttagagtgagtttcgggtggagtatggccctggcgtgggggtcgtgtgcgctggaggcctttagcggaactctgttactgtcagctgcttggaccctgagcctttcacccccaatctgtgggcatctctctccccagcaagtaggcggaaggggaggagactag

SEQ ID NO: 31451 - DNA, 453 bp, Artificial Sequence
  Description of Artificial Sequence: Synthetic coding sequence
atggcaaggcttggcgctcttctgttggccgccgccctgggggcactgctcagctttgccttacttgcagcagcagtcgccagcgactactggtacatcctcgaggttgcagacgcggggaatgggagtgcttggccaggacgggccgaattgctgtcatctcatagcggactgtggcgcatttgcgaaggggtgctaacattggcaggcgtgagcatctacatcagctattcccacctggcttttgctgagacagtccaacagtacggtccccagcacatgcaaggggtgcgggtgagcttcggctggagtatggctctcgcatggggctcgtgcgccctggaagccttctcagggacactgctgcttagcgcagcttggacactgtctctgtcgccaccaatttgcggacacctgtccccacaacaggtgggcggtagaggtggcgactag

SEQ ID NO: 31452 - DNA, 1056 bp, Artificial Sequence
  Description of Artificial Sequence: Synthetic coding sequence
atggccagcggaaggctgattaagtttgtggtgtttgagctccttgaatttgcagccttcagtataccgaccctcgtaataacagagcagtttgcaaccgcctatcagggtacccgtgcacggtccgacaacacccactattggctgattatttcgtgctcaattgcctacgtagccctcgtgacgctcttgatctgggttcctgtgaaggttattctgcataagaagaggtatatctatcgaaagattaaaggctggaggccagtgctcatgatgtgtgttgtactgacgactctgccctgcctgacttttagtattgccgttactgaagtccaaaagtctataaacggatctgcggatgtgctgcctgacatgctgccagatctcccagtgtcactagtgttgctgtctctgattatggtggacatcatagagaaactgcggatatacccattgcgaggatcccagaaatcaagcgagaacggtcacatccacagtactagtcttcagcacatcaaaactgtgaccgagcaggtgcggcagtcccctgagaatgcagccagcccacaggccaccaattccacccaagttagccagcccagcggggccatgaccagatctcaggagtccgtgttcatgggcccccaggaacctagttgcgacagcggtatattgcggatgatgtcccggcgcgacgtacgggcagagttgtttctgtggtcattcctcctctggagcgacacgatcgagatggtgagagtggccggccaccctaacgtgtacaagtccagctggctgtatcctgtttacatcttctcatttatctcactgctgaggatcaccttcacaccacaaaatccattactgaactctctttcagttcttcttcaggacctgccttttgtgttcgtgcggcttgggctcataattgctctgggaacaattaccccagtgctgggactgtgtaaaaatatactggtcactctttcctatatttacttcaactatctcaccagaattcgcatcttctctgctttcgagatgagtcctttttag

SEQ ID NO: 31453 - DNA, 1056 bp, Artificial Sequence
  Description of Artificial Sequence: Synthetic coding sequence
atggcaagtggtagacttatcaagtttgtggtatttgaactgctggagttcgcggcctttagcattccgacgttagtgatcacggaacagttcgctacagcttatcaaggaacgagggcaaggagcgataatacccattattggctcatcatctcctgctcaatagcgtacgtggccctggtgactcttttgatctgggtccctgtcaaggtgatattgcataagaaacgttacatctatagaaaaataaaggggtggcgccccgtgttgatgatgtgtgttgttctgaccactctcccgtgcctaaccttctccatcgcagttaccgaggtacaaaaatcgatcaacggttccgctgacgtccttcccgatatgttaccagacctgccggtttccctcgtgctgctgtctctcataatggtcgacattattgaaaagttgcgcatctacccactgagaggttcccagaaatcttctgaaaacgggcacatacattctacctctctacagcatatcaaaactgttaccgagcaggtgaggcaaagtcctgaaaacgccgcatcccctcaagccaccaattcaacacaggtgagccaaccttccggtgccatgacaaggtcgcaggaaagcgtgtttatggggccacaggaaccaagctgtgacagtgggattctacgtatgatgagtagacgggatgtgcgtgcagaactgttcctatggtcatttttgctctggagcgacacaattgaaatggtgcgggtcgccgggcaccctaatgtttataaatcctcatggttatacccagtctatatcttttctttcatctcattgctgaggattacattcaccccacagaaccctctgttgaacagcctgagcgtgttgctgcaggatttaccctttgtattcgtccgccttgggctaattatcgcgctcgggactatcactccagtgttgggattgtgtaagaatatcttggtgacactctcctacatatactttaactatctgacccgaattcggattttctccgccttcgaaatgagccccttctag

SEQ ID NO: 31454 - DNA, 1056 bp, Artificial Sequence
  Description of Artificial Sequence: Synthetic coding sequence
atggccagtgggaggctaatcaagttcgtcgtgttcgagctgcttgagtttgcggccttctccattccgacccttgtcatcactgagcaattcgccaccgcttatcagggcacccgcgcaagaagcgacaacacccactattggttaatcattagctgctccatcgcttacgttgccctcgtgactctcctgatttgggtcccagtgaaggttatcctgcacaaaaagaggtatatctaccggaaaattaagggctggaggcccgtcttgatgatgtgtgttgtactgacgacgttgccatgtttgacattttccatcgccgtgactgaggttcagaaatcgattaacggctccgccgacgttcttcccgacatgctgccagatcttcccgtttctttggtgctgcttagccttatcatggtcgatattattgagaagctgcgcatctaccccctcagaggaagtcaaaagagctcagaaaatggacatatccactcgaccagtttacagcacatcaagacggtgacagaacaggttcgacagtccccagagaatgctgcatcccctcaagctaccaattcaacccaagtcagccagccaagcggagctatgacacgcagtcaggagtccgtcttcatgggcccacaggaacctagctgcgactccgggatactgcgcatgatgagtagaagggacgttcgggcagaattgttcctgtggtctttcttgctgtggtccgacactatcgaaatggtcagggtcgccggccacccaaatgtctataaatcttcctggctgtatcccgtgtatattttcagctttatctcgttacttcgcatcacctttacgccgcaaaaccctctcttaaattctctctcggtgctgctacaagatttaccattcgtgtttgtgagattggggctcatcatcgcccttgggactatcaccccagttctggggttgtgtaaaaatattctggtaacactgtcttacatatatttcaattatctcacgcgaatccggatctttagtgcatttgagatgtctccgttttag

SEQ ID NO: 31455 - DNA, 1056 bp, Artificial Sequence
  Description of Artificial Sequence: Synthetic coding sequence
atggcgtccggcaggctaattaagtttgtcgtgtttgagcttctggagttcgccgcattctccattccgactctcgtgataacggaacagtttgccacagcttaccaggggacacgtgctcgatctgacaacacccattactggcttataatctcttgcagtatcgcctatgtcgccctcgtcaccctgctgatttgggtccctgtgaaagttatcctgcataaaaagcgatacatctacaggaaaattaaaggttggcggcccgtgctcatgatgtgcgtggtcctgactacgcttccgtgtctgaccttttcaattgctgttaccgaggtgcaaaagagcatcaatggctctgccgatgtgttacccgacatgttaccagatctgcccgtgtcccttgtcctgctgagtttaattatggtggacatcatcgaaaaactgaggatctatcccctccgcggttcccagaaaagctccgaaaacggtcatattcattccacaagcttacagcacattaagaccgttacagagcaagtgcgccagtctcccgagaatgcagccagtcctcaggccacgaactccactcaggtgagccaaccaagtggggccatgacgcggtcacaagaatcagtatttatgggaccccaagagccaagctgtgattcaggaattcttaggatgatgtcacggagagatgtcagagcagaattgttcctgtggtccttcttactctggtctgacaccattgaaatggtgcgcgtggccggccaccctaatgtgtataagtcctcttggctttatcctgtgtacattttctccttcatttcactgctccgcattacattcacgccccagaatccactgctgaattccctctctgtccttctgcaggatttacccttcgtgttcgtgcgcctggggctaataatcgcactaggaacgattacccccgtgctggggttatgcaagaatatcttagtgaccctgtcctacatttattttaactacctgacccggattcgcattttttccgctttcgaaatgtcaccattctag

SEQ ID NO: 31456 - DNA, 522 bp, Artificial Sequence
  Description of Artificial Sequence: Synthetic coding sequence
atgagtatgtccgccaatactatgatcttcatgattctcggcgcgtcagtggtcatggccatcgcatgtctcatggacatgaacgccctcttggaccggtttcataattacatcctgcctcacctgaggggagaggaccgggtctgtcattgcaattgtggccgccatcatatccattatgtcatcccatatgatggtgaccagtcagttgtcgacgcctctgagaactacttcgtcactgacagtgtaacgaagcaggagatcgacttgatgctgggattactcctggggttctgtatctcgtggttcttggtctggatggatggggttttacactgcgccgtgcgcgcatggcgggccggccgtaggtatgatggcagctggacatggctgcctaagctctgttctctgcgagagctggggcgaaggccgcatagacccttcgaggaggccgccggcaatatggtgcacgttaagcagaaactttaccataatgggcaccccagcccacgtcacctgtag

SEQ ID NO: 31457 - DNA, 522 bp, Artificial Sequence
  Description of Artificial Sequence: Synthetic coding sequence
atgtccatgagcgccaatacaatgattttcatgattctgggcgctagtgtcgtgatggctatcgcttgcttgatggacatgaacgcactgctcgaccgttttcacaattacattctgcctcatctgcggggcgaggatcgcgtgtgtcactgcaattgtgggcgacaccatattcactacgtaattccttacgacggggatcagagcgtcgtggacgcatcagagaactatttcgttactgattcagtcacaaaacaggagatcgacctgatgctgggcttactgctggggttctgcatatcatggtttctggtatggatggatggtgtactgcactgcgcagtacgcgcctggagggccgggcgacgttatgatgggtcctggacttggctacctaagctctgctccttgagggagctcggccgcagaccgcaccgtcccttcgaagaagctgctgggaacatggtacatgttaagcagaaattgtaccacaacggccacccttcccccaggcacttgtag

SEQ ID NO: 31458 - DNA, 891 bp, Artificial Sequence
  Description of Artificial Sequence: Synthetic coding sequence
atgtgcgtgagacgctctctggttggtcttactttttgcacgtgttacctcgccagttacctaaccaacaagtatgtactctctgtactgaaattcacttatcccacactttttcagggctggcagacgctgatcggcggactgctgctgcatgtctcatggaaactggggtgggtggaaattaattctagttcgaggtcacacgtgctcgtctggttgcccgcatcagtcttgttcgtggggataatctacgccggtagtcgggctttgagtcggctggctatcccagtcttcctaactctgcacaacgtcgcagaggttattatctgtggatatcagaaatgttttcagaaggagaagacatccccagcgaagatttgctcggcattgttgctgttagccgccgccggttgtcttccttttaatgattctcagtttaaccctgacgggtatttttgggccataatccatctgttgtgcgtcggggcatataagatcctccagaagtcccaaaaaccctcagcgctcagtgacattgaccagcaatatctgaactacattttctccgtcgttctgttagctttcgccagtcatcccacgggtgatcttttcagtgtgctggattttcccttcctctatttctaccgattccacggctcctgttgcgcttccggtttccttggcttcttcttgatgttctctaccgtaaagctgaagaatctgctcgcccctgggcagtgcgcagcgtggattttctttgcgaagatcattaccgccgggctgagtattctgctctttgacgctattctgactagcgccactactggatgtctcctcctgggcgcacttggcgaagctctcctcgtttttagtgaaaggaaaagttcttag

SEQ ID NO: 31459 - DNA, 372 bp, Artificial Sequence
  Description of Artificial Sequence: Synthetic coding sequence
atgtgtgtcaggcgatcgctggtcggcctgactttctgcacctgctacctagcctcctatttgactaacaaatacgtgcttagcgtcctgaagtttacttaccctaccctcttccagggaagccacgtacttgtgtggttgcccgcaagtgtattgttcgttgggatcatctacgccggctctcgagcactctccaggttagctatcccggttttcctgacgctccataatgtggcagaggtgatcatttgtggctatcaaaagtgctttcaaaaagagaaaacttcccccgctaagatctgccgcctgcacctggagcggacgcgtcagaaccaaaccagccggctctcatcctgcctgaagggagattag

SEQ ID NO: 31460 - DNA, 468 bp, Artificial Sequence
  Description of Artificial Sequence: Synthetic coding sequence
atgattccagacgtgatctccgctctcctcctcttggccgcagccggttgcctgccattcaacgactcccagttcaatcctgatgggtacttttgggccatcatccatctgctgtgcgtcggcgcctataaaatcctgcagaagagccagaagccctcagctttgtctgacattgaccagcaatatttgaactacatcttttctgtggtcctgctggcttttgcgtcacacccgaccggagatctgttctcggtccttgacttccctttcctgtatttctatcgattccacggaagctgctgcgccagtgggttcctaggttttttcctgatgttttcgacggtaaagctgaaaaaccttcttgcgcccggacagtgtgccgcctggattttttttgctaaaattatcaccgccggactttcgattctcctgtttgacgcgatcctgactagcgcgactaccggctag

SEQ ID NO: 31461 - DNA, 507 bp, Artificial Sequence
  Description of Artificial Sequence: Synthetic coding sequence
atgtgtgtgagacgcagcttagttggcctaactttctgtacttgctaccttgcctcttacctgactaataaatacgtactcagcgtcctgaagttcacctacccaacactctttcagggttggcagaccttgatcgggggcctgcttttacacgtctcctggaagttaggatgggttgaaatcaattcaagctcgaggtcccacgtcctggtctggctcccagcatcagtgctatttgtggggataatatacgcggggtcaagagccctttccaggcttgccatacccgtatttctgaccttgcacaatgtggctgaagtaattatctgcgggtatcaaaaatgcttccagaaggagaaaacatcaccagcaaagatatgctcggctcttttgctgctggcagccgcaggctgcctcccgttcaacgattcccagtttaatcctgacggttacttctgggccattatccacctgctttgtgttgtaacgttgactagcaacacgtag

SEQ ID NO: 31462 - DNA, 387 bp, Artificial Sequence
  Description of Artificial Sequence: Synthetic coding sequence
atggaaaccgccggcgcagccacgggtcaacccgcttcaggcctggaggccccaggctccaccaacgatcgactctttctcgtgaaggggggcatatttcttggaactgtggccgctgcaggaatgctcgccggctttattactaccctgagtctggcaaagaaaaagtcccctgaatggttcaataaggggagcatggcaaccgctgcgcttccagagtctgggtccagtctggctctccgtgccttggggtgggggtccctgtacgcatggtgcggcgtcggggtgatatccttcgccgtgtggaaggcattaggggttcattcggtttccaactattgtcttgtcccaggtatttatatgttcatcctgctcacagttttttag

SEQ ID NO: 31463 - DNA, 426 bp, Artificial Sequence
  Description of Artificial Sequence: Synthetic coding sequence
atggaaactgctggagctgctaccggccagccagcctctgggcttgaggctcctgggtccacaaacgatcggctgttcctggtcaaaggtggaatcttccttggcactgttgcagctgctggcatgctggccggctttattacaaccctatcactggcaaagaagaaaagccctgagtggttcaataaggggagcatggccaccgctgctctacctgaatccgggagctcgctggccttgagggcattgggttggggcagcctgtatgcctggtgcggcgtcggggtgatcagttttgctgtgtggaaagcactgggggtccacagcatgaacgattttaggagcaaaatgcagtccatcttccccaccatccccaaaaactccgagtctgcagttgagtgggaagaaactctcaaatccaagtag

SEQ ID NO: 31464 - DNA, 651 bp, Artificial Sequence
  Description of Artificial Sequence: Synthetic coding sequence
atgccaaagggaagggcgggcagcttacctacaacaagtattggctggcgcttccagctctggttcctggggttaacttgcccggagcggcatctggcccgcagactcaagaataatagcttttatccatttgtgcagcaggagccaaacggagcagaagctagagacctggggcttccacgggtgcggaggggacgcggaccagtcgctcgggacctggtcgccgcggctgcccctcctggcgcagagcctcacgctaggcgtgtgccactgctccaccccgggccacatagagtgcctgggcctcttgcctccggcctgagggccccgggagctcagcttagatgcccaagaaaggtgcttctgcctcccggcccacggagacctcaggtgggagcccctggcgctggcgcagctgttggagcgctcagggcgaatggtatccttggccctctgcatcggcctgagacccagcatcagttgcttcgcctgccaggccacctgctgcctgctcgtggttctcccctggccaccccttggagatggcactgcgacggccaggagccgcacggttcccaggcacagctcctgtcggtccagcccggcggggtcactcttagagcaagccccacgagcggactttgttcctag

SEQ ID NO: 31465 - DNA, 672 bp, Artificial Sequence
  Description of Artificial Sequence: Synthetic coding sequence
atggagggtctggtttttcttaacgctctcgctacccgcctgttgtttctacttcactccctggtgggggtctggcgagtcaccgaagtgaaaaaagagcccaggtattggttgctggccctgctgaatcttctcctgtttctggaaaccgccttaactttgaaattcaaaagggggagaggctacaaatggttttctcctgcaatctttctgtaccttatctccattgtaccttctctctggctcttggagctgcatcacgaaacccagtactgttctatacaagctgaggggacttcccagaatacttcccgaaaggaagatttcaaccaaacgctcacttctaatgaacagacgtcccgcgctgacgacctgattgagacggctaaagtgttcgtcaataatctgtcgacagtgtgtgagaaagtgtggacactggggcttcaccaaacttttctactcatgttaattattggtaggtggttgctgcctattgggggcggaataacccgtgatcagctgtcccaactccttctgatgtttgtcggaactgccgccgatatattggagttcacttcggaaacactggaagaacagaacgtgaggttatgttggaagaactccaccaacaggaggcacacgaatcctaaatggcagctagtgctcttttag

SEQ ID NO: 31466 - DNA, 1107 bp, Artificial Sequence
  Description of Artificial Sequence: Synthetic coding sequence
atggaaggcttagtgttcctgaacgctctcgccactagattgctctttttgctgcactctttggtaggcgtgtggagggtcactgaggtcaagaaagagccacgctattggctgctggcccttctaaatctcttgttattcctcgagaccgctctgaccctgaaattcaagcgcggccggggatataaatggttctctcctgcaatattcctttacctgattagcatcgtccccagtctttggctactggaactgcaccatgagacccagtactgcagcattcaggccgaaggcactagccagaacacctcaagaaaggaggacttcaaccaaaccctaacttctaatgagcagactagtagggcagatgatctaattgaaaccgctaaggtgttcgtaaataatttaagcaccgtgtgcgagaaggtgtggacactgggcctgcatcaaacatttttgctgatgctaatcatcggccgttggctgctccccatcggaggggggattacgagggaccaactgagccaattgctcttgatgttcgtgggcaccgcggctgacatcctcgaatttacctcagaaaccctcgaggagcagaatgtcagaaattcccccgccctggtttacgctattctcgtgatatggacctggtccatgctccagttcccccttgatttggctgtgcagaacgtggtgtgccctgtatccgtcactgagaggggctttccatcactttttttctgccagtactcagccgacttgtggaatattggcatctccgtgttcattcaggacggcccctttctggtggtccggctgattctgatgacatatttcaaggtcattaaccagatgttggtcttctttgctgctaaaaatttcctagttgtcgtgctgcagctttacaggcttgtggtgctggcactcgcagtaagagcctctctgcgctctcagtccgagggactaaagggtgaacatggctgtcgggctcaaacaagtgagtcgggtcccagccagagggattggcagaatgagtccaaggaaggcctagctattccgctgaggggatcacccgtcactagtgacgactctcaccacaccccttag

SEQ ID NO: 31467 - DNA, 1107 bp, Artificial Sequence
  Description of Artificial Sequence: Synthetic coding sequence
atggagggtctggtttttctgaatgcactcgcaaccagattgctgtttctacttcactccctcgtgggggtctggcgcgtaaccgaggtaaaaaaggaaccccggtattggctactggccctgctgaatttgttgctttttctggagacagcgctgacactgaaatttaaacggggcagggggtataagtggtttagccctgccatattcctctacctgatttctattgtgccgtcactttggctgctagagctgcatcacgagactcagtattgcagcatccaagctgaaggcacctctcagaacacttcccgaaaggaggatttcaatcaaaccttgacatcaaacgagcagacatctcgagcagacgaccttattgagaccgccaaggtgttcgtgaacaatctctcaacggtttgtgaaaaagtctggacattgggccttcaccaaacttttctacttatgttgatcatcgggaggtggttattgcctatcggaggcggcatcacccgtgatcagctgtcgcagctgttactgatgttcgtgggaaccgcagccgacattctggagttcacctccgaaacactcgaagagcagaatgttcggaatagcccggcccttgtatacgctattttggttatctggacctggtccatgcttcagtttccactggatcttgccgtgcagaacgtggtttgtcctgtgtcggtgacggagaggggcttcccatccctattcttctgccagtactcggccgacctgtggaacatagggatttccgtgttcattcaggatggccctttcctcgtggtcaggctcattctcatgacttatttcaaggttatcaaccagatgctggtgttcttcgcagcaaaaaactttctcgtggttgtgcttcagctgtaccgtcttgtggtattggcattggccgtgagggccagcctccgtagtcagtcagaagggctcaagggtgagcacggatgtagggcccaaacaagcgagtcagggcccagtcagagagactggcagaacgaatctaaggaaggcctagccattccacttagaggaagccctgtcacttccgatgatagccatcataccccctag

SEQ ID NO: 31468 - DNA, 507 bp, Artificial Sequence
  Description of Artificial Sequence: Synthetic coding sequence
atgaggctaaccgagaagtctgagggcgaacagcaacttaagccaaacaatagcaacgctcccaatgaggaccaggaggaggagattcagcaatccgagcaacacactccagcgcgacagcgcacccagagagcagatactcaaccatcccggtgtcgactgccgagcaggaggacacctactacatccagcgacagaacaattaatctcctcgaagtcctaccctggcctactgagtggatttttaacccctatcggctgcccgcactgttcgaattgtacccggagtttcttcttgtgttcaaggaggccttccatgacatttctcactgtctgaaggcccagatggagaaaatcgggctgccgatcatcctgcatttgttcgccctctcgaccctgtacttctataagttctttctccctaccattctgtctctgagctttttcattcttctggtattgctccttctcctcttcattattgtgttcatcttgatctttttctag

SEQ ID NO: 31469 - DNA, 744 bp, Artificial Sequence
  Description of Artificial Sequence: Synthetic coding sequence
atggccgatacaacccctaatgggcctcagggtgccggcgctgtgcagttcatgatgacaaataaactcgacacagcaatgtggctaagcagactgttcaccgtctattgctctgctctctttgtcctgccgctcctgggcctccacgaggccgccagtttttaccagcgtgccctgttggccaacgccttgacaagtgccctccgccttcatcagagactaccccactttcagctgagccgggcctttctcgctcaggctctgctggaggactcatgtcattacctgctttattccttgatatttgtaaacagctatccagtgactatgagtatcttccctgttctgctattctccttgctgcacgccgctacatatactaaaaaggttctcgacgccagaggctcaaatagcctgcctctactgagaagcgtattggacaaactgtccgctaatcagcaaaatatacttaaattcatcgcttgtaacgagatatttcttatgcccgcaacggttttcatgttattcagcggtcagggctctctgctgcagccattcatttattataggttcctaaccctaaggtattcttcgaggagaaacccgtattgcaggactttattcaatgagttacgtatagtggtggaacacattatcatgaaaccggcctgccctctgttcgtccggcggctgtgcctgcaatccattgcgttcatctctagactggctcccactgtgccctag

SEQ ID NO: 31470 - DNA, 744 bp, Artificial Sequence
  Description of Artificial Sequence: Synthetic coding sequence
atggctgataccaccccaaacggaccccaaggtgcgggagccgtgcaatttatgatgactaataaattggataccgctatgtggctatctcgtctttttaccgtatattgttccgctctttttgtcctgcccctgctgggcttgcacgaggccgctagcttctatcagcgagctctcctcgccaatgcacttacgagcgcacttcgcctgcatcagagattgccccacttccagctttcccgggcctttttggctcaagcccttctagaggactcctgccattaccttctgtactctctgattttcgtgaattcgtacccagtgaccatgagtatattccctgttttgctgttctctttgctccacgcagcaacatatacaaagaaggtcttggacgcaaggggttcgaactcccttcctctgttgagaagtgtgctggacaagctttccgcgaaccagcaaaatatcctcaagtttattgcttgcaatgagatatttctgatgcccgcaacagttttcatgctgttcagtggccaggggagcctgctgcagcctttcatatactaccgcttcctgacactgcgctactcttcacggcgaaatccctactgtcgaacgctgtttaacgagctcaggatcgtagttgaacatatcataatgaagcctgcctgcccactttttgtgaggagactttgcctgcagtccattgcgttcatctcacgcctagcaccaacagtaccatag

SEQ ID NO: 31471 - DNA, 669 bp, Artificial Sequence
  Description of Artificial Sequence: Synthetic coding sequence
atggctgataccacgcccaatggtccccagggggccggcgcagtccagtttatgatgacaaacaagctggataccgcgatgtggttgagtaggctgtttaccgtgtactgtagcgccttatttgtcttacctctcctcggcctgcatgaggcggcaagtttctaccagagggctctactggctaacgccctgacatccgccctgaggctgcatcagcgtctgcctcactttcagctttcaagggcttttctagctcaagctctgctggaagactcatgccactacctgctctacagcctaattttcgtaaattcttatccagtcacaatgtccattttcccggtgctcctgtttagtctgctgcatgcagccacctatacaaaaaaggttttagacgcccgcgggagtaacagtctgcctttgctgagaagcgtgctggacaagctgtcagcaaaccagcaaaatatcctgaaatttattgcatgcaatgaaatattcctgatgccagccacggtcttcatgctgtttagtggtcagggatcgctgttacaacctttcatatattatcggttcctcacattgcgctattcgtcccgccgcaacccctattgcaggacccttttcaacgagctgcgcatcgtcgtcgaacacatcattatgaaaccttag

SEQ ID NO: 31472 - DNA, 744 bp, Artificial Sequence
  Description of Artificial Sequence: Synthetic coding sequence
atggctgacaccacgcctaatggcccccagggggcaggtgctgtgcagttcatgatgactaacaaattggacacggcaatgtggctgagtcggttgttcaccgtctactgcagcgccctttttgtcttgccacttcttggtctccatgaagccgcttcgttctaccaaagagccctgttagccaacgcattgacttccgcgctgcgactccatcagaggctgccacatttccagttgtctagagcttttctcgcccaggctctcctggaagactcttgtcattatctcctctattccctaatctttgttaacagctatcctgtcactatgtccattttccccgtgctgctcttctccctgctccatgctgcaacgtataccaagaaggtcctggacgcacgggggtctaactcattacccctactccgcagtgtgctagacaagctgtctgctaatcagcaaaatatcctgaagtttattgcctgtaacgagatattcctgatgccagctacggtattcatgttgttttcaggccaaggaagtctcctgcagccttttatatattacaggtttttgactctccgttacagctctcgccggaatccatactgtaggacactttttaacgaactgaggatcgttgtcgagcacatcattatgaaaccagcctgtcccctgttcgtacgtaggctctgtctccagtctattgccttcatatcacgtctagcccccacggttccctag

SEQ ID NO: 31473 - DNA, 504 bp, Artificial Sequence
  Description of Artificial Sequence: Synthetic coding sequence
atggcatctcccaggacggtgacgatcgttgccctgtcagtggcactgggactgtttttcgtctttatggggaccatcaagctcaccccccgtttgtccaaggatgcctattccgagatgaaacgggcatataaatcttacgttcgagccctgcctttactcaagaagatgggaatcaatagcatcctgttgaggaagagtatcggtgctctcgaagtggcgtgcggcatcgtgatgactttggtccccggacgacccaaggacgttgccaacttttttctgctgttactggtactcgctgtattgtttttccaccaacttgtaggagacccgttaaaaaggtatgctcatgcgctggtcttcgggatcctgctgacctgcagattgctgattgccaggaagccggaagaccgcagctcagagaaaaaaccccttccaggcaacgccgaagagcagccaagcctatacgaaaaggcgccccaaggtaaagtgaaagtctcctag

SEQ ID NO: 31474 - DNA, 381 bp, Artificial Sequence
  Description of Artificial Sequence: Synthetic coding sequence
atggcatcccctagaaccgtcacgatcgtggcactctccgttgcccttggattgttttttgtcttcatgggtaccataaagctgactccaaggctctccaaggacgcttactcagagatgaagagagcgtataagagttacgttagggccctgccactgctgaagaagatggggatcaacagtatcctgcaccaactggtaggcgatcccttgaagcggtatgcccacgcactggtcttcgggatcctgctgacctgccgcttattgatcgcacggaaacccgaggacagaagctcggaaaagaaaccccttccgggaaacgccgaggagcagcccagcctatacgagaaggccccgcaggggaaggtcaaggtctcttag

SEQ ID NO: 31475 - DNA, 573 bp, Artificial Sequence
  Description of Artificial Sequence: Synthetic coding sequence
atgactgccgtgggcgtgcaggcacagcgtcccctcgggcagcgacagcctagacggtccttcttcgaatcgttcattcgcacgctgatcattacatgtgtggccttggccgtggtcctcagtagtgtcagcatctgcgacggccactggcttctagccgaggacagactcttcggactctggcatttctgtaccaccactaaccagacaatttgttttagggacctcggacaggctcatgtaccaggccttgccgtagggatgggtctggttcggtccgttggcgccctggccgtggtggctgcgatatttggcttggaattcctgatggtctcccagctgtgtgaggataagcatagccaatgtaaatgggtaatggggagtatcctgttgctggtgtcctttgtattgtcgagtgggggcttgctaggcttcgtgattctgttgcgtaaccaggttaccctgataggatttaccttaatgttttggtgtgaattcactgcctccttccttttgttcctgaacgcaatctctgggttgcacatcaatagcattactcacccctgggaatag

SEQ ID NO: 31476 - DNA, 900 bp, Artificial Sequence
  Description of Artificial Sequence: Synthetic coding sequence
atggaactcttgtcggctctgtccttgggagaactcgcgctgtctttctctcgggtgccattatttcccgtcttcgacctatcctattttatagtatcaattctgtatctcaaatacgagcccggtgccgtggagctgagccgcaggcaccctatcgcttcctggctgtgcgccatgctgcactgcttcggaagctatatcctggcagacctgcttctgggcgagcccctcattgattacttcagcaataatagcagcattctcctggcctctgcggtctggtacctgatcttcttttgtccacttgatctgttttacaaatgtgtctgttttctgcctgtcaagttgatcttcgttgccatgaaagaagtggtgcgggtacgaaagattgcagtcggaatccaccacgcgcaccaccactaccatcatggatggtttgtgatgatcgcgactggttgggttaagggctccggcgtagccctaatgtctaattttgaacagttgctgcgcggtgtttggaagcctgagactaatgaaatcttgcacatgagtttccctaccaaggccagcctttacggcgctatcctctttaccctgcagcagactagatggctaccagtatccaaagcctccctcatcttcatatttactttgtttatggtgtcatgtaaggtgtttctgactgccactcattcacactccagtccttttgatgcgctagagggctacatctgcccagtgctgttcggctccgcctgcggtggagatcaccatcacgataatcacggcggcagccattctggggggggcccaggcgcccagcattcagcaatgccagccaaatctaaagaagagctttcagaaggtagcagaaagaagaaagccaagaaggccgattag

SEQ ID NO: 31477 - DNA, 714 bp, Artificial Sequence
  Description of Artificial Sequence: Synthetic coding sequence
atgctccactgttttggcggaggtattctcagctgcctgttgttagccgagccaccgctcaagtttcttgccaaccacacaaacatccttttagcctccagcatctggtacataaccttcttctgtccacatgacctggtgagccagggctacagctatctgccagtgcaactgctggcaagtggaatgaaagaggtaactagaacttggaagatagtgggcggggtcacccacgctaactcctactacaaaaatggttggatagttatgatcgccatcggatgggccaggggggctggaggtaccatcattacaaactttgagaggctcgtgaagggagattggaagccagaaggggatgagtggctgaaaatgagctatccagccaaggtaacactgctgggctcagttattttcacttttcagcatacccagcacctagccatctccaagcacaacctaatgttcctgtacacaatctttatagtggcgacaaagataactatgatgacaactcagaccagcacaatgacgtttgcccccttcgaggacactctgagttggatgctgtttggatggcagcagcctttttcctcttgtgagaaaaagagcgaggctaagtccccctctaatggcgtaggatcactggcctccaagcctgtcgacgtcgccagcgataatgtcaaaaagaaacataccaagaaaaacgaatag

SEQ ID NO: 31478 - DNA, 876 bp, Artificial Sequence
  Description of Artificial Sequence: Synthetic coding sequence
atggattctccttgggatgaactcgctctcgcattctcaagaacatcaatgtttcccttttttgacatagcgcattacctcgtttccgtgatggctgtgaaacgccagcctggtgccgctgcgttggcgtggaagaatcctattagctcttggtttacagccatgcttcactgttttggtggtggaatcctgtcatgcctgctgctggctgaacctcctttaaagttccttgccaaccatacaaacatcctgctggcctcatcaatttggtacatcacttttttctgtcctcacgatctggtgagccagggttactcctatctccccgtccaactgctggcctctggcatgaaggaggtgactcgaacgtggaaaatcgtggggggcgtcactcatgccaactcctactacaagaacgggtggattgtaatgattgccatcggatgggctaggggggccggagggacgatcataactaatttcgagaggttggtgaaaggtgattggaagcccgagggcgacgaatggcttaagatgtcatatccggccaaggtgaccctgttaggttcagttatctttacatttcagcacacccagcatttagcaataagcaaacataacttgatgtttctgtatacaatcttcatagtcgccactaagatcacgatgatgaccacgcaaacgtcaacaatgacttttgctcctttcgaggacacgttgagttggatgttgttcgggtggcagcagccgttttcctcatgcgaaaagaaatctgaagccaaaagtccctctaacggcgtagggagcctggcgtccaaacctgttgatgttgcaagcgataatgtgaaaaagaagcacaccaagaagaacgagtag

SEQ ID NO: 31479 - DNA, 108 bp, Artificial Sequence
  Description of Artificial Sequence: Synthetic coding sequence
atgctacattgtttcggaggaggaatccttagttgcttgctgctcgccgagccccctctgaagtttctggctaatcacaccaatatcctattagcctcgagcatctag

SEQ ID NO: 31480 - DNA, 489 bp, Artificial Sequence
  Description of Artificial Sequence: Synthetic coding sequence
tgaagttgcctgctgttggcagagcctcctctcaagttcttagctaatcatactaatattttactggcctcctccatatggtatatcacttttttctgccctcacgacttagtctctcaggggtactcatatctcccagtccaactcctggcctctggtatgaaagaggtgaccagaacctggaagattgtagggggggtcacacacgccaattcctattacaagaacggttggattgtaatgatcgctattggttgggccagaggtgcgggtggaactattatcacgaattttgaacggctggttaaaggcgactggaaaccagaaggtgacgagtggttaaaaatgagttacccagccaaggtgacactgctcggctcagttatctttactttccagcacacacagcacctggccatctccaagcataatttgatgttcctgtataccattttcatcgttgctaccaagagcctaaattggaggtag

SEQ ID NO: 31481 - DNA, 246 bp, Artificial Sequence
  Description of Artificial Sequence: Synthetic coding sequence
taatggattgtgatgatagcaataggctgggcccggggtgcaggaggtacaataatcacaaacttcgaaaggctcgtcaaaggggactggaaacccgagggcgacgagtggctcaagatgtcctaccccgccaaggtgaccctgctcgggagcgtgatttttacatttcaacacacccaacacctggcgatcagtaagcacaacctgatgtttctatacactatcttcatagtggccaccaagtag

SEQ ID NO: 31482 - DNA, 1467 bp, Artificial Sequence
  Description of Artificial Sequence: Synthetic coding sequence
atgcctggaggaaggcggggtccgtccagacagcagctaagccgttctgcattaccctcgctgcagactttggtgggtgggggatgtggcaatgggaccggccttcgaaatcgtaatggatcagctatcggtctgcccgttccacctattactgcactcatcacccctggaccagtgagacactgccagatccccgatctgcctgtggacggatctctactcttcgagtttcttttttttatctatctgctcgtggctctcttcatccagtatataaacatttacaaaaccgtgtggtggtacccctacaaccaccccgcgagctgtacgagtctgaactttcatcttattgactaccaccttgctgcctttataaccgtgatgttagcccggagactggtgtgggctcttatatctgaggcaactaaggctggagccgcctcgatgatccactacatggtcctgatcagtgctcgtttggtcttgctaaccctatgtggatgggtactgtgttggacgttagtgaacctgttcagatctcattctgtcctgaacctgctatttttgggctatccctttggagtgtatgttccactttgctgcttccatcaggactcccgtgcgcatctactgctcactgactacaactacgtagttcagcacgaagccgtggaagaatcagcatctaccgttggagggctcgccaagagtaaagatttcctttctctgcttctggaaagcttgaaagaacaatttaataacgctacacccattcccacccacagctgcccactcagtccagacctgattcgaaatgaagtggaatgtctgaaggccgactttaatcataggataaaggaggtgctgttcaattctctcttctccgcctattatgtggcattcttgcctttgtgcttcgtgaagtccacccagtactatgacatgagatggagttgcgagcatttgattatggtctggatcaacgcctttgttatgctgactacccagttgttaccaagcaaatactgcgacctccttcacaagtcagctgcccatcttggcaaatggcagaaacttgagcacgggtcatactctaatgccccccagcatatctggtccgagaacactatatggcctcagggggtgctggtgaggcattccaggtgcctgtatcgggccatgggaccctataatgtcgccgttccatcagatgtttcacacgcaagattttacttcctgtttcatcgcccattgagacttttgaaccttttgatactaatcgagggatcagtggtgttctaccaactttactctctgctccgatccgagaagtggaatcacacactgtcaatggcgctcatcttgttttgtaattactatgttctgtttaaattactgcgggaccggattgttctcggccgcgcctacagttaccctttaaattcctatgagctgaaagcaaattag

SEQ ID NO: 31483 - DNA, 339 bp, Artificial Sequence
  Description of Artificial Sequence: Synthetic coding sequence
atgcctgggggcagacgggggcccagcaggcagcagttatctaggtccgcccttcctagcctgcagaccttagtaggcggtgggtgcggcaatggaaccgggctgcgaaaccgcaacggcagcgcaatcggactcccagtgcctcccataactgctcttattacaccgggaccggtgcggcactgccagatccctgacctgcctgtggacgggtctcttctatttgaattcctgttttttatctatctcctggtcgctctttttattcagtatatcaacatctacaagacagtatggtggtatccttataaccacccagcctcttgtacgtcattatag

SEQ ID NO: 31484 - DNA, 579 bp, Artificial Sequence
  Description of Artificial Sequence: Synthetic coding sequence
atgccaggcggcagaaggggaccttctagacagcagctgtcccgctccgctcttcccagcctgcagactttggtgggcggaggttgcgggaacgggactggccttcgcaaccgcaacggctccgccatcggccttcccgtcccacctataacagccctgatcaccccgggccccgttcgccattgtcagattcctgatctccctgtggatggctccctgctctttgaatttctcttttttatttatctactggtggctctctttattcagtacatcaatatatacaagacggtgtggtggtatccgtataaccatcctgcaagctgtacttccctgaatttccacttaattgactatcacctggctgcctttatcaccgtaatgctggcccgaaggctggtttgggccctgattagcgaagccacaaaagcaggagcagcctccatgatccattatatggtcctgatctccgccagactggtcctgttgactctgtgcggctgggtactgtgctggactcttgtgaacctgtttcgttcccactcggttttaaatctgctgtttctggggtatccctag

SEQ ID NO: 31485 - DNA, 423 bp, Artificial Sequence
  Description of Artificial Sequence: Synthetic coding sequence
atgcccggcggtcgccgcggacccagccggcagcaattgtctcgatctgctttgccgtctcttcagacactagtgggcgggggatgtgggaatggcacaggactccgcaatagaaatggcagcgcaatcggcctgcctgtcccacctatcaccgcactgattactcccggccccgtgaggcactgtcaaatcccagaccttcctgtggatggatcgctgctgttcgagttcctctttttcatatacctgttagtggctctcttcatacaatatattaatatatataaaactgtgtggtggtatccctacaaccatccagcctcctgtacaagtttgaattttcatctaatcgattaccacctggcggcctttatcactgttatgctagcccgacgtcttgtgtgggccttaatcagcgaatag

SEQ ID NO: 31486 - DNA, 1479 bp, Artificial Sequence
  Description of Artificial Sequence: Synthetic coding sequence
atgggcggccgcagagggcccaatcgcacttcctactgccggaacccactgtgcgaacccgggtcctctggagggtcatccggatcacacacatccagcgcatctgtcacctctgtcagatcaaggacccgttctagtagcgggacaggtctaagttcacctccgctcgcgacacaaaccgtggttcctctgcaacattgtaaaattcccgagctgccagtccaggcttccattctgtttgaactgcagctttttttttgccagctcattgcgctgttcgtgcactacattaacatttacaaaacggtttggtggtatcccccctctcacccgccatctcatacttcgctgaattttcacttaatcgactttaatctcctgatggtcaccacgattgtgctgggcagacggttcataggcagcatcgtaaaggaggcctcgcagagggggaaggtttcactttttaggtctattcttttatttctgacccgcttcacagtgttgactgctacagggtggagcctttgcagatccttgatccacctgtttcgcacctatagctttttgaatcttctttttttgtgttacccgtttggaatgtacataccattcttacaactgaactgcgacctcagaaagacgagcttgttcaatcatatggcctctatgggacccagagaagctgtgagtggcctggccaaaagcagggattacttgttaactctgagggagacctggaaacaacacacccggcagctttatgggcccgacgctatgcccacccacgcctgctgcctgtctccaagtctgatccggagcgaggtggagttcctgaaaatggactttaactggcggatgaaggaagtactcgtaagcagcatgctgtctgcttactatgtggcctttgtgcccgtctggttcgtaaaaaacactcattactatgataaacgatggtcctgcgagctatttctgttggtgtcaatctcaacatcagtgatcctcatgcagcacctgctgcccgcctcgtattgtgatcttcttcataaggctgctgcacatctagggtgctggcagaaagtcgatccagctctctgcagcaatgttttgcaacacccttggaccgaagaatgcatgtggccacaaggcgtactagttaagcactcaaagaatgtctataaggccgtgggacattataacgtggcaatcccatctgatgtgagccattttcgctttcatttctttttcagcaaacctctgcgcattttgaacattcttttactgctcgaaggggccgttatcgtgtaccagctttattcactgatgtcttccgaaaaatggcaccagaccatatctctggcccttatcttattcagcaactattatgctttctttaagcttttaagagataggctagtgctgggcaaggcatactcttactctgcctctccacagagggaccttgaccatagattcagttag

SEQ ID NO: 31487 - DNA, 579 bp, Artificial Sequence
  Description of Artificial Sequence: Synthetic coding sequence
atggggggtcggcgcggccctaaccgtacctcttattgtagaaatcctttgtgcgagcccgggtcatccggaggttcctccggctcccacacatcttccgccagcgtcaccagtgtgagatcaagaacccggtcttccagcggtactgggctgagttcacccccactggccacacagacagttgtgcctcttcaacactgcaagattcccgaactccctgtgcaggcctcaattctgttcgagctacaactcttcttttgtcagctgattgctttgtttgtacactacattaacatctacaaaaccgtctggtggtatcctcctagccatcctcccagccacaccagcttagcttcccagaggggcaaagtatctctgtttagatccatcttactcttcctgactagatttactgtgctgacagctacagggtggtccctgtgcagatccctgattcatctgttccggacttactcgtttcttaaccttctctttttgtgttatccctttggcatgtatattccttttctccagctcaattgcgatcttaggaagacctctcttttcaatcacatgtag

SEQ ID NO: 31488 - DNA, 882 bp, Artificial Sequence
  Description of Artificial Sequence: Synthetic coding sequence
atgtatatcccgtttctgcaacttaattgcgatctgcggaagaccagcctgttcaatcacatggcatccatggggccaagagaagcagttagcggcttagccaagtctcgtgactatctcttgaccttacgcgaaacctggaagcaacatacccgacagctctatggtccagatgccatgcctacccacgcatgctgtctgagtccttctttgatacggtcagaggttgagttcttgaaaatggacttcaactggcggatgaaggaggttcttgtcagcagcatgctgagcgcctattatgtcgcgttcgtacctgtttggtttgtgaagaacacccattactatgataagaggtggagttgtgaactgtttctactcgtaagtatcagcacatctgttattctgatgcagcatctattgcctgccagctattgtgatcttttgcacaaagccgcggcacacctggggtgctggcagaaagtggaccccgccctctgttccaatgtgttacagcatccatggacagaggaatgtatgtggccgcagggcgtccttgtaaaacacagtaaaaacgtgtacaaagcagtcggccactataatgtcgccattccatctgacgtgtcacactttcggtttcattttttcttttcgaagccactgcgcatactaaatatcctgttgctgttggagggagccgtcatcgtgtaccagctctactctctgatgtctagtgagaagtggcatcaaactataagtctggcactgatcctcttcagcaactactacgcctttttcaagttgttaagagatagattggtgctgggcaaggcgtacagctactcggctagtcctcagcgcgacttggaccatcggttttcttag

SEQ ID NO: 31489 - DNA, 1029 bp, Artificial Sequence
  Description of Artificial Sequence: Synthetic coding sequence
atgaagaacttccacctcatcgattttaacttgttgatggtgacaacaatagtccttggtcggcggttcataggctctatcgtaaaagaagctagccagcggggaaaagtgagcctttttagatcaatacttcttttcctgacgaggtttaccgtgctgaccgcgacaggctggagtctgtgtcgatctctgatccatctgttccggacatacagcttcctgaatcttctatttttgtgttatcctttcggcatgtacatcccctttttacagctgaactgcgatctgaggaaaacgtccctgtttaatcatatggctagcatgggccctagggaagcagtctctggcttggcaaagtcaagggactatctcctgacccttagagagacatggaagcagcatacccggcaactatacggtcccgacgccatgcccacccacgcatgttgtctgagccctagtctgatcagatctgaagttgagttcctgaaaatggacttcaattggcgcatgaaggaggtgctggtcagtagtatgctgagcgcctattatgtggcattcgtgccagtctggtttgtgaaaaacacccattattatgataagagatggagctgtgaattgttcctcttagtgagtattagtacctccgtgatcctgatgcagcatcttctccctgcttcttattgtgacctgttacacaaagccgcggcccacctgggttgttggcagaaggtggacccagcgctttgctctaacgtcctgcagcacccttggacagaagagtgtatgtggccacagggcgtcttggtgaaacactcaaaaaacgtttataaggccgttggccactacaatgttgccatcccatccgatgtatcacatttccggttccatgtttctctgttaccaggagagggcggcctgggacctgaaagagtcgggggctctgccgggcaagagtgtgatgtgatagcccgggaaagctacttccaatacttccccaatcctaaggaagacagtgcccatatgtag

SEQ ID NO: 31490 - DNA, 579 bp, Artificial Sequence
  Description of Artificial Sequence: Synthetic coding sequence
atgggaggtaggcggggacccaaccggacctcatactgccgaaatcctctgtgtgagcccggctcctcaggggggtctagcggctcccatacctctagcgcttcagtaaccagcgtacgcagcaggacaaggtctagctccggcacgggtctgtctagtcccccccttgccacgcagactgtagtgccactgcagcactgtaagattcccgagctgccagtgcaggcatcgattctcttcgaactccagctgttcttctgtcaattaattgctctttttgttcattacattaacatctataaaaccgtttggtggtatcccccttcacatcctccgagccatacaagtctggcaagtcagagaggaaaagtgagccttttccgctctatcttgctgtttctgactcgctttaccgttttgacggctaccggctggagcctgtgcaggtcgcttatacacctgtttcggacttacagtttcttaaacctgctctttctgtgctaccctttcgggatgtatatcccgttcctccagctcaactgcgacctgcgtaagacctcgctgttcaaccacatgtag

SEQ ID NO: 31491 - DNA, 666 bp, Artificial Sequence
  Description of Artificial Sequence: Synthetic coding sequence
atgggcgggaggcgcggaccaaaccgtacctcatattgtaggaaccccctgtgtgaacctggatcttctggcggctctagtggcagtcacacgagcagcgcgtccgtcacctctgtgagatcaagaactcgcagctcctcagggacgggcctctccagtcccccccttgccacccagactgtggtgcccctgcagcactgtaaaattcctgagctccccgttcaggcctcaatcctgttcgagctccaacttttcttttgtcagcttatcgcactcttcgtgcattacattaacatctataaaaccgtgtggtggtatccaccttcacaccccccaagtcatacttctctcaattttcaccttattgacttcaatctccttatggttacaaccattgtactgggccgtaggttcataggaagcatcgtgaaagaggtctgggatgtgcacagtgtgcctgccgccgaacttaggcctccccaagacaagccactgcagccgcacgggttgcatggtgcacctgggggcggccagtggcctggaaaggagcccggactccccccagacacagctggagacgtcgaagccgcgcacaaaacagcagtgtggcccggccgccatgctcacccgtgcctgctgcccgtgacgcagccacatcctcagtag

SEQ ID NO: 31492 - DNA, 702 bp, Artificial Sequence
  Description of Artificial Sequence: Synthetic coding sequence
atggagaccagcgcaagtagcagtcaaccacaggataatagccaggtgcatagagagactgaggatgtcgattacggcgaaacagacttccataaacaggacggaaaagccgggctcttttcccaagagcagtatgaacgcaataaaagctcatcttccagttcctctagcagctcaagtagcagttcaagttcatcatccagctcatccgagagcaatgacgaagatcagcagccccgcgccacgggaaagcacaggcgatcactgggggccgggtacccgcacggtaacggctctcctggtcccggacacggcgagccagacgttctcaaggacgagctccaattatatggagacgcaccgggcgaggttgtgccctcaggggaatctggcctcagacggcgtggcagcgacccagccagcggggaggtggaagcatcccagcttagacggctgaacattaagaaagacgacgagttctttcacttcgtcctgctgtgttttgctattggagccctgttggtgtgttatcattactatgctgattggtttatgagcttgggtgtgggactcctaacttttgcttctctcgagaccgtggggatctactttggcttggtataccgcatccattctgttctgcagggattcatccctctctttcagaagttccgcctgactgggttccgcaaaacagattag

SEQ ID NO: 31493 - DNA, 702 bp, Artificial Sequence
  Description of Artificial Sequence: Synthetic coding sequence
atggagacttccgctagttctagccagcctcaggacaacagtcaggtgcatcgcgagacggaggacgtggactatggcgagacagacttccacaaacaggacgggaaggcaggtctgttttcgcaggaacagtacgaacggaacaaatccagcagcagcagcagttcttctagttcctcttcatcctcatctagttcctcttcaagttctgagagtaacgatgaggaccagcagccgcgcgctactgggaaacatcgcaggagcttgggggccggttatccacatgggaatggttcaccggggcctggccatggcgagccggacgtgttgaaggacgagctccagctgtacggggacgcacccggcgaagttgtcccctccggagaaagtgggctcaggcgcagaggtagcgatcctgcctctggcgaagtagaagcatcgcagttgcgtagacttaacatcaaaaaagacgatgagtttttccacttcgtgttgctatgtttcgcaatcggggcactcctggtctgctatcattactacgccgactggttcatgtctttgggagtcgggctactgacattcgcctccttggagaccgtgggcatttacttcggactggtctaccggatccactcagtgctgcaggggttcattcctctgttccaaaagttccggctcacaggattccggaaaaccgattag

SEQ ID NO: 31494 - DNA, 750 bp, Artificial Sequence
  Description of Artificial Sequence: Synthetic coding sequence
atggcagaggccggcgcgggatctctgtcgctgccaggggggaaagcaatggagacaagcgcatcttcatctcagccacaggataatagtcaggtgcaccgcgaaacagaggatgttgactatggcgaaacagattttcataagcaggacggcaaggcaggcctgttctctcaggagcagtatgagagaaacaaaagctcgagcagtagttcaagttcaagctcttcctcaagcagttctagcagtagctcttcttctgaaagcaacgatgaagaccagcagccccgtgcaaccgggaaacacagaagatccttgggggccggctatccacatggaaacggttcaccaggcccagggcatggcgaaccagatgtcctgaaagatgaactgcagttgtacggagatgctcccggtgaggtggttccttctggggaaagtgggctgcgacgaagaggctccgaccccgcttccggagaagtggaagcctcacagctgaggagactgaatatcaagaaagatgacgaatttttccactttgtgttgctgtgctttgcaatcggcgcactactagtgtgttatcactattatgccgattggtttatgagcctgggcgtcggcctcctgactttcgcgtcattggagactgtggggatttattttggcctggtttatcggattcactctgttttacagggctttattcccctgttccaaaaatttagacttactggattccgcaagaccgactag

SEQ ID NO: 31495 - DNA, 612 bp, Artificial Sequence
  Description of Artificial Sequence: Synthetic coding sequence
atggaaaccagcgcttcaagttcacagcctcaggacaattcccaggtacatcgggaaacagaagatgtggattatggagaaacagacttccataaacaggacggtaaagctggtctgttcagccaggagcagtacgaaaggaataaatctagctcttcatcaagttctagcagctcttcgagctcatcatcctcttcatctagctcaagcggccctggccatggtgagccggacgtactgaaagacgaactacaactgtatggggacgcccctggcgaggtggtgccctccggtgagagcgggctacgccgccgaggttctgaccctgcctctggggaagttgaggcttctcagctgcgacgactgaacatcaaaaaagatgatgagtttttccactttgtgctcctctgcttcgcaattggcgcattgttggtttgctaccattattacgccgattggttcatgagcttgggtgtcggactacttactttcgcctctttggagacagtgggaatctatttcggcttagtttacaggattcattccgtgctgcagggctttatccctctattccagaagttccggcttaccgggtttaggaaaacagactag

SEQ ID NO: 31496 - DNA, 474 bp, Artificial Sequence
  Description of Artificial Sequence: Synthetic coding sequence
atggaaactagcgcttcaagctctcagccacaagataattctcaagtgcaccgcgaaacggaagacgtagattgtcctgggcacggcgagcctgatgtattgaaggacgaacttcagctatacggagacgcccccggggaagtcgtgccgagcggagagagcggcctgagacgccgtggaagcgatccagcttctggggaagtggaagcctcacagttacggaggttgaacatcaagaaagacgacgaatttttccactttgtgctgctctgcttcgccatcggggccttgctcgtgtgctaccactactacgctgattggtttatgagtctgggagtgggtctcctgacctttgcatctttagaaaccgtgggcatctactttggcctggtttaccgaatacatagcgtcctccagggctttatccccctcttccagaaatttagattaacagggtttcggaaaacggactag

SEQ ID NO: 31497 - DNA, 795 bp, Artificial Sequence
  Description of Artificial Sequence: Synthetic coding sequence
atgcgacctctgctcggcttattgctggtttttgcaggttgtacttttgccctatacctcctgtcgactcgcctgcccagggggagacgcctggggagcaccgaggaggccggcggcagatcactgtggtttccaagcgacttggccgagcttagggagctgtcagaggtgcttagggaataccgtaaggagcaccaggcctatgtgttcctgttattttgcggagcctatctgtataagcagggctttgctatccccggcagctcatttctgaacgtcctggctggcgccctgttcggaccgtggttggggctactcctgtgctgcgttcttactagtgttggcgcaacctgctgttatctgctgtcctcaatcttcggcaaacagctcgtggtgtcctattttcccgacaaagtggcactcttacagcggaaggtcgaagaaaacagaaattcgttattcttttttctcctgtttctccggctgttccccatgacaccaaactggttcctaaacctgtctgcccccatcctgaacatcccaatagtgcagttttttttctccgttctcatcggactgatcccatataattttatctgcgtgcagactggttcaatcctctccactctcacatcgctggacgccttattcagttgggacaccgtgtttaagctgctagcaattgccatggtggctctcatcccgggcactctcattaaaaagttcagtcagaagcacctacaactgaatgaaacatctactgcaaatcacatccattcccgaaaagacacctag

SEQ ID NO: 31498 - DNA, 876 bp, Artificial Sequence
  Description of Artificial Sequence: Synthetic coding sequence
atggccaagggacgggtggccgagcgcagccagctgggggcgcatcataccaccccggtgggcgacggagctgccggaacaaggggtcttgctgcccccggctcacgagatcaccaaaaggagaagtcatgggtggaggctggctccgctaggatgagtttgctgatcttagtgtctatctttctctctgccgccttcgttatgttcctggtctacaagaactttccacagctgagcgaagaggagcgtgtgaatatgaaagtgccccgcgacatggacgacgctaaagccttgggcaaagtgctcagtaaatacaaggacacattctatgtccaagtgctggttgcgtatttcgcaacttacatcttcctccaaaccttcgcgatacccggctccatattcctgtcgatcctgagtgggttcttatatccttttcctttggccctgttcctagtttgtttatgtagtggattaggtgcctccttctgctatatgcttagctatttggtggggagacccgtcgtgtataagtacctcaccgagaaagctgttaagtggtcccaacaggttgagcgccatcgcgagcacctcattaattatataatattcctgaggatcacgccgttcctccctaattggttcatcaacatcacatcgcctgtaattaatgtccccctgaaggtgttttttattggcacgtttttgggggttgcgcctccctcattcgtagccattaaagccgggacaaccctgtaccagctgaccaccgctggagaggccgtgtcttggaattcaatcttcatattgatgatcctcgccgtgttgagcatcctcccagcgatcttccaaaaaaaactcaagcagaaattcgagtag

SEQ ID NO: 31499 - DNA, 876 bp, Artificial Sequence
  Description of Artificial Sequence: Synthetic coding sequence
atggcaaaaggcagggtcgctgagaggagccaacttggggcccatcataccacaccggtgggggatggcgccgcaggcactcggggcctggcggcccctgggagccgcgaccaccagaaagaaaagagctgggtggaggccggttctgccagaatgagtctgcttattctggtgtctattttccttagtgccgcttttgtcatgtttctggtgtataagaacttcccgcaactctcggaagaggaacgtgttaatatgaaggtgcctagggacatggacgatgctaaagctctcggtaaggttttgagtaagtataaagataccttttatgttcaggtcctggttgcatattttgcaacctatattttccttcagacgtttgcgattcccgggtcaatctttctttccatcctatccgggttcctctatcccttcccgcttgctctgttcctggtctgtctgtgcagcggccttggcgcctctttctgctatatgttatcctacctggtgggaagaccggttgtgtacaagtatttgacagagaaagccgtcaagtggagtcaacaggttgagcgccaccgggagcatcttatcaattatattattttcctgcggatcaccccattcctgccaaactggtttataaatatcacatctccagtgatcaacgttccactgaaggtcttcttcatcggcactttcctcggggtggcccccccgtcatttgtcgctatcaaggctgggactacactgtatcagctgacaaccgccggcgaggcagtgtcctggaacagcatctttatcctgatgattctggcagtgttgtccattctcccagccatctttcagaagaaattaaagcagaagtttgagtag

SEQ ID NO: 31500 - DNA, 384 bp, Artificial Sequence
  Description of Artificial Sequence: Synthetic coding sequence
atggccaagggaagggtggcagaacggtcacagctgggggcccatcatacaactcctgtgggcgatggagccgctggaaccaggggtctggctgcacctggatctagggaccatcagaaggagaagtcctgggttgaggccgggtccgcgaggatgtcactgctaatcctggtctctatctttctgtctgccgcctttgtgatgtttttggtttacaagaattttccacagttgtctgaggaggaaagggttaatatgaaagtccctcgcgatatggacgacgctaaagccttgggcaaggtgctttccaagtataaggacacgttttatgttcaggtcctggtagcctactttgccacttacattttgtacccatttaactag

SEQ ID NO: 31501 - DNA, 480 bp, Artificial Sequence
  Description of Artificial Sequence: Synthetic coding sequence
atggcagaacgtcccggcccccccgggggggctgtgtcagctaccgcctaccctgacaccccagctgagtttcccccccatcttcaggctggtgccatgcggcgaagattctggggagtgttcaactgcctgtgcgcgggggcctttggggctcttgccgcagcaagtgctaaactggcgtttgggtccgaggtaagcatgggactgtgtgtgttggggatcattgtgatggcctccacaaactcccttatgtggaccttctttagcaggggcctgagcttctcgatgtcctcagccatcgcatctgtgacagtcacattctcgaacatcctgtcctcagctttcctgggttacgtactgtatggcgagtgtcaggaggtgctgtggtggggcggtgtcttcttaatactgtgcggcctgacactgattcatcggaagcttccacctacatggaaacctctaccacacaaacagcaatag

SEQ ID NO: 31502 - DNA, 828 bp, Artificial Sequence
  Description of Artificial Sequence: Synthetic coding sequence
atgggaaacttcaggggccacgcactgccaggaacttttttcttcatcatcggattgtggtggtgtacgaaatccattcttaagtacatctgcaagaaacagaagagaacatgctacctgggcagcaagaccctattttatcggctcgaaattctggagggcattacaatcgttggtatggctttaactggaatggctggtgagcagtttatacccggcgggccacacctgatgctctacgattataaacaggggcactggaaccagctgcttggctggcatcattttacaatgtacttctttttcggactgcttggggtcgcagatattctctgcttcacaatatcctcgttacctgtgtctctgaccaaactgatgctgagcaatgccctctttgtcgaggcattcatattctataatcatacgcacggtcgggagatgttagatattttcgtccatcagctacttgtgttagtcgtgttcttaaccggcctagtagccttcctggagtttctagtgaggaacaacgttttattagagctgctgagatcatctctgatcctgttgcagggatcctggttttttcagatcggttttgtgctctaccctccgagcggaggacccgcctgggacctgatggaccatgaaaatatcctgttccttacgatttgcttctgttggcattatgccgtcacgatcgtgattgtgggcatgaactacgcctttattacctggttggtgaaaagccgactcaaaagactgtgttcatctgaggttgggctgctgaagaatgcggaacgtgaacaggagtccgaggaggagatgtag

SEQ ID NO: 31503 - DNA, 876 bp, Artificial Sequence
  Description of Artificial Sequence: Synthetic coding sequence
atgaccaacgacagtgagggcaagatggggtttaagcatcctaagataatgggcaattttcggggccacgctctacccgggactttcttctttattatcggtctgtggtggtgcacaaagtctatccttaaatatatatgtaagaagcagaagcggacctgttaccttggctctaagacccttttctataggctggagattctggagggcataaccattgtaggaatggccttgaccgggatggctggcgagcagttcatacctggggggcctcacctcatgctttatgattacaagcagggacattggaatcaactgctaggatggcatcatttcacaatgtacttctttttcggcctactgggcgtggcagatattctgtgtttcacaatcagctccttgcccgtttccctgaccaaacttatgttaagtaacgccttattcgtggaagctttcatcttctacaaccatacgcatggccgagagatgctggatatctttgtgcatcagcttcttgtgttggttgtgttcttgactggcctagtggctttcctggagttcctggtacgcaacaacgttttgttagagctcctgcgtagctctttaatcctgctgcagggctcttggttctttcagataggcttcgtcctgtaccctccctctggcggacctgcatgggatttgatggatcatgagaacatactatttttgaccatttgtttttgttggcattatgccgtgacgatcgtgatcgtcggcatgaattacgcgttcatcacatggcttgtcaagagcaggctgaagcggttatgttcgtccgaggtggggttactcaaaaacgccgaaagagaacaagaatccgaggaagaaatgtag

SEQ ID NO: 31504 - DNA, 828 bp, Artificial Sequence
  Description of Artificial Sequence: Synthetic coding sequence
atggctaactttaagggtcatgcactgcccggatcctttttcctcattatcggcttgtgttggtctgtgaaatatccactgaaatactttagccacacaaggaaaaattccccactacactactatcagcggctggaaattgtcgaggcagccattcggactctgttctcagtgacaggcatcctcgccgagcagttcgttcctgatggcccccaccttcatctatatcatgaaaaccattggattaaactcatgaattggcagcatagcactatgtacctctttttcgccgtatccggcatcgtcgacatgctgacctatctcgtgagtcatgtccctttgggggttgaccgactggtgatggcagtggctgtgtttatggaaggatttttgttctattaccacgtgcacaaccgccctccactcgaccaacatatccattcactactgctgtacgccctcttcgggggatgcgtctctatttccctagaggtgattttccgggaccatatcgtcctggagctctttcgcacatccctgatcatactccagggtacttggttttggcagatcgggtttgtgctatttcccccctttggaacacctgaatgggaccagaaagacgacgcgaatcttatgtttatcactatgtgcttctgctggcactatttggccgccctgagcatagtagctgtcaactactctttagtatactgcctgttaacaaggatgaagcggcacggaagaggggaaatcattggcattcagaagctgaatagtgacgatacctatcagactgccttgctgtccgggtccgacgaagaatag

SEQ ID NO: 31505 - DNA, 828 bp, Artificial Sequence
  Description of Artificial Sequence: Synthetic coding sequence
atggctaatttcaagggccacgctctgcctggctctttttttctgatcatcggtttatgttggtccgttaaataccctttgaaatactttagccacacacggaagaacagcccacttcactactaccagagactggagattgtcgaagccgcaatcaggaccctattcagcgtgacagggatattggcagaacagttcgttcccgacggtccccacctccacctgtatcatgaaaaccactggattaaactcatgaactggcagcattctaccatgtatctattcttcgccgtctctggaatcgtggacatgctgacgtacctagtttctcacgtgccactgggagttgatcgcctcgttatggcagtggctgtctttatggagggcttcctgttttactatcacgtgcataatcggccaccactggatcaacacattcatagccttcttctgtacgcccttttcgggggttgtgtttccattagcctggaagtgatattccgagaccatattgtactggagctgtttcggacatcccttattattctgcagggcacttggttctggcagataggcttcgtcctgttcccaccattcggcacacccgagtgggatcagaaggacgacgccaaccttatgtttatcaccatgtgtttttgttggcactacctagctgctttgtccattgtcgcagtgaattattctctagtgtattgtttgctgacgcggatgaaacgccacgggagaggcgagattatcggaattcagaagttaaacagcgacgacacgtaccagacggcactgctctctggatccgatgaggagtag

SEQ ID NO: 31506 - DNA, 474 bp, Artificial Sequence
  Description of Artificial Sequence: Synthetic coding sequence
atgagcgggttcctagaagggttaagatgttcggagtgcattgactggggtgaaaaaagaaacaccattgcctccatagcagccggggttctcttcttcactggatggtggatcattatagacgctgctgtgatttaccccacaatgaaagacttcaatcactcttaccatgcctgcggagtgattgcgactatcgcgtttttaatgataaacgccgtgagtaacggacaggtgaggggagactcttactctgagggatgtttaggtcagacgggggctaggatctggctgtttgtgggctttatgctggcctttggctcccttatcgctagtatgtggattctcttcggtggttatgtggcaaaagagaaggacattgtctacccagggatcgctgtgttctttcaaaacgcctttattttttttggcggcctagtattcaagttcgggcgtaccgaggatttgtggcagtag

SEQ ID NO: 31507 - DNA, 477 bp, Artificial Sequence
  Description of Artificial Sequence: Synthetic coding sequence
atggctggctttctcgacaattttagatggccagaatgcgagtgtatagattggtccgagaggaggaatgctgttgcttcagtcgttgccggtattttgttcttcactggatggtggattatgattgacgctgccgtggtgtaccctaagcccgaacagttgaaccacgcgttccacacttgcggagtgtttagcacgctggccttcttcatgatcaatgctgtcagcaacgctcaagtgcgcggggatagttatgagagcgggtgtttgggacgcactggggccagggtctggctgttcatcgggttcatgcttatgttcggctccttgatcgcaagcatgtggattttatttggggcatatgtcacacagaacaccgatgtttatcctggccttgcagtcttctttcaaaacgctctgatctttttttccaccttgatctacaaattcggtaggactgaggaactctggacatag

SEQ ID NO: 31508 - DNA, 246 bp, Artificial Sequence
  Description of Artificial Sequence: Synthetic coding sequence
atggccggcttcttggataactttcgctggcctgaatgcgaatgcatcgactggagtgagagaaggaacgcagtggcaagcgttgtggcaggaattctgttttttactggctggtggattatgatagacgcagcagtcgtctatcctaaacctgaacagttgaatcatgcgttccacacctgtggagtcttctccaccttggcctttttcatgataaacgccgtgtccaacgctcaggtgaggtag

SEQ ID NO: 31509 - DNA, 189 bp, Artificial Sequence
  Description of Artificial Sequence: Synthetic coding sequence
atggcagggttcctggacaattttaggtggccggagtgtgaatgcatcgattggagtgaaagaagaaatgccgtggcatccgttgtggccggcatcctctttttcacaggttggtggattatgattgacgctgcggttgtgtatcctaagcccgagcagctgaaccacgccttccacacctgtggctag

SEQ ID NO: 31510 - DNA, 381 bp, Artificial Sequence
  Description of Artificial Sequence: Synthetic coding sequence
atggctgggtttttagataattttaggtggcctgagtgtgagtgcatcgattggagcgagaggagaaacgctgtcgcttcagtagttgcaggcatccttttctttacaggatggtggataatgattgacgctgccgtagtgtatccgaagccagaacagctcaaccacgcattccacacttgtggggtgttttctacgcttgccttcttcatgatcaacgctgtaagcaacgcacaggtccggggagactcctatgagtcaggctgtctaggacggacgggcgccagagtgtggctctttataggcttcatgctcatgtttgggtccctaattgccagcatgtggatcctttttggtgcatacgtaacccagaacttgtag

SEQ ID NO: 31511 - DNA, 477 bp, Artificial Sequence
  Description of Artificial Sequence: Synthetic coding sequence
atggcagggttcttggataattttagatggcctgaatgcgaatgcattgactggtctgaacgccgcaacgctgtggcctccgtggttgccggaatcctgttcttcaccggatggtggattatgatcgacgcggctgtggtttatcctaaacccgagcagctcaatcatgcttttcacacatgcggggtgtttagtaccctggcattttttatgatcaatgcagtctccaatgcacaggtccgaggagatagttatgagtcggggtgcctcggtcgaaccggggctagagtctggctctttatcggtttcatgctgatgttcggtagtctcatagcaagcatgtggatcttgtttggcgcttacgtgacacaaaatactgacgtctaccctgggctggccgttttttttcaaaatgcattgattttcttttctacactcatttacaagtttggccggactgaggaactttggacctag

SEQ ID NO: 31512 - DNA, 762 bp, Artificial Sequence
  Description of Artificial Sequence: Synthetic coding sequence
atgatggctcagagtaaagctaatggcagccattatgccctgaccgctatcggcctgggcatgctcgttctgggtgtaattatggctatgtggaatctggtcccgggcttcagcgccgctgagaaacctactgcacaggggtcaaataagacagaggtgggaggcggtatactcaaatcgaaaactttctcagtggcttacgtgcttgttggcgccggagtcatgcttcttctgttatcaatttgcctcagcatccgcgacaaacggaagcagaggcagggtgaagatctggcccatgttcagcaccccacaggtgcaggacctcatgcccaagaggaggactcccaggaggaagaagaggaggacgaggaggctgcgtctagatactatgtcccttcatacgaagaggtaatgaataccaactactctgaggcacgaggggaggaacagaatcctcgccttagtatcagccttccttcatatgaaagcctgaccggtcttgacgagacaacccccaccagcactcgtgctgacgtggaggcttctcctggaaatcccccagaccgccagaactccaaattagctaagcggctgaaacccctgaaggttcgtcgcattaagtcggaaaagctacatctgaaggactttcggatcaacctccccgataagaacgtgcccccaccatctattgaaccactgactccccccccgcagtatgacgaggtgcaagaaaaggccccagacacgagaccacccgactag

SEQ ID NO: 31513 - DNA, 762 bp, Artificial Sequence
  Description of Artificial Sequence: Synthetic coding sequence
atgatggcgcagtccaaggccaatggttcccactatgcactgactgccatcgggttaggaatgttagtgctgggggtgatcatggcaatgtggaacctggtccccggcttctccgcagccgaaaaaccaaccgcccagggttccaataaaacagaagtgggcggcggaattctaaaaagtaagacctttagtgtcgcatatgtgcttgtcggagcgggggtcatgctgctgctcctgagcatctgcttgagcatcagggataagagaaagcaaagacaaggcgaggacctcgcccatgtgcagcacccgaccggagccggacctcacgcacaggaggaggattctcaggaggaggaggaggaggatgaggaagctgctagccggtattacgtgccatcctacgaggaagtgatgaataccaactacagcgaagcaagaggcgaggaacagaaccccagactgtcaataagtctgccgtcttacgagagcttgacagggcttgacgagaccacccctacttcaacccgtgccgatgtcgaggccagtcctggaaaccctcctgaccgtcaaaatagtaaactggccaagcggctaaaaccgctcaaggtgcggcgcattaagtccgagaagctacacttgaaagactttcgtatcaacctccctgataagaacgtgccccctccctccattgagccgttaactccgccgccacaatacgacgaggtgcaggagaaggcaccagatacccggccacccgattag

SEQ ID NO: 31514 - DNA, 762 bp, Artificial Sequence
  Description of Artificial Sequence: Synthetic coding sequence
atgatggcccagtctaaggcgaacggcagccattacgctcttacagctatcgggcttggtatgttagtactaggcgtgatcatggccatgtggaacctggtgcccgggtttagtgccgctgaaaaaccgactgcccagggctcgaataagaccgaagtcggtggaggaatcttgaaatctaaaaccttctctgtggcttacgtcctcgtcggcgctggcgtcatgctacttttgctatcaatttgtctgtcgattagggacaagagaaaacagaggcagggggaggacttagcccacgtgcagcatccgaccggagctgggcctcatgcacaagaggaggattcacaagaagaggaggaagaagatgaagaggcagcatccagatactacgttccaagttacgaagaggtgatgaacaccaactacagtgaggctcgcggagaggaacaaaatcctagactttctatcagcttgccctcttacgagtctttgactggacttgacgaaactacacctacatctacacgggccgacgtagaggcgagccccgggaaccccccagaccgacagaatagtaagctggccaagcggttaaaaccactgaaggtgcgacggatcaaaagcgagaaactgcacctcaaggattttaggattaatctgccagataaaaatgttcccccaccaagcatcgaaccattgaccccaccaccccagtacgatgaagtgcaggaaaaggctcccgacacccgccccccggactag

SEQ ID NO: 31515 - DNA, 762 bp, Artificial Sequence
  Description of Artificial Sequence: Synthetic coding sequence
atgatggctcagtccaaggccaatggaagccattacgcgttgaccgctatcggacttggcatgctggtgctcggagtcataatggcaatgtggaatctggttcccggtttcagcgccgcagagaagccaacagctcaggggtccaacaagacggaagtcggcggcggtatcctgaagtccaagacctttagtgtggcatacgtcctggttggggctggcgtcatgctgctgcttcttagcatctgcctttccatccgggataagcgcaagcaaagacagggagaagatctagcccacgtgcaacatcccactggggcgggtccgcacgcccaggaggaagactcacaggaagaggaggaggaggatgaggaggctgccagccgctactacgttccatcgtatgaagaggttatgaatacgaattattctgaagctcggggcgaagagcagaacccaagactttctatttcactcccatcatatgagtccctgacaggcctcgacgaaacaacaccaactagcacaagagcagacgttgaagcttctccaggaaatcccccagatcgacaaaacagtaaactggcaaaaaggctcaagcctctgaaggtacggcggattaaaagcgaaaaactgcatctgaaggatttcaggatcaacctccccgacaaaaacgtccctcccccttctatcgagcctttgacgccacctccacagtacgatgaagtgcaggagaaggcgcccgacactaggcccccagattag

SEQ ID NO: 31516 - DNA, 762 bp, Artificial Sequence
  Description of Artificial Sequence: Synthetic coding sequence
atgatggcgcagagtaaggccaatgggtctcactacgcgctgaccgcgattgggctcggaatgttggttctcggggtcataatggctatgtggaacctggttccagggttcagcgctgccgagaagccgacggcacagggctccaacaaaaccgaggttggcggaggtatcctgaagtccaaaacattctccgtcgcctatgtgcttgttggcgccggagtgatgttgctgctgctctccatctgccttagtataagagacaagcggaagcagagacagggggaagatttggcacacgtccagcaccccaccggggccggaccacatgcccaagaggaagactctcaggaggaagaagaggaggatgaggaggccgcatcgaggtactatgtgccctcctatgaggaagtgatgaacactaactacagcgaggctcgaggggaagagcagaatccaaggctctcaatttccctgccatcatatgagtcactcacaggacttgacgaaacaactcccaccagcacccgggctgatgtcgaagctagccctggcaacccccctgaccgacagaactccaagctggccaagcggcttaaaccactgaaggtgcgccgcatcaaaagtgaaaagctccaccttaaggactttcgtatcaacctccctgacaaaaatgtgccccctccctccattgaaccattgacacctccaccccaatatgatgaggttcaggagaaggcccctgacacgcgacctcccgattag

SEQ ID NO: 31517 - DNA, 762 bp, Artificial Sequence
  Description of Artificial Sequence: Synthetic coding sequence
atgatggcccagagcaaggcaaatgggagtcattacgccctgaccgcaataggactcggtatgcttgtgctaggtgtgattatggccatgtggaatttagtgcctggtttcagcgccgctgagaagcctacggcccaggggagcaataaaacggaagtgggaggcggcatcctcaagagtaagaccttcagcgtcgcatacgttctggtgggcgctggcgttatgttattattactgtccatctgcctcagtattcgcgataagaggaagcagcggcaaggcgaagacctggcccacgtccagcatcccaccggtgccgggccccatgctcaggaggaagatagtcaggaggaggaagaggaagatgaggaagcagcatctcgctactatgtgcccagctacgaagaggtgatgaacaccaactacagcgaggctcgcggtgaggagcaaaacccgcgactctccatttccctcccatcatacgaaagcctgactggactggacgagaccacacctacttctacccgggctgatgtggaggcctcacctggaaacccccctgatcggcagaattctaaacttgccaagagacttaaacctctgaaggtgaggaggataaagagcgaaaaacttcacttgaaagattttcgaatcaacctccctgacaagaacgttccgccccccagtatagagcccctgacgcccccgccacagtacgacgaagtgcaggagaaagccccagacacgaggccacctgactag

SEQ ID NO: 31518 - DNA, 528 bp, Artificial Sequence
  Description of Artificial Sequence: Synthetic coding sequence
atgatggcccaatctaaggccaatggatcccattatgcacttaccgcaatcgggcttgggatgctggtcctgggtgtgatcatggccatgtggaacctggtccctgggttttctgcggccgaaaagcccacagcccaggggtctaataagacggaggtcgggggaggaatccttaagtccaagactttttcagttgcttacgtgctggttggcgcgggtgtcatgttacttttgctgtctatatgcctgagcattcgcgataagaggaaacagaggcaaggcgaggacttagcacatgtgcagcatccaaccggcgccgggccacacgcccaggaggaagatagtcaggaggaggaagaggaggacgaggaggccgccagtcgctactatgtgccatcatatgaggaagtcatgaacaccaattacagcgaggcacggggggaagagcaaaacccccggctatccatttccctgccttcttatgaatcattgactggactagatgagacaacccccacttcaacatag

SEQ ID NO: 31519 - DNA, 630 bp, Artificial Sequence
  Description of Artificial Sequence: Synthetic coding sequence
atggccaggggcccgttagccgctagggggttgagactgctgctcccactcctcccgctgttgccgttactgccactgccccaagtcgcattggggttcgctgatggaagctgcgatcctagtgatcaatgcccacctcaggcccggtggtcctccctctggcatgtgggactgatactgctggccgtgctacttttgttactttgcggggtgaccgctggctgcgtgcgattctgctgtctgcggaagcaggcccaagcacaacctcatcttcccccagccagacagccttgtgatgtggccgttatccctatggactctgattctcccgtacacagcacggtgacatcatactcgagtgttcagtatcccttagggatgcgacttccgctgcccttcggtgagcttgatctagattccatggctccacccgcctactctctgtacaccccagagccacctccttcttatgacgaagcggttaaaatggcaaagccgagggaggagggaccagctttgagccaaaaaccatccccgctgcttggagcgtccggactcgagactacaccagtgccacaggagtccggccccaacacgcagctgccaccttgctctcctggagcaccttag

SEQ ID NO: 31520 - DNA, 375 bp, Artificial Sequence
  Description of Artificial Sequence: Synthetic coding sequence
ggcggaaggtggcctccagctgactgcgggtgctgctgtagaagctgtcgctcctgccgcagctgtcggtgtcgccgatgggttggacgccgctccttgagtgttagaccgccgcgaggtggatccctgctggggccccgaccaagtagagcccacccttgccctcacaggtggcgctgggcctcacgcactgcagccgctacgccacggacatccgcaagacctcgccccgcaggcgcggcctgtgggacttgggcctgcacaccaaggagtctgcacccgcctacaatgaagttatccaggtggccctcccccgagcgaaaagatcagcatagtccccggaatcctgccctgtctctcgggccaagagcgtag

SEQ ID NO: 31521 - DNA, 585 bp, Artificial Sequence
  Description of Artificial Sequence: Synthetic coding sequence
atggagcggcattgcttgctatttattttactcacatgtctaagatggttatgtcacgatataccacagggtgccggcgcccgctggccgagagtgtcccctgtagtggagccatgttctccccggctgattcttctggctgtgttactcctgctgctttgtggcgtcactgccggctgcgtcaggttttgttgtttgcggaaacaggctcaggcccagccacacctcccacctgcgcgccagccttgcgatgtagcagtgatacccatggattccgacagcccagtgcattccaccgtgacttcctattcatcggttcagtaccctctaggcatgcgtcttccactccctttcggcgagctggatctggactctatggccccgcctgcctactccctgtacaccccagaaccccccccgtcttacgatgaggccgtgaaaatggccaaaccaagggaagaaggcccggctctatctcagaaaccttctcctctgctgggcgcatctgggctggaaactacaccagtcccccaagaatccgggccgaacacacagttgccgccttgtagtcccggagccccatag

SEQ ID NO: 31522 - DNA, 312 bp, Artificial Sequence
  Description of Artificial Sequence: Synthetic coding sequence
atggcacgcggccctctggccgccagaggactgcggctgctgctgcctctgctgccgctgctaccgctgctgccactaccccaggtcggccgtgccgcctttagccttggtagcgccaccgccggacgcgtgccagctagaaccacacccctgccggggagccccctgtcccctcaggtcgcactcggcttcgccgacggatcctgtgacccgtcagatcaatgtcctccacaggcgagatggtcctcactttggcatgtgggcctgatcttgttggccgtgcttttgctgctgttatgtggagtgacatag

SEQ ID NO: 31523 - DNA, 744 bp, Artificial Sequence
  Description of Artificial Sequence: Synthetic coding sequence
atggctagtgccgaactggattacacgatcgaaatcccggatcagccctgttggtcccagaagaactctccttccccgggcggtaaggaggccgaaaccaggcagcccgtcgttattctgctcggatggggcgggtgcaaagataagaatttagccaagtacagcgccatatatcacaagcgaaagctactggaactcctgtttgactacgagattgaaaaggagcccctgctcttccacgtgttctccaatggcggcgtcatgctctacagatacgtgctggaactgctgcagaccaggaggttttgtcggcttcgggtagtgggcacgatattcgattccgcacccggcgactctaatttggttggcgctctccgggcgctcgccgcaatcctggaaaggagggctgccatgctgagactcctcctcttggtcgcgttcgctttagtggtagtgctctttcacgtgcttcttgcgccgatcaccgcgttattccacacccatttctacgaccgcctgcaggatgcaggatcccggtggcctgagctctatctgtacagcagagctgacgaggtggtgctggctagagatatcgagaggatggtcgaggccaggctcgccaggcgggtgctggcccggtcagtcgattttgtgtcaagcgctcacgtgtcccacctacgagactaccccacctattacacaagcttatgcgtcgattttatgagaaattgcgtgaggtgttag

SEQ ID NO: 31524 - DNA, 834 bp, Artificial Sequence
  Description of Artificial Sequence: Synthetic coding sequence
atggctagcgctgagctggattatacaattgaaattcccgaccagccgtgctggagtcagaagaattctccatcgcccggcgggaaggaagctgagactcgtcagcctgttgtgatactgctgggctggggaggctgtaaagacaaaaatctagccaagtactctgccatttatcacaagcgcgggtgtattgtcattaggtacacggccccctggcatatggttttttttagcgagagcctgggtatacctagcctgagagtgctggctcagaaactgcttgagctcctctttgactatgagattgagaaagagccactgctctttcatgtcttctctaacgggggcgtcatgctatatcggtacgtgctcgagcttctgcagacaagacgcttctgcagactgcgtgttgtaggaacaatcttcgatagcgcccccggagactctaatcttgtaggtgcgctgagggctttggccgctattttagagcgaagagcagcaatgcttaggctgcttttactcgtggccttcgcgttggtcgtggtgctttttcacgtcctgcttgcacccattacggccctttttcatacgcatttttacgacaggctgcaggacgcggggtccagatggcccgagttgtacttgtattctagggctgacgaagtagttcttgctcgggatattgagagaatggtcgaagcacgcctggcacgccgcgtgctcgcaagatccgtagattttgtctccagcgctcacgtctctcacttacgcgactaccctacctattatacttccttgtgtgttgacttcatgcggaattgcgtgagatgctag

SEQ ID NO: 31525 - DNA, 606 bp, Artificial Sequence
  Description of Artificial Sequence: Synthetic coding sequence
atggcaagcgccgagttagactacaccatcgagatacctgaccagccctgctggagccagaaaaacagcccctcccccggaggcaaagaggccgagactcgtcaacccgttgtgattctcttgggctggggaggctgcaaagacaagaatctggccaaatattcagcgatatatcacaagcgaggctgcattgtcatccggtacaccgccccttggcatatggttttttttagtgagtctctgggcataccgagcctcagggtcctagcgcagaaactgctggagctgctttttgactacgagattgaaaaggaacctttgctttttcacgtgttcagcaacggtggggtcatgctgtatcgctatgtgctggagttgcttcagactcgacggttctgtcggctcagagtagtcgggacaatctttgactccgctcccggcgacagcaatctggtgttctgtatggcgtcgtgtctgctgctgagtccactcctggtcgacggcatatccgccgggactgaagggcaactgacacttcgcccagattgggctgcccaggtcctaacgagacttggctgccatcttcagtgcatcacacggagttag

SEQ ID NO: 31526 - DNA, 336 bp, Artificial Sequence
  Description of Artificial Sequence: Synthetic coding sequence
atggcatcagccgagctagactatacaattgagatccctgaccaaccgtgctggagccagaagaatagtccatcccccggggggaaggaggcagaaacacgtcaaccggtggtcattctgctgggctggggcggatgcaaagataagaacttggcaaaatatagcgcaatttatcataaaagagtgttctgtatggcttcttgcctgctcctctccccactgcttgttgacggcattagcgccggtacggaaggtcaacttacactccggcctgactgggctgctcaggtgctgacacgtcttgggtgtcacttgcagtgcatcaccagatcttag

SEQ ID NO: 31527 - DNA, 237 bp, Artificial Sequence
  Description of Artificial Sequence: Synthetic coding sequence
atggcttccgcagagttagattacacaatcgaaatacctgaccagccatgctggagccagtcactgctgcatggcctcctgctggcagcctttacaatcgccggtggctggcatctgtgttgggaccggggcgctactcatacaccagcgcgattgggctccactggagcaaacgctgcttggttgtccccgagcatgcaccacccgaaactgcgtgcacctctcaggcacagctag

SEQ ID NO: 31528 - DNA, 408 bp, Artificial Sequence
  Description of Artificial Sequence: Synthetic coding sequence
atggccagtgctgagttggattacactatcgagatcccagaccagccatgctggtcccaaaaaaattctccctctccgggcggtaaggaggcagaaactcgccagcctgtggtgatcctcttagggtggggcggatgtaaggataaaaatctagctaaatattccgcaatctatcacaaacggttgcttgaactactcttcgactatgagatcgagaaagagcctctgctctttcacgtgttttccaacggcggagtcatgttatacagatacgtcctggaactgttgcaaacccgccggttctgtaggttacgagtagtagggacgatttttgactcagcccctggggatagtaacctggtcggagcccttagggcactggctgcaatcctcgaacgacgagcatag

SEQ ID NO: 31529 - DNA, 510 bp, Artificial Sequence
  Description of Artificial Sequence: Synthetic coding sequence
atgtgcttacgccttgggggactgagcgtgggagactttaggaaggtgcttatgaagaccgggctggtcctggtggtgttaggacatgttagtttcatcactgctgcactctttcatggtacggtcttgaggtatgtgggtactccgcaggatgccgtggctttgcagtactgcgtggtcaatatcttgagcgtgaccagcgcgattgtgggcaaagctctgttagccgcctgtaccttcggcagtagtgagctgcttgcactggcaccagactgccctttcgatccaactcggatctacagttcatctctgtgtctatggggcatagctctggtgctctgcgtcgctgaaaatgtcttcgccgttcgatgtgctcagttaacccaccaattgttagagctccgcccatggtggggtaaaagcagccatcacatgatgagagaaaaccccgagctggttgaagggagggatctgctctcttgtacttcaagcgagcccctcaccctgtag

SEQ ID NO: 31530 - DNA, 669 bp, Artificial Sequence
  Description of Artificial Sequence: Synthetic coding sequence
atgtgcctcagattgggaggcctcagtgtgggagattttcgcaaagtactgatgaagacaggacttgtgctcgttgtgctcgggcacgtcagctttatcaccgctgcgctgttccacggaaccgttctgagatatgtcggcaccccccaggacgccgtggcactccaatattgcgtcgtgaatatactctccgtgacctctgctattgtggtgatcaccagcggaatagccgcaattgtactcagcagatacttgccttctactccactgcgatggacagtcttctccagcagtgtcgcttgcgccctactatccctaacctgtgcgctgggccttctggctagcattgccatgaccttcgcaacccagggcaaggccttgcttgcagcatgtaccttcggctcctctgagttactggctctagctccagactgcccattcgatcccacccgcatctattcgagcagcctctgcctgtggggaatcgcccttgtcttgtgcgtcgcagaaaacgtttttgcagtaaggtgtgcccaactaacccaccagctgttggagctgcgcccctggtgggggaagtcttctcaccacatgatgcgcgagaacccagaattagtagaaggtcgcgatctcctctcatgtacttcttccgaaccattgacactgtag

SEQ ID NO: 31531 - DNA, 834 bp, Artificial Sequence
  Description of Artificial Sequence: Synthetic coding sequence
atggcagcagatggagagcgctctccactgctgtccgaaccgatagatggcggtgctggcgggaacggactagtgggcccaggtgggtcgggcgctggacccggcggcgggctcacccctagcgcacccccatacggcgccgctttcccacctttccctgaaggtcatccggcagtccttcccggcgaggatccaccgccttattcccctttgactagccctgacagtggttcggcacctatgatcacttgtcgcgtatgtcagtcattaatcaatgtagaagggaagatgcaccagcatgttgtgaagtgtggcgtctgcaatgaggcaactcctatcaagaatgctccacccggcaagaaatacgtcaggtgcccctgcaactgtctgctgatttgcaaggttacatcccagaggatagcttgcccaagaccatattgcaagagaattattaatctcggaccagtgcacccaggacccctaagcccggagccccaacctatgggggtgcgcgtaatctgtggccattgcaaaaacacctttctctggacggaattcaccgaccgaaccctagccaggtgtcctcattgccgaaaggtgtctagcattggccgtagataccccagaaaacggtgtatctgctgcttcctgctggggcttttactcgccgtgactgccacaggcctggccttcggcacatggaagcacgccagaagatacggaggcatctatgctgcatgggccttcgtgatcctgcttgcagtgttgtgtctcggtagggccctgtactgggcctgcatgaaagtttcccatcccgttcagaacttcagctag

SEQ ID NO: 31532 - DNA, 855 bp, Artificial Sequence
  Description of Artificial Sequence: Synthetic coding sequence
atggccgccgatggcgagcgatcgcccttgttgtcagaacccatcgatggaggggcaggcggaaatgggcttgtcggcccaggcggtagcggtgcgggccctggcggagggctgaccccctcagcccccccttacggagcaggaaagcatgccccccctcaggccttcccaccttttccggagggccacccagccgtgctcccaggggaagaccctcctccgtactcccccttgaccagcccggacagcgggtctgcccctatgattacctgccgtgtgtgtcagagcttgatcaacgtggaaggaaaaatgcaccaacacgtggtcaagtgtggggtctgcaacgaggctacacccataaagaatgcccctcccggtaaaaagtatgtacgctgcccctgtaactgtctcttgatctgcaaagtgacgtcacaaagaattgcatgtccacgcccctattgtaagcgcattattaatttaggacccgtgcaccccggcccgttgagcccagaaccacagcctatgggcgttcgggtaatatgcggacactgtaaaaacacctttctatggactgagtttaccgatcgcacactggctcgatgcccccattgtagaaaagtcagttcgattggcaggcgatatcctcggaaaagatgtatctgttgctttctcctgggcctgcttctggctgtcacagccactggacttgcattcgggacgtggaagcacgcccggagatatggcggaatttatgcagcttgggcctttgtgattttgctcgccgtgttatgcttaggtcgggcactctactgggcttgcatgaaagtctcccatcccgtgcaaaacttttcttag

SEQ ID NO: 31533 - DNA, 792 bp, Artificial Sequence
  Description of Artificial Sequence: Synthetic coding sequence
atggagatcaatactaagttgttgatctccgtgacttgtatttccttctttacgtttcagcttttattctatttcgtgagctattggttcagtgcaaaagtctcccctggattcaactcgttgtctttcaagaagaaaattgaatggaatagcagagtcgtctccacctgccactcacttgttgtaggcatattcggactctacatcttcctttttgatgaagcaacaaaggctgatccgctctggggcggtccctcactcgccaacgtgaatatagctatcgcatccggttaccttatcagtgacttgtcaattataattctctactggaaggtcatcggagacaaattctttattatgcaccattgtgcatcgctgtatgcttattacctggtgctgaaaaacggcgtgttggcttacattggcaatttccggttactcgccgaactctcttcccccttcgtgaaccagcgctggttcttcgaagcattaaagtatcctaagtttagcaaggcgattgtgataaatgggattcttatgactgtcgtcttcttcatcgtcagaatcgcgtctatgctgccccattatggttttatgtacagtgtgtacgggaccgagccttatatccgccttggagttcttattcagcttagttgggtgataagctgtgtggttctcgatgtgatgaacgtgatgtggatgatcaaaatttcaaaaggctgtattaaggtgattagccatattcgccaggaaaaggccaagaattctttgcaaaatggcaaactggattag

SEQ ID NO: 31534 - DNA, 432 bp, Artificial Sequence
  Description of Artificial Sequence: Synthetic coding sequence
atggagataaataccaagcttttgataagcgtgacatgcattagtttttttaccttccagctgttattttattttgtcagttactggttttctgccaaagtcagcccaggattcaactcgttgagttttaaaaagaagattgagtggaactctcgtgtcgttagcacatgccattccctggtagtgggcatcttcggtctgtatatttttctgtttgacgaggctaccaaagccgatcccctgtggggtgggccctctttggccaacgttaacatcgcgatcgctagtggctatctgatttctgatctctctatcattattttgtattggaaggtgatcggtgacaagttcttcattatgcatcattgtgcttctctttatgcctactacctggtgctgaagaacggcgtcttggcctatatcggaaactag

SEQ ID NO: 31535 - DNA, 465 bp, Artificial Sequence
  Description of Artificial Sequence: Synthetic coding sequence
atggaaataaatacaaagctgctgatctcagttacatgcatctcatttttcaccttccagctgcttttctatttcgtgtcctattggttctctgcgaaagtgtcccccggctttaactctttatcttttaaaaagaagatcgagtggaactcccgagtcgtcagcacgtgtcattcactggtggtcggtatctttgggctgtacatttttctatttgacgaggctacaaaggccgaccctctgtggggaggtcccagtctggcgaatgtgaacatcgcgatcgccagcggctacctgataagcgacctcagtatcatcatcctctactggaaggttatcggagataagtttttcataatgcaccactgcgctagtctgtacgcatactaccttgtgcttaagaacggtgtactagcttatattggtaacttccgactgctggctgaattgagcagccctttctag

SEQ ID NO: 31536 - DNA, 1995 bp, Artificial Sequence
  Description of Artificial Sequence: Synthetic coding sequence
atgaaacggaggaatgctgactgctccaagctcaggcggcccttgaagagaaatcgcattaccgagggtatctacggctcgacttttctttaccttaagttcctggtggtttgggcactcgtgttgttagctgatttcgtgctcgaattccgattcgagtacctctggcctttctggctgttcatccgatctgtttacgacagctttcgctatcagggcttagcgttctcagttttctttgtgtgtgtcgcttttacctccaacatcatctgtctcttgttcatcccaattcagtggctgttcttcgctgcatccacttacgtgtgggtgcagtacgtgtggcatacagaacggggcgtgtgcctaccaaccgtatccctctggatcttgttcgtgtatatcgaagccgctatccgatttaaggatttaaagaacttccatgttgacctgtgtagacctttcgccgctcattgcattggctatcctgtggtaacccttggttttggttttaaaagctatgtgtcttacaagatgcgactgcgaaagcaaaaggaggtgcaaaaggaaaacgaattttatatgcagctgctccaacaagccttgccacctgagcaacagatgctgcagaaacaggagaaggaggccgaagaggccgcgaagggactgcctgatatggatagctcaatactgatccaccataatggagggattccagccaataagaagctgtccacaaccctgccagagatcgagtatagagagaaagggaaggaaaaagataaagatgcaaaaaagcataatttaggaatcaataataataacatcctgcaaccagttgactctaagatacaagaaatcgagtacatggagaaccatatcaatagtaagcggttaaataatgaccttgtcggctccacagagaacctgctcaaggaggatagctgtaccgcctctagcaagaattacaagaacgcctccggtgtggtgaattccagcccaagaagccattcggctaccaacggcagcattccttccagctctagcaaaaatgaaaaaaaacaaaaatgtacctctaagtcccctagcacacataaggatcttatggagaattgtatcccaaacaaccagctgagtaaacctgacgcactcgttagactcgaacaggatattaagaagctgaaagccgatctccaggctagccgccaggtagaacaggaacttcgatcacagatctctagcctgtcatctactgaaagaggtatcagaagcgagatgggtcagcttcgtcaggagaacgagcttttacagaacaagttgcataacgccgtgcagatgaaacagaaggacaagcaaaacatatcccagctagagaagaagctaaaggccgagcaggaggcaagaagttttgttgaaaagcagctgatggaggaaaagaagcgtaagaaactcgaggaggccaccgccgccagagccgtggcgtttgcggccgccagtagaggggagtgtaccgagacactccgcaaccggataagagagctggaggcggaaggcaagaagctaaccatggatatgaaagtgaaagaggaccagatcagggagctggagcttaaagttcaagagctacgtaagtataaagagaatgagaaggatactgaagtactgatgtccgctttatcagcgatgcaggacaaaacacagcatcttgagaactccttaagtgctgaaacaagaatcaaactggatttgttttctgcccttggggacgcaaaacgccagctggaaattgcacagggccaaatactgcagaaagaccaggaaattaaagatttgaagcagaagatcgccgaagttatggccgtgatgccgagtatcacatatagtgccgctacctcccccctgtcgcccgtgtccccccactacagcagcaagttcgtagagacgagtccgagcgggctggatcctaatgcctctgtgtaccaacccctgaagaaatag

SEQ ID NO: 31537 - DNA, 921 bp, Artificial Sequence
  Description of Artificial Sequence: Synthetic coding sequence
atgaaacggagaaatgctgactgcagtaagttgcgtagacccctcaagaggaatcgcatcacagaaggcatctacggcagattggagcaggacatcaaaaagctcaaagcggacttgcaggcttctagacaggtcgaacaagagctgcgtagccaaatctcttccttatcctctactgagcgcggaattaggtctgaaatgggtcaattgcggcaggagaacgagcttctgcagaacaagcttcacaacgcagtgcagatgaagcaaaaggataaacagaatatcagccaactagagaagaaacttaaggccgaacaagaggctcgttcttttgtagagaaacagcttatggaggaaaaaaagcgcaagaagctagaagaggccactgctgcccgcgcggtggctttcgctgctgcttcaaggggagagtgtacagagacattacggaataggattagagaactggaggccgagggcaaaaagctgaccatggacatgaaagtgaaggaagatcagattcgtgagctggaacttaaagtacaggagttgagaaagtataaagaaaacgaaaaggataccgaggtattgatgtccgcgctaagcgccatgcaggataaaacccaacacctggagaattctttgtcagccgagacccgcattaaactcgatctcttctcagccttgggcgatgccaaaaggcagctcgaaatagcacaaggtcagattctgcagaaggatcaagagatcaaggaccttaagcaaaagatcgcagaagtgatggctgtgatgccttccatcacctactccgctgccacatcacctctctcacctgtttccccacattattctagcaaatttgtggagacgtccccgagcgggcttgacccaaatgcctctgtataccagcccctgaaaaagtag

SEQ ID NO: 31538 - DNA, 1314 bp, Artificial Sequence
  Description of Artificial Sequence: Synthetic coding sequence
atgaagcgccgaaacgccgattgttcgaagcttcggcgccctctcaaacggaaccgtatcactgaaggaatctatggatcaacatttctgtatctcaagtttctcgtcgtctgggctctggtgctactggcggattttgtgctggagttccgcttcgagtacttgtggccgttctggttgttcatcagatctgtttacgatagttttaggtaccaggggttggctttttccgttttcttcgtctgtgtggcttttacgtctaatatcatatgcctgttgtttatccctatccagtggctgtttttcgctgcgtccacttacgtctgggttcagtacgtatggcataccgaacgtggcgtgtgccttcctacagtgagtttgtggattttattcgtctatatcgaagccgccattaggtttaaagacctcaaaaattttcacgtggatctttgtcgacctttcgcagcccactggttggaacaggacatcaagaagctgaaagcagatttgcaggcctctcgccaggtggagcaggaactgcgaagccagatcagttctttgagcagtaccgagcgcggcattaggagcgagatgggacagttgcggcaggaaaacgagctccttcagaataagctgcacaacgccgtgcagatgaagcaaaaagataaacagaacatcagccagctggagaagaaactgaaagccgagcaggaggcaagatcttttgtcgaaaagcaactcatggaggagaagaagcgtaaaaagctggaagaagccacagccgcccgcgccgttgcttttgccgctgcaagtcgaggcgaatgtacagagaccctgcgcaaccgtatcagggaattagaagctgaaggcaagaaactcacaatggatatgaaggtgaaagaggaccagattcgtgagctggaactgaaggtgcaggagcttcgcaaatataaggagaacgagaaagataccgaagtgttgatgtctgcgctgagtgccatgcaggataaaacccagcatctggagaattctttgagcgcagagacccgcatcaaattggacctcttcagcgccctgggtgacgccaagcggcagctggagattgctcaggggcagatacttcagaaggaccaggagataaaggatttaaagcagaagattgccgaggtgatggcagtgatgccgtcgatcacctactccgccgctacgtctcctctctcccctgtgtcaccgcattactcaagcaagttcgtagaaacttcacctagtggcctcgatccaaatgcttccgtgtatcaaccattaaagaaatag

SEQ ID NO: 31539 - DNA, 627 bp, Artificial Sequence
  Description of Artificial Sequence: Synthetic coding sequence
atggacaagttcgtaatccgtactccccggatccagaacagtccgcaaaagaaggacagcggaggcaaagtttataagcaggccaccatagaaagcttaaaaagagtcgtggtagttgaggatatcaaaaggtggaagacaatgctagagttacctgaccagacaaaggagaaccttgtcgaagctctgcaggagctcaagaagaaaattccctctcgagaggtattaaagagcacccgcatcggccacactgtcaacaaaatgaggaagcacagtgactcggaagtggcctcattagctagagaagtatatacagagtggaagacatttacggaaaagcacagtaaccgaccatctatcgaagtgcgctctgaccccaagacagaatccctgcggaaaaacgctcaaaaactgctgtccgaagcactggagcttaagatggaccatctgcttgtggagaatatcgaacgcgagacctttcatctctgctcccggctgataaacgggccttacagaaggacagtgcgcgccttggtttttaccctcaagcatagggctgagattcgcgctcaagtgaagtcaggctctttacccgtgggaacttttgttcaaacccacaagaagtag

SEQ ID NO: 31540 - DNA, 438 bp, Artificial Sequence
  Description of Artificial Sequence: Synthetic coding sequence
atggcggcaccaaaagggagcctgtgggttcgcactcagttaggcttaccccctctgctcttattaactatggcgcttgctggaggcagtgggaccgcctccgccgaggccttcgactcagtgctcggggacacggcatcttgtcatcgagcctgccagcttacctatcccctgcacacatatccgaaggaggaagagctgtacgcttgtcaacgcggctgccggctcttttcaatttgccagttcgtcgatgacggcatagacctcaaccggactaaactcgagtgtgagtctgcttgcacagaggcctattcccaatctgacgagcagtacgcatgtcaccttggctgtcaaaatcaactccccttcgccgaactgagacaagaacaggtgaggaataacactgcgttccagacttctttgttgcggtggcactag

SEQ ID NO: 31541 - DNA, 852 bp, Artificial Sequence
  Description of Artificial Sequence: Synthetic coding sequence
atggctgccccaaagggtagcctgtgggtgaggactcagttgggcctccctccactgttgcttttgacgatggccctggctggaggaagcgggaccgccagcgcagaagcttttgactccgtcttgggtgacaccgccagttgccatagggcctgccaactcacctacccattacacacttatcccaaggtttccgccagcctgtacaccgttgatcacatagaggaagagctctatgcgtgccaaagagggtgccgacttttctccatctgccaatttgtcgacgacggaatcgacttgaaccgcactaagctcgagtgcgagagcgcctgtactgaggcctactctcaaagcgatgaacagtacgcttgccaccttggatgccagaatcagctcccatttgccgaactcaggcaggagcagctgatgagcctgatgcctaagatgcaccttctattcccattgacactcgtcaggtccttttggagcgacatgatggactccgcccagtcctttatcaccagctcttggacattttatctgcaggccgacgacggtaagatagtgatttttcagtcaaagcctgaaattcagtatgccccacatctggaacaggaacctacgaacctcagagagtccagtctatccaaaatgtcatacctacagatgcggaactcccaggcccacagaaacttcctggaagacggcgaatccgacgggttcctgcgatgcctgtcactaaattcaggctggatcttgaccaccacgcttgtgctctcagtgatggtgctgctttggatatgctgcgccactgtggccacagctgtggagcaatacgtcccatccgagtag

SEQ ID NO: 31542 - DNA, 579 bp, Artificial Sequence
  Description of Artificial Sequence: Synthetic coding sequence
atgtcactcatgcccaagatgcacctcctcttcccgttgacgttagttcggtcattttggagcgatatgatggattctgcgcagagcttcatcacctccagttggaccttctatctgcaagccgatgacggcaagatagttatattccaaagcaagcccgaaatacagtacgccccgcacttagagcaggagccaacgaacctgcgagaaagttccctctccaagatgtcttacctgcagatgcgaaattcacaggcacataggaactttctggaagacggagagagcgacggatttctgagatgcttgtccctgaactccggatggatcctcacgactaccctggtgctatctgtgatggttcttctgtggatctgctgcgccactgtcgctacggccgtagaacagtacgtaccgtccgagaaactgagcatctacggtgacctcgagtttatgaatgaacagaaattgaatcgctaccctgctagcagtctggtagtggtccgctccaaaacagaggaccatgaggaggcagggcctctaccgacaaaagttaatttagctcacagtgagatatag

SEQ ID NO: 31543 - DNA, 579 bp, Artificial Sequence
  Description of Artificial Sequence: Synthetic coding sequence
atgtctttaatgcccaagatgcatctgctttttccgctgacgctggttcgcagcttttggtccgatatgatggactcagcacagagcttcataacatcctcttggaccttctatctccaggccgacgatggaaagattgtcatctttcaatccaagccagagatccagtacgctccacacttagaacaggagcccacgaacctgagagaaagctccttgtccaagatgtcgtacctgcaaatgagaaattcacaagctcatcgcaatttcctggaagacggggaaagtgatggttttctcagatgcttatccttgaattccggatggatactgactacaaccctcgtgctaagtgtgatggtgctcctgtggatttgttgtgccaccgttgcgaccgcggtggagcagtatgtgccatcagagaagctgagtatctacggggacctcgaatttatgaatgaacagaagctgaatagatatcccgcctcctctctcgtggtggtcaggtctaaaacagaagaccacgaggaggcaggccccctaccaacgaaggtgaatttggcgcattcagagatctag

SEQ ID NO: 31544 - DNA, 579 bp, Artificial Sequence
  Description of Artificial Sequence: Synthetic coding sequence
atgtccctgatgccaaaaatgcacctgctgttcccactgaccttggtccgcagtttttggagcgacatgatggacagcgcccagtcatttataactagcagctggactttctaccttcaggctgacgatgggaagatcgtaatatttcagtccaagccagaaatccagtatgcccctcacctggaacaagaacccaccaacctgagagagagctcattgagtaagatgtcatatcttcaaatgcgtaattcacaggcccacaggaattttttagaagacggtgaaagcgacggctttctgcgatgcctgagtcttaatagtggctggatcctgactacgacactagtcctcagcgtcatggtcctgctatggatatgttgcgcgaccgtggcaactgccgtcgaacagtacgtgccttccgagaagctgagtatttacggtgatctggagttcatgaatgagcagaaattaaatcgctacccggcctcatctctcgttgtggtgagaagcaagactgaggaccatgaagaggctgggccgctgccaaccaaagtgaacctcgcccactctgagatctag

SEQ ID NO: 31545 - DNA, 435 bp, Artificial Sequence
  Description of Artificial Sequence: Synthetic coding sequence
atgagcctgatgcctaagatgcacctgttattcccactgactctagtccgaagcttctggtccgatatgatggattccgcacaatcgttcataactagctcctggacattttatcttcaggctgatgacggcaagatcgtgattttccagtcaaagccggagatccagtacgccccgcacttggagcaagagcccaccaacctgcgggaatcaagtctttctaagatgtcttacctccagatgcgcaacagccaggcccatcgcaacttccttgaggacggcgaaagtgatggttttctcagatgcctcagcctcaacagcggctggatcttaacaaccacactggtcctgagtgtcatggtgctgctctggatatgctgtgccacagttgcaacagccgttgagcagtatgtccctagcgaagttaatttatag

SEQ ID NO: 31546 - DNA, 435 bp, Artificial Sequence
  Description of Artificial Sequence: Synthetic coding sequence
atgtccctgatgcccaagatgcatcttctgtttcccctgacactggtcaggtccttttggtccgacatgatggatagtgcgcagtctttcattacgagttcttggaccttctacttgcaggctgatgacggcaagatcgtcatttttcaatccaaaccagagattcagtatgcgccccatttagagcaggaacctaccaatctcagggagagcagcctatccaaaatgagctatctgcaaatgcggaacagccaggcacatagaaacttcctagaggacggcgaatccgacggattcttacggtgtttatcgctcaacagcggttggatactgactactaccttggtactgagcgtaatggtactcttatggatctgttgtgcaacggtggcaacagcggtggaacagtacgtgcccagcgaggtgaacctgtag

SEQ ID NO: 31547 - DNA, 858 bp, Artificial Sequence
  Description of Artificial Sequence: Synthetic coding sequence
atggcagccccgaaaggctcattgtgggtgagaacccagctggggcttccgcccctgctactccttacaatggctctcgctggggggtccggcacagccagcgctgaggccttcgactcagtcttgggcgacacagcaagttgtcatcgagcctgccagctaacttacccactgcacacctaccccaaggtgtcggcgtcactttatactgtggatcacattgaggaagaattgtacgcttgccagaggggatgcaggcttttttctatttgtcagttcgtagatgacggcatcgacctgaaccggactaaactcgagtgcgagagtgcctgtaccgaggcatacagtcagtccgacgagcagtacgcctgccatctgggttgccaaaaccagctgccgtttgctgagctgcgtcaggagcagttgatgtcactgatgcctaagatgcacttgctcttccccctgacactggtcagaagtttttggtcagatatgatggatagcgcacagtctttcattacaagctcctggactttttatctgcaggccgatgacggaaaaattgttattttccagagcaaacccgaaatccaatacgccccacacctggagcaggagcccactaacctgcgggaaagttcattatctaagatgtcctatctccaaatgcgaaacagtcaggcccataggaattttctcgaggacggagagagcgatggattcctccgctgtttgagcctgaatagcgggtggattctaacaaccaccctggtgttgtccgtcatggtgctgctctggatctgctgcgctaccgttgccaccgccgtggaacagtatgtgccctccgaggttaattag

SEQ ID NO: 31548 - DNA, 1029 bp, Artificial Sequence
  Description of Artificial Sequence: Synthetic coding sequence
atggccgccgtggcgcttatgccacctcctctgctgctgctactcctgctggcctctccacctgcagcaagcgccccgtccgctcgggatccctttgcgcctcagctgggcgacactcagaactgtcagctgagatgtcgcgatagagacctcggaccgcagccctctcaagcgggcctggaaggcgcctctgagagcccttacgaccgggctgtgctcataagcgcatgtgaacgagggtgccgactctttagtatatgcagattcgtggcacgatcttctaaacccaatgccacacagaccgaatgtgaggctgcttgcgttgaggcctacgttaaagaagccgagcagcaagcttgttcacacggatgctggagccagcccgccgaacccgaacccgagcaaaaaaggaaagtccttgaggctcctagcggcgccctgtcactactggatctgttttcaactctgtgtaacgatctggtgaattcagcacaggggttcgtgagttccacatggacttactacttgcaaactgacaacggtaaggtcgtcgtgtttcaaactcaaccgatcgtggagtccttgggtttccagggtggacggttgcagcgcgttgaagttacatggcgcggatcacaccccgaagccctggaggtgcacgtggaccctgtcggaccacttgacaaagtgaggaaggctaagatacgggtgaaaaccagttccaaggccaaggttgagtccgaggaaccacaggataatgattttctcagctgcatgagcagacgtagcggccttccccgctggattttggcctgttgtttgttcctatccgtgctggtgatgctgtggctctcttgctcaactctcgtaactgcccccggccagcacttgaaatttcagcccctcaccctcgagcagcacaaaggcttcatgatggagcccgattggccactgtatccacccccgtcacatgcttgcgaggactcgctgccaccttacaaattaaagctggatctgaccaaattatag

SEQ ID NO: 31549 - DNA, 1029 bp, Artificial Sequence
  Description of Artificial Sequence: Synthetic coding sequence
atggccgcggtggcattgatgccccctcccttgctgctgcttctgttgctggcctcccctccagcagcctcagcgccatctgcccgggacccattcgctccccagttaggagacacgcagaactgccaactgagatgcagagaccgcgatctcggtccacaaccgagccaggctgggctcgaaggagcctccgaaagtccgtacgatcgagcagtgctgatcagcgcctgcgagagaggctgtcggctgttcagcatctgtcgctttgtggcaagatccagcaagcccaacgcaacccagaccgaatgcgaggctgcctgtgtggaagcatacgttaaagaggcagagcaacaggcttgttctcatggctgctggtctcaaccggcagagccagagcccgagcagaagcggaaagttttagaggctccatctggtgccttgtcactgctggacctcttctcgaccctctgtaacgacttggtcaacagcgcacagggtttcgtcagcagcacctggacatattacttgcagaccgacaacggtaaggtcgtcgttttccaaacccagccaattgtggagtctctcggatttcagggcgggcgcctccagagggtggaagtcacttggagggggtctcaccccgaggctctcgaagttcacgtcgatcctgtgggccccctggacaaggtgcggaaagccaaaattcgggtcaaaacctcctccaaggcaaaagtggagtcggaggaacctcaagataacgatttcttatcttgcatgagccgacgaagcggtttaccacgctggatccttgcgtgctgtcttttcctgtctgtgctcgtgatgctgtggctgagttgtagcaccctggttaccgctccaggccagcacttgaagtttcagcctctcacgttagaacagcataaaggatttatgatggaaccagattggcccctgtaccctcccccttcacatgcctgtgaagacagcttgcccccttacaagctgaaactggatctgacaaaactttag

SEQ ID NO: 31550 - DNA, 402 bp, Artificial Sequence
  Description of Artificial Sequence: Synthetic coding sequence
atgagaatgtccctcgctcagagagttttactgacatggctgttcacactgttattcttgattatgctggtgctgaaactggacgagaaggcaccctggaactggtttctcattttcatacccgtatggatctttgacactatcctgctggtgctcctcatcgtgaagatggcgggacgatgtaagagtgggtttgaccccagacatggctcccataatatcaagaagaaagcatggtatctaattgctatgctgctgaaattggctttctgtcttgctctgtgcgccaagctcgaacaattcaccacgatgaatctgtcatatgtgtttattccgctttgggctctcctggccggggcgctcacggagctgggttacaatgtcttctttgtccgggattag

SEQ ID NO: 31551 - DNA, 633 bp, Artificial Sequence
  Description of Artificial Sequence: Synthetic coding sequence
atggccctaccacaaatgtgtgatggatcacacctggccagcacactcaggtactgcatgacggtgtctggcacagtagtcttggttgccggcaccttgtgctttgcttggtggagtgagggagatgcaaccgcacagcctggccagttggctccacccaccgagtacccggtccctgaaggaccttccccactgctacgtagtgtgtctttcgtatgttgtggtgcaggtggcttacttttactcatcggattactctggagcgtaaaggcatccattcctggaccaccccgatgggacccctatcacctgtctagagatctttactaccttaccgtggagtctagcgagaaggagtcgtgcagaacccccaaggttgtagacattccaacttacgaggaagcggtttctttcccggttgcagaggggccacccaccccaccggcataccctaccgaggaagctctcgagccatctggttcacgcgatgcccttctttctacccaacccgcctggcctccaccatcatacgaatccattagtttggccctggacgccgtgtcggccgagactaccccctctgccacccgttcctgttccggtctggtccaaaccgccaggggggggtcgtag

SEQ ID NO: 31552 - DNA, 1932 bp, Artificial Sequence
  Description of Artificial Sequence: Synthetic coding sequence
atggcagcagtcctggcgctcagagtggtggcagggctggccgctgcagcgttagtagctatgctgctagagcattacgggctggcgggccaaccctcccccctcccgcggccagccccaccacgtcgacctcaccccgctcccgggccaggcgacagtaacattttctggggactccagatttccgacattcacctttcgaggttccgggacccgggacgtgccgtcgatctggagaaattctgtagtgagaccatcgatatcatccagcccgctttagttttggccacgggcgatttaacagacgccaaaaccaaagaacagctaggaagtcgacaacatgaagttgagtggcagacttatcagggtatcctgaagaagaccagggtgatggagaaaacgaagtggctggatataaaggggaatcacgatgcattcaacatccccagtctggactctattaaaaattactatagaaaatacagcgcggttcgtcgcgatggctctttccactacgtgcatagcacacccttcggtaattactccttcatttgtgttgatgcgacagttaaccctggtcctaagcgcccttataatttctttggtatcctggataagaagaaaatggaggagctcctcttacttgccaaagaaagctctaggtcaaaccacaccatatggttcggtcactttactaccagcaccatacttagcccctctcctggtatcaggagcattatgtcctcggctatcgcatatttgtgcggtcacttacacactctgggggggctaatgcctgttctgcataccaggcacttccagggtactctggaattggaagtcggcgattggaaggacaaccggcggtatagaatctttgcctttgaccacgatctgttctcattcgccgatctgatcttcggcaaatggcccgtggtcttaatcactaatcccaaatccctgctgtactcatgcggcgagcacgagcctctggaacgcctcctgcatagcacacacataagggttctggctttcagtctgtcctcaattacttctgtcacggtgaaaatcgatggtgtccacctggggcaggctgtccacgttagtgggccaatctttgttctcaagtggaacccccggaattactcgtcaggcacccacaatatagaagttattgtccaggacagtgcaggccgaagtaagagtgtacaccatatcttctccgttcaggagaataatcatctaagctttgatcccctcgcctccttcatcctcagaaccgatcattacattatggccagggtgctgtttgtactgattgtcctttcccagttgacaatcctgatcattttccgctaccgggggtatccggagctgaaggaaccaagtggcttcatcaatctcacatccttctcgctgcacgtactgtctaaaattaacatattctactactccgttctccttctgacactgtacacagttttaggaccgtggttcttcggagaaattatcgatgggaagttcggatgttgtttcagtttcggcatttttgtgaatggtcattttctgcagggatccatcacttttattattgggatcctacagctcgccttctttaatattcccctcatggcatatatgtgttggagccttctgcagagatgcttcggccataactttcggagtcacttacaccagaggaaatacttgaagattatgcctgtccacttgctgatgttgctgttgtatatttggcaagtgtactcatgttactttctctacgccacttatggaaccctcgcatttcttttctcaccattaaggacatggctgactttactgacccccgttctgatcagatacgtctggacccttaatagcactaagttcggaatctttatggtacagttaaaatctcatttatcttcgtag

SEQ ID NO: 31553 - DNA, 2424 bp, Artificial Sequence
  Description of Artificial Sequence: Synthetic coding sequence
atgatggacagccccttcttggaactttggcagagtaaggccgtcagcataagggagcagttgggcctcggcgaccgccctaatgattcctattgttacaacagcgctaaaaactcaaccgtgctgcagggcgtgacatttggcggcattcccacagtcctgctcatcgacgtctcatgtttcctgtttctcattcttgttttcagcataatcaggaggcgtttctgggactacggacgcattgcgcttgtgtcggaagctgattccgagagcagattccagcgcttgtccagtacatccagctcagggcagcaggactttgaaaacgagttgggttgttgtccctggttgacggctattttccgcctacatgacgaccaaattctagaatggtgcggagaagatgccattcactatctttcgttccagaggcacatcattttcctattggttgttgtgtccttcctgtccttatgcgtcatcttgcctgtgaacctcagcggggacttactcgataaggacccgtacagttttgggcgcactaccatcgctaacctgcaaactgataacgatctgctttggttgcatacgatatttgctgtaatataccttttcctcacagtcggcttcatgcgccaccacacgcagagtatcaaatacaaagaggaaaacctcgtgcgacgtaccctgttcatcacagggctgccacgcgacgcaaggaaagagacagtggagtcccactttagagacgcctatccaacctgcgaagttgtggacgtccagctttgctataatgtggcgaagttaatttacctgtgtaaagagaagaagaagacggaaaagagcttgacttactacactaatctgcaggttaagacaggtcaacggactttaatcaaccccaaaccctgcggccagttttgctgctgtgaggtattgggctgtgagtgggaggacgcgatctcatattatactaggatgaaagatcgcctgcttgagagaatcacagaggaagagagacacgtccaggaccagcctctcgggatggctttcgtgaccttccaggagaaatctatggcaacatacattctcaaggatttcaacgcatgcaagtgtcaaagtctccaatgcaagggggagccacagcccagcagccattccagggaactatacactagcaagtggacagtgacctttgcagctgatccagaagacatctgctggaagaatctgtccatccaggggctgcgctggtggcttcagtggcttggcatcaattttacactcttcctcggcctgttctttctcaccacccctagcataattctctctacaatggacaaatttaatgtgacaaaaccaattcatgcgcttaacaaccccattatttctcagttctttccaactcttctactctggagcttttccgccttgttgcccagcatcgtttactatagcacactgctggagagtcactggacgaagtccggggagaatcagatcatgatgacgaaagtttacattttcctgattttcatggtgctgatcttgcccagtctgggcctgacgagtttggatttcttttttcgatggctgtttgataaaacaagtagcgaagcttccatccgcctggagtgcgtgttcctcccggatcagggcgccttcttcgtcaattatgtcatcgcaagtgctttcattggaaacggtatggaactgctcaggctgcccggtctgatactgtacacctttagaatgatcatggccaaaactgccgcggaccggcgcaacgtgaaacagaatcaggccttccagtatgagttcggcgcaatgtacgcatggatgctctgcgtctttaccgttatcgtggcctacagtattacatgcccaatcatagctccatttggactcatttacatcctactgaaacacatggtagaccggcacaatctatattttgtgtacctgcccgcgaagctcgagaaggggatccacttcgccgctgtcaatcaggctctagctgcgcctatcctctgtctcttttggttatactttttttcttttctgcggctgggcatgaaggcaccagcaaccctcttcacattcctcgtgctgctgctgactatccttgtctgccttgcccacacgtgcttcggatgttttaaacatctgtcgcctcttaattataagacagaagagcctgcgtctgacaaaggttccgaagctgaggcacacatgcccccaccctttactccgtacgttcctcggatcctcaacggcctggcaagtgagaggactgctttgagcccacaacaacagcagcaacagacctacggcgccatccataacatcagcggcaccatccctggccaatgcttggcccagtctgctaccggatctgttgctgccgcccctcaggaagcgtag

SEQ ID NO: 31554 - DNA, 357 bp, Artificial Sequence
  Description of Artificial Sequence: Synthetic coding sequence
atgatggactctccttttctggagttgtggcagagtaaagccgtctcaatccgcgagcagctgggtttgggcgataggcctaacgacagctattgctacaattcggcaaaaaacagcacggttctccaaggagtgacatttggtgggatcccgaccgtcctgttgattgatgttagctgttttctgttcctcatcttggtattctcaattatcaggcgccgcttctgggattatgggcggattgcactcgtcagtgaagcagacagcgagtctcgcttccagcggctgtcatctaccagctcttcagggcaacaggacttcgagaacgagctgggctgctgcccctggctgacgtag

SEQ ID NO: 31555 - DNA, 249 bp, Artificial Sequence
  Description of Artificial Sequence: Synthetic coding sequence
atgaaagacaggcttctcgaacggatcacagaggaggaacgccatgtgcaagatcagccccttggcatggcatttgttactttccaggaaaagtctatggctacctatattctgaaggacttcaatgcatgcaaatgtcagtccctgcaatgcaaaggcgaaccccagcccagcagccattcccgggagctgtacacgagcaaatggacagtgaccttcgccgccgatcccgaggatatctgttggtag

SEQ ID NO: 31556 - DNA, 2499 bp, Artificial Sequence
  Description of Artificial Sequence: Synthetic coding sequence
atgctgcccttcctcctggccacccttggaaccactgccctgaataatagcaatccgaaggactattgctatagtgctcggatccggtctacagtgctgcaggggctcccctttgggggagtgcccactgttctggccctggattttatgtgttttctggccctcctcttcctgttcagcattcttcgtaaggtcgcctgggattacggtagactggcgcttgtaacagatgccgataggcttagacgccaggagagagatcgggttgagcaggagtacgtcgcatctgccatgcatggagattcccacgaccggtatgagcgccttacaagtgttagttcctccgttgatttcgatcagcgcgataacggattttgtagctggctgaccgcaatctttcggataaaagacgatgagattagggacaagtgcggcggcgacgccgtacattatctgtcttttcagaggcatatcatcggcttgctggtcgtggtgggggtgctatctgtgggtatcgtgttgccagtaaatttcagtggggacctgctcgagaataatgcctacagttttgggagaaccactatcgctaacctgaagtccggcaataacctactctggctgcacacttcattcgcatttctgtatttgctgctcactgtttacagcatgcgcagacacaccagcaaaatgcgttacaaggaggacgacctcgtcaagcggactcttttcattaacggtattagtaagtatgcagagtcagaaaagattaaaaagcacttcgaggaagcttacccaaattgcaccgtgcttgaggccagaccttgttacaacgtagctcggctgatgtttctcgacgcggaaagaaaaaaagctgagcggggaaagctgtacttcacgaatttgcagtctaaggagaacgtgccaactatgatcaatccgaaaccctgcggacacctctgttgttgcgtcgttagaggctgcgaacaggtagaagctattgaatattacaccaagctggagcagaagttgaaggaggactataagcgcgaaaaagaaaaagttaatgagaaacccctgggtatggcttttgtgacattccataacgaaacaatcacagctattatcttaaaagacttcaacgtgtgcaaatgtcaaggatgcacatgtaggggtgagcctagaccctcatcatgttctgaaagcctacacatcagtaattggacggtgtcctatgcccctgacccgcagaacatttactgggaacatttatccatccggggcttcatctggtggttgcgctgtctcgtcattaacgtggttctttttattttgctgttttttctgaccacacctgcaataattatcaccacgatggataaattcaatgtgaccaagcctgtggagtatctgaataatcccatcatcacccagtttttccctaccttgctgctctggtgcttttcagccctcctccccacgatagtgtactattcagcctttttcgaggcgcattggacccggtccggggaaaatcgtaccaccatgcacaaatgttatactttccttatttttatggttttactgctgcccagtttgggactgtccagtctcgacctttttttcaggtggctgttcgataaaaaattcttggctgaggctgctatcagatttgaatgtgtgtttcttcctgacaacggtgcattcttcgttaactatgtgatcgccagcgcttttattggcaacgccatggacctgcttcgaatacccggactactgatgtatatgatccgtctctgtctggcaaggagcgcagccgagagaaggaacgtgaagagacaccaagcttatgagtttcaatttggtgccgcttacgcctggatgatgtgcgtgtttacagtcgtgatgacatatagtatcacgtgccctataattgtgccctttgggctgatgtacatgctgttgaagcacctggtggaccgctataatctgtactacgcatacctccccgcaaagctcgacaagaagatccactctggggcagtgaaccaagtcgtagctgcccctatactgtgtctcttttggctgttatttttctccactatgagaaccgggtttcttgccccgacctctatgttcacttttgtggtgctggtcatcacaatcgtaatctgtctttgccacgtctgctttggccatttcaaatatttgtccgcacacaactataagatcgagcacacagaaactgacacagtcgaccctcggagtaatggccgcccccccacagcagctgcagtgccaaagagcgccaaatatattgcacaggtcctgcaggatagcgaggtcgatggggatggcgacggcgcacctggatcttctggggatgagcctccctcatcatcttcccaggacgaagagctccttatgccgccagatgcccttactgacacggatttccagtcctgcgaagattccctcatcgagaacgaaatccaccagtag

SEQ ID NO: 31557 - DNA, 2499 bp, Artificial Sequence
  Description of Artificial Sequence: Synthetic coding sequence
atgctcccattcctactagcaacgttggggactacagcccttaacaacagcaacccaaaggattactgctattcagcccgaattcgctcaactgtgcttcaaggcctgcccttcggtggggttccgaccgtgctggccctagattttatgtgcttcttggcgttgctgtttctgttttccatcctgcgaaaagttgcttgggactacggccggctcgcgcttgtcacagatgccgaccggctcaggcgacaggagagagaccgggtggaacaggagtacgttgctagcgctatgcatggagattcccatgaccgatatgaaaggctaacctcggttagtagctcggtggacttcgaccaaagagacaatggcttttgctcctggctcactgctatttttaggatcaaagatgatgagatcagagacaagtgtggaggcgacgctgtgcactacctttccttccagcgacacatcattggtcttttagtcgtcgttggtgtcctgagtgttggaattgttctgccggtgaacttcagtggcgacttactagagaataacgcttattcattcggacgcacgaccatcgcaaatctcaaaagtggcaacaatctactctggctgcataccagctttgcctttctatatctgctcttgacagtctatagcatgaggcgacacaccagcaagatgcggtataaggaagatgatctggtcaaacggactttgtttattaacggaatctccaaatacgccgagtccgagaaaatcaagaagcatttcgaagaggcctaccccaattgcaccgtgctggaagctaggccctgttacaatgtcgctcgtttgatgtttcttgacgccgaacggaagaaagcggagcgcggaaagctatacttcacaaaccttcagtccaaagagaacgtgcctactatgattaaccccaagccctgcggccatttgtgctgctgtgtagtgcgaggttgtgagcaggtagaggcaatcgaatactatactaaactggagcagaagttgaaagaagattacaaacgagaaaaggaaaaggtgaacgagaaacccctgggtatggccttcgtgacttttcataatgagactatcacagctattatcctgaaagactttaatgtgtgcaaatgccagggctgtacatgccgcggagagccccgcccttcatcctgttccgaatcccttcacatctccaattggacagttagctatgcccctgacccccagaacatttattgggagcatctgagtattcgcggcttcatttggtggctcagatgtcttgtgattaatgtggtgctgtttattttgctgttctttcttacaacccccgccattattataacaacgatggataaattcaatgtcactaaaccagttgagtatctgaataaccccatcatcacccagttctttccgacattgctgctgtggtgctttagcgccctcctacccacaatcgtctattatagtgctttttttgaagcacactggaccaggagcggcgagaaccgtacaacgatgcataaatgttatacttttctgattttcatggtgctgttattgccttccctgggtctttcaagcctggacttattctttcgctggctcttcgacaagaagttcttggccgaggctgccatccggttcgaatgcgtgttccttcccgacaatggcgccttcttcgtcaactatgtgattgcctctgctttcattggcaatgccatggatttactgaggatccctgggctgctaatgtatatgattagactgtgtctggctaggtcagccgcagaacgtcgcaacgtaaagaggcaccaggcttatgaattccagttcggcgcagcttacgcctggatgatgtgtgtctttacagtcgtcatgacgtacagcattacttgtccgattattgtgcctttcggactaatgtacatgttattgaagcaccttgtggacagatacaacttgtactatgcatacttaccagcaaagctggacaagaaaatccattcaggcgctgtaaaccaagtggtcgccgcccccatcctgtgccttttttggctgctgttcttttcaaccatgagaactggattcttggcacctaccagcatgtttaccttcgtcgtactggtcatcactatcgtcatatgcctatgtcacgtttgctttggccacttcaaatacctgagcgcccacaactacaaaatagagcacaccgaaacagacactgtagacccaagatctaacggtcggcctcctaccgccgcagccgtgcccaaatctgctaagtacatcgctcaggtgctgcaggacagcgaagtggatggtgacggggacggcgcaccagggagctcaggggatgaacctccttccagctcctcccaggatgaagaactactgatgccccccgatgcccttactgataccgattttcagtcttgtgaagacagtctgattgagaacgagatccatcagtag

SEQ ID NO: 31558 - DNA, 681 bp, Artificial Sequence
  Description of Artificial Sequence: Synthetic coding sequence
atgctcccttttctgcttgccaccctggggaccacagcattaaacaattccaatcccaaggattattgctattcggcaagaattcgatctacagtccttcagggacttcctttcggaggggtccccacagtgttggcgctcgacttcatgtgtttcctggctctgctctttctcttcagtatcctgagaaaggtcgcctgggattacggtcgtctcgccctggtcacggacgctgacaggctgcggcgccaagagcgtgatcgcgtggagcaggagtatgtggctagcgctatgcacggcgactcacatgataggtacgaaagactcacgagtgtatcctcttctgtcgatttcgatcagcgggacaatggattttgcagttggctcaccgcaatctttaggatcaaggacgatgagatccgggataagtgcggcggcgatgctgtccactatttaagcttccagcggcacattattgggctactggtcgtggtcggcgttctgagcgttggcatcgtgctccctgtgaacttcagcggggacctcctggaaaataatgcctattcgtttggcagaaccaccatcgccaacctgaaatctggaaataatctactgtggttgcacacgagcttcgcgttcttgtacctcctcttaaccgtttattccatgcggcgtcattag

SEQ ID NO: 31559 - DNA, 2421 bp, Artificial Sequence
  Description of Artificial Sequence: Synthetic coding sequence
atgagcgcttctccagacgacctgagcaccggtgggcgcttacagaatatgactgtggatgaatgctttcagagtcgcaatactgtcctgcagggtcagccctttggaggcgtcccaactgtcctgtgcctcaatattgctctgtgggtcctggttttagtggtgtactcattcctgcgaaaggcagcctgggactatggacggttagctctgttaatccataacgattctttaacctctctgatctacggggagcagagcgagaaaaccagccctagcgagacatcactagaaatggagaggcgcgataagggattttgcagctggtttttcaatagcataaccatgaaggacgaggatctcatcaacaaatgtggagacgacgcccggatctacatcgtgtttcagtaccacctcattatttttgtcctgattatatgcatcccaagtttaggcattatcctgcccattaactacaccggttccgtactcgactggagtagccacttcgcgcgcactacaatcgttaatgtgagtaccgaaagtaagttgctttggctccacagcctgctgagctttttctactttatcacaaatttcatgttcatggcgcatcactgcctgggattcgcacctagaaatagccagaaggtgacacgcaccctgatgatcacttatgtccctaaggatatcgaagatcccgagttgatcatcaagcatttccacgaagcctacccgggtagcgtggtcaccagggtgcacttttgctacgatgtgaggaacttgattgaccttgacgaccagcgccggcatgccatgcgaggccgactgttttacaccgcaaaggcaaagaaaaccggcaaggtcatgattcgcattcacccttgcgcaagactatgtttctgtaaatgttggacctgcttcaaagaagtcgatgcagagcagtactattccgaattggaggagcagttgaccgatgagtttaacgccgagctgaaccgtgttccgctgaaaagacttgatttgatatttgtgacttttcaggactctcgaatggctaagagagtaagaaaggactacaagtacgttcagtgtggcgtgcagccacagcagtcctccgtcacaacaattgtcaaaagttattactggcgcgtgacaatggcaccacatccgaaggacatcatctggaaacacttatccgtacggcgattcttctggtgggctcgctttattgccattaataccttcctgttcttcctcttttttttcctcactactccagctatcatcatgaatacaattgatatgtacaacgttacaaggcccatcgaaaaactgcagaatccaattgttactcagttcttcccgtccgtaatgctgtggggttttacggttatccttcctttaatagtctacttctctgcattcctggaagcacactggacccgctcatcacaaaacctggtgatggttcacaaatgttacatctttctagtgttcatggtcgtgattctgccatccatgggattaactagcctagacgtgtttctgcggtggctcttcgacatttactatctggagcaggctagcattcggttccaatgcgtttttcttccagacaacggggccttcttcgtgaattatgtgattaccgccgccctcctcgggacagggatggaactactgcgattaggttccctattctgttatagcacccgactgtttttttctcgatctgaaccagagcgtgtcaatatccgcaagaatcaagcaattgatttccaattcggcagagaatacgcatggatgatgaacgtttttagcgttgtcatggcctactcaataacctgtcccatcattgtacctttcggtttgctgtacctgtgcatgaagcacttgacagatagatacaacatgtactacagcttcgctcccactaaactgaatgaacaaatccacatggccgccgtgtctcaggctatatttgcacctctcctgggtcttttctggatgctctttttctctatcttacgcttggggtccttgcatgctatcactatattttctctctccacactgctgattgcgatggtcatcgcgtttgtcggaatattcctcggcaagctgagaatggtggccgattacgaacccgaagaagaagaaattcagacagtgttcgatatggaaccctcctccacttcatcaacgcccacgagcctcctttacgtggccacagtactgcaggaacccgagctcaacctgactcctgcatctagcccagccagacatacgtacggcactatgaacaatcaaccagaagagggagaggaagagtcaggcctaagagggtttgcccgggagctggattccgctcagtttcaggaaggactggaactggaggggcagaatcagtaccattag

SEQ ID NO: 31560 - DNA, 1131 bp, Artificial Sequence
  Description of Artificial Sequence: Synthetic coding sequence
atgaacactatcgacatgtataacgtgactaggcccattgagaaacttcagaatcccattgtgacgcaattctttccatccgtgatgctgtggggcttcacagtcattcttcctttgattgtgtatttctcggccttcctcgaggcccactggacccgtagtagccaaaaccttgtgatggtgcataagtgttacatattcctggtgtttatggtagtgatcctgcccagcatggggcttacatcattggacgtttttcttagatggctgtttgacatatattacctggagcaggcctctatcagattccagtgtgtctttttgccagacaatggggcctttttcgttaattacgtcattacagcagcactccttgggacaggaatggagcttctgcgcctgggcagtctgttctgttattcaacaaggcttttttttagtcggtctgaacccgaaagagtgaacatcagaaaaaatcaggcaattgacttccagtttggtagggaatacgcctggatgatgaacgtcttcagcgtggttatggcttactctatcacatgccccattatagtgcccttcggactcctctacctttgtatgaagcaccttactgatcggtataatatgtactactcattcgccccgaccaagctgaacgagcagatccacatggccgctgtcagtcaagctatcttcgctccgctgctggggctcttttggatgctgttcttcagcatattgcggttgggatctttacacgccattacaatctttagtctgagcaccctcctcatagccatggttattgcctttgtggggatttttcttggaaagttacgcatggtcgcagactacgaaccagaagaggaggaaattcagactgtgtttgacatggaacctagttcgacaagcagcactcctactagccttctttatgtggccacggtacttcaagaacccgagttaaatttaactcccgcaagctccccagcacgccatacttatggcaccatgaacaaccaacctgaggagggcgaggaagaatcaggtctccgaggattcgctcgagaactggacagtgcacaatttcaggaaggcctggaactggagggacagaaccagtaccattag

SEQ ID NO: 31561 - DNA, 153 bp, Artificial Sequence
  Description of Artificial Sequence: Synthetic coding sequence
atgtcagcgagcccagatgatctcagcacaggcggccgattacagaacatgaccgtagatgagtgttttcagagccgcaacacagtgctccagggacagccctttggcggggtgcccacggttctttgcttaaacatcgcactgtgggtatag

SEQ ID NO: 31562 - DNA, 495 bp, Artificial Sequence
  Description of Artificial Sequence: Synthetic coding sequence
atgagcgcaagtcccgacgacctctccaccggaggtagattacagaatatgacagtggacgaatgcttccagtcccgaaacaccgtgctgcaggggcagccgttcggcggggtgcccaccgtactatgtttaaatatcgccttgtgggtacttgtgctcgtagtttattcatttctgcgtaaagctgcctgggactatggaaggcttgcactcctgattcataatgactctctaacttccttgatctatggcgaacagtcagagaagacatcaccctccgaaacctctcttgaaatggaaaggcgagataaggggttctgctcctggttttttaactctatcacaatgaaagacgaggacttgatcaataagtgtggagacgatgccaggatatatattgtgttccagtaccacctgattatctttgttcttatcatctgtatcccttccctgggcattattctccccatcaattacactggctctgtcctgtag

SEQ ID NO: 31563 - DNA, 156 bp, Artificial Sequence
  Description of Artificial Sequence: Synthetic coding sequence
atgtcagcttcgcccgacgacctctctacaggaggaaggttgcagaacatgacagtggatgagtgttttcaaagcagaaataccgtacttcaggggcagccattcgggggagtgccaaccgtgctgtgtctcaacatagctttgtgggttctgtag

SEQ ID NO: 31564 - DNA, 111 bp, Artificial Sequence
  Description of Artificial Sequence: Synthetic coding sequence
atgtcagcgtcccccgacgatctctctactggcggtcgcttgcaaaacatgacagtggatgaatgcttccaaagccgtaacactgttctccaggggcagccctttgggtag

SEQ ID NO: 31565 - DNA, 72 bp, Artificial Sequence
  Description of Artificial Sequence: Synthetic coding sequence
atgagtgccagtcccgatgacctcagtaccgggggcaggctgcagaacatgaccgtggatgagtgcttttag

SEQ ID NO: 31566 - DNA, 987 bp, Artificial Sequence
  Description of Artificial Sequence: Synthetic coding sequence
atgcgcagccccggaggaatcctcctgcaggccttacccagactgctccagcatgcagctctccctggcctcgccgaactccctgctcgctgggcactgccacgaggagctggtggagacggacctgccgaccgcttgccccgaggcggcggtgcctcagcggccgcagctgccgcagccgcatcaggcgcattgctgggagcatacttggagcgacacggtcctcctgaagcctcagaattgcccgaaccaggtggcgcactggccggaggacccggttcagggggaggaggggtggtcgtcggcgtagccgaagttcgaaattggcgctgttgttgcctgggaagcacgtgctggtgtaggtctttggtccttgtctgtgttctggcggctctgtgcttcgcctcgctggcccttgtgaggcggtatctgcatcacctgctgctgtgggttgaaagcctcgactctctgctgggggtgttgttgttcgtggtgggtttcatagtcgtgtcgttcccctgcggctggggctacatcgttttgaacgtggcagccggctatctgtatggattcgtattgggcatggggcttatgatggtcggggtcctcataggaacctttatcgcccatgtcgtatgtaagaggcttctaacggcctgggtggctgcccgcattcagtcttccgagaaactaagcgcagtgatccgtgtggtggaaggcggctccggcctgaaggtagttgccctggctcgtcttactcctattcccttcgggctgcaaaacgctgtcttttcaatcatcatctccatcggattgatgttctacgtcgttcacagagcgcaagtcgagctcaacgccgccattgtggcatgtgaaatggaattaaagagcagcttagtcaaagggaaccagccaaacacgagtggcagctctttctacaataaacggactttaaccttcagtggaggaggcattaatgttgtgtag

SEQ ID NO: 31567 - DNA, 1143 bp, Artificial Sequence
  Description of Artificial Sequence: Synthetic coding sequence
atgcggtcccctggagggattcttcttcaagcactcccaagactgttacagcatgcagcgttgcctggcctggccgaattgcctgcgaggtgggcactgccccgaggcgccggcggcgacggccctgccgatcggctcccacgggggggaggcgcatccgctgcggcagctgctgccgccgccagtggggcactcctgggcgcttatctggaacggcatggccccccggaggcatccgagctgcctgagcctgggggggccctcgccggggggcctggcagtggcggagggggagtggtggtcggcgtcgccgaagtacggaattggagatgttgctgcctagggagcacttgttggtgcaggagcttggtgcttgtatgcgtgttagccgccctgtgcttcgccagcttagctctggtgaggcgatatttacatcatcttttactctgggtggaaagcctcgacagcctcctgggcgtgctcctttttgtcgtcggctttatcgttgtgtcttttccttgtggctggggctacattgttctgaatgttgcagcagggtatctgtacggctttgttctaggcatgggcctaatgatggtgggcgtgctaatcggtacgtttattgcccatgttgtgtgcaagagactcctaaccgcctgggtcgccgcaaggattcagtcttcagagaaactgagcgccgtgatcagggtggtggaggggggtagcggcctgaaggtagtagccttggcaaggctgacccccatcccctttggactgcagaatgctgtgttctcaatcaccgacttatcactccccaattacctcatggcgagctccgtgggcctgttgccaacacagttgttgaactcatatctgggcacaacgctgagaacaatggaagatgtcatcgccgaacagagtgtcagtggatatttcgtcttctgcctgcagattattatcagcattggtctgatgttctatgtggtccacagggcgcaggtggaacttaacgccgcaatagttgcctgtgaaatggagttaaagtcatcgctggttaagggcaatcagcctaatactagcggctccagcttttacaacaagagaacccttaccttctccggaggtggaatcaatgtggtctag

SEQ ID NO: 31568 - DNA, 360 bp, Artificial Sequence
  Description of Artificial Sequence: Synthetic coding sequence
atgcctcccaggataactgatcttagtctgcccaactatcttatggctagcagtgtaggtcttttacctacccaattgctcaactcctatctgggcaccacactgaggacgatggaagacgttattgccgaacagtccgtaagtggttactttgttttctgcttgcaaatcattatctctatcggcctgatgttctatgttgttcacagggcacaggtggaactgaatgcagccattgtagcctgcgagatggagctgaaatcttcgctggtgaaaggtaaccagccaaatacatccggatcctctttctacaacaagaggacattgactttttccggaggcggcattaacgtggtctag

SEQ ID NO: 31569 - DNA, 156 bp, Artificial Sequence
  Description of Artificial Sequence: Synthetic coding sequence
atgcctccgcgtatcaccgatctgtctttgcccaactatcttatggcatcatccgtggggcttcttcccacacagcttttgaactcctacttaggaaccacactccgtactatggaggacgtgatcgcggaacagagcgtaagtggatatttttag

SEQ ID NO: 31570 - DNA, 723 bp, Artificial Sequence
  Description of Artificial Sequence: Synthetic coding sequence
atgtccaggctgctgcccctgttacggagccggacggccagaagccttagaccaggacccgcagctgcagcagctccaagacccccgtcttggtgctgttgcggccgggggcttctggccctggcccccccaggaggtctgcctggcggtccacggcggctggggactcatcccaaaaaagaaccaatggaagcactcaatacagcacagggcgctagggatttcatatactccctccacagtaccgaaaggtcatgcctcctgaaagaactgcaccggttcgagtcgattgctatcgcacaggaaaaattggaagccccgcctccaacacctggtcaactgagatacgtattcatccataatgccataccctttatcggtttcggattcctggacaatgccatcatgatcgttgctggtactcatatcgaaatgagtattggaatcatcctgggcatcagcaccatggctgccgcagcacttggcaacctcgtgagcgatctcgccggcctggggcttgcggggtacgtggaagccctcgctagtcgattagggcttagtatacctgatctgacacccaagcaggttgatatgtggcagacacgattgtccacccacctgggaaaagccgtgggggtgactattggttgcattttgggaatgttcccccttatcttcttcggtgggggtgaggaggatgagaaactggagaccaaatcctag

SEQ ID NO: 31571 - DNA, 1020 bp, Artificial Sequence
  Description of Artificial Sequence: Synthetic coding sequence
atggctgcagcttgcggacccggcgccgccggctactgcctcctattgggtctgcacctgtttctcctgactgcaggtcctgcactcggatggaacgatcctgatagaatgctgttacgagatgtgaaggcactcacgcttcactatgacaggtacaccacctcaagacgcctggaccctataccccaattgaagtgcgtgggaggcactgccggatgtgattcctacactcccaaggtcattcaatgtcagaataagggttgggatgggtacgatgtgcaatgggagtgcaagacagatctggacatcgcttataagttcggtaaaaccgttgtgagttgtgaagggtacgaatcatctgaggaccagtacgtgttacgtggatcctgtggactggagtacaatctggactacacagaactgggtctgcagaaattgaaggaatcaggaaagcagcacggatttgccagcttttctgactattactacaaatggtcttcggccgacagttgcaacatgagcgggcttatcaccatcgtagtccttctaggaatcgctttcgtagtgtacaaactctttctttcagacggacagtacagccctccaccttattcagagtacccaccgtttagccatcggtatcaacgattcaccaatagtgcggggccaccaccccccggctttaaatcagaattcaccggaccccagaataccggtcacggagccacatctggatttggtagcgcctttacaggccagcagggctacgagaactctggaccgggattttggacagggctcggaactggcggaatactgggttatttgttcgggtcgaatagagcagccactccctttagcgattcctggtattacccctcctaccccccaagttatcccggaacgtggaatcgggcctactcccctctccatggagggagcggctcctatagcgtgtgttctaattcagacaccaaaactaggacggcatccgggtacggcggaacaaggcgtcgctag

SEQ ID NO: 31572 - DNA, 504 bp, Artificial Sequence
  Description of Artificial Sequence: Synthetic coding sequence
atgtctggactgatcaccatcgtggtccttctggggattgcttttgtggtgtacaagctgtttctgtctgatggtcagtactcaccccctccatatagcgaataccccccattttcacacagatatcaacggtttactaacagcgcaggacctccgcctccaggcttcaaatccgagttcaccggacctcagaataccggccacggcgcgactagcggttttggatcagcttttacaggtcagcaaggctatgagaattcaggacccggattctggacggggctcggtacaggtggcattctgggctacctgtttggaagcaacagggcagccacgcccttttccgacagttggtattatccttcataccccccaagttatcccgggacatggaatcgcgcttacagccctttgcatggcggttctggaagctattccgtatgctcgaattccgacaccaaaactcggactgcatctggatacggcggaaccaggcggcgatag

SEQ ID NO: 31573 - DNA, 912 bp, Artificial Sequence
  Description of Artificial Sequence: Synthetic coding sequence
atgctcctgcgggacgtcaaggcattgactctccattacgatcgctacactacgtcacggagacttgatcctattccccagctgaaatgtgtgggcgggaccgccggctgcgacagctacaccccgaaggtgatccaatgccaaaacaaaggttgggacgggtacgacgttcagtgggagtgtaagacagacctcgatatcgcctataagttcggtaagaccgtggttagctgcgagggctatgaatcatccgaggaccagtacgtactgaggggcagctgcggcctggagtataacctggactatacagagctgggactgcagaaactgaaagaatctggcaaacagcacgggtttgcttctttttctgactattactataagtggtccagcgcggattcctgcaacatgtcagggctgataacgattgtggtccttctgggaatcgcatttgtcgtgtacaaactgttcctatcagatggccagtattctccacccccgtattccgagtaccctcctttcagtcaccgataccagcgattcacaaatagtgctggacccccccccccaggctttaaaagcgagttcaccggcccacagaatactggacatggggctaccagtggattcggctctgcattcacagggcagcagggctacgaaaactctggcccggggttctggacaggactagggacaggcggaatattgggttacttattcggctcaaatcgcgcagccacaccatttagtgatagctggtattacccttcataccctcctagctacccaggcacttggaaccgtgcctacagtcctctccacggggggagtggcagttatagcgtctgttcgaattccgacactaagacaaggaccgcgagcggctacggcggcactcgaagaagatag

SEQ ID NO: 31574 - DNA, 504 bp, Artificial Sequence
  Description of Artificial Sequence: Synthetic coding sequence
atgtcaggcctgatcaccatcgtcgtgcttctcggcatcgcctttgtggtttataagctgttcctgagcgatgggcagtatagcccaccgccatatagcgaataccccccgttctctcaccgttaccaacgtttcaccaattccgctgggccacctcctccaggctttaagagtgaatttactggccctcagaataccggacacggcgcaacttccggattcgggtcagcctttacgggacaacagggctacgagaattccgggcctggcttctggacagggctgggtacgggcggaatcctgggctacctgtttggctctaacagggcggccacgcctttttctgatagctggtactacccttcctaccctccctcatatccaggcacttggaaccgagcctattcccctctgcatggcggctcggggagctacagtgtctgttcaaattccgacaccaagacgaggactgcttcaggctatgggggtactagaaggagatag

SEQ ID NO: 31575 - DNA, 774 bp, Artificial Sequence
  Description of Artificial Sequence: Synthetic coding sequence
atgatcgacaaaaatcagacttgcggcgtggggcaagatagcgtgccatatatgatctgtctcattcatattttggaagaatggttcggcgtcgagcagctggaggactatctcaattttgctaattacctgctgtgggtgttcacccctctcatccttcttatcttgccctattttactatctttctcctttacctgactatcattttccttcacatttacaaacgcaagaacgtgcttaaggaggcttatagtcacaatctgtgggacggagcaaggaaaacagtggctaccctgtgggacggccacgccgccgtctggcatggttacgaggtacacggaatggagaaaatcccagaggacggtcctgcactgatcattttctaccatggcgcgatcccaattgacttttattatttcatggcaaagattttcattcataaaggcaggacatgtagagttgtcgcggatcacttcgtgtttaaaattccagggttctctctgctgctggacgtgttctgcgctctgcacggccctcgggagaagtgcgtggagatactgcgcagcggtcacttgctggcaatctctcccgggggcgtgagagaggcgctcatctccgatgaaacgtacaatattgtgtggggacaccggcgcggcttcgcacaggtggcaatcgatgccaaggtcactaaaaacgccgtgcaggcgttgattgataagcaccagcgtattcctggcaacataatgagtgccctgctagaaaggtttcattag

SEQ ID NO: 31576 - DNA, 975 bp, Artificial Sequence
  Description of Artificial Sequence: Synthetic coding sequence
atgattgataagaaccagacttgcggggtcggccaggactctgtgccttacatgatctgcctcatccacattctggaagagtggttcggcgtagagcagctcgaagattatttaaattttgccaattacctgctgtgggtgtttactcccctgatcctcttaattttgccctactttacaatctttctcttatatctaaccatcatctttctgcacatttacaaacgtaaaaatgtgcttaaggaggcctacagtcacaacctgtgggatggtgctaggaagaccgtggctaccttatgggacggacatgccgctgtgtggcacggctatgaggttcatggaatggaaaaaatcccggaagacggtcctgcattgattatattctaccacggtgccattcccatcgacttctattatttcatggccaagatctttattcataaaggacgtacgtgtcgggtggtggccgaccacttcgtgttcaagattccgggcttctccctgctcctggatgttttctgcgccttacatggcccaagagagaaatgcgttgagatattaaggtctggccatctgctggccatttcccctggcggagtgcgggaagccctgatttccgatgagacctacaatattgtgtggggccaccgaagagggttcgcccaggttgctattgacgccaaagtgcctatcattcctatgttcacacagaacatccgcgaaggattcaggtccctgggaggtactagactttttagatggctctacgaaaagttcaggtacccgtttgctccaatgtacggcgggttccccgtgaagctgaggacatatctgggcgacccaattccatatgacccccagatcaccgctgaagaactggcggagaaaacgaagaatgctgttcaagcattgattgataagcaccagaggatccccggcaatattatgagcgcccttttagagagattccattag

SEQ ID NO: 31577 - DNA, 381 bp, Artificial Sequence
  Description of Artificial Sequence: Synthetic coding sequence
atgattgacaaaaatcagacatgtggggtgggacaggacagcgtcccctatatgatttgcttaatccatattttagaggagtggtttggcgtcgagcagctggaagattacctaaattttgcaaattatctgctgtgggtgttcacgcccctgattctgttgattttaccatatttcacgatttttctgttgtatctgaccattatcttcttacacatctataaacggaagaatgtcctgaaagaagcatattcccataacctctgggacggagctagaaaaaccgttgcgacactctgggacggccatgctgccgtctggcacggttacgaagtgcatggaatggaaaaaataccagaggatggacctgcgttgatctag

SEQ ID NO: 31578 - DNA, 408 bp, Artificial Sequence
  Description of Artificial Sequence: Synthetic coding sequence
atgatcgataaaaaccaaacatgcggtgtcggccaagattctgtgccttacatgatttgtctaattcatatcctggaagaatggtttggggtggaacaactggaggactacctcaacttcgccaactacttactctgggtcttcactcctctcattttacttatccttccttacttcacaatctttctactgtaccttactatcatctttcttcacatttataaaagaaagaatgtactgaaggaggcttacagccacaacttatgggatggggccagaaagacagtggcaaccctctgggatgggcatgccgccgtctggcacggcaagcagggctacttccacctgtgtgtcgccatccatgtctgttgcatcggaactgtcctcccttttcactttatcgactag

SEQ ID NO: 31579 - DNA, 732 bp, Artificial Sequence
  Description of Artificial Sequence: Synthetic coding sequence
atgatcgacaagaatcagacatgcggcgttgggcaggacagcgtgccctacatgatttgtttgatccatatcctggaagaatggtttggcgtcgaacaattagaggattatcttaactttgccaattacctgctgtgggttttcacaccgttgattctgcttatccttccctattttacaatatttcttctgtatctgaccatcatttttttgcacatctacaagagaaagaatgtcctcaaagaagcatacagccacaatctttgggacggtgcccgaaaaaccgtggcaacgctctgggatgggcacgcagcagtttggcacggctatgaagtgcatggcatggagaaaatccccgaagatggtcctgcactcattattttctatcacggggctatccccattgacttttactacttcatggccaagatattcatccacaagggccggacctgtcgagttgtcgctgaccactttgtattcaagatccccggttttagtttgttactggacgtgttttgcgctctccacgggcctagagaaaaatgtgtcgaaatcctcagaagcggccacctcttagccatttcaccaggaggcgtcagagaggcgctaatttctgatgaaacctacaacatcgtctggggccaccgcagaggtttcgcacaggtggctattgatgccaaggttcccatcataccaatgttcactcagaacattcgcgaaggcttttag

SEQ ID NO: 31580 - DNA, 408 bp, Artificial Sequence
  Description of Artificial Sequence: Synthetic coding sequence
atgattgacaaaaaccagacctgcggggttgggcaagatagcgtcccttatatgatttgcctgattcacattctagaggagtggttcggggttgagcaactggaggactatctaaactttgcgaattatctcctgtgggtgttcacacctctgattttactgattctaccttattttacaatcttcctgctctacctgacaattatatttctgcatatctataagcggaagaacgtgctaaaggaggcctactctcataacctgtgggacggggcacggaagacagtagcgacactttgggacgggcacgccgccgtgtggcatggcaagcagggatattttcatctgtgtgtggcgatccacgtatgttgcataggcactgtgctgcccttccacttcatcgactag

SEQ ID NO: 31581 - DNA, 9 bp, Artificial Sequence
  Description of Artificial Sequence: Synthetic coding sequence
atgatctag

SEQ ID NO: 31582 - DNA, 495 bp, Artificial Sequence
  Description of Artificial Sequence: Synthetic coding sequence
atgatcgataagaatcagacatgcggcgtagggcaggactctgtgccctacatgatttgcctcatccacattcttgaagaatggttcggagtggagcagctggaggattaccttaactttgccaattaccttctttgggtgttcaccccacttatactcttaatactcccatatttcaccatctttctactctacctgaccatcattttcctgcatatttacaagagaaaaaacgtgttaaaggaggcatactcccataacctttgggacggtgctcgtaaaacggtggcaaccctgtgggacggacatgctgccgtctggcatgggtatgaggtgcacggtatggagaagattcctgaagacggaccagccctcataatattttatcacggtgcaatcccaatagacttctattattttatggctaaaatctttatacacaaagggaggacctgtcgagtggtggccgatcactttgtattcaagatcccctag

SEQ ID NO: 31583 - DNA, 276 bp, Artificial Sequence
  Description of Artificial Sequence: Synthetic coding sequence
atgttcacccagaacatcagggaaggctttagatccctgggcgggactcgcctgttcaggtggctgtatgaaaagtttcgctacccgtttgcacctatgtatggtggattccccgttaagttgagaacgtacctgggcgatcccatcccctatgatcctcagatcacggctgaggaactggccgagaaaaccaagaacgccgtgcaagctcttattgacaagcatcagagaataccaggcaacattatgagcgccttgctcgaacgatttcactag

SEQ ID NO: 31584 - DNA, 744 bp, Artificial Sequence
  Description of Artificial Sequence: Synthetic coding sequence
atgctgcggtttattcaaaagttctcgcaggcctcctctaagatcctcaagtatagttttcctgttggtttgcgcacttcacggaccgacatcctgtccctgaaaatgagtcttcagcagaatttcagcccctgccctaggccatggctatcttcttctttccccgcgtatatgtccaaaacccagtgttaccacacgagcccttgcagtttcaagaagcaacaaaaacaggcactgttggcgagaccatctagcaccattacctacctgactgatagcccgaagccagcactctgtgtcaccctggcagggctcatcccttttgtagctccccctcttgtgatgttaatgaccaaaacgtacatcccgatcctggcatttactcagatggcgtatggggcttccttcctcagctttctcggcggcataaggtggggatttgccttgcctgaagggagtccagcgaagccagattatcttaacctagcctcttccgccgcacccctttttttcagttggtttgccttcctgatcagcgaaaggctctccgaagcgatcgtgaccgtcatcatgggaatgggcgtggcctttcatctggagctgtttcttctcccccactatcctaactggtttaaggccctgcggatcgtggttactcttctggccactttttcttttatcataacgttagtagtcaagagctcttttccagagaaggggcacaagaggcccgggcaggtttag

SEQ ID NO: 31585 - DNA, 828 bp, Artificial Sequence
  Description of Artificial Sequence: Synthetic coding sequence
atgcagttgcaggtcttttggacaggactcgaatatacatgcaggcttcttgggattaccacagctgctgtgctgattggcgtgggaactgagacttttcttcaaggccagtttaaaagcttagccttttatctgctctttaccggcgctgcggtctccatctgcgaaggtgcgtactttgtggcccaactgctggctatctgttttcagtgccagcccggctcactcgcagacagagttcgagaaaaggctcactggcttggctgttttcagaagtttcttgcctatctgctcctcagcgttgcttgttttttgcatcccgtgttagtgtggcatgttacaatccccggaagtatgctgatcatcaccgggctggcctatttcctgctctctaagagaaagaagagaaaggccgcaccagaagtactggcaagcccggagcagtataccgatccatcttcatctgccgtttcaaccaccggcagcggagatacagaacagacatatacattccatggtgcgttgaaggagggtccatccagtctgttcattcatatgaaatcaattttaaaaggaaccaaaaaaccatccgccctgcaaccacccaacactttgatggagcttagcctcgaaccagccgattcattggcaaaaaagaaacaagtgcacttcgaagacaatcttgttcggattgtgccttcgcttgcggaaggcctggacgacggcgactcagaaccagaagagacaacctctgacacaaccccgattattccgccaccgcaggctcccttgttcctgtccagcctgacggctacgggactgttttag

SEQ ID NO: 31586 - DNA, 474 bp, Artificial Sequence
  Description of Artificial Sequence: Synthetic coding sequence
atgttaattattaccggtctggcgtacttcctgctcagcaaacgtaagaagcgcaaggccgctccagaggtactggcctcacctgaacagtataccgacccatcctcatccgcagtctctactacaggttctggagataccgagcagacatatacctttcatggcgctctgaaagagggtccctcttctctgtttatccacatgaaaagcattctaaagggaaccaagaagccaagcgccctgcagccgcccaacaccctcatggaactctccctggagcccgcagactcgctcgcaaagaagaaacaggtgcacttcgaggacaaccttgtgcgcatcgtgcccagtctggccgaaggcctggacgatggggattccgaaccagaggaaacaactagtgatactactcccatcatcccgcctcctcaggcccctctcttcctgtcatccctgactgcgaccggactcttctag

SEQ ID NO: 31587 - DNA, 771 bp, Artificial Sequence
  Description of Artificial Sequence: Synthetic coding sequence
atgccacccgcgcagggatatgaattcgctgccgctaaggggccccgggacgagcttggaccatctttccctatggcaagcccccccggtctcgagttgaaaactctgagtaatggacctcaggcccctcgaagaagcgcccctctgggtccagtcgccccgactagagagggggtcgaaaatgcttgttttagcagcgaagagcacgagactcacttccagaaccctgggaacactcgattggggagcagtccctcaccaccaggtggagtgtcttccttgcctcggtcccagcgcgatgacctgtcccttcactcagaggaggggcctgcactggaaccagtgtcgcggcccgtggattacggatttgtgtctgcactcgtgtttctagtctccggcatccttctggtcgtgacagcatacgccattcccagagaagctagggtgaatccagatacagtaaccgcacgggagatggaacggctagagatgtattatgccagactcggaagccatctggaccggtgtattatagctgggttggggctgttaactgtaggcggaatgttgctgagtgtgttactgatggtctcactgtgcaagggtgagctttatcggaggaggacatttgtgcctggcaagggcagcagaaagacttacggctccatcaatctgcgcatgcgacagttgaatggcgatggtggccaggcattggtcgagaacgaggttgtccaagtgagtgaaaccagtcatacgctgcagagatcttag

SEQ ID NO: 31588 - DNA, 465 bp, Artificial Sequence
  Description of Artificial Sequence: Synthetic coding sequence
atgccacccgcgcagggttacgagtttgctgcagctaagggaccgcgggatgagttaggccctagcttccccatggcttctcccccgggactcgagttgaaaacactgtctaatggaccgcaagccccccggcgctcagccccgctgggaccagtggcgccgaccagagaaggagtggaaaatgcgtgcttctcgagcgaagaacacgagacccatttccagaacccaggaaacacaaggctgggctcaagcccgtctccaccaggcggggtttcgtcattacccagaagtcagcgagacgacctcagcctccatagcgaggaaggccccgcactggagccagtgtcacggccagtggattacggatttgtgagcgcactagtcttccttgtgtccggcatcctactcgtggtgaccgcctacgcaataccacgagaggcacgcgtgaatcccgacaccgtgtag

SEQ ID NO: 31589 - DNA, 417 bp, Artificial Sequence
  Description of Artificial Sequence: Synthetic coding sequence
atgcgaccaacagccgatagctttcggctgaagaagggcaacgtctttccaaactttgatccctgcgctcaggcacttcagaagtcttgtcacttcgccctctcgttcctgatcggaaaaatggggatcatcatcctcagcgtttgcctgatttgcactaggttgcttcaggaaggtatcgcacaatccaaatgcctgataaatgtgtccttttctttatattcctgtttcatcgtctttgtgaccatcagccaggactctgaaactctgtctctagattgcgatcacagactcttcttctcattgcctttcaccgacccagctagcggaggacagtcccagcacagttggccgtgtccagaacgcagtaaaaacctcccacaggtttcaaaacagctgcgaaatcgcgccggttag

SEQ ID NO: 31590 - DNA, 411 bp, Artificial Sequence
  Description of Artificial Sequence: Synthetic coding sequence
atgtggctggacacaagaaatctgggaatcgtcattagctgttggaagggtgtctgcgtgcctcagaccaccacattggaaatgttctacaacgataatgatcgggtcgaagaatcttcaaattcttatcagattcggagggaattcctgctccccgcgtgcttgccggcattcctgtccttcagtacctccttttcgttttttctctcttttctccccctcagtctgtcgctgttcctgccctttttcccttcattcttcctttctctgtccctgagtcccagcttcctgccatccttcttgagacaagggctggctctttcaccacggctcgaatgtgacggcgctataatgattcactgttcgcttaacatcccgggtagttccgatccacctacctcggcaagttag

SEQ ID NO: 31591 - DNA, 1185 bp, Artificial Sequence
  Description of Artificial Sequence: Synthetic coding sequence
atgaccgagcaggagactctcgcgttgctggaagtgaaacggtcggattcacccgaaaagtcatcaccgcaggcccttgttcctaacggccgccagcctgaaggggaggggggggccgaaagcccaggggctgagtctcttagggttggcagcagcgctggaagtcctactgctatcgagggcgctgaggacggtcttgactccacagtgtccgaagcagcgacacttccttggggcacaggacctcagcccagcgccccgtttcctgaccctcctggatggagggatatagagcctgagccgccggaatccgaacccttaaccaaactagaggagctgcctgaggacgacgcgaacctcctccccgagaaggccgccagagcctttgtccctatcgacctccagtgtatcgagcggcagcctcaagaggatttgattgtgcgctgcgaggccggagagggcgaatgtaggacctttatgcctcctagagttacccatccggatccgaccgaaaggaaatgggccgaggcagtggtgagaccaccaggctgtagttgcggaggatgcggctcctgtggtgatcgagaatggctaagggcggtggcgagcgttggagccgcgctgattctgtttccatgtttattgtatggcgcctacgctttcctgccctttgacgttccccgactgccaacaatgtcctccagattgatctacacccttcggtgtggcgttttcgccactttcccaattgtcctggggattctggtgtacggactctcactgctctgttttagcgctctccgaccatttggtgagccgaggcgcgaggtagagattcacagaaggtacgtggcccagtcggtgcagttattcattctctactttttcaacctggccgtgttgagcacgtacctcccacaagacactctgaaacttctgcctctgctgacaggactcttcgccgtaagcagactgatttattggctgactttcgccgtggggcggtcttttcgtggattcggatacggcctgactttcctgccactgctatcgatgcttatgtggaacctatactatatgttcgtggtggagcccgagcgcatgctcaccgccaccgagagtagactggattatccagatcatgctcggagcgctagtgactaccgccccaggccatggggatag

SEQ ID NO: 31592 - DNA, 528 bp, Artificial Sequence
  Description of Artificial Sequence: Synthetic coding sequence
atgacagaacaggagaccctggccctgttagaagtgaagcgcgatccaggggtgagggccgagccagtgatgctcttttgtcctagtgcgttatggggagctaccgccggaggcggggatcccccagccatctgcgggccggtcggcccagccttatacagcttgctgctgcagccaggccgggcattccatctcccagcacccggatatccccaaaccgccccttccgctcactggtcactctgccgcttaccggctgatctattggcagacctatgcagagggcctttgctacctcgcctgcgtctcaggccggatgtgtctgctaccgctgttgatgctgacgtagagcctctgctgcatgtgcgagggggggcaggagctcacgcgcactgccaccgcgaaccacccggcctgccaggccctcggccacttggtttgcgactgcaggcccccccactcggcctgagcctttctgcactggctctgggagtcggagggtcaggcctgggtctcacgcacctgtag

SEQ ID NO: 31593 - DNA, 1185 bp, Artificial Sequence
  Description of Artificial Sequence: Synthetic coding sequence
atgacagagcaagagacattggccttactggaggtgaagagaagcgattcacctgagaagagctcccctcaggctctcgtgcctaatggccggcagccggagggcgagggtggagctgaatcgccgggcgctgaatctctgcgggtgggaagctcagcaggttcccctaccgccatcgagggggccgaagacggtctcgatagtactgtgagtgaagctgcgactctgccctggggaacaggcccccagccatccgccccgttcccagaccctccagggtggcgggacatagaacccgagcctcccgaatccgagcctctcacaaagctggaagaactgccagaagatgatgcaaatttgctaccagaaaaagccgcacgggcattcgtgcccattgatctgcagtgtatagagcggcagcctcaggaagatctgatcgttagatgtgaggccggcgaaggagaatgccgcacctttatgcccccccgtgtgactcaccccgatcctacggagcgaaagtgggcggaggccgtcgtacggcctccaggatgcagctgcggagggtgtggatcgtgtggagaccgcgaatggctgcgtgcagtggctagcgtgggcgcagcattaatcctttttccctgcttgctgtacggggcctacgcgttcttgccatttgatgtgcctcggctgccgacaatgagttccagactcatctatacactgaggtgcggagtcttcgctacattccccatcgtgctgggcatcctggtgtatggtcttagcctactgtgttttagcgccctgagacctttcggtgaacccaggagagaagttgagattcacagacgctatgttgcccagagcgtgcagcttttcatcctgtatttcttcaacctggccgtgctctccacataccttccacaggacactcttaaattactgccactgttgaccggactcttcgctgtgagccgccttatttactggcttacattcgcagtaggcaggtcgttccgcggttttggctacggcctgaccttccttcctcttcttagcatgctgatgtggaacctatattatatgtttgttgtagagcctgagcgcatgctaacagccactgagtcacgactggactatccagaccacgcccggagtgcatctgattaccgccctagaccttggggctag

SEQ ID NO: 31594 - DNA, 399 bp, Artificial Sequence
  Description of Artificial Sequence: Synthetic coding sequence
atgactgagcaggagactcttgccctcctggaagtaaaacgcgatcctggtgtccgagcggaacccgtgatgttattctgcccttccgcgctgtggggcgctaccgcagggggcggcgacccgccagccatctgcggccccgttggaccagccctgtattccttgcttttgcaacccggccgcgcatttcacctgcccgcgccaggctaccctcaaacggcgccgtcagctcattggagcctgtgtagactccctgccgatctgctggctgacctctgcaggggtcctctcttgccacgtctcagacttaggcccgacgtcagtgcgaccgcagtggatgcagacgtagagccactcctccacgtccgtggtggcgcaggtgctcacgctcattgctag

SEQ ID NO: 31595 - DNA, 507 bp, Artificial Sequence
  Description of Artificial Sequence: Synthetic coding sequence
atggcggagggcgcacgtgcccggggtccgcggggctgtcgcgatagagatggccctgccggaggcgcaggcaaaatggcggccccacggcgtgggcgcggatcaagcacagtgctcagctccgtaccactccagatgcttttttatctctccgggacatattacgctttatatttcctggccactctactgatgattacatacaagtctcaggtgttcagctacccccacaggtacctagtactggacttggcattgctgtttttaatgggaatcctggaagcagtccgcctttacctcgggactaggggcaatttaaccgaagcagaaagacctctcgccgccagtctggcattaacagcaggcacagcactgttgtcagcacatttcctgctgtggcaagccttggtcctgtgggctgattgggccctctctgccacgctgcttgctctccacggcctggaggccgtgttgcaagtcgtcgcaatcgctgccttcacacgttag

SEQ ID NO: 31596 - DNA, 483 bp, Artificial Sequence
  Description of Artificial Sequence: Synthetic coding sequence
atggccgagggggcaagggcgagaggaccgcgtggatgtcgagatcgcgacgggcctgccggaggagctggcagagggtcttcgaccgttctctcatccgtgccactccagatgctcttttatctgtctggaacctattacgctctgtactttcttgccacattgctaatgattacctacaaaagtcaagtgtttagctacccacaccgctatctggtgctggatttagccctgttgttcctgatggggatcctagaggctgttaggttgtatctgggtactcgaggcaacctcacagaggctgaacgcccccttgccgcttccctggctctgacagcaggaactgcgctcctatctgcccatttcctcctgtggcaagccctggtattgtgggctgattgggctcttagcgcgaccttattagctctccacggcctagaagctgtgctccaggtcgtcgcaatagcggcctttaccaggtag

SEQ ID NO: 31597 - DNA, 768 bp, Artificial Sequence
  Description of Artificial Sequence: Synthetic coding sequence
atgaaagtgttggcgacctctttcgtgctcggaagtctgggcctggcattttacctcccattagtggtgaccacacctaagacactggccattccagaaaagctgcaagaggccgtcgggaaagtgatcatcaacgccactacatgcacagtgacgtgcggactgggctacaaagaagaaaccgtttgcgaagtaggacccgatggcgttaggagaaagtgtcagacgcggcgcctcgaatgtctaaccaattggatctgcggaatgcttcacttcaccattcttattggaaaggagtttgagctaagttgtttgagcagtgatatccttgaattcggtcaagaagcttttcgctttacgtggcggttggcacgaggcgtgatctcaacggatgacgaggtgttcaaaccctttcaggcgaacagccatttcgtcaagtttaagtacgcgcaggaatatgacagcggcacatatcgctgtgacgttcaactggtgaagaacctccggctggtgaagcggctttattttggactgcgggtacttccccccaacttggtgaaccttaacttccaccagtcactgaccgaggaccagaaactgattgacgaggggcttgaggtcaacctcgactcctactcaaagccgcaccaccccaaatggaaaaaaaaagtagcttccgcactgggcattgggatagccattggggtggtggggggagtgctggtgaggattgtgctgtgcgcattaagaggaggcttgcagcagtag

SEQ ID NO: 31598 - DNA, 1032 bp, Artificial Sequence
  Description of Artificial Sequence: Synthetic coding sequence
atgtttagcctgccctccctgcccagctggctgccagggctcccaagcctggagtggggatcatctctgctcgattcactgctgcagggactcatcggagccctaggagtactcgtactgaacagcctgctcaaagtgtacttctttgtggggtgcgctaatgacccacagcggcgacccgagaaagagagactgcgggctcagtgggccagcctggagaccgtgcacttggcaggcctggcgctgttcctcaccgtggtgggctcccgagtggctgctcttgttgtcctggaattctccctaagagccgttagtacactcctgagcctggggaaagggtcccagggggcagctgaacggcttcagctttatctactatgccagtactccctcggttgcgggctgacttgtgggctctcttttctccaagagggcgccccccatagaactctgaatctgcttctttcactcggccttgccaccctgctcgggttgggtgctaggcgtctgcatagacatgtgtgccgactgtatgaactgcatagttctcagaggtactgcggggtgtgcctggggctgctggctcacgctcacgggctcccgcagctcctcgggcgagctctggccatcgcctttgccgtgggtgatctagccgctgtggcactaataaatcaagatttccttacaacttcggaggccatgcggttctggacacctctgaccatttgttatactctactggtcatttatatgcaggaggagcagagacagcaccctggtctccagtctcaggtccagactgtcttggtgcgtatgggcggcctcttcgttctgctactcacagtaggacgatggctcgacctcctcgggatccttgtgagcctgctgggtgagctttggtgcctggtgggcgttaggaccctacttgatctttgtcagatccaggatttccctagccagagacccccggtctctaccccctctcagccactcccatctgcaccgcagagccagtctagtgctccctcatag

SEQ ID NO: 31599 - DNA, 450 bp, Artificial Sequence
  Description of Artificial Sequence: Synthetic coding sequence
atgactgcccagggcggtcttgttgcgaaccgcggcaggcgcttcaagtgggcaattgagttgtccggaccaggcggaggtagccggggtagatccgacaggggttccggtcaaggcgattctctgtatcctgtgggatatcttgacaagcaagttcccgacaccagcgtccaagagactgatcggatccttgttgaaaagcgatgctgggacatcgccctcggcccgttaaagcaaattccgatgaacctcttcattatgtacatggccgggaacacaatatccatatttccaactatgatggtgtgcatgatggcctggaggccaattcaggccctcatggctatctctgccaaaaacggcgtgcagtggtggcggacggctttcgtcaatatgagaaagcagcggctcgtccctatgtacctgggacttatatatatactgctgtag

SEQ ID NO: 31600 - DNA, 552 bp, Artificial Sequence
  Description of Artificial Sequence: Synthetic coding sequence
atgaccgcccaggggggtctggttgctaaccgtggccgccgattcaagtgggccatcgaactgtccggtcccggcggcgggtctcgtgggaggagcgacagaggatcaggtcagggcgatagcctctatccggttggctacttagacaagcaggtcccggacacttcagtacaggagacggacaggattctcgttgaaaagagatgctgggacattgctctcggcccacttaagcagattcctatgaacctctttattatgtacatggctgggaataccatcagcatcttcccaaccatgatggtgtgcatgatggcatggcggcccattcaggctctgatggccataagcgcaacctttaagatgcttgaaagcagtagtcagaaatttctgcaggggttggtgtatctcatcggcaatcttatggggctggcactagccgtctataaatgccagagcatggggctcttgcctactcacgcgtcggactggctagcattcatagagccccctgagaggatggaatttagtggtggcgggctactcctgtag

SEQ ID NO: 31601 - DNA, 723 bp, Artificial Sequence
  Description of Artificial Sequence: Synthetic coding sequence
atggtttccccagtcaccgtggtgaagtctgaaggacccaagctcgtgccattctttaaagcgacctgtgtgtactttgttttgtggctgccctccagtagtccctcctgggttagcacgcttattaagtgtctgccaattttctgtctatggctcttcctgttggctcacggactcggctttctgcttgcccacccatctgccacacgcatatttgtaggactggtattctccgcggtaggtgatgcatttctgatctggcaggaccaagggtatttcgtccacggactgctgatgttcgcagtgactcatatgttctatgcctcagcgtttggcatgcagcccctagcattacggactgggctggtgatggctgctctctccggcctctgttacgcactcttgtacccttgcctgagcggagccttcacatacctcgtcggagtctatgtggcgctcataggttttatggggtggcgggccatggccgggctgagactggcgggcgcagactggagatggactgaattagccgcaggcagcggcgctttgttttttattatcagcgatctgacaatcgctcttaataagttctgtttccctgtgccatactcccgcgccctgattatgtcaacatactatgtggcacagatgcttgttgccctgtctgccgtagaaagccgtgagcctgtcgaacattacagactgacaaaagcaaattag

SEQ ID NO: 31602 - DNA, 723 bp, Artificial Sequence
  Description of Artificial Sequence: Synthetic coding sequence
atggtgagccccgtcacagttgttaagtccgagggacccaagctcgtccctttttttaaggcgacatgtgtgtacttcgtactgtggctcccatcctcctccccttcatgggtgtccactcttatcaagtgtttgccaattttttgcctttggcttttcctactggctcacggactcggtttccttttggcacatcctagtgccaccaggatcttcgtggggctggtgttttccgcagtgggagacgcctttctaatttggcaggaccaagggtacttcgtgcacggcctgctcatgttcgccgtgactcacatgttctatgcctctgcatttggaatgcagccattggcactgcggactggattggtaatggctgccctgagcggactatgttacgccctgctctacccatgcctgtcaggcgccttcacatatctcgtgggcgtgtatgttgcactgatcggtttcatggggtggcgtgctatggctgggctgcgtttggcaggcgccgattggaggtggacagagttggcagccgggtctggggccctgttctttatcatcagcgatttgacgatcgcgctcaataaattctgcttcccagtgccctatagtagggcgctgatcatgtccacttactacgtggcacagatgctagtggcgttaagcgcggtcgagagtagagaacccgtggagcattacagactgacaaaggctaattag

SEQ ID NO: 31603 - DNA, 681 bp, Artificial Sequence
  Description of Artificial Sequence: Synthetic coding sequence
atggatgccggcaaagccggccaaactcttaagacccactgctccgctcagagacccgacgtctgtaggtggctgagtcctttcatcctcagttgctgcgtgtatttttgcttgtggattcccgaagaccagctctcctggttcgcagccctggtcaagtgtctacccgtcttgtgcctcgccggttttctttgggtaatgagtccgagtggagggtacacccagctgctgcagggggctctcgtctgtagcgctgtgggcgatgcttgtttgatttggcccgccgcctttgttccaggaatggccgccttcgcgaccgctcacctgttgtacgtgtgggccttcggtttctcacctctgcaacccgggctgctgctcttgattatcttagcaccaggcccctatttaagcctcgtgctccaacacttggagccagatatggtcctgcctgtggctgcctatgggctgatccttatggccatgctttggagggggctggcgcaaggtgggagtgccggatggggggctctgctgtttaccctgtccgacggcgtcctggcgtgggatacctttgctcaacccctcccacatgcccacctggtcatcatgaccacatactacgccgcacagctgctcatcacactctctgccttacgatcccccgtccctaagacggattag

SEQ ID NO: 31604 - DNA, 546 bp, Artificial Sequence
  Description of Artificial Sequence: Synthetic coding sequence
atggccgccgccgcgtggctccaggtgctacctgtgatactactcctcctcggcgcgcacccctctcctctcagcttcttctctgccggccctgcgactgttgcagctgccgaccgctcaaaatggcacatcccgatcccgtcgggtaagaattacttttcttttggtaagatcctgtttcgaaatactacaatcttcctcaaatttgatggagagccatgcgacctgtcattgaatatcacctggtatttgaaatccgccgactgttataatgaaatttacaactttaaagccgaggaagtggaattatatctggaaaagctgaaggagaaacgcggattgtcaggaaaatatcagacctcttccaaactgtttcagaattgctcagaactgtttaaaactcagaccttttccggagattttatgcatagattgccattgctgggcgaaaaacaggaggcaaaggagaacggaactaacctgacgttcataggagataaaaccattcagatgcctttcctcaagaagcactttcttgactgctag

SEQ ID NO: 31605 - DNA, 1668 bp, Artificial Sequence
  Description of Artificial Sequence: Synthetic coding sequence
atggccgccgctgcatggctgcaggttttgcccgtgatcctcctcctcctaggcgcacatcccagccctttgtccttcttctccgccggtccagctaccgtggccgctgcagatagatcaaaatggcatattcctattcccagcggcaaaaactacttctcctttgggaagattctttttcgaaataccaccatcttcctcaaattcgacggcgagccctgtgacctttcccttaacatcacatggtatctcaagagcgccgactgttataatgagatctacaacttcaaagcagaggaagtggaattatatctagaaaaattaaaagagaagcgcgggctatctggaaagtaccagacatcgtctaagttgttccagaactgttccgaactgtttaagacacagactttctccggcgacttcatgcatcgactgcccctccttggggagaagcaagaggccaaggagaatggaaccaatctgactttcattggcgacaaaactgcaatgcacgagcccctacaaacatggcaggacgcgccttacattttcatcgttcatattggaatttccagcagcaaggagtcgtccaaggagaatagcctgagtaacctgtttactatgaccgtggaggtgaagggtccatacgagtacctaaccctcgaggactatccactcatgatttttttcatggtgatgtgtattgtatatgtgctcttcggggtgttgtggcttgcttggtccgcctgttactggcgggacctcctgcgcatccagttctggataggtgcggtcatctttctgggtatgttagaaaaggccgttttttacgccgagtttcagaacataagatacaagggtgaatcggtgcagggggctctgatcctggctgaacttttgtctgcagttaagcgtagtttagctagaacactagtcatcatcgtctcgttaggctatggcatcgtaaaaccccgcttgggtgtcactttgcacaaggtggtcgttgccggagccctgtacctgttgttctctggcatggaaggcgtgttgcgggttaccggggcgcagacagacctggcatccctggccttcattcccctggccttcttggataccgccttgtgctggtggatatttatctccctgactcagactatgaagctgctcaagctgagaagaaacattgtcaaactttctttgtaccgtcactttactaacactctgatcctggcggttgctgcctcgatagtatttataatctggactactatgaaattcaggatcgtaacttgtcagagcgattggcgggaactctgggtagacgacgcgatttggcggttactgttcagtatgatacttttcgtcattatggtgttatggaggccaagcgccaataatcagcgttttgctttttctccgctcagcgaggaggaagaagaggatgagcaaaaagaacccatgctgaaggagagtttcgaaggcatgaaaatgcgatccactaagcaggaaccaaatggcaattccaaagtcaacaaggcacaagaagacgatttaaagtgggtcgaagagaacgttcctagtagcgtcaccgacgtcgccctgcccgcactgttggactcagacgaagaacgaatgattacacacttcgaaaggagcaaaatggagtag

SEQ ID NO: 31606 - DNA, 1485 bp, Artificial Sequence
  Description of Artificial Sequence: Synthetic coding sequence
atggcacacagtgatactgtcgtcgatggcgagccttgcgacctaagtctgaacatcacttggtacctgaagagtgcagactgttataacgaaatttacaattttaaggcagaggaagtggagctctatctagagaaactcaaggaaaaaagagggttgagtgggaaataccagacttcctcgaagctcttccagaattgttccgagctgttcaagacacagaccttttccggagattttatgcatcggctgcccttgctgggagagaagcaggaggctaaagagaatgggacgaatctcacctttattggcgacaagactgccatgcacgaacccttacaaacatggcaggacgccccgtacattttcattgtgcatattggtatcagttcatctaaagaaagttcgaaggaaaactctctcagtaacctgttcaccatgactgtcgaggttaaaggaccctatgaatacttgaccctggaagattacccactgatgatttttttcatggtgatgtgcattgtctacgtgctgttcggcgtgctctggctagcttggtcagcgtgctactggagagatctactccgcatacaattttggattggcgcagtcattttcctcgggatgctcgagaaagcagtgttctacgctgaattccagaatatccgctacaagggcgagagtgtgcagggcgctctaatactggcagagcttctgtccgccgtgaaaagatcactggcacgcacacttgttatcatagtgagcctgggctacgggatagtcaagccgcgcctcggcgtgactttacataaagtggtggtggccggagcgctctacctgctcttctcagggatggagggtgtgctacgggtgacaggcgcccagactgacctggccagcctagctttcatccccctagcctttttggacaccgcactgtgctggtggatcttcatatcactaacacagacaatgaagctgctcaaactgcggcggaatattgtgaagttatccctgtaccgccacttcacaaacactcttatactggcagtagccgcgtccatagttttcattatctggacaaccatgaaatttcgcattgtgacatgtcagtcagactggcgggaactgtgggttgacgacgcaatctggcgcctgttgtttagcatgattctgttcgtcatcatggtgctgtggaggccctctgccaataaccagcgattcgcgttctcccccctgtccgaagaagaggaagaagatgagcagaaagagcccatgctgaaagaaagcttcgaaggaatgaagatgcggtccactaagcaggaacccaatggcaacagcaaggtcaataaagcacaggaggatgacctgaaatgggtggaggagaacgtcccttcgtccgtgacagacgtcgccctccctgcattattggactccgatgaggagcggatgattacccacttcgaaaggagtaaaatggagtag

SEQ ID NO: 31607 - DNA, 1596 bp, Artificial Sequence
  Description of Artificial Sequence: Synthetic coding sequence
atgtataagcgacgggtcgtatatctgtcagacgtctcacagaatcctgtgtctccagggtggatcagaaagggaaagaactatttctcatttggaaagatactcttcaggaacaccaccatttttttgaagttcgacggtgagccctgtgacctgtccctcaacattacatggtatctgaaatctgcagactgttacaatgagatctacaacttcaaggcagaggaggtggagctgtacctcgaaaaactcaaggagaaacggggactcagcggaaagtatcaaacaagttctaaattgtttcagaattgctccgaactcttcaaaacccagacgttttccggggacttcatgcatagactgcccctgctcggggaaaaacaggaggcgaaggagaacggaaccaatctgaccttcattggagacaagaccgctatgcacgagccccttcaaacatggcaggatgccccttatatctttatagtacatattggaatcagcagtagcaaggaatccagtaaggaaaactcgctcagtaatttgttcacaatgactgttgaagtcaagggcccttatgagtatttaactttagaagactatcctctcatgatcttttttatggttatgtgtatagtgtatgtcctgtttggggtcctctggctagcctggtctgcctgttactggcgcgacctcctacgcatccagttttggatcggtgctgtcatcttcctgggcatgctcgagaaagccgtcttctatgccgaatttcagaacatacgatacaagggagaatccgtccagggcgccctaatcctggctgaactgctatccgcagtcaaacggtccctcgctaggactcttgtaatcatcgtgagcctagggtacggaatcgttaagccgcgcctcggcgtcacactgcacaaggtggtggtggctggcgccctgtacttgcttttcagtgggatggaaggagtgctgcgagtcacaggcgcacaaaccgatctggcttcattagcatttatcccattagctttcctggacactgcactgtgttggtggatctttatttccttgactcagactatgaagctcctcaaactccgtaggaacattgtaaagctgagcctttatcgacattttacgaacaccttaatattggccgtcgccgcctccatagtgtttataatctggacgactatgaagtttcggatcgtgacttgccagagcgattggagagaactgtgggtggatgatgcaatttggcgacttcttttctccatgattttgtttgtcataatggtcctatggcggccatctgccaataatcaaagattcgccttttcccctctgtccgaagaagaggaagaggatgagcagaaagagcctatgctcaaggaatcgtttgaaggcatgaagatgcggtccactaaacaggagccaaacggaaattccaaggtcaacaaggcccaagaggatgacctcaagtgggtggaggagaacgtgccctcttccgttaccgatgtcgccctgcccgccctcctcgactcagacgaagagcggatgatcacacacttcgaaagatcgaagatggagtag

SEQ ID NO: 31608 - DNA, 1668 bp, Artificial Sequence
  Description of Artificial Sequence: Synthetic coding sequence
atggtagccgcctgccggtcggtcgctggtctattgcctcgacgcagaaggtgtttccctgcgcgggcaccactgttgcgcgtggctctgtgcctcttatgctggacccctgccgctgtcagagctgtgcccgaactcggcctgtggctcgaaaccgtgaacgacaaatctggacctctgatcttccgtaaaactatgtttaatagcaccgacatcaagctctcggtaaaaagctttcattgcagtggtcccgtgaagtttaccatcgtttggcacctgaaataccatacatgccacaatgaacactccaatctggaggagctgttccaaaagcataaactcagtgtagatgaagacttttgtcactacctcaagaatgacaattgctggaccaccaagaatgaaaaccttgattgtaacagcgactcccaggttttccctagtttgaataataaggagctaataaacatccggaatgtttctaaccaggaacgttctatggatgtagttgccaggactcagaaagacggttttcacatctttatcgtttccatcaaaactgaaaatacggacgcaagctggaacctgaatgtaagtttgtccatgatcggcccacacggatatatttcagcatctgactggcccctgatgattttctacatggtcatgtgtatcgtgtacattctgtacggtatcttgtggctcacttggagcgcctgctactggaaggacattctgcggattcagttttggatcgccgccgtgattttcctcggcatgcttgagaaggctgtgttctattcggagtatcaaaacatatctaacaccggtctgtccactcaggggctgcttatatttgcagaactgattagcgctatcaaacggaccttagcgagacttctagtgataatagtgagcttgggatatggtattgtcaaaccccgcctgggcactgtgatgcacagggtgattggtttaggccttttgtacctgatcttcgcggcagtggaaggcgtgatgcgggttatcggcggtagtaatcacctggccgtagttctcgatgacatcattctggctgttattgactccattttcgtatggttcatcttcatcagccttgctcagactatgaagaccctccggttacggaaaaacaccgtaaaattcagcctgtataggcattttaagaacactttgatattcgcagtcttggcctctatagtttttatgggctggacaaccaaaaccttccgcattgctaagtgtcagtcagactggatggaaaggtgggtagacgatgccttttggtcatttttgtttagcctcatcctgatagtcatcatgtttctgtggcgacccagcgccaataaccagagatacgctttcatgcccttgattgacgacagtgacgacgagatcgaagaattcatggtgactagtgagaatctcactgagggcatcaaattgagagccagcaaaagcgtatctaatggcaccgccaagcccgcaacaagcgagaatttcgacgaagatcttaagtgggtggaggagaacattcctagttctttcactgacgtggccctcccggtgctcgtagacagtgacgaggagattatgacaaggtcagaaatggcagagaaaatgttttccagcgagaagattatgtag

SEQ ID NO: 31609 - DNA, 480 bp, Artificial Sequence
  Description of Artificial Sequence: Synthetic coding sequence
atggcggatgtacctggtgctcagagagccgtccccggggatggtcctgaaccacgggatccccttgactgctgggcttgcgccgtcctggtgactgcgcagaatctgctggttgctgcatttaacctcttacttctagttctcgttttggggactatactgctccccgcagtgaccatgcttggctttgggttcctgtgtcattctcaattcttaagaagccaggcgcccccctgtacggctcatcttagagatccaggatttaccgccttgttagttaccggcttccttctgctcgtgccactgttagttctggctctggcaagctaccggagactgtgtctccgtctgcggctggcggactgcttggtcccctattctcgtgctctgtacaggagaaggcgcgcgccccagccccggcaaatcagagcttctcctggaagccaggccgttcccacatcaggcaaagtgtgggtttag

SEQ ID NO: 31610 - DNA, 480 bp, Artificial Sequence
  Description of Artificial Sequence: Synthetic coding sequence
atgctccacgtcctagcttctttgcccctgctccttctgctggtgactagcgcaagcacacatgcctggtctcggcccctgtggtatcaggtcggcctggatttgcagccttggggttgccagcctaaaagtgtggagggatgcaggggaggactctcgtgccccgggtactggctgggaccgggtgcttcaaggatctaccccgtggcagcagtgatgatcactactaccatgcttatgatatgcagaaaaattctgcaggggcggcggcggtctcaggcaacaaaaggcgagcaccctcaggttaccacagagccctgcggcccctggaagagacgcgcaccaattagcgaccatacccttctgcgcggagtgctgcacatgttggacgctctccttgtccacattgaaggccaccttcgccatctggcgacccagcggcagatccagattaagggaacatctacacagtccggatag

SEQ ID NO: 31611 - DNA, 780 bp, Artificial Sequence
  Description of Artificial Sequence: Synthetic coding sequence
atgtgcccagaaaatgccgaggattgtgaacaggctgtcgtacatgtggaaacaaccttatatctggtcccatgccttaatgactgtggtccttatggccaatgcctgcttctacgccggcactcgtatttgtacgcttcatgcagttgcaaggcaggttggagggggtggagttgtactgacaactctacagcacagacagtcgcacaacagagagctgctacactgcttttgaccttgagcaacttaatgttcctggcacctatcgctgtctccgttcggcgctttttcctggtggaagctagcgtgtacgcatacaccatgttcttcagcactttttatcatgcgtgtgatcaaccgggggaggccgttctttgtattctctcatatgatacactgcaatactgcgactttttagggagcggtgctgcaatttgggtcaccattttatgtatggctaggctgaagaccgtcctgaagtatgcctatcgctgcggacacaggcgccagtgctacccaacgtcctggcagaggtgggccttttacctgctcccgggagtgtcaatggcctccgttggcattgctatctatacgtccatgatgaccagcgataactactactatacccacagtatatggcacatcctgttggccggctcggctgccctacttctgcctccgccagatcaaccagcagagccctgggcctgctcccagaaatttccctgccattatcaaatctgtaagaacgatcgggaagaactctatgcggttacgtag

SEQ ID NO: 31612 - DNA, 2316 bp, Artificial Sequence
  Description of Artificial Sequence: Synthetic coding sequence
atggggcgggcaggtacaggcaccggaggcgaagctgtagccgccgtggtggccggccctttgctgctgctcttgttagcccggcccccacctgcatccgccggctatagcggaaagagtgaggtgggactggtgagcgagcatttctcccaagccccccagcgtctcagtttttactcatggtacggctctgcccgcctattccgcttcagagttcctcccgacgccgtgctgctacgctggctccttcaggttagtcgggagagcggcgccgcctgtacagacgccgaaattacagttcactttaggtccggcgccccacctgtcatcaatccgctgggaacctcttttccggatgatacagctgtccagccttcctttcaagtgggagtccccctgtccactacaccacggagcaatgcttcagttaatgtgtctcatcccgcacctggtgactggtttgtcgctgcacacctgccacctagctcacagaaaattgaactgaagggcctcgctccaacatgcgcctatgtgttccagcccgagctgctcgttactagagtcgtagagatcagcatcatggaaccagatgtccctctgccacagaccctcctgtcccacccctcctatttaaaagtgtttgtccctgactatacgcgcgaacttctcctcgagctcagggactgtgtctcgaatggtagtctgggatgccccgttaggctgacagtgggccccgtgaccctaccgagtaatttccagaaagtgttgacctgtaccggcgctccctggccttgtcgcctgctgttacctagcccgccttgggaccgatggctacaagtgaccgcagagtcattagtggggccgttaggaactgttgcattttctgccgtggccgccctcaccgcgtgccgtcccagaagcgtcaccatccagcccctgctccagtcatcccaaaaccagtccttcaatgcctcaagtgggctattgagcccctcccccgatcatcaggatctggggcgaagcggccgggttgatcgttcacccttctgcctaaccaactatccagtcaccagagaggacatggacgtggtcagcgtccattttcagcctctggacagggtgagtgttagagtctgcagcgacacaccttccgtgatgcgcttgcgattaaacaccgggatggactctggcggttcgctgaccatatctctgagagccaataagactgaaatgcggaatgagaccgtcgtcgtcgcctgcgtaaacgcagctagtcctttcctgggatttaatacctctctcaactgtactactgctttttttcaaggctatccattgagtctctccgcttggtctcgaagagcaaacctgattattccctaccctgaaaccgataactggtatctgagcctgcagttgatgtgtcctgaaaacgccgaagactgtgagcaggctgtcgttcatgtggagaccaccctctacttagtaccatgcctgaacgactgtggaccctatggtcagtgtttactgctgcgcagacatagctacttgtacgcaagctgctcttgcaaagccgggtggagagggtggtcctgcacggataattcaactgcccagacagtggcccagcagcgagcggccacccttttactgacgttaagcaacctgatgttcctggctcccatcgccgtttccgtgagaaggttcttcttggtagaggcgtcagtgtacgcctatacaatgtttttttctacgttttaccatgcctgtgaccagcctggagaggcggtgttgtgtattctgtcgtacgataccctgcaatattgcgattttttggggtccggtgccgccatatgggtcacaatactgtgcatggctcgcctgaagacagtccttaagtatgtgctttttttattgggcacactcgttattgcaatgtcattgcaactggatcggcgcggaatgtggaacatgctggggccctgtctgttcgccttcgtgatcatggcctccatgtgggcctaccgatgcggccatcgccggcagtgttaccccacctcatggcagagatgggctttctacctcctgcctggtgttagcatggcgtcagtcggtattgccatctacactagcatgatgactagcgataactactattatactcactctatttggcatattctgctggctgggtccgctgccctactgctgccaccacccgaccagccagcggaaccctgggcttgcagtcagaagttcccctgtcactatcagatatgcaagaacgacagagaggagctttatgccgtgacctag

SEQ ID NO: 31613 - DNA, 1419 bp, Artificial Sequence
  Description of Artificial Sequence: Synthetic coding sequence
atgaacatgccgcagtcactcggaaaccagcctctacccccagagccacccagcttaggaacacccgctgaggggcccggtaccacatcccctcctgagcactgttggcccgtgcgacccaccctgcgcaacgagctagacacttttagcgtgcatttttacattttctttggcccttccgtggcgctccctcctgagcgacccgcggtattcgccatgaggttgttaccggtactggactccggcggagtactgtcactggagctgcagttaaatgcttccagcgtgagacaggagaatgtgacagttttcggttgtctcacacatgaagtccctctctcactgggcgacgcagcagttacctgctcaaaggagagtttggccgggtttctgttgagcgttagcgctaccacccgagttgctcgcctaagaattcccttcccgcagacaggaacatggtttttagcgctgcggtcactgtgcggagtggggccccgcttcgtgagatgccggaatgctacagccgaagttaggatgcgcaccttcttgtccccttgtgtggacgattgtggaccctatggccagtgcaagctgctccggacacataactacctctacgctgcgtgtgagtgcaaagccgggtggagaggctggggatgcaccgactcggcagatgccctcacatatggttttcagctgctctccacactcctgctgtgtctgtctaatctgatgttcttaccacctgtggtcctggccatccgcagtaggtatgttctggaggcggccgtgtacaccttcaccatgttcttttctacgttctaccacgcctgcgaccagcctggcatcgtcgtgttttgcataatggactatgatgtcctgcaattttgcgattttctcggtagcttgatgtctgtctgggtcactgtcatagccatggctaggctgcaaccagtggtgaagcaagtgctgtatctcctcggtgctatgctgctttccatggcactacaattggacagacacgggctgtggaacctactgggacctagcttattcgcgctcggcatccttgcaaccgcctggacagtacgctctgttagaaggagacactgctacccgcctacttggcggcgctggctgttctatctttgccccggaagtttgattgcagggagtgccgtactgctgtatgcgttcgtcgaaactcgggataattatttttatattcattctatctggcatatgctgattgctggctcggtcggttttctgctgccaccacgtgccaaaaccgatcacggcgtgccttcaggagctcgagccagaggctgtggctaccaactttgcatcaacgagcaagaagaactagggctagtcggaccaggtggcgcgacggtcagttccatctgcgcctcatag

SEQ ID NO: 31614 - DNA, 1419 bp, Artificial Sequence
  Description of Artificial Sequence: Synthetic coding sequence
atgaacatgcctcagtctttgggcaaccaacccctgccgccggaacccccctccctaggcactccagcagaagggcctgggacaacctccccgcccgagcactgttggccagtgcgacctactctgaggaacgagctggacactttctctgtgcacttttacatatttttcggtccaagcgtcgcactccctcccgagaggccagccgtgtttgccatgagacttctgcctgtgctagattccggcggagtgctttctctcgagctgcagctgaacgcctcttctgtgcgtcaagagaacgtcaccgtgttcggatgcctgacccatgaggtgcccctgtcactcggagacgcggcggtgacctgttctaaggagtctttagcaggctttcttttgtccgtgtccgccacaactagagttgctcgacttagaatacccttcccgcagacaggaacatggtttctggcgctcaggagcttgtgtggcgtaggcccacgctttgtgcgctgccgaaatgctactgcggaagtccggatgcgtaccttcctctctccgtgtgttgacgattgtggcccttatgggcaatgcaagctactgagaactcataactacctgtacgcagcttgcgaatgtaaggcaggctggagaggctgggggtgtaccgactctgctgacgcccttacttatggctttcaattactgtctactctattgttatgcctcagcaacttgatgttcctgcccccagtggttctggctattcgatcccggtacgtcctagaggctgctgtgtatacttttactatgttcttcagcaccttctaccatgcctgcgaccagcctggcattgtcgttttttgcattatggactatgacgtgcttcaattctgcgactttctgggcagtttaatgagcgtgtgggtcacagtgatcgccatggctcggcttcaacccgtggtaaagcaggtcctgtacctcctgggggcaatgttgcttagtatggcacttcagctcgatcggcatggcctgtggaatctgcttgggccatccctctttgccctgggcattctcgcaacagcttggactgtacggtctgtgcggagacggcattgctatcccccaacatggcggaggtggctcttctacctgtgtccgggttcacttatcgcaggatcagctgttttgctttacgctttcgtggagacgcgggataattatttctacattcactctatttggcatatgctgattgcgggatccgtgggttttctcctcccgccgcgggctaagacagaccacggagtgccatcaggagccagagctcggggatgcggataccagctctgtatcaacgaacaggaggagctaggcttggtggggcctggcggtgcgacggtgtcaagcatttgcgctagttag

SEQ ID NO: 31615 - DNA, 1017 bp, Artificial Sequence
  Description of Artificial Sequence: Synthetic coding sequence
atgaatatgccacaaagtctggggaatcagccgcttcctccagagccaccaagcttaggcacccccgcggagggccccgggaccacttcacctccggagcactgctggccggtgcggccaacactacgaaatgaacttgacacctttagtgttcatttttatattttcttcggcccatccgtggctctgccacctgagaggccggctgtgtttgctatgagactgctgccggtattagactcgggcggagtcctgtctctggaactccaactcaatgcttcctccgtgcggcaggaaaatgtcactgtcttcggctgcctcacgcatgaagtgcctttatctctgggcgacgctgctgtcacctgctcgaaggaatctctcgctgggttcttgctgtctgtctccgcaaccacgcgagtggcccgtttgcgtataccattcccccagaccggcacttggtttctggccctgcggtctctatgtggggttggcccgagattcgtgagatgcagaaatgccacagccgaagtgagaatgcgaacttttctgtcaccctgtgttgacgactgtggaccctatggtcagtgtaagctgctccgcacacacaattacctgtacgctgcctgcgagtgcaaagccggatggcgaggatggggttgtactgatagtgcagatgcccttacctacggatttcagttactcagcacgctcctcttgtgcctgagtaatctgatgttcttgcccccagtggttctggcgattaggagtcgctacgtactggaagccgcggtctacactttcacaatgtttttttcaaccgtgtgtggcggtgtgtgtattctgagcctgggagcctgtgcatggtggtgggtaacagtctgtataagcacaactttctctgaaggcttggggatgtcagtgcctagcctgtgtcttttgcagaccgagacagctgtcctccctaaactgtcgtgtattgacaatggccacttttgcaaaacccactggagcaagtag

SEQ ID NO: 31616 - DNA, 1017 bp, Artificial Sequence
  Description of Artificial Sequence: Synthetic coding sequence
atgaatatgccacagtcactcggtaaccagccccttccccctgaaccgccgtccttggggactccagcagagggaccaggcaccacttccccacccgaacattgctggcctgtgcgccctacattacggaatgagttagatacattctctgtgcacttctatatattttttggtcctagtgtggccctccccccagaaagacctgctgtgtttgcaatgcggcttctcccggtgctggactctggcggggtattgtcattggagctgcaactgaatgcctcttctgtgcgccaggaaaatgtgaccgtctttgggtgccttactcacgaggtgccactctcccttggcgatgcagcagtgacgtgctcaaaggagagcctcgccggctttctgctgtccgtgtcagcaactacacgagtagcgagactgcggattccctttccacagactgggacctggtttctcgcgctgcggtctctgtgcggcgtcgggccccgattcgtgcgctgtcgcaacgcgactgcagaggttcggatgagaacatttctttctccttgtgtcgatgactgtggtccctatggccagtgcaagctgctgagaacccacaactatctctacgccgcttgcgagtgtaaagcgggttggaggggatggggatgcacagactcagcagatgctctgacttacggctttcagctcctgtcaaccctactcctgtgtctgtcaaatctgatgttcctgccgccagtagtcctggctatacgaagcagatatgtattagaagctgccgtttacaccttcactatgttcttttccactgtctgcggaggcgtatgcatcctgtccctaggggcctgtgcctggtggtgggtcacagtttgtatttccacaacattctcggaaggcctggggatgtctgtcccatctctctgcctccttcagacagagaccgcagtgctgcccaagttgagctgcattgataatggtcacttctgcaagacccactggagtaagtag

SEQ ID NO: 31617 - DNA, 552 bp, Artificial Sequence
  Description of Artificial Sequence: Synthetic coding sequence
atgaagctgctgtctctggttgctgtagttgggtgtctcctggtccctcccgccgaagctaataaatccagcgaggacatccggtgcaagtgcatctgtcccccctaccgcaatatcagcggccacatctacaatcagaatgtgtctcaaaaagattgtaactgtctccatgtcgtggagccaatgcccgtcccaggccacgacgtggaagcctattgtctgttatgcgagtgccggtacgaggaacggtctacgactaccatcaaagtcataattgtaatatacttgtcagtggtgggtgccttgcttctttatatggcctttctgatgctggtggatcccctgatccgtaagcctgacgcatacactgaacagctgcataacgaggaggagaacgaggatgcccggtcaatggctgctgccgcggcgagcctagggggtcctcgagcaaacaccgtcctggagagggtcgagggagcccagcagcgctggaaactgcaagtccaggagcaaagaaagaccgtctttgatcgccataagatgctgtcttag

SEQ ID NO: 31618 - DNA, 552 bp, Artificial Sequence
  Description of Artificial Sequence: Synthetic coding sequence
atgaagcttctgagtttggttgcagtagtggggtgcctcctggtacctccagctgaggcgaacaagtcatctgaggatattcgatgtaagtgcatctgtccaccgtacagaaatattagcgggcatatctacaatcaaaacgtatctcagaaggactgcaattgtttacacgtggtcgagccaatgccagttccaggccacgacgtggaagcctattgtctgctgtgcgaatgtagatatgaagagaggtcaactacaaccattaaagtcatcattgttatttacctaagcgtcgtcggcgccctcctcctgtacatggccttcctgatgttggttgaccctctcattagaaagccagatgcgtatactgagcagttgcacaacgaagaagagaatgaagacgctaggagcatggcagccgccgccgcgtctctgggaggacctagagccaatacagttctggagcgagtggaaggagcccagcaacgctggaaactgcaggtccaggagcagcgcaagaccgtttttgatagacataaaatgctaagctag

SEQ ID NO: 31619 - DNA, 561 bp, Artificial Sequence
  Description of Artificial Sequence: Synthetic coding sequence
atgaaacttctgagcctggtggcagtcgttggatgtcttctcgtgccccctgcggaggctaataaagttagggagtcctccgaggatattcggtgcaagtgtatctgccccccctatagaaacatttcaggtcatatatacaaccagaatgtctcacagaaggactgtaattgcttacacgtggttgagcccatgcccgtgcctgggcacgacgtcgaggcctattgtctgctttgcgaatgcagatatgaggagaggagcactacaacgattaaggttattatcgttatctatctatccgtggtcggcgcgctcctgctctacatggctttcctgatgctggtcgatccactgatacgcaagcccgatgcctacaccgaacagctccacaacgaggaagagaatgaagatgctcgcagcatggccgcggccgcagcatctctcggggggcctcgagccaatactgtgctggaaagggttgaaggtgcccaacaacggtggaagctgcaggtacaagaacagaggaagaccgtgtttgatcgccacaaaatgttgtcctag

SEQ ID NO: 31620 - DNA, 561 bp, Artificial Sequence
  Description of Artificial Sequence: Synthetic coding sequence
atgaagctcttatcccttgttgcggtggttgggtgcctgctggtcccacctgctgaagccaacaaagttcgggaatctagcgaggacatacggtgcaagtgcatttgtccgccctacaggaatatttccggccatatttacaaccagaacgtctcgcagaaagactgtaattgcctgcacgtggtcgaacctatgcctgtaccaggccatgatgtggaggcctactgtctgctgtgcgagtgtagatacgaggagcgttcaaccacaactattaaggttattatcgtgatatacctgagcgtggtgggcgcactgctcctctacatggcgtttttaatgcttgtggacccactgattagaaagcctgatgcctacaccgagcaactccataatgaggaggagaacgaagatgctaggtctatggccgccgctgccgcatccctgggaggaccacgagccaatacagtactggagcgagtcgaaggtgcccagcagcgttggaagctgcaggtgcaagagcaacgcaagactgttttcgaccgacataaaatgctcagttag

SEQ ID NO: 31621 - DNA, 552 bp, Artificial Sequence
  Description of Artificial Sequence: Synthetic coding sequence
atgaagctgctcagtctggtagctgtggttgggtgccttctggttcctcccgcagaagccaataaaagtagcgaagatattaggtgtaaatgcatttgccccccatatagaaatatttcgggccatatttacaatcagaacgtgtcacagaaagattgcaactgtttgcacgtcgtagaaccaatgcctgtgccagggcacgatgttgaggcctattgccttctctgtgaatgtagatatgaagagcgatcaactactacgatcaaagtaatcatcgtgatctatctaagcgtggttggcgctctgttactatacatggcgtttctcatgctggtggaccccctgatccgtaaacctgacgcgtacaccgagcagttacacaacgaagaagaaaatgaggacgcacgttcaatggccgccgctgcggctagcctgggcggcccccgcgcaaacacagtgttggaacgggtggaaggagcacagcagcggtggaagctccaggtgcaggagcaacgaaaaactgtctttgatcgccacaaaatgcttagctag

SEQ ID NO: 31622 - DNA, 345 bp, Artificial Sequence
  Description of Artificial Sequence: Synthetic coding sequence
atgaaactgcttagtctggtggctgtagtcgggtgcctgctggtgccaccagccgaggcaaacaaggtaagagaggtgagccttcagcacttggttactaccactgtccatggccacccagtgtaccgagctgactctgaatccagcgaggatatacgctgcaagtgtatttgtccaccatacaggaacatatcaggccatatttacaatcagaacgtcagccagaaggactgcaattgcttgcacgtggtggagcccatgcctgtgcccggtcatgatgtggaggcctattgcttgttatgcgaatgtagatacgaggagaggagcacaaccaccataaaatag

SEQ ID NO: 31623 - DNA, 417 bp, Artificial Sequence
  Description of Artificial Sequence: Synthetic coding sequence
atgaaacttctgtcactcgtggctgttgtgggctgtctcctcgtcccacccgctgaggcaaataagtcgtccgaagatatccgatgcaaatgtatctgtcccccttaccgcaatataagcggccacatctataatcaaaacgtgtcccagaaggattgtaattgtctccacgttgtagagccgatgcccgtcccggggcatgacgtcgaagcctactgtctgctttgcgagtgccgctacgaagagaggtcaactacaaccataaaagtcatcattgtcatatacttgtccgtggtcggtgccttgcttctctatatggcttttttgatgctggtggaccctctcattagaaagcctgacgcatatacggagcagctacataatgaggaagagaatgaagacgctcggagtatgtag

SEQ ID NO: 31624 - DNA, 456 bp, Artificial Sequence
  Description of Artificial Sequence: Synthetic coding sequence
atgaagctgctctctctggtcgctgtagtcggatgtctgctggtgccaccagccgaggccaataagtccagtgaggatattcgctgcaagtgtatttgtcccccttatcgaaatatatccggccacatctacaatcagaatgtcagccagaaagactgtccagtgtctctgtgctgctccaactgtttacatgtcgttgagcccatgccagtaccaggccacgatgtggaggcttattgtctgctttgtgagtgccgctacgaggaacgaagcaccacaacaatcaaggtgatcattgttatatacttatcagttgtgggcgctctgttgctctacatggcgtttttgatgctggttgatcctttaattcgtaagcccgatgcttacactgaacagctccacaacgaagaagagaacgaagacgcacgctcaatggccgcagccgcggcatcttag

SEQ ID NO: 31625 - DNA, 369 bp, Artificial Sequence
  Description of Artificial Sequence: Synthetic coding sequence
atggacagcccatctcttagggaacttcagcaaccgttgttggaggggaccgaatgtgagactcccgcacagaagccaggcaggcacgagttgggttcccccctccgggagattgcttttgcagaatccttaaggggcctgcaatttctgagtcctccactgccctccgtgagcgcaggtctgggagaaccacggccccccgacgtggaggacatgagctcttcagactccgactccgattgggatgggggaagcaggctttctcccttccttccacatgatcatttgggactcgcagttttctccatgctgtgctgcttttggcccgtaggtatcgccgccttctgtctggcccagaagacaaattag

SEQ ID NO: 31626 - DNA, 420 bp, Artificial Sequence
  Description of Artificial Sequence: Synthetic coding sequence
atggactcgcctagtctccgagagctccagcagccattactcgagggcacagaatgcgaaacacctgcacagaaacccggtcgacatgaattagggtctcccctgagggagattgctttcgcggagtccctccgaggcttgcaattcctgtcccctcctttgccaagcgtgagtgccggacttggcgagcccagaccaccggacgtcgaggatatgagctctagtgatagtgattccgactgggacggaggaagccgtctcagcccctttttgccccacgaccatctgggactcgctgtgttctcgatgctgtgctgtttttggccagttgggattgcggccttctgcttggcccagaagcacccccagtgcttgacctatagccgatgttacgtctccgcctttgggatccatgcgtag

SEQ ID NO: 31627 - DNA, 519 bp, Artificial Sequence
  Description of Artificial Sequence: Synthetic coding sequence
atggatagccctagcctcagagagttacagcagccactgctggagggcaccgagtgcgaaacaccggctcagaaacccggacgacatgaactggggagccccttacgggagattgccttcgccgaatctctccgggggttgcaattcctttctccccctttgccttcagttagtgccggactcggggaacccaggccaccggacgtggaggacatgtcaagctcggatagcgattcggattgggatggcggcagtagactctccccgttcctgccccatgaccatctgggactcgctgtgttctcgatgttgtgttgcttctggccagtcggcatcgccgccttctgcctggcacagaagaccaacaaggcctgggctaagggagacattcagggggcgggtgctgcatcacgaagggcgttccttttaggtgtgttggccgtagggttgggtgtgtgcacttacgctgctgcactggtcaccctggctgcctatctcgcttcccgcgaccccccttag

SEQ ID NO: 31628 - DNA, 402 bp, Artificial Sequence
  Description of Artificial Sequence: Synthetic coding sequence
atggacagtcccagcctccgggaactccaacagccactcctagaaggtaccgaatgtgagactcctgcccagaagcccgggagacacgagctgggctccccattgcgcgagatcgcatttgccgaaagcctgcgaggtctgcagttcctatctcccccacttcccagtgtctcggcggggctcggggaaccaaggccacccgacgtagaggacatgtcgtccagcgactcggactctgactgggacggtggctcacgattgtctcccttcttaccacatgaccatcttggactcgcagtgttttcaatgctgtgttgtttttggcctgtgggcattgccgctttctgcctagcgcaaaagacaaggccttcttgcccatactccccccattgtgaaccctag

SEQ ID NO: 31629 - DNA, 372 bp, Artificial Sequence
  Description of Artificial Sequence: Synthetic coding sequence
atggacagcccatctctgcgggaactgcagcagccattgttagagggcactgaatgcgagacgcctgcgcaaaagccaggaaggcatgagcttggatccccactgcgagaaattgcttttgcagagtcgcttcgggggttgcaattcctgtcaccacccctgccaagcgtgagcgcaggcctcggcgaaccgcggccccccgacgttgaggatatgtcatcaagcgacagcgacagtgactgggacggcggatcccggctctcaccgttcctccctcacgaccacttgggtttggctgtattcagcatgctgtgctgcttttggcccgtaggcatagcagccttctgcctagcgcagaagccaagtctgtag

SEQ ID NO: 31630 - DNA, 384 bp, Artificial Sequence
  Description of Artificial Sequence: Synthetic coding sequence
atggatagtccgtcacttcgcgaactgcagcagccactcctcgaaggaacggaatgtgaaacacccgcacagaaaccaggaagacatgagctaggctcacctctgagagagatcgctttcgcagagtctctgagaggtcttcaattccttagcccacctcttcccagtgtcagtgcaggcttgggagagccaagacctcctgatgttgaggatatgtcctcatccgacagtgatagcgattgggacggaggttcacgactgtcgcctttcttgcctcacgatcatctcggtcttgccgttttttctatgctgtgctgtttctggcctgtgggtatcgcagcgttctgccttgcacagaaattacccctgcagccgagcctgtag

SEQ ID NO: 31631 - DNA, 183 bp, Artificial Sequence
  Description of Artificial Sequence: Synthetic coding sequence
tagtgggatggcggcagcagactgagccccttccttccacacgaccacctgggactggcggtattcagtatgctctgttgcttctggcctgtgggcattgcagccttttgcctggcccagaagcacccacagtgcctcacatattccagatgctacgtgagcgcattcgggatccacgcctag

SEQ ID NO: 31632 - DNA, 345 bp, Artificial Sequence
  Description of Artificial Sequence: Synthetic coding sequence
atggacagtccgagcttgagagaactgcagcaaccgctgctggagggaactgagtgcgagacccctgcccaaaaacctggtcgacatgaattgggttcccccctccgagaaattgcatttgctgagagtctgagaggactccagtttctgtcccctccgctgccaagcgtgtccgctggcctgggggagccaaggcctccagatgttgaggatatgtcctctagcgattccgatagtgattgggatggaggttctaggctttcccccttcttgccacatgatcaccttgggctcgccgtcttctccatgctttgctgcttctggcccgtgggtatcgccgcttag

SEQ ID NO: 31633 - DNA, 402 bp, Artificial Sequence
  Description of Artificial Sequence: Synthetic coding sequence
atggattcgccctctcttagagaactgcaacagcctctgctggagggtactgagtgcgagacaccagcacagaaaccaggtcggcacgaactggggtcgcctctgagagagatcgccttcgctgagtctttgaggggactgcagtttctgtctccccctctgcctagcgttagcgccgggcttggcgaaccaaggccccctgacgtcgaggacatgtcaagctctgactctgattcagactgggatggtggctctcggctgtcccccttcctgccgcacgatcacctgggcctggcggtcttcagcatgttatgctgcttttggcccgtgggaatcgctgcattttgcttagcccaaaagacaaggcctagttgcccttatagcccccattgtgaaccctag

SEQ ID NO: 31634 - DNA, 264 bp, Artificial Sequence
  Description of Artificial Sequence: Synthetic coding sequence
tgacttccgagtgtgtctgctgggttgggagagcctcggccgccggatgtcgaagatatgtcaagctctgacagcgatagtgattgggatggcgggtcccgattgtcgccctttttaccccatgaccacctgggcctggccgtgttttccatgttgtgttgtttctggcctgtcggcatagccgccttctgtctcgcccagaaacatcctcaatgtcttacctattccagatgctatgtgagcgcatttggaatccacgcttag

SEQ ID NO: 31635 - DNA, 480 bp, Artificial Sequence
  Description of Artificial Sequence: Synthetic coding sequence
atgagccaggcctgggtacccggcttagctccaaccctcctgttttcactgctcgccggcccacagaaaattgctgctaagtgtggcctgattcttgcttgccccaagggattcaaatgctgcggcgattcgtgttgccaggagaacgaattattcccgggtcccgtgcgtatttttgtgatcatcttcttggtcattttgtctgtcttttgcatctgcggactggcgaagtgcttctgtcgcaattgccgggagcccgagccagacagtcctgtggattgtcggggccctctggaactgccaagtattataccccccgaacgtgttagggtctccctttccgcaccccctcccccatatagcgaagtaatattaaagccatcactaggccctactcctacagaaccccctccaccgtattcctttaggcccgaagagtatacgggcgatcagaggggaatagacaatccagcgttttag

SEQ ID NO: 31636 - DNA, 480 bp, Artificial Sequence
  Description of Artificial Sequence: Synthetic coding sequence
atgtcccaggcatgggtgcccggactggcgcctactctgttgttctccctcctagctggcccccagaagattgcagcaaagtgtgggcttattctcgcttgtcccaaggggttcaagtgttgcggagattcatgctgccaggaaaacgaactgttccccggaccagtgagaatattcgtgatcatttttctcgtcattctgtctgtgttttgtatctgcgggctggcgaaatgcttttgtcgaaactgccgcgaaccagagcctgatagcccggtagactgcagaggaccgcttgagctgccatctatcatcccaccagagcgggtgagagtgagcttgtcagctcctccgccaccctattctgaagtgattttgaagcctagcctcggcccaaccccgacagaacctcccccaccttatagcttccgccccgaggagtatactggcgaccaaaggggcattgataatcctgcattttag

SEQ ID NO: 31637 - DNA, 333 bp, Artificial Sequence
  Description of Artificial Sequence: Synthetic coding sequence
atggcagcggtggtcgccaaaagagaaggacctccctttatctctgaggctgctgtgcgcggaaacgcggcagtactcgactattgcagaacctcagtgtcagcactttctggcgcaacggccggaattctgggcctgaccggtttatatggatttatcttttatttgctagcctctgttttgctgagccttcttctgatactcaaggcagggcgtaggtggaacaaatactttaagagcagacggccgctctttacagggggcctaatcggaggtctgtttacgtacgtgctgttttggacatttttatacgggatggtgcacgtgtactag

SEQ ID NO: 31638 - DNA, 333 bp, Artificial Sequence
  Description of Artificial Sequence: Synthetic coding sequence
atggctgcggtggtggccaaacgagagggacctccctttatttctgaggccgctgttagaggcaacgcagccgtgctggattattgtaggacatctgtatcagcactctctggtgcaacagccggaatcttgggcctcacaggcctatatggctttatcttctatctcctggctagtgttctgctgagcctgttgctgattcttaaagcaggcagacgctggaacaaatacttcaaaagccgccggccactgttcaccggagggttaatcggaggcctcttcacatacgtcctgttctggacattcctttacggtatggtgcacgtttattag

SEQ ID NO: 31639 - DNA, 681 bp, Artificial Sequence
  Description of Artificial Sequence: Synthetic coding sequence
atggaaacggttgtgatcgtggcaattggtgttctggccaccatttttttggcttcttttgcagcccttgtgctggtttgtcgccagagatactgtagaccccgagatctactccagcgctacgattcaaaaccaatcgttgatctcattggagctatggagacacagtcagagccctcagaattagaactggacgacgtcgtcatcacaaatccccacattgaggctatattagagaatgaagactggattgaggacgctagcggcctgatgagtcactgcatcgctatcctgaagatttgccacaccctaaccgaaaaactcgtcgccatgacgatggggagtggggccaaaatgaaaacatctgcttcagtgtccgatattatcgtcgtcgcaaagaggatcagcccacgtgttgatgacgttgttaagtcaatgtaccccccactggatcccaagctgctggacgcgagaacgacagctttgcttctgagcgtaagtcacctggttctcgtcacacgcaatgcctgccacctcacaggcggactggactggatagatcagtctttatccgcagctgaagaacatctggaggtgctgcgggaagcagctctcgcgagcgagcctgataagggactgcccggccctgagggcttcttgcaggagcagtccgccatttag

SEQ ID NO: 31640 - DNA, 681 bp, Artificial Sequence
  Description of Artificial Sequence: Synthetic coding sequence
atggaaacagtagtcattgtcgcaataggtgtgctggcaacgatttttctcgctagtttcgcagctctggtgctggtttgtcgacaaaggtactgtcgtccaagggacctactgcagagatatgacagtaagcccatcgtggatctgatcggggcaatggaaacacagagtgaaccatccgaactggagctggacgacgtggtcatcacgaaccctcacatagaggccattctcgagaacgaggactggatcgaggatgcctcaggcctgatgtcccactgcattgccattctcaagatttgccatactctgacggagaagttggtggccatgacgatgggatccggagccaagatgaagacctccgcatccgtgagtgatataattgtggtcgccaaacgcatcagtcctagggttgacgatgttgtgaaatccatgtatccgcccttggaccccaagctgttggacgcacggaccactgctttgcttttatccgtgtcacacctcgttctggtaaccagaaatgcatgccatcttaccggaggattagactggatagatcagtccctctctgccgccgaggagcacttggaggtacttagggaggcggcgcttgcgtctgaacccgataaaggcctgccagggcccgaagggtttctgcaagaacagtccgcaatttag

SEQ ID NO: 31641 - DNA, 414 bp, Artificial Sequence
  Description of Artificial Sequence: Synthetic coding sequence
atggaaacagtcgtaatcgtcgccatcggcgttctggctacaatttttctggcatcttttgccgccttggttctcgtatgtaggcaaaggtattgtaggccgcgggatttactgcagcgttacgattctaaacctatcgttgatctcattggggcaatggaaacccaaagcgaaccatctgagctggagttggacgacgtcgtgatcactaacccccacatcgaagctatactcgagaacgaggactggattgaggatgccagcgggctgatgagccattgcatcgcaatcctgaaaatctgtcatactctgacagagaaactcgtggctatgaccatgggtagcggggcaaagatgaagacctccgcctccgtgtctgatatcatcgtagttgcgaagcgaatcagtccatag

SEQ ID NO: 31642 - DNA, 669 bp, Artificial Sequence
  Description of Artificial Sequence: Synthetic coding sequence
atggagactgtcgtcatcgtggctataggggtgctggcgactatcttcttggcctcgtttgccgcccttgtgcttgtgtgccggcaacgctactgccgccccagagacctgctgcagcgctacgattcaaaaccaattgtggatcttatcggagccatggagacacagtcagagccctcagaacttgagctagatgacgtagtgatcaccaatccccacattgaggctattctggagaacgaagattggattgaggatgcctcagggctcatgtcgcactgtatagctatactgaaaatctgccacaccctgacagaaaagcttgtggcaatgactatggggtcaggcgctaaaatgaaaacgtcagcatcagtcagcgacattatcgttgtagctaagcgcatctctcctcgcgtggacgacgttgtgaaatcaatgtacccacctcttgaccccaagctgctcgatgcacgaacaactgccctactgctgagtgtgtcacacctggttttggtcacgcgcaacgcatgtcacctgacagggggtctggattggattgatcagtccctgagcgcggccgaggaacacttagaagtgctgagggaagccgctctcgctagtgagcccgacaagggattgcctggacccgagggcttccttcaggaatag

SEQ ID NO: 31643 - DNA, 681 bp, Artificial Sequence
  Description of Artificial Sequence: Synthetic coding sequence
atggagactgttgtgatcgttgccattggcgttctggccactatcttcctggcatctttcgccgcgctcgtgttagtgtgccgacaaagatactgtaggccacgggaccttctccaacgatatgactccaaacctatcgtggatctaatcggtgcaatggaaacacagtccgaaccgagcgagctagaactggatgatgtggtcatcacaaatccccacatcgaggcaattctggagaacgaggattggatcgaggacgcatccggtctgatgtctcattgcatagccatcctaaagatctgtcatactctcaccgaaaaactggtggccatgaccatgggctcaggggcaaaaatgaagacttctgcttcagtaagcgacatcattgtggttgccaaacggatttctcctagggttgacgatgtggtgaaatcaatgtatccccccctggacccaaagctgctcgacgctcgcaccactgcactgcttctgagcgttagtcatctagtcctggtcactcgcaacgcctgtcacctgaccggcgggctggactggatcgatcaatctttgagtgcagctgaggagcatttagaggtgttgcgcgaggctgctttggcatccgaacccgacaagggcctacccggccccgaaggctttcttcaggagcagtctgctatctag

SEQ ID NO: 31644 - DNA, 777 bp, Artificial Sequence
  Description of Artificial Sequence: Synthetic coding sequence
atggtgggcatattgcccctgtgttgtagcgggtgcgtcccttcgctttgctgtagcagttatgtaccgtctgtggctccaacagccgctcactctgtgagagttccacattctgctggacactgcgggcaaagggtgctcgcgtgttccctcccgcaagtgttcttgaagccttggattttcgtcgagcactttagctcctggctcagtcttgagttgttctctttcctcagatatctggggaccctgctgtgcgcatgtggccacagactgcgtgaggggctgctgctaccatgcctcttgggggtcggctcttggctgctctttaataactggaccggagggtcatggttcagccttcatctccaacaggtttctttatctcaggggtcacacgtggctgcctttctaccagaggccatcggtccaggggttcccgtccccgtgtctggagagagtacctctgctcaacagtctcatgcaggttggcagctgagcgccgaggccgatgcttgtccttcggtgttgtactcagaagtgctggagtggaacaaaaacattaatacgtatacatcatttcacgatttctgccttattctgggaattttcctgttctgtttcgtgttagcagtgataggtctcccctacattaagcccggactgtccctatctgttgccctgctatggcaaagcctgattctgctctcctctctagtccagcaagattcccaggtgcatacctggggttgcctcttttccaccttcacctcaacttag

SEQ ID NO: 31645 - DNA, 570 bp, Artificial Sequence
  Description of Artificial Sequence: Synthetic coding sequence
atggtggggatcctacctctttgctgctctggctgtgtgccctctctctgttgcagctcatacgtgccaagtgtggcaccaaccgctgcacattctgtgagggtccctcattctgctgggcattgcggtcaacgggtcttggcctgtagcctgcctcaagtattcctgaagccttggatctttgtcgagcatttcagctcctggctttccctggagctgttcagtttcctgcggtacctgggcacgctactctgcgcctgcggccaccggctgagggaggggctacttcttccatgtctgctgggagttgggtcttggctcttgttcaataactggaccggcggctcttggttttcactgcacctgcagcaagtgtccctcagtcaggggtctcatgttgcagccttcctgcccgaggctatcggaccaggcgtgcccgtccccgttagtggtgagagcacatcagcccagcagagtcacgctggctggcagcttagtgccgaagcagacgcgtgtcctagtgttctgtacagtgaagtgttggagtggaataaaaatatcaatacgtag

SEQ ID NO: 31646 - DNA, 507 bp, Artificial Sequence
  Description of Artificial Sequence: Synthetic coding sequence
atgccgaaaggatggggtgtgcgatctagtacgtttctacctctatggctgcctgtgaaaatagagttacaccaggtgcaatttcattcaagcagccaaatgattttctcaacactgagaagtgaactttacaagctcctcgccctgtgtcagcacgcagttgtacctatgggaaagtttctgggcaaaaccaagacccagtcccagggccaagtggtaatcttttcagagaagggaaaggcaatcatttacctatccctcccccgcactgtgcccatctacacctgtattttctcccagtcagtgggttgcctctttattctgttgattattagcctcaattttcttctgttcatctattttatcgaaaccgaccttatcatgttgccacgcgtgatcctcgacctcctcgcatccagcgatcccccaacattggttagccaaagtgctggaataactgacgtgaactatcatactcagagcacatgtagacgattctctgtgtag

SEQ ID NO: 31647 - DNA, 1362 bp, Artificial Sequence
  Description of Artificial Sequence: Synthetic coding sequence
atggcaatttttcgtcagctgtctctgggagccaaagccaccctggccgcggttaccgtcttcgtgtctatgattgcctcccgtagttacctggccgaatcactggaactccgcgcttggagatggctcctccggctgcagctggctctgttcgttaactccctgctgctcataggtagcctctacatctggcgctctactgtcagcaatctctgtcactccccagctgcagaaagcacctgcttccagctgtggaaagtggtggtgttggcattcttagctttagcccattcatcgttttttacaatgttcttcctggtcgccgaggagccgtaccttttctccctggccgcctacagctgtctgggggcttacatcatcatgctcttttttctgtttattctgagcggaatggaacaggcttaccagttgctggcctggaggtcgggccgagtggtggggagccttgaaaagacacgcaagctggtgctgcgaccagcactggctgttggtgtcacagctgtgctctcagttgccggcatcctgaacgctgcgcaaccccccgctgtcaaaacggtagaagtgcccatacaccaactgcctgcttcaatgaataatctgaagatcgttctgttaagtgatattcacctggggcctacagtcgggcgcacaaagatggagatgttcgtaagaatggtcaatgtactggaaccagatatcactgtaattgtgggcgacttgagtgactctgaagctagtgtgctgcgcacggccgtggccccacttgggcagctgcactctcatctgggggcttatttcgttactggcaatcacgagtattataccagtgacgtgagcaattggttcgcattgttggagagtttgcatgtgcagcccttgcacaatgagaatgtcaaaatctccgccacaagggcccagcgcggcggcggaggtagcgggtctggatccgaagacgaggattggatctgtcttgctggagttgacgatatcgaggccgacatcctccactatagtggacatgggatggatctggataaggctctggagggatgctcccccgaccacaccatcatcctcctggctcaccaaccactggcagctaagcgggcccttcaggcccgcccagacataaatctcatcctatcaggacatacccacgctggacagatctttcctcttaatgtggcagcttacttactgaaccccttcttcgcggggttataccaggtcgctcaggcaacgtttgtttacgtatcccccggtacagcttactacggcatacctatgcgtttagggagccgagcagagatcacagaactgattctccagaggtccccgtag

SEQ ID NO: 31648 - DNA, 951 bp, Artificial Sequence
  Description of Artificial Sequence: Synthetic coding sequence
atggagcaggcgtaccagctactggcatggaggtccggtcgggtggtggggtcactggagaagacacgcaaactggttctacgtcctgccctggcagtcggggttaccgcagttttaagtgtggccgggatcctgaacgccgcgcagccccccgcggtgaagactgttgaagtgcctatccatcaactgcctgcttcgatgaacaatctgaagatcgtgctgctgtccgacattcatcttggcccaacagtgggcaggaccaagatggagatgtttgtgcgaatggttaacgtgctagagccggacattactgtgatcgtgggggatctttctgactcggaagcgagtgttttgcggactgccgtggccccactcgggcagctgcactctcatctgggcgcgtatttcgtgactgggaaccacgagtactacacctcagatgtgtctaattggttcgccttactggaatcgctgcacgtgcagcctctgcataacgaaaacgtcaagatcagcgctacccgggctcagcgcggtgggggggggagcggatccggcagcgaagatgaagactggatctgcttagctggtgtggatgatattgaagcagacattctgcactatagtgggcacgggatggacttggacaaagccctcgaagggtgtagcccagaccatacaattatactgcttgctcatcaacccctggcagccaaacgcgcactgcaggcacgaccagacattaatttgatcctttcaggacatacccatgcaggccaaattttccctttgaacgtggcagcctatctgctgaatccttttttcgcaggactctaccaggtcgcccaggccacatttgtgtacgtctctcctggcactgcttattatggtataccaatgagattggggagcagagccgaaattaccgaacttatactgcagcggtcaccctag

SEQ ID NO: 31649 - DNA, 882 bp, Artificial Sequence
  Description of Artificial Sequence: Synthetic coding sequence
atggacaccctcgaggaggttacctgggccaacggctctacagccttaccacctcccttagcacctaacatttccgtgcctcacaggtgtctattgctcctgtacgaagacatcggaacctcccgtgtaagatattgggatctgctacttttgatcccaaatgtgctgttccttatatttctgctgtggaagttaccgtcagctcgcgccaagattaggatcacctcaagtcccatttttataactttttacatcctggtttttgttgtcgccttagtgggtatagccagggctgtggttagtatgaccgtctcgactagcaatgcggccacagtggccgataagattctctgggagataaccaggttcttcctgcttgcgatcgagttgagtgtcataatattgggcctcgcctttgggcatcttgaatcgaagagcagtataaaaagggtgctcgcaattaccaccgtgctgtccctagcctatagtgtgacccaaggcactttagagatcttgtatcccgacgctcacctgtccgcggaggatttcaacatctacggccacggagggagacaattttggcttgtgagttcgtgttttttctttctgctgtgcaggtgccacaacctgccagtgctgcagctcttgagatcagctcacctcaggggtttccctccaggtctcctacgcctgggcgctcaagaccccctgcttctccaaatgccatccggtcgggaccggggagcccgttgtactcccacccccgctctgagatgtggtccagcaggaggcccagggggatgccggggctgttgggggctgtcttgtcagcttctcgaacacgcggtgcgattgtgccgccggggaggtctacctgggtag

SEQ ID NO: 31650 - DNA, 1122 bp, Artificial Sequence
  Description of Artificial Sequence: Synthetic coding sequence
atggatacactcgaagaggtgacatgggcaaacggttcaactgccctgccacccccccttgccccaaatatttctgtcccacacagatgccttctgctgctctacgaggatataggcacatcgagagttcggtattgggatcttctcctgctgataccaaacgtgctgttcctgatcttcctgctgtggaagctcccttccgctcgtgccaagatccgcatcacctccagtccaatttttataactttctacatcctggtgtttgttgtggccctggtcggcatagcccgggctgtagttagcatgacagtttccacatcaaatgctgcgactgtggctgacaagattttgtgggagattacacggttcttcctgctggcgattgagctgtcagtgatcattctagggctggccttcggccacttggaaagcaagtcttccatcaaacgcgtactggcaatcactactgtcttgagccttgcatactctgtgacacagggtaccttggaaatcctctatcctgacgctcaccttagcgctgaggacttcaatatttatggtcacggtggccgtcagttttggctcgtaagttcgtgcttcttcttcctggtctacagtcttgtggtaatcctgcctaagaccccacttaaggagcgcatttccctcccctcaagacggtccttttatgtgtacgccggcatcctggcactcctgaatctcctgcagggtcttggaagcgtcttgttatgctttgatatcatagagggcctttgttgcgttgacgcaacaacctttttgtatttctccttcttcgcaccgcttatctacgtggcctttcttcgtggcttctttggctcagagcccaaaattctattctcctacaagtgtcaggtggacgagaccgaggagccggacgtgcacttgcctcagccgtacgctgtggccagacgcgaaggtcttgaggcggcaggcgcagctggtgcttcagccgcgagttactcttcgacccagttcgactccgccggaggtgtggcatacctggacgatattgcctctatgccatgccacactgggtcgattaactctacagattctgagcggtggaaggctatcaatgcgtag

SEQ ID NO: 31651 - DNA, 1122 bp, Artificial Sequence
  Description of Artificial Sequence: Synthetic coding sequence
atggatacactggaggaggtcacttgggctaatgggtctacagccttacccccccctctggcccccaacatctcagtgccccatcgatgccttcttctgctttatgaggatattggaaccagccgggtacgatactgggacctgctgctgttaatcccgaatgtgctgttcctgattttcctgctttggaaattgccctccgctagagccaaaatcagaattacgtctagccctatttttattacattttacatcctggtgtttgttgtggcacttgtggggattgcccgcgccgtcgtttctatgaccgtctctacttcaaacgcggccactgtggctgacaagatcctctgggagattactcgcttttttctcctggcgattgagctgagcgtcatcatcctgggcctggcatttggacaccttgagagcaagagttctatcaagcgtgtcttggccatcactacggttctaagtcttgcttatagcgtaacgcagggtacccttgagattttgtatcctgacgcccacttaagtgctgaggactttaacatctacgggcatgggggcagacagttttggcttgtgtcgtcttgttttttctttctcgtgtatagtttggtcgtgatcctgccaaaaacgccgttgaaagaaagaatcagtttaccaagtagacggagcttttatgtgtacgccggcattttggccctgctcaacctgctccagggactgggatccgtcctgctgtgctttgacatcatcgagggtctgtgctgtgtggatgctacaacttttctatatttctcatttttcgcccccctgatatacgtagcatttctcagagggttcttcgggtctgaaccaaaaatacttttcagctacaagtgccaggtggacgaaacggaggaaccggacgtgcatctgccacagccctacgccgtggcacgtagagaaggcctagaggcagcaggtgctgctggcgccagtgctgcctcctactcttcaactcagtttgattctgccggcggtgtagcttacctagacgacatagcttctatgccctgtcacaccggctctatcaacagcaccgactctgagcggtggaaggccattaacgcttag

SEQ ID NO: 31652 - DNA, 126 bp, Artificial Sequence
  Description of Artificial Sequence: Synthetic coding sequence
atggacactctcgaagaagtaacttgggcaaatggctctactgcattgccaccccccctggcacccaacatctccgtaccgcacaggtgcctgctgttactctatgaggatattgggactagctag

SEQ ID NO: 31653 - DNA, 612 bp, Artificial Sequence
  Description of Artificial Sequence: Synthetic coding sequence
atggatacactcgaagaagtcacatgggcaaatggatctacagcattaccccctccactggcccctaatatttctgtgcctcatcggtgcctgctgctcctatacgaagacattggaacctcccgggttcgatactgggacctcctgttgttgatccctaacgtgcttttccttattttcctgctgtggaagctcccttccgcccgtgcgaagatccgcatcacttcctcccccatattcatcactttctatattttagtctttgttgttgcgctggtgggcatcgcccgggctgttgtctctatgacagtgtccacgtctaatgccgcaactgtagctgataaaattctgtgggagatcacccgatttttcctgctcgcgatagagctgtcagtgattatcctgggtctggcgttcggacacctggagtccaagagctctatcaaacgagttttagccatcacaactgtgctatccctggcctactctgttactcagggcacgctcgagattctgtatcccgacgcgcacctgtccgccgaagactttaatatctacggccatggggggaggcagttttggttagtgagtagctgcttcttttttctgtag

SEQ ID NO: 31654 - DNA, 1122 bp, Artificial Sequence
  Description of Artificial Sequence: Synthetic coding sequence
atggacactctcgaagaggtgacgtgggccaacggctctaccgctctgccgcctcccctagcacccaacatctctgtgcctcatagatgcttgttgctcttgtacgaagacatcggcactagtcgggtgcgctattgggatctgcttctactgattcccaatgtactgtttctgatttttctgctatggaagcttccatcggcccgggctaagatcagaatcacctctagccctatctttatcactttttatattttagtcttcgtggtggccctcgtgggaattgcgagggctgttgtgtccatgacagtgtctacctctaatgctgccacagtcgcagacaagattctctgggagattacccgcttctttctactggccatcgagcttagcgtgatcatactgggcctcgctttcggacatctggagtcaaaaagtagtatcaaacgcgtccttgccataactactgtcctgtctcttgcttacagcgtgacgcagggtaccctggaaatcctctatccagatgcccatttgtcagcggaagactttaatatttacgggcacggtggaaggcagttttggttagtaagtagctgtttcttcttccttgtttattctctggtggtgatactcccaaagacgccccttaaagaaaggatttctctaccttcaagacgaagcttttacgtgtatgcaggtattcttgcactcctgaatttactccaaggactgggctctgtgctcttgtgcttcgatatcatcgaaggcttatgttgcgtcgatgccactacctttttgtacttctccttcttcgccccattgatttacgtcgctttccttcgtggatttttcggcagcgagccgaagatcttattttcttacaagtgtcaggtagatgagaccgaagagcccgatgttcacttgcctcaaccatacgcggtagcccggagagaaggtttggaggccgcaggcgctgctggggcctccgcagcctcctactcaagtactcagtttgactccgcggggggcgtggcctatctggatgacatcgcatcgatgccctgtcacaccggcagtattaatagcactgactccgagcgctggaaggctatcaatgcctag

SEQ ID NO: 31655 - DNA, 615 bp, Artificial Sequence
  Description of Artificial Sequence: Synthetic coding sequence
atggacacgctggaagaggtgacctgggccaatgggagtacagctcttccccctccgctcgccccaaatatcagtgtgccccacagatgtttactgctgctgtacgaggatattgggacaagcagagtgcgctactgggacttgctgctgctgatccctaacgtgttgtttcttatcttcctgctgtggaagttgccctcagcacgggctaagatcagaatcacatcttcgcccattttcatcacattttacattttggtctttgtggtcgccttggtggggattgcccgggctgtggtatccatgactgtgtcaacaagcaacgctgcaaccgtcgcggacaagatcctttgggaaataactagattcttcctgttagccatcgaattgtcggtaatcatcctgggattggcattcggacatctggagagcaagagtagcatcaagagagttctcgcaatcacaactgtgttgtcgctggcctacagcgtaacacaggggacactggagatcctgtatcccgatgcacacctatccgccgaggacttcaatatttacggtcacggtggacgacagttttggctcgtgtcctcttgtttcttttttctggtctag

SEQ ID NO: 31656 - DNA, 501 bp, Artificial Sequence
  Description of Artificial Sequence: Synthetic coding sequence
atggatacgctggaggaagtgacttgggcgaacggttctaccgcactcccgccccctctggcccccaacatctcggtgcctcaccgctgcctgctactcctgtatgaggacatcggtacttctagagtcaggtactgggacctcttactactgatccccaacgtgttgttcttgatattcttactttggaaacttccttccgcccgggcaaagataagaattacgagtagccccatttttattaccttctacattttggtgttcgtggttgctctggtaggaatcgctcgcgcagtagttagcatgaccgtgtctacgtcaaacgcagccacagtcgccgataagatcctttgggagataaccaggtttttccttctggcaattgagctaagcgtgattatactcgggctagccttcggtcaccttgaatcaaagtctagcatcaagcgcgttcttgctatcacaacggtcctcagccttgcctactcagtcacccagtag

SEQ ID NO: 31657 - DNA, 390 bp, Artificial Sequence
  Description of Artificial Sequence: Synthetic coding sequence
tgaagtgaggtccccctcccccctggtgctctggctaccctatctagtagctgcagcctgggtgtcgctctgcacagatcctctccagccagtaggggcccaggcgagtcttccctgccagccttttccggcgtcgcgcttctacccccagcatgcaaagcaggtctgccttacaacctttctcgacaggagggacacctgacatgcttatctatccctgacatcaaaaccgccttctcggattgcacgagcaaaattggccggcgtgactgtctgactcaggcttgcagtgcactgactggcaagggtgtccgggaggggattgagtggatggtgaaatgcgtagtcagaaacgtgcaccgaccacccaggcaacgggacattacgtag

SEQ ID NO: 31658 - DNA, 1158 bp, Artificial Sequence
  Description of Artificial Sequence: Synthetic coding sequence
atggttctgatgcatctcgcggtcaagaacaacaggatgtccgcaaacaatgatcatttcctgactcctacctggcagcagatgcgcgccacccctcttgccgcccctgctggatccctcagcaggaagaagaggttggagctagatgacaacctggacaccgaaaggccggtgcaaaagagagctcgatccggacctcaaccacgcctccctccatgtctgcttccgctgtcccctcccaccgcacccgaccgagcgaccgccgtggcaacagcatcaagattagggccctatgtgctgctcgaacctgaggaaggagggagggcctaccaggcccttcactgtccaaccggcacagagtatacctgcaaagtgtaccctgttcaggaggcccttgcggtgctagaaccttatgcacgcctcccgccccacaaacacgtcgcaaggcctaccgaggtgctggccggtactcagcttctatatgccttttttacccggactcatggggacatgcatagtttagtgcgctctcgccacagaattcccgagcccgaggccgccgtactgttccgtcagatggcaactgccctagcacattgtcaccagcacggcttggtgctccgagacctgaagctctgtcgctttgtgttcgctgacagagaacgcaaaaagctcgtgctcgagaatttggaggacagctgcgtccttactggcccagacgactctctgtgggacaaacatgcctgtcctgcttatgtggggcccgagatcctttctagtcgggcgagctacagtggtaaagcagccgacgtttggtctttaggcgtggccttgttcacaatgctggcgggccattatcccttccaggattccgaacctgtactgctgttcggcaaaatcaggcgcggcgcatacgcgcttcctgcaggcctgagtgccccagccagatgcctggtgcgctgtctgttgcgccgcgagcctgctgagcgactgacagctacagggattctgttgcacccctggctgcgccaggaccccatgccactggcacccacacgaagtcatctgtgggaagccgctcaggtggtgcccgacggtctgggactagacgaggcccgcgaggaggagggcgaccgggaggtggttctgtatggatag

SEQ ID NO: 31659 - DNA, 816 bp, Artificial Sequence
  Description of Artificial Sequence: Synthetic coding sequence
atgcgggccacccctctcgctgcccctgccggtagcctgtctcgaaaaaagcgcttagaactggatgacaatctcgatacagagcgccctgtccagaagcgtgccaggtctggtccgcaaccaagattgcccccctgccttctccccctctcccctccgaccgcaccagaccgcgccaccgctgtggccaccgcctctcgcttagggccatatgttctgctggagcctgaagaaggaggccgggcctaccaggccttgcactgtccaacaggaacagagtatacgtgtaaagtctaccctgtccaggaggctctggctgtgctggaaccttatgctcgtctgccgccacacaaacacgtggcgagacctaccgaagtgctagcggggacccagctgctctatgccttttttacccggacccacggcgatatgcattcactagtgagaagccgccaccgcatccccgaacctgaggccgctgtgctgtttcgacagatggccaccgctctggcacactgccatcagcacggtctggtgcttcgcgatttgaagctatgtcgattcgtgttcgccgacagggagaggaaaaagcttgtgctagaaaatttggaggactcctgtgtgcttactggcccggatgacagtttatgggataagcacgcatgtccagcctacgttggtccagagatcctgtccagtcgagcctcatactctgggaaagccgccgatgtctggtctctgggcgtggctctgttcaccatgctagcggggcattacccctttcaggattcggaacccgtgctgttattcggctag

SEQ ID NO: 31660 - DNA, 1188 bp, Artificial Sequence
  Description of Artificial Sequence: Synthetic coding sequence
atggcctcagctgcatccgtgacaagcctggctgacgaggtgaactgtccaatctgtcaggggactctgcgcgagcccgtgacaatcgactgtggccacaatttctgtagagcctgcctgacgaggtattgcgaaataccaggacccgatctcgaggaatctccgacatgccctctctgtaaggaaccttttaggccaggttcctttaggcctaactggcagctggccaacgtagtcgagaatattgaacgcttgcagctggtttctaccctgggacttggtgaagaagatgtgtgccaggagcacggcgaaaaaatatattttttctgtgaagacgatgaaatgcaactgtgcgtcgtctgcagggaggccggagaacacgccacccacactatgagatttttagaggacgccgctgccccatatcgcgagcagatccacaagtgcctgaagtgtctgcgtaaggagagggaggagattcaagaaattcagagcagagaaaataagcgtatgcaggtgctactcacccaggtgagcacaaagcggcagcaggttataagtgagttcgctcacctgcgcaagtttctggaggaacagcaatcaattctcttggcacagctggagtctcaggacggggatattcttaggcaacgcgatgagtttgacctactggttgcaggcgaaatttgtcgattctctgccttgattgaggagctagaagaaaagaacgagcgccctgcaagagagctgttgaccgatattaggtccacactcatccgatgcgagacacgaaagtgcaggaagccagtggccgtgtcccctgagctgggccagagaatccgggatttcccccaacaggccctgccgctgcagagagagatgaagatgttcctggaaaagctgtgctttgagctggactatgaaccagcgcacatctcattggatcctcagacaagccacccaaagctcctcctgtccgaggatcaccaacgagcccagtttagttacaagtggcagaattcccccgacaatccccaacgttttgatcgcgctacgtgcgtgcttgcacacacaggaattaccggggggcgtcacacctgggtctggatggcgcgagtgcctggagacagtggctgttgccagttttgttctcccccaagcgttctgggcactgaggtagccgcgtag

SEQ ID NO: 31661 - DNA, 1446 bp, Artificial Sequence
  Description of Artificial Sequence: Synthetic coding sequence
atggcaagcgcagcatccgtaacctctctcgccgacgaagtcaactgtcctatctgccagggtaccctgcgcgaacctgtgaccattgactgtggccataacttctgccgggcctgcctgaccagatattgtgagatcccaggccctgacctcgaagaatcaccaacatgccctttatgtaaggagccattccgccccggttcgttccgaccaaattggcagctagcgaatgtcgtggaaaatatcgaaaggcttcaacttgtaagcaccctcggcctgggtgaagaggacgtgtgccaggagcacggggagaagatatattttttctgtgaggatgatgaaatgcaactgtgtgtggtttgtagagaggctggggagcacgccacgcacaccatgaggttcctcgaggacgccgctgcaccatatcgcgagcagattcacaaatgtcttaaatgtctccgcaaagagagagaagagatccaggagatacagagtagggaaaataaaagaatgcaggtcctgctcacccaggttagtaccaaacgccagcaggtgatctcagaattcgcccatttacgtaaattccttgaggagcaacagtcaatcctattagcccaactggaatcacaggatggagacatacttaggcagcgcgatgagtttgatctgctggtcgcaggggaaatctgccggtttagtgcactgattgaggagctagaggagaagaacgagcgccctgctagggaactgctcacagacatcaggtccaccctcattcgctgcgagaccaggaagtgtcgaaagcctgtggccgtaagcccagaactgggacagcgcattcgcgactttcctcagcaggctctcccacttcaacgcgaaatgaagatgtttctcgaaaaactctgttttgagctcgattacgaacccgcccatatctcactcgatcctcaaacatcccaccctaaactgctgttatccgaggaccaccaacgcgcacagttctcttacaagtggcagaactccccagacaaccctcagagatttgatcgcgcaacgtgtgtgctagctcataccgggatcactggaggaaggcacacctgggttgtttccatcgatcttgctcacggcggatcttgtacagttggggtcgtgagcgaggacgtccagcggaaaggggagctgcgcttaagacctgaggagggtgtatgggccgtcaggctggcatggggctttgtatcagctttaggaagtttcccaactcgtctaactttgaaggagcagccccgccaggtgcgggtcagcttggattacgaggtggggtgggtcacttttactaatgcagtgacacgggaacccatctacactttcacagcatccttcacccgaaaggtgataccattttttggcctttggggcaggggatcaagcttctctctctcctcttag

SEQ ID NO: 31662 - DNA, 1446 bp, Artificial Sequence
  Description of Artificial Sequence: Synthetic coding sequence
atggcatccgctgcgtccgtgacatcattagcagatgaggtgaactgtcccatatgccagggtacactgcgtgagcctgttaccatagattgtggccacaacttttgtcgggcttgcctgactcgatattgtgagatcccaggccccgacttggaggaaagccctacatgccctctctgcaaggagccattcagaccaggcagttttagacctaactggcaattagcaaatgttgtcgagaatatagagaggctacaactggtgtccactttgggactcggagaggaggacgtttgtcaggagcatggagagaagatctacttcttttgtgaagatgatgaaatgcagctgtgtgtggtctgcagggaagcgggggagcatgcaactcacaccatgcgcttcctcgaagacgctgctgctccttatcgcgagcagatccacaagtgtctgaagtgcctacgcaaggagagagaggagattcaggaaattcaatcacgtgaaaataaaaggatgcaagtgttactgacccaggtcagtacaaagagacaacaagtgatatctgagttcgcccacctgcgcaaattcctggaggagcagcaatcaatcctacttgcccaactcgaatctcaagatggggacatcctgcggcagagggacgaatttgatttactggttgcaggagagatctgcagattctccgcactgattgaagagttagaagagaaaaacgaaagacccgctagagaactactgactgatatccgatctactctgatccgctgcgagaccagaaagtgcagaaagcccgtggccgtgagcccagaactgggccagcgtatccgcgacttcccacagcaagctctgccccttcagcgtgagatgaagatgttcttggagaatctacccaaccatctcgttatacctacagcacacatctccctggatccccaaacctcccatcctaagcttcttctcagcgaggaccaccagagggctcagtttagttataaatggcagaactcccctgataatcctcaacgatttgacagagctacctgcgtgttggcacacaccgggatcacagggggtaggcacacctgggtagtgtccattgacctggcacacggaggttcttgtacagtgggagtggtctccgaagatgtgcagagaaagggcgaactccgacttaggccagaagaaggcgtgtgggctgtgaggctcgcctgggggttcgtcagcgccttaggtagctttcccacccgcctaacgttaaaggagcagcctagacaggtaagggttagtctggattacgaagtgggctgggtgactttcacgaatgccgtgacccgggaaccaatttatacctttactgccagctttacccggaaggtgataccattcttcggactttggggtcgaggatcctccttttctctttccagctag

SEQ ID NO: 31663 - DNA, 1695 bp, Artificial Sequence
  Description of Artificial Sequence: Synthetic coding sequence
atggcggaattggatttaatggcccctggtcctctgcccagggctaccgcccagccgcctgcacccctgagccctgactccggcagcccttctcctgattccgggagcgcgtcacccgtggaggaggaagacgttgggagtagcgagaaactcggaagagagactgaagaacaggattctgattctgccgaacaaggggaccccgccggagaggggaaagaggtcctgtgtgatttctgcctggacgatacccggcgcgtgaaggccgtgaagagctgtctcacttgtatggtgaactattgtgaagaacatctgcagccccaccaggttaacataaaattgcagtcacatctgttgaccgagcccgtcaaggaccataattggaggtactgcccggcgcaccactctccactttcagcattctgctgccccgaccagcaatgcatttgtcaggattgctgtcaggagcattctgggcacaccatcgtgtccctcgatgccgcccggcgagacaaagaggctgagttacaatgtacgcagctggatcttgagaggaaacttaagcttaatgagaatgccatatcaagactgcaggcaaaccagaagagtgtccttgtgtctgtaagtgaggtcaaagctgttgctgaaatgcagtttggcgaattgctcgctgccgtccgtaaggctcaggccaatgtgatgctcttcctggaggagaaggaacaggccgccttatcgcaagcaaacggcattaaagctcatctggagtatcgatcagccgaaatggagaaatctaagcaggagctcgagaggatggccgccatttccaatacagtccagtttctagaagagtattgcaaattcaaaaatacagaagacatcacgtttccctccgtgtatgtcggtttgaaagataagctttccggaattcggaaggtcataacggagagcactgtgcatctgatccaactgttagagaattacaaaaagaaacttcaggagttttccaaggaggaagaatatgacatccgaacccaagtctctgccgtggtccagcgaaaatactggacttcaaagcctgaaccatctaccagagagcagtttctgcagtatgcgtatgacataaccttcgaccccgacacagctcacaagtacctcaggctccaggaggagaatcgtaaggtgacaaacactacaccatgggaacatccctaccccgacctcccttcgaggttcttacactggaggcaggtcctgtcccaacagagcctctatctgcaccggtactacttcgaggtggagatttttggcgcagggacgtatgtgggactgacttgcaagggtatcgaccgaaagggggaagagcggaactcttgcatctcaggaaacaatttctcttggagcctgcagtggaacggtaaggaatttaccgcttggtattcggatatggaaacaccccttaaggccggcccctttaggcgattgggcgtttacatcgatttcccaggaggcattctatcgttttacggagtcgaatatgacacaatgaccttagtacacaaatttgcttgcaagttctcagaacctgtgtatgccgcgttctggctgtcaaaaaaagagaatgccatacggatcgtggacctgggagaggaacccgagaagccggctccaagccttgttggaacagcaccatag

SEQ ID NO: 31664 - DNA, 1695 bp, Artificial Sequence
  Description of Artificial Sequence: Synthetic coding sequence
atggccgagctggatttgatggcaccagggccactgcccagggccacggctcagcctccagcgcccctcagtcctgactctggctctcccagtcccgattcggggtctgctagtcctgtggaagaggaggatgtcgggagctccgagaagctcgggcgagagacggaggaacaggattcggactcagctgagcagggtgatccggctggagagggaaaagaggtgttgtgcgacttttgtttagatgatacgcgcagggtcaaagcagtgaaatcttgtctgacgtgtatggtgaactattgcgaagagcatctgcagccacatcaggtgaacatcaagctccaaagccacttgcttacagagccagtgaaggaccataactggcgttactgtccagcacaccactctcccctttctgcattttgctgtcccgatcagcagtgtatttgccaagattgctgtcaagagcactctggtcatacaatcgtttcccttgacgcagccagaagggataaggaagctgagctgcagtgcacccagctcgacctggagaggaagctgaagctgaacgagaacgccataagtagattacaggccaaccagaaaagcgtgctagtttctgttagcgaagtgaaggcagttgcagaaatgcaattcggtgagctgctcgccgccgttcggaaagctcaggccaatgtcatgctgttcctcgaggagaaagagcaagctgcactgtcccaggccaacggtatcaaagcgcacctagaatataggagcgccgaaatggagaaatctaagcaggagctcgaacggatggcagctatttccaacacggtccagttccttgaagagtattgcaagttcaagaacaccgaggatattacattccctagtgtttacgtcgggctcaaagacaaactcagcggtattaggaaggtgattacggagtctactgtgcatctaatacagcttctggagaattataaaaaaaagctgcaagaattctctaaagaggaagagtacgatatccgaacccaggtgagcgccgttgtccagcgaaagtactggacatcaaaacctgaaccctccactcgcgaacaattccttcagtacgcgtacgatatcaccttcgaccctgacaccgcccacaaatacctgagactgcaggaagagaatcgcaaggttactaatactactccttgggagcacccttatcccgatcttccatccaggtttctgcactggagacaggtcctcagccagcagtccctgtatctgcaccggtactatttcgaagttgagatatttggcgccggcacttatgtggggctgacttgcaagggaatagaccgcaaaggcgaagaaagaaactcttgcatcagtggcaacaatttttcctggagcttgcaatggaacgggaaggagttcactgcatggtattctgatatggagacaccattgaaagctggccccttccgtaggttgggggtctacattgacttcccaggaggtatcctgtcattctacggagtggaatacgatacaatgactttggtccataaatttgcatgtaagttctcagagcccgtgtacgcagccttttggctgtcaaaaaaggagaacgccattaggattgttgacctaggagaggagccagaaaagccagccccaagcctggtgggaactgctccatag

SEQ ID NO: 31665 - DNA, 1425 bp, Artificial Sequence
  Description of Artificial Sequence: Synthetic coding sequence
atggaagcagaagacattcaggaggagctgacctgccccatctgtttagattacttccaggaccccgtttccatcgaatgtggccataatttctgcagaggctgtctccatcggaattgggccccaggtgggggcccctttccgtgtccagagtgccggcacccgtccgcccccgccgccctgcggcccaattgggcccttgcaaggctcaccgaaaagacgcaaagaaggaggctcggtcctgtgccgcctggtctgtgcggcagacactgggagcctctgagattgttttgcgaagatgatcagcggcctgtctgcttggtttgtcgggagtctcaggagcaccagactcacgcgatggcccccatcgatgaagcctttgaaagctatcgggaaaagctccttaaaagccagagaaacctggtggcaaagatgaagaaggtgatgcacctgcaggatgtcgaagttaagaacgctacccagtggaaagacaaaattaaaagccaacggatgcgcatatccaccgagttcagtaagctgcacaacttcctggtggaggaagaggacttgttcctgcagaggctgaataaagaagaggaagagaccaagaagaagcttaatgaaaataccctgaaacttaatcaaaccattgcatccctgaagaaactgattttagaagtgggggaaaagagtcaggccccaacgctggaactcttgcagaatcctaaggaagtgcttacgcgctccgagatccaggacgttaattactcccttgaggcggtcaaagtcaagacagtctgtcagatccccctaatgaaggaaatgcttaagcgatttcaggttgccgtgaacctggcagaggacaccgcccaccccaagctcgtcttcagtcaggagggccgctatgtgaaaaatacagcctccgccagttcatggccggtgttttcatctgcatggaattatttcgccggatggaggaatccccagaagacggctttcgtcgaaaggtttcaacacctgccctgcgtgctggggaagaacgtgttcacaagcggcaaacactactgggaagttgagtccagggactccctcgaagtggccgttggagtctgtcgggaagacgtcatgggaatcacagatcgctctaagatgagcccagatgtgggcatttgggcgatttactggagtgctgcagggtactggccactcatcggcttcccggggactcccacgcagcaggagccagcccttcaccgcgtcggcgtgtacttggatcgcggaactggcaatgtaagcttctattctgcagttgacggtgtacacctccacacattctcatgttcctccgtctctcggctgagaccgtttttctggctttctcctctcgctagcttggtaattcctccagtcactgataggaaatag

SEQ ID NO: 31666 - DNA, 885 bp, Artificial Sequence
  Description of Artificial Sequence: Synthetic coding sequence
atggaggcggaggatattcaggaggagctcacgtgcccaatttgccttgactactttcaggatcccgtaagtatagagtgcggacataacttctgcagagggtgtttgcatcgcaattgggctccaggcggaggcccttttccctgtcccgagtgccgacatccctccgcccccgccgccttacgccccaattgggcgctcgcccggcttaccgagaagactcagcgccgacgcttgggacctgtccccccagggctgtgtggaagacattgggagcctctgagactgttttgtgaggatgatcaaaggccagtgtgtctagtgtgtcgggaatcacaggagcatcagacgcatgctatggctccaatcgacgaagctttcgaatcttatcgtgagaagctcctcaagtcccagagaaacctcgttgccaaaatgaagaaggtgatgcacctccaagatgtggaggtcaagaatgctactcaatggaaagacaagataaagtcccaacggatgcggatttccacagagttctcaaagcttcacaattttttagtggaagaggaggacctgtttctccagcggcttaacaaagaggaggaggaaactaaaaagaagctgaatgagaacaccttaaagctgaaccaaacaattgctagtctgaagaaactgatcctggaagttggcgaaaagtcacaggctcctacacttgagctcctccaaaaccccaaagaggtattgacacgcagcgagatccaagatgtgaattatagcctggaggccgtcaaggtgaaaaccgtctgtcaaataccactgatgaaagagatgctcaagaggtttcaggcgactaaaataaagacacagaagcagaacaggcacaatatgtag

SEQ ID NO: 31667 - DNA, 1503 bp, Artificial Sequence
  Description of Artificial Sequence: Synthetic coding sequence
atggaggcagaagacattcaggaagagttgacatgtcctatctgtctggactacttccaggatcctgtgtcgatcgaatgcggccacaatttctgtagggggtgcctccatcgaaattgggcgccaggcggcggaccatttccgtgccctgaatgccgacatccctccgcaccggccgccctgaggcctaattgggccctggcacgacttactgaaaagacacagaggaggcggctgggaccagtgccaccagggctttgcgggcggcactgggagcccctgagacttttctgcgaagatgatcagcgacctgtttgcttggtatgcagggagtctcaagagcatcaaacacatgctatggcgcccattgatgaagcgttcgagtcataccggactgggaactttgacatccacgtggacgagtggaaaaggcgcctgatacgtctactgctgtaccacttcaaacaggaagaaaaattgctcaagagtcaaaggaatttagttgctaaaatgaaaaaggtgatgcacctacaggacgtggaggtaaaaaacgcgactcaatggaaagacaaaatcaagtcacaaagaatgcggatctccaccgagttcagcaaactccacaactttttagtggaagaggaagatcttttccttcagcgactgaataaggaagaggaggaaacaaagaagaagcttaacgaaaataccctgaaactcaaccaaacgatcgcgtccttaaaaaaactgatcttggaggtcggggagaagtcccaggcccctaccctggaattgttgcagaacccaaaggaggtgctcactaggagtgaaattcaggacgtgaattattccttggaggcagtgaaagttaagacagtgtgtcagattccccttatgaaagaaatgcttaagcgttttcaagtggctgttaacttggccgaggatactgcccatcctaagctcgtgttctcacaggaaggccgctatgtgaagaacacagctagtgcatcaagttggccagtattctccagcgcgtggaactatttcgccggatggcggaacccccagaagactgcctttgtggagcggtttcaacacctgccctgtgtcctcggcaaaaacgtgttcacttccggaaaacattattgggaggtagaaagcagggatagcctggaagtcgctgttggcgtttgccgcgaagacgttatgggtattacggatcgcagcaagatgagtccggacgtgggaatctgggctatatattggtccgccgcagggtactggcccctgattggcttccctggtacccctacccaacaggaacctgccctgcatcgggtgggcgtgtacttagacaggggtactggcaacgtgagcttctacagtgccgttgacggagtgcatttgcatacctttagctgctcttctgtcagccgactccggccattcttctggctgtctccactcgccagcttggtgataccgcccgtgacggatcggaaatag

SEQ ID NO: 31668 - DNA, 993 bp, Artificial Sequence
  Description of Artificial Sequence: Synthetic coding sequence
atgaaaaaagtgatgcacctgcaggatgtggaggtgaagaatgctacccagtggaaagataagatcaaaagccagagaatgcgcatttcgacagagttcagtaagttacacaactttctcgtggaggaggaggacctgttcctccaacgcctgaacaaggaggaggaggagaccaagaagaaactcaacgaaaacaccctaaaactgaatcaaaccatcgcttccctcaagaaacttatactcgaggtcggtgaaaaatcacaggctcctacattggaactgctgcagaatccgaaagaggtgttgaccagatctgaaattcaggatgtcaattattccctggaggccgtgaaggtaaaaacagtctgccagatcccactaatgaaggaaatgctgaaacgctttcaagtggctgtgaaccttgccgaggatactgcgcaccccaagctggtcttttcgcaggagggccgatatgtcaagaatacagcctctgcgagctcgtggcccgtgtttagttctgcctggaattactttgccgggtggagaaacccccagaaaaccgcctttgtggaacgtttccagcatctgccctgcgtcctgggtaaaaacgtctttacctcaggaaagcactattgggaagtggaatcacgagatagcttagaggtggccgtcggcgtgtgtagggaggatgtcatgggaattacggataggagcaaaatgagccccgatgtcggaatttgggcaatctactggtccgccgccggctactggcccctgatcgggtttcctggaacaccaactcagcaggagcctgctctccaccgcgtgggggtttacctggaccgggggaccggcaacgtttctttttacagcgctgttgatggggtgcatctccacaccttctcctgcagctctgtctccagattgcgacccttcttttggctatccccattggcatcactagtcatcccccccgtaaccgacaggaagtag

SEQ ID NO: 31669 - DNA, 1212 bp, Artificial Sequence
  Description of Artificial Sequence: Synthetic coding sequence
atgcacaattttgaggaagaattgacttgcccaatctgttactccatctttgaggaccctcgggttctgccttgcagtcacaccttttgccgtaattgccttgagaacattctgcaggccagcggcaatttttatatctggcgccccctgagaatcccactgaagtgtcccaattgtcggtccatcactgagattgcaccgactggcatcgagtccttgcccgtgaacttcgcactgagggcaataatcgagaagtatcagcaagaggatcaccccgacatcgtgacctgccctgagcactacagacaacctctcaacgtctactgcctccttgataagaaactggtctgtggacattgcttgacaatcggacagcatcacggacacccaattgacgacttacaatcagcttacttgaaagagaaagatacccctcagaagttgcttgagcagcttaccgatacacactggaccgatttaacacatttaatcgaaaagctgaaggagcagaagagccatagcgaaaaaatgatccagggcgataaggaggctgtcctccagtacttcaaggaactgaacgacacccttgagcagaagaaaaaaagcttcctgaccgccctgtgcgatgtgggaaatttaatcaatcaggagtacacaccgcagatcgagcgtatgaaagagatccgagaacagcagttggagttaatggctctcacgattagcctgcaagaggaatcacctcttaagtttctggaaaaagtcgatgatgtgagacagcatgtccagattcttaagcagcggccgcttcccgaggtgcagcctgtggagatttatcctagggtctccaagatcttaaaagaagaatggtctcgaacggaaattgggcagatcaagaatgttttaattccaaaaatgaagatcagccccaagaggatgagctgctcatggcctggcaaagacgaaaaggaggtggagttcctcaaaatccttaacattgtggtggtgacacttatctcagtaattctgatgtccatattgttcttcaaccagcacattatcacgttcctctcagagattactttgatctggttttctgaggcttccctgtccgtataccagagcctcagtaattccttgcacaaagtgaaaaacattctttgccacatattttaccttctcaaggagtttgtttggaagattgtttcacactag

SEQ ID NO: 31670 - DNA, 345 bp, Artificial Sequence
  Description of Artificial Sequence: Synthetic coding sequence
atgcataattttgaggaggaattgacttgccccatctgctacagtatcttcgaagacccgcgcgttctcccctgttctcacacattttgcaggaattgtctcgagaacattctgcaagctagcggcaatttctacatatggcgcccattacggatccccctcaaatgccccaattgccgcagtattacagaaattgcccctactggcatcgagagcctcccagttaactttgcactgcgtgcaatcattgaaaaataccagcaggaggaccaccctgacatcgttacatgccctgagcactatcggcagcccctcaatgtgtactgtctgctagataagaaatag

SEQ ID NO: 31671 - DNA, 468 bp, Artificial Sequence
  Description of Artificial Sequence: Synthetic coding sequence
atgcataatttcgaggaagaattgacctgccccatctgctatagcatcttcgaagacccgagggtcctgccatgttcccacacgttctgccggaattgcttagagaatattttgcaagcgtccggtaacttctatatatggcgaccactgcggattcccttgaagtgcccaaattgccgaagcatcacagagattgcccccacaggcattgagtctctgcccgtgaatttcgctctccgggctataatcgagaagtaccagcaggaagatcatcctgacattgtgacctgccctgagcattataggcaaccactgaacgtgtattgtctgcttgacaaaaagctggtatgcgggcactgcttaacgatcggccagcaccatggtcatccaatcgacgaccttcaatctgcatatcttaaggaaaaggataccccccagaagcttctggaacaattaacagacacctag

SEQ ID NO: 31672 - DNA, 534 bp, Artificial Sequence
  Description of Artificial Sequence: Synthetic coding sequence
atgcataattttgaggaggaacttacttgccctatctgctattcgatattcgaggatcctcgggtccttccatgctcccatacattttgtcgaaattgcctagagaacatactacaggcgtccggaaacttctacatttggcgtcctctacggatacctctgaagtgccccaattgcaggagtatcaccgagatcgctcccacagggatcgaatctttacccgtgaactttgctctgagagccatcatcgagaaatatcagcaagaggaccaccctgatatcgtcacctgccccgagcattatcgacagccgctgaatgtatactgtctcctagacaagaagctggtgtgtggacactgcttaactataggacaacatcacggccacccaatcgatgatctacaatctgcatatctgaaagaaaaggataccccacaaaagcttctggaacagctgactgatacccattggacagacttaacacacctgatcgaaaaacttaaagaacagaagtcacatagcgagaagatgtag

SEQ ID NO: 31673 - DNA, 336 bp, Artificial Sequence
  Description of Artificial Sequence: Synthetic coding sequence
atgcacaacttcgaagaggaactcacatgcccaatctgttattcaatttttgaggatccacgggtacttccttgtagccatactttttgtaggaactgtttggagaatatattacaagcatccggcaacttttatatctggcgccctctgcgaatccctctgaagtgccccaactgccgcagcataaccgagatagcacctactgggattgaatctctacctgtgaatttcgccctgagagctataatcgaaaaataccagcaggaggatcatcccgatatcgtcacctgtcccgagcactatagacagcctctcaacgtatattgtttactttag

SEQ ID NO: 31674 - DNA, 972 bp, Artificial Sequence
  Description of Artificial Sequence: Synthetic coding sequence
atgcacaacttcgaggaggagctcacatgccccatttgttatagcatctttgaggacccgcgagtgctgccctgtagccacacattctgccggaattgtctggagaatatcctccaggcctctggcaatttttacatctggagacctttacgcattccattaaaatgccccaactgcaggtccattactgagattgctccaactggaatcgagtccctcccagtcaactttgccttgcgggcaattatcgagaaataccagcaggaggatcaccctgacattgtaacctgccccgagcattatcgccagccattaaacgtgtactgcttactagacaaaaagctggtgtgcggacactgcctgacaattggccagcatcatgggcatcctattgacgatcttcaatccgcatatttgaaagagaaggacaccccacagaagctgttggagcagctcacagacacccactggacagatctgacccacctcatcgagaaattgaaggagcagaaatctcacagtgagaagatgatccaaggagacaaggaagcagtgctgcaatacttcaaagaactcaatgacaccctcgaacagaagaaaaagtcctttctgacggccctgtgcgacgtggggaatcttattaatcaggagtacacgccacagatcgagcgcatgaaggagatccgtgaacagcaattagagttaatggccctaaccataagtctacaagaagagtccccactgaaatttttagagaaggtggatgacgtgaggcagcacgtacagattcttaagcagagacctttgccagaggttcagcccgtggagatttacccaagagttagcaagattctgaaagaggaatggtccagaactgaaatcggccaaatcaagaacgtgctcattcccaagatgaaaattagtcccaaacgaatgagctgctcttggcctgacgagggcactgataagtag

SEQ ID NO: 31675 - DNA, 1380 bp, Artificial Sequence
  Description of Artificial Sequence: Synthetic coding sequence
atggcgggactgaagaggagggtgccgctgcacagtctgcgttattttatttcaatggtcgggttgttcagtaagcctggcttgctgccttggtacgccaggaatccgcccgggtggtcacagctcttcctcggaactgtgtgcaagggcgactttaccagagtaattgcaacgaagtgtcaaaagggccagaaatcgcagaaaaagcctagccatctgggccctctggacggctcctggcaggagcgcctcgccgacgtggtgacccccctctggagactcagctatgaggaacagcttaagccggttatcaatggttaccgcaacaagtccacgtttagtgtgaaccgtggaccggacggcaatccaaaaacggtagggttctatctgggaacctggagggatggtaatgttgtgtgtgttcaatccaatcacttgaagaatataccagagaaacactcccaagtggcccagtattatgaggtgttccttaggcagagtccgctggagccctgtctcgtcttccacgagggggggtattggagagaactcaccgtgcgaaccaatagtcaagggcacacaatggccattatcaccttccacccgcagaaactctcgcaggaggaacttcatgtccagaaagaaatcgtgaaggaattcttcatacgagggcctggcgccgcttgtggattgaccagcttgtacttccaggaatcaacaatgacgcggtgctcgcatcaacaatctccctatcagttactatttggagagccatatatattcgaggaactgctgagcctcaagataaggataagcccagatgcgttctttcaaattaacactgcaggagcagaaatgctttatcgcacagtgggagagctgactggtgtcaatagtgatacaatcctcctggacatctgttgcggtactggcgtgataggtctcagcctggcccagcatactagtcgtgtgctgggcatagaattacttgagcaggccgtggaagatgcacgctggacagcagccttcaacggcatcactaactcagagttccataccggccaggccgagaaaatcttacccggtctgttgaagagcaaagaggatggacagagcatcgttgctgtcgtgaatcccgctcgtgctgggctgcattataaagtaatccaggctatccggaattttagggcaatacacacactggtattcgtatcctgcaaactgcacggcgagagcacccgcaatgtgatcgagctttgttgtccccctgatccggctaagaaattactgggagagcctttcgtgctacagcaggccgtgccagtcgacttatttccccacaccccacattgcgaattggtgctcctgttcacaaggtag

SEQ ID NO: 31676 - DNA, 1485 bp, Artificial Sequence
  Description of Artificial Sequence: Synthetic coding sequence
atggccgggctgaaaagacgcgtgcctctgcactctctgaggtatttcatcagcatggtcggtctcttctccaaaccaggactgctcccctggtacgcccgcaatccgcccggatggagccaactgtttctgggaacggtatgcaaaggagacttcactcgtgttatcgcgactaagtgtcaaaagggccagaagagccagaaaaagccctcccacctcggccccctagatgggagctggcaagagcgcctggctgatgtggtcacacccctttggagactgtcctacgaggagcagctgaaggttaagttcgctgctcagaagaaaatcctccaaaggctggagagctacattcagatgctaaatggcgtcagcgtaactaccgccgtgcctaagagcgagcggctgagttgtctgctacatcctataatcccctcccctgtgataaatggataccggaataaaagcactttcagtgtcaatcgtggacctgatggcaaccctaagacagtgggattttatctcggcacgtggcgtgacggcaatgtcgtctgcgttcaatctaatcacctgaaaaacatccccgagaagcatagccaggtggcacagtactacgaagtcttccttcggcaatccccgctggaaccgtgtctggtctttcacgagggcggatattggcgcgaactcacggttcgcacaaattcacaaggacacactatggccatcattactttccatcctcagaaattgagccaggaagagttgcacgtccagaaagagatagtcaaagaattctttatcaggggccctggtgctgcgtgcgggttaacatctctatatttccaggagtctacaatgacaaggtgcagccaccagcaatccccatatcagctgctcttcggggagccctatatatttgaggaacttctcagcctgaaaatccggatttcacctgacgccttctttcaaattaataccgctggggcagaaatgctttaccgtactgtgggggagcttaccggggtaaacagcgacaccattctcctcgatatctgttgcggcactggggtcattggcctgtccctggcccaacatacaagtcgggttctcgggatcgaactgctagaacaggcggtggaggatgcccggtggacggccgccttcaacggtataactaactctgaattccacaccgggcaagccgaaaaaattttgcctggattactcaagtctaaagaggatggccagtctattgtggccgtggtgaaccccgctagagcgggtctgcattacaaagtgattcaggcgatccgcaattttagggcaatccacacgctcgtgtttgtgtcctgcaaactgcatggcgagtctactcggaacgtcattgaaaggtctctcatcctactggaatgcagtggcatggtatcagcacactattctctgcacctgcccggatctagtgatagcccagctagcgcttcctag

SEQ ID NO: 31677 - DNA, 1515 bp, Artificial Sequence
  Description of Artificial Sequence: Synthetic coding sequence
atggcagggctgaaacgaagagtccctttgcacagtttgcgttactttatttctatggtgggcctgttcagcaagcctgggttacttccatggtatgcccggaacccgcctggctggtcccaactattcctgggcactgtctgtaaaggtgacttcacgcgggtcatcgccacaaagtgccagaaaggccagaagagccagaaaaagccgagtcatctcggccccttggatgggtcatggcaagagcgcctggccgacgtggttactcccctctggcgactctcgtacgaggaacagttaaaggtgaaattcgctgcacaaaaaaaaatcctacaaaggcttgagtcctatatccagatgctgaatggcgttagtgttaccactgccgtcccaaaatcagagcgactaagctgcttgttgcatcccatcatcccttcacccgtgatcaacggatacagaaataagagcacattctctgtaaataggggcccagacggtaaccctaagacagtcggattctacctggggacatggcgcgatggcaatgtggtgtgtgttcaatccaaccacttaaagaatatccccgagaaacactcccaagtggcacagtactacgaagtgttcctgcgacagagccctctcgagccgtgcctcgtatttcatgaaggaggatactggcgcgagttaaccgtgcggaccaattcacagggacatactatggctatcataacatttcacccacagaagctctcccaagaggagctgcatgtgcagaaagagattgtgaaagaattctttatccgaggcccaggtgctgcctgcggcctcacgtcgttatactttcaggagtcgaccatgacccgatgctcacaccaacagagcccttaccaactcctgttcggcgaaccctatattttcgaggagctattgtctctgaaaatccggatttccccagacgccttcttccaaatcaataccgccggtgcggaaatgttgtaccgaaccgtcggggaacttaccggagtcaatagtgacaccatcctgcttgacatctgctgcggtaccggagtgatcgggttgtcactggctcaacacactagcagggtgctgggtattgagctgctggagcaggcggtggaggatgccagatggacagcagcctttaatggcatcacaaattctgaatttcacacagggcaggcggaaaaaatcctccccggtctgctcaagtccaaagaggatggtcaatccatcgtggccgtggtgaatccagcaagagcaggcctgcactacaaagtgatccaggccatccggaacttccgcgcaatccacacactggtcttcgtctcatgcaagttgcatggcgagtccacccgtaacgtaattgaactctgttgccccccagaccccgctaagaagctgttgggagagccgttcgttctccagcaggcggtgcctgtggatttatttcctcacacgccccactgcgaattagttctcttattcactcgatag

SEQ ID NO: 31678 - DNA, 1515 bp, Artificial Sequence
  Description of Artificial Sequence: Synthetic coding sequence
atggctgggctgaaacgacgcgttcctctgcattcgctgcgctacttcatctccatggtgggccttttctcaaagcctggattgttaccttggtacgctagaaacccccccggttggagtcagctctttcttggaaccgtctgtaagggtgatttcacacgcgtgattgctaccaagtgtcaaaagggtcagaaatcccagaagaaaccctctcacttaggccctctggacggttcttggcaggaaaggttggccgatgttgtgactcccctgtggcgactatcatatgaagagcaattaaaggtgaaattcgctgctcaaaaaaagatcctgcagcgacttgagtcctacattcagatgctgaatggagtatctgtcacaactgcagtgccaaaatctgagcgattgagttgcctattgcaccccataatcccctcccctgttatcaatggctacaggaataaatctacattttctgtgaatcgtggccctgacggaaacccgaaaacggtggggttttaccttggtacatggcgcgatggcaacgttgtatgcgtgcagagcaatcatctgaaaaatattcccgaaaaacattcacaggtcgctcagtattatgaagtgttccttcgtcagtcccccttggagccctgtctcgttttccatgaaggtggctattggagagaactcactgtgcgaacaaactctcaagggcatacgatggccataattactttccatccccagaagctgtctcaagaagagctgcacgtgcagaaggagatcgtgaaggaatttttcatccgaggccccggagccgcctgcggtctaacaagtctctatttccaggagtctaccatgactcgttgtagccatcagcagtctccatatcaactcctgtttggagagccctatatcttcgaggagctgttgtcgctcaaaatccggatcagccctgatgcattctttcagatcaataccgcaggtgctgaaatgctgtaccgaaccgtgggagagctgacgggcgtgaactccgatacaattctactggacatatgctgtgggaccggcgttatcgggcttagtctggcccagcacacatctcgcgtgctcgggatcgaactgttggagcaggccgtcgaggacgctcggtggacagccgcttttaatggcataaccaacagcgaattccacacaggacaggctgagaaaattctcccgggtctgctcaaatctaaagaggatgggcagagtattgtagccgtggtaaaccccgcgcgcgccggactccactataaagtcattcaagcaatacgtaacttccgagccatccacaccctggtgtttgtaagttgcaaattgcacggagaatctactcgaaacgttatagagttgtgctgtcctcctgatcccgccaaaaaactgcttggggagccattcgttctccagcaagctgttccagtcgacctgttcccccatacccctcactgcgagctcgttttgctttttacccgatag

SEQ ID NO: 31679 - DNA, 1380 bp, Artificial Sequence
  Description of Artificial Sequence: Synthetic coding sequence
atggccggtcttaaacgacgcgtgccgttacactcactgagatactttataagcatggtggggctgttctctaaacccggcttactcccgtggtatgcaaggaatcctcccggatggagccaactgttccttggcactgtatgtaagggcgacttcactagggtaatagccactaaatgtcagaaaggccagaagtctcagaagaaacctagccatctgggtccattggatggttcatggcaggaaaggctcgccgatgtcgtaacaccactgtggcggctgtcatacgaagagcagctcaagcctgtaattaatggttataggaataagagtaccttcagtgtgaaccgtggccccgacggaaatccaaagacagtgggtttctacctcgggacctggcgggatggaaatgttgtttgtgtacagtccaaccaccttaaaaatattcctgagaagcatagtcaagtcgcccagtactatgaagtgttccttagacagtctcctttggagccgtgtttggtttttcacgagggtggatattggcgggagctgaccgtgcgaaccaatagccagggacataccatggctattattaccttccacccacagaagctctcacaggaagaacttcacgttcagaaggaaatagtcaaggaattctttattagaggcccaggtgccgcttgtggccttaccagcttgtactttcaggaaagtactatgaccaggtgctcccatcagcagtctccttaccagcttctttttggagagccgtacatttttgaggagctactgtccttgaaaatacgaataagtcccgacgcattctttcagataaatacagcaggggcggagatgttatatcgtacagtgggcgaactgactggggtgaacagcgacacaatactgctggacatttgctgtggcactggtgtcatcggcctttcccttgcgcagcacacctctcgcgtgctgggaattgagctgcttgaacaggctgtggaagatgccaggtggacagctgcgtttaatggcataactaacagcgaatttcataccggccaggccgagaaaatactaccgggcctgttgaagagcaaggaggacggccagagtatcgtcgctgttgttaatcccgcccgggcgggccttcattacaaggtcatccaggccattagaaatttcagggcaattcacacattagtgttcgtgtcatgcaagttacacggcgagtcgactaggaatgtgattgagttgtgttgcccgcctgatcccgcgaagaagttactaggcgaaccattcgtgctacagcaggcagtgccggtggacctgtttccccacaccccacattgcgaattggtgcttctgttcaccagatag

SEQ ID NO: 31680 - DNA, 1515 bp, Artificial Sequence
  Description of Artificial Sequence: Synthetic coding sequence
atggcggggctgaaaagaagagtacctcttcactctcttagatacttcatttctatggtcggcctgttctccaagccaggcctcctgccctggtatgcccgtaacccccccgggtggtcgcagctgtttctgggcacggtgtgcaagggcgattttacccgggtaatagccactaagtgtcagaaagggcaaaagtcccagaaaaagccaagtcatttaggacccttggatggtagctggcaagaaaggttggcagatgttgtcacgccactgtggcggctgtcatacgaggagcagttaaaggtcaaattcgcagcacaaaagaaaattctgcaacggttggaatcctatattcaaatgctaaacggcgtttccgtgacaaccgcagtaccaaagagcgagagactgagctgcctactgcacccaatcattcctagccctgtcataaacgggtacagaaataagtcaacattctccgtgaaccgtggtccggacggcaatcccaaaacagtggggttctacctgggcacttggagagacgggaacgtggtctgcgtccaatcgaaccacctcaagaatatccctgagaaacactctcaggtagctcagtactacgaggtgtttttgaggcagtctcccctggagccatgcttagtattccatgagggcgggtactggcgagagcttactgtgcgcacaaacagccagggccacacaatggctattattacctttcacccccagaagcttagtcaagaggaactccatgtacaaaaagagatcgtgaaggagttttttattcgagggccaggcgccgcatgtgggttaacctctctgtactttcaagagtccacaatgacacgctgtagccaccagcaaagcccatatcaactgctgtttggagagccctacatattcgaggaattgctgagcctgaagattcggatatcccctgacgcgttcttccagataaacactgccggggcagagatgctgtataggaccgtcggagaactcaccggcgtcaatagcgacacaatcctgctggacatctgttgtggaactggcgtcatcggcctttctttagcccagcacacaagcagggtgctgggcatcgagcttctggaacaggccgtggaagatgccaggtggactgccgccttcaacggcatcacgaactcagagtttcataccggacaggccgagaagatccttcctgggttgctgaagtccaaggaggatggccagtcaatcgtagctgttgtcaatcccgctagggcgggattgcattataaagtgatacaggctatccgaaactttcgcgcaattcacactctcgtgttcgtctcgtgcaaactgcacggcgaaagtactcggaacgtcattgaactctgttgccccccagaccccgccaaaaaattattgggcgaaccttttgtccttcaacaggccgtgcctgtagacctgttccctcacacaccccattgcgagctggtactgttatttactagatag

SEQ ID NO: 31681 - DNA, 1542 bp, Artificial Sequence
  Description of Artificial Sequence: Synthetic coding sequence
atgtcatatggaagtatcgcacggggcggcggacttggaagccgtgggccatttggggggccttcgcgtcaagggtgccaacccctcgagtgcgctcgctgttggacagagtatggtattcggcactttccttgtcctagccctgagtccaagctgcagaaccgttgtgtcggtaaggatggtgaaggagacctcggcccagcgggcaccccaatagttccgcgcgctcggaaacgcggccctggtgtggcccctgagggctcaagaatgccggagcccacgtcctctccaactatcggcccccgaaaagactccgcagccggaccacacggaaggatggccggcccttctacaacccgggcgaagaagaggaagcctaatttttgtccccaggagacggaggtcctggtctctaaggtctccaagcatcatcagctgctattcggaaccgggttactcaaggcagaaccaactagaaggtatagggtgtggagccgcatcctgcaggctgtgaacgcgctgggttactgccgccgtgacgtagtggacctgaagcacaaatggcgagacctgagggccgtggtgagacggaagcttggagatctcaggaaggcggcgcatggtccatcccccgggagcggaaaacctcaggcgctcgccctgactcccgtggaacaggttgtggctaagaccttcagttgccaggccctgcctagtgaaggctttagtctggaacccccccgcgcaacacaggtggacccttgcaatctgcaggaacttttccaagagatgagtgccaacgttttcagaataaattccagtgtcacgagcctggagcgaagcctccagtcgctggggacaccaagcgacacacaagaactgagggattcactgcacaccgctcagcaagaaactaacaagactattgctgcaagcgcatcgtcggttaaacaaatggccgagttgcttcgcagcagctgtccccaggagagactgcaacaggagagaccacagttagaccggcttaaaacacagctgtctgacgctattcagtgttacggcgtcgtgcagaaaaaaatcgcggagaagagtagagccctcctgcctatggctcaaagggggtctaaacaatcgcctcaggcacctttcgccgaactggcagacgacgaaaaggtcttcaatggctccgataatatgtggcaggggcaggagcaagccctgttgcccgacataaccgaggaggatctggaggccattcggttgcgggaagaggccatcctccagatggagtccaaccttctggacgtgaaccagataatcaaggatctcgcaagcatggtctcagagcagggtgaagcagtagacagtattgaagcttcgcttgaagctgccagcagccatgctgaagccgcccggcagcttctggctggagcaagtagacaccagctgcagaggcacaaaatcaagtgctgtttcctgagcgctggggtaacagctttgctggtgattatcattattatcgcaacaagcgttcgcaaatag

SEQ ID NO: 31682 - DNA, 834 bp, Artificial Sequence
  Description of Artificial Sequence: Synthetic coding sequence
atgtcttatggaagcatcgctcggggcggtggccttggcagtcggggccctttcggaggcccgtcacgtcagggctgccaacccctcgccacacaagtcgacccatgtaacctgcaggaactgttccaggaaatgtccgcgaacgttttcaggattaacagctctgtgaccagcttggaacggtcactgcagtcccttggaactcccagtgacacacaggagctacgggatagccttcatacagcccagcaggaaactaataaaacaattgcagctagcgctagcagtgttaagcaaatggctgaactgcttcgcagttcctgtcctgagaggctgcagcaagaaagacctcaacttgatcggcttaaaactcaactttccgatgctattcagtgttatggagtggtacagaagaagatcgccgagaagtcaagggctctgctacccatggctcaaagaggctctaagcagcagtctccacaggctccctttgcagagctggctgatgatgaaaaggtgttcaacggatctgataatatgtggcagggtcaggaacaggccttgctgcccgatataacggaggaggacctggaagccattcgcctgagggaggaggctatcttgcaaatggaaagcaacttgcttgacgttaaccagataatcaaggatctggcctcgatggtctctgagcaaggagaagccgtggacagcattgaagcatccctcgaggccgcaagcagtcacgcagaggctgcccgacaattactcgccggcgcatcccgtcaccaattgatgaggaggaccaggccccctgccgcctgcggctgcccatag

SEQ ID NO: 31683 - DNA, 1542 bp, Artificial Sequence
  Description of Artificial Sequence: Synthetic coding sequence
atgtcctacggtagcattgctcgcgggggcggcctcgggtcaaggggcccgtttggtggcccatcaaggcagggctgccagcctctcgaatgcgccaggtgctggacggagtacggcataaggcactttccttgcccatctcccgaatctaaactgcagaatcgttgtgtgggaaaggacggggagggcgatttaggtccggccgggacacctattgtcccaagggccagaaaaaggggtcctggggtagcgccggagggatctaggatgccagagccgacatccagtcctaccattggcccaaggaaagactctgcggctggacctcacggacggatggcaggacccagcactacacgtgcaaagaaacgaaagccgaatttctgtccacaggagaccgaggtgctggtttccaaagtctcaaagcatcatcagctcctgttcggcacgggcctcctgaaagctgaacccaccagaaggtaccgggtgtggtctagaatcctccaggccgttaacgcactgggctattgtcgtcgtgacgtcgtcgacctgaagcacaagtggagggacttaagagccgtggtgagacgtaagctcggagacttgagaaaggccgctcacggcccgtccccaggatcaggtaaaccgcaggccctggcactcaccccagttgagcaggtcgtggccaagacgttttcctgccaagctctcccatccgaggggttcagcctcgagccaccaagagccacgcaggtggacccatgcaatctgcaggagctgtttcaggagatgtccgctaacgtgttcagaatcaattcttccgtaacctccctagaacggagcctgcagtctctcggcaccccatctgatacacaggaactcagagatagcctgcacacagcgcaacaggaaaccaataagacaatcgcggccagtgcatctagcgtcaagcagatggccgagcttctcaggtctagttgtccagaacgcctgcaacaagaaagaccacagttagaccgtctgaagacacaattgagtgatgccattcaatgttacggggtggtccagaagaaaatcgcagagaaatcgcgagcacttcttccaatggctcagaggggcagcaagcaacagtctccccaggcaccgttcgccgaactggctgacgacgagaaggtgttcaacggcagtgataatatgtggcagggacaggagcaggcgctgctgccagatattacagaggaggatctggaagcgattcggctgagagaggaggccatccttcagatggagtccaatttgctggacgtgaaccagattatcaaagacttggcctccatggtcagcgagcagggggaggctgtcgacagcatcgaggcttcattggaggcagcgagtagccatgctgaagccgcacggcagcttctggcaggcgcctctaggcaccagctccagcgccacaagatcaaatgttgcttcctatcagcgggagtcactgctctgcttgttattatcatcattatcgctacatctgtgcgtaaatag

SEQ ID NO: 31684 - DNA, 453 bp, Artificial Sequence
  Description of Artificial Sequence: Synthetic coding sequence
atgtcgtacgggtccattgctcgaggaggtggcctaggtagccgaggtccgtttggtggccccagtaggcagggatgccaaccactggaatgcgcgcgatgttggaccgagtacgggatccgccactttccctgtccttctccggaatctaaattgcagaatcgatgcgtggggaaagacggagaaggcgaccttggaccagcaggtacaccaattgttccgcgagcccggaagcggggacccggcgtagcaccagaaggcagccggatgcctgagcctactagttctcccactattggacctaggaaggattcggcagcaggcccccatggtcggatggctgggccgtctacaacaagagccaaaaagaggaaacccaatttctgccctcaggagacagaggtgctcgtgagcaaggtaagcaaacaccatcaactgttgtttggaacctag

SEQ ID NO: 31685 - DNA, 1539 bp, Artificial Sequence
  Description of Artificial Sequence: Synthetic coding sequence
atgtcatacggttcaatcgccagaggaggtggattaggatctcgtggcccattcggagggccttcgaggcagggctgccagccactggaatgcgcccggtgctggacagagtatgggatccgtcattttccatgcccttcgcccgaatcaaaacttcaaaaccggtgcgttgggaaggacggggagggagatcttggccccgccggcacgccaatcgtgccccgcgctcgaaaaaggggaccaggcgttgcccctgaaggctcccgcatgccagaacctacaagttctccaacaattgggccaagaaaggactcggccgctgggccccacggtagaatggccggcccaagcacaaccagagccaagaaaagaaaaccgaacttctgtccacaagagacagaggtcttagtttccaaggtgtccaagcatcaccagttactatttggcaccggcctgcttaaagccgaacctacccggagataccgagtctggtccaggattctccaagctgtaaacgcactggggtattgccgtagggatgttgtggacctcaagcacaaatggcgcgatttgagagccgtggtccggcggaagctgggtgatctgaggaaggcagcacacggtccttcaccgggaagtggcaagccacaggctttggctctgacgcctgtggagcaggtggtcgccaagaccttttcctgccaagctctgcctagcgaggggttctccctcgagcccccacgcgccactcaggttgacccatgcaacctgcaagagttgtttcaggaaatgtcagctaacgtgttccgaatcaatagttccgttacctccctcgagcgtagcctacagagtttagggacccccagcgatacccaagagctgcgggactctctccatacagcccagcaggaaaccaacaagacgattgcagcctcggccagctcagtgaagcagatggccgagctattaaggtcatcgtgtccagagcgtctgcagcaagaacgcccccagttggacagacttaagacccagctgtcagatgcaatccagtgttacggcgtggtgcagaagaagatagctgaaaagagtagagctctcctgcctatggcgcaacgtggaagtaaacagagtccccaggctccctttgccgagcttgcggacgacgaaaaggttttcaatgggagtgacaacatgtggcagggccaggagcaggcccttcttcccgacatcactgaagaggatctggaggcaataagactgcgggaggaagcaatcctgcagatggagtccaacctgcttgatgtcaaccagatcattaaggacctcgcaagcatggtttctgaacagggcgaagctgttgattccattgaagcaagcctggaagccgcctcctcccacgctgaggccgcaagacagctcctcgccggagcttcgagacatcaactccagaggcacaaaattaagtgctgttttttatccgccggagtcaccgccctccttgtgatcattatcattattgccacatctgtgcgaaagtag

SEQ ID NO: 31686 - DNA, 1686 bp, Artificial Sequence
  Description of Artificial Sequence: Synthetic coding sequence
atgtcaactgagcggacaagctggactagcctgtcaacaatccagaaaatcgctctgggcctgggcatccctgcctctgccaccgtggcatacatcctgtacaggaggtacagagaatcaagggaagagcggctgacatttgtgggagaagacgacattgaaatcgagatgagagtgccacaggaagccgtgaagctgataatcggcagacagggcgctaacattaaacagctgcgcaaacaaaccggggctaggatcgacgtcgacaccgaggacgtgggtgatgaaagagtgctcctgatttctggattcccagtgcaggtctgcaaggccaaggccgccatccaccagattctgacggagaatacacctgtgtcagaacagttatcagtcccgcaacggtctgtcggacgcattattgggagggggggagagaccataaggtcaatctgtaaggcatcaggcgctaagataacatgcgataaagaatcggaggggacgctgttactcagtcgacttataaaaatctccgggacccagaaggaggtggcagctgccaaacatctcatcttggagaaggtctcagaggatgaagagctgcgcaagcggatagcgcattccgctgagacacgcgtgcctaggaagcagccgatctccgtcagacgtgaggatatgacggagccaggaggagctggcgaacccgccctctggaagaatacctccagttctatggagcccaccgccccgctagtgactccacccccaaaaggcggcggtgatatggccgtagttgtcagtaaggaaggtagctgggagaaaccttctgacgatagctttcagaagtctgaggcacaggccattccggaaatgcctatgtttgaaatccccagtccggatttttccttccatgccgatgagtacctcgaagtgtacgtgtccgcctcagagcaccccaaccacttctggatccaaattgtgggaagccggtccctgcagttggataaactggtgaatgaaatgacacagcactacgagaattctgtccccgaagatctgacagtgcatgtgggggacattgtggctgcccctcttcccacaaatggatcttggtaccgggcacgggttctcgggactcttgagaacggaaatctggacctctactttgttgattttggcgataacggggactgtccgttaaaggacctgcgagccctgcggtcagattttctctccctgcctttccaggcgatagagtgctcgctcgctcgtatagctccaagcggtgaccagtgggaggaagaggccctggacgaattcgatagactgacccattgcgcagactggaagcctctggttgctaaaatctccagttacgtccagacgggaatcagcacctggccaaagatctacctctacgacacctctaatgggaagaaattagacataggactcgaattggtgcataaaggctacgccatagagctgcccgaagatattgaagagaaccgggcagtgcccgatatgctcaaggatatggccacagagacagacgcctcactgagcactctcttgacggagaccaagaaatcttccggggagatcacacacaccctatcatgtctgtcgctgagcgaggcagccagtatgtcgggagatgataacttggaggacgactacctattatag

SEQ ID NO: 31687 - DNA, 1674 bp, Artificial Sequence
  Description of Artificial Sequence: Synthetic coding sequence
atgtcaaccgaacgaacgagctggacttcactgtccactattcagaagatcgctcttggactgggcattcctgcaagcgccacagttgcctacattctgtaccggcggtacagagagtctagggaggaaaggctgacctttgtgggtgaggacgatattgagatcgagatgagggtgcctcaggaggctgtcaagctgatcattggtcgacagggcgccaacattaagcaaactggtgcccgtatcgatgtggacactgaggacgtgggagatgagcgcgtgctgcttatttctgggttcccagtccaggtctgtaaggcaaaagccgcaatccaccagatcctgactgaaaatactccagtgtctgagcagcttagcgtacctcagaggagcgtaggccggattatcggccgcgggggtgagacaataagaagtatctgtaaggcttctggcgcaaagataacctgcgacaaagagtctgagggtaccctattactttctcggctcattaagatctccggtacgcagaaggaagtggctgccgccaagcatttaatcctcgagaaagtatctgaggacgaagaactacgtaaaaggatagcccatagcgctgagacaagggtgcccaggaaacaacccatttccgttcgccgcgaagatatgacagagccaggtggggccggcgagccggcactgtggaagaatacctcctcttctatggagcctacagctcctctggtcaccccgcccccgaaaggggggggggacatggcagtagtcgtgtccaaggagggtagttgggaaaaaccatctgatgattctttccagaaaagcgaagctcaagcaatccctgagatgccaatgtttgaaatccctagcccggacttcagcttccacgctgacgaatacctggaagtgtacgtctcggcctctgagcacccaaatcacttctggatccagatcgttggctcaagatccctacagctcgacaaactggtgaacgagatgactcaacattacgaaaatagcgtccccgaggatttaacagtacacgtcggcgatatcgtcgcggctcctcttccaactaacggatcctggtatcgggcacgcgtcctgggaacgttagaaaatggcaatttggatctctatttcgtcgattttggagacaacggcgactgtccactgaaagaccttagggccctgcgttcagactttttgtccctgccatttcaggctattgaatgctcattagcccgtatcgccccaagtggggatcagtgggaggaggaagcgctcgacgaattcgatcgcctaacccattgtgcagactggaaaccattggtggctaagatttcaagctatgtccagaccggcattagtacttggccaaagatatacctgtacgatacatccaatggaaagaagctggacattggtctggagcttgtgcataagggatacgcgatcgaactgcctgaagatatagaggagaacagagctgttcccgacatgcttaaggatatggcaacggagaccgatgcgtccttaagtaccctcctgacagaaactaagaaatcaagtggggagatcactcacactttgagctgcctttctctatcagaggccgcatctatgtccggtgacgataatcttgaagacgactacctgttgtag

SEQ ID NO: 31688 - DNA, 1686 bp, Artificial Sequence
  Description of Artificial Sequence: Synthetic coding sequence
atgagcacggaaaggacttcttggacctccctaagtactatccaaaagattgcgttggggttggggattcctgcctctgctactgttgcatatatcctgtatagacgctatagagaaagcagagaagagcggttgacgtttgtcggcgaggatgacattgaaatcgaaatgagagtcccacaggaggccgtgaagcttataattggacgccaaggagcgaacatcaaacagcttaggaaacagacaggggctaggattgacgttgacacagaggacgtgggagacgagcgcgtgttacttatctctggctttccagtgcaagtttgcaaagccaaagccgcaatccatcagatactgactgagaacacccccgtttccgagcagctttcggtgccgcagcgcagcgttgggcgcattatcggaaggggtggggaaaccataaggtcaatctgtaaagcctccggcgccaagattacatgcgacaaagagtcagaaggaaccttgctattaagtcggttgataaagataagcggcacacagaaagaggtggctgcagcaaaacaccttattctggagaaggtgtcagaagacgaggaactacgaaaaaggatcgcccattctgccgaaacccgagtgccacgcaagcaacctatttccgtccgtagagaagatatgacagagcccgggggagccggggagcccgccctttggaagaacacttccagcagcatggaacccacggcacccttagttacccccccaccaaagggtggcggtgacatggccgtcgtggtgtcaaaggaaggttcctgggaaaagcccagtgatgacagtttccagaaatcggaagcacaggcaattccagagatgccaatgttcgaaattcccagccctgatttctcctttcacgctgatgagtaccttgaagtttacgtttcagcctctgagcacccaaatcatttttggattcagattgtgggaagccggtccctgcagttagacaagctggttaatgaaatgactcagcattacgaaaactcagtgcctgaagatctgactgttcatgtgggtgatattgtcgccgccccgttacctacgaacggtagctggtatcgtgctcgggtactgggcaccctcgagaatggcaatctggacctatacttcgtggattttggcgataacggtgattgccctttaaaggacctgcgggctctcagaagcgacttcctctccctcccgtttcaagctattgaatgttccctggcccgtatcgcaccctcgggtgaccagtgggaagaagaagccctcgatgagttcgaccggctcacccactgtgccgattggaaacccctggtggctaagatctcaagttatgtgcaaacaggcatctctacttggccgaaaatttacctatacgatacctcaaacggaaagaagcttgatattgggctcgaacttgtgcacaaaggctacgcaatagaattgcccgaggacatcgaggagaatagggcagtcccggatatgctgaaggacatggcaacagaaaccgatgcatctctttccactttactcacagaaactaaaaaatcgtctggcgaaattactcacacactgtcctgtctcagcctgtctgaagctgcatcgatgtccggcgatgataatctggaagatgactacctgctgtag

SEQ ID NO: 31689 - DNA, 1551 bp, Artificial Sequence
  Description of Artificial Sequence: Synthetic coding sequence
atgagtactgaaagaacttcgtggacaagcctctccactattcagaagatcgctctgggattgggcatccccgcgagcgctacagtcgcctacatcctgtaccgaaggtaccgggaatccagagaagagcgtttgaccttcgtaggggaggatgatattgagatcgagatgagggtacctcaggaggccgtcaagttgattatcgggcgacaaggcgccaatatcaagcagctgcgcaagcagacgggagcaaggattgacgtggatactgaagatgtgggcgacgagagggtcctactgatcagcggcttccccgtacaggccagtggagctaaaattacatgcgataaggagagcgagggcactctgctgctgtctagacttatcaaaatcagcggtacccagaaggaagtggctgccgctaagcatctgatcctcgagaaggtgagtgaggacgaagagctaagaaaacggattgctcatagcgcggagacaagagttccgagaaagcagcccatcagcgtccggcgtgaggacatgacagaacccggcggggctggtgagcctgctctgtggaaaaacacatcttcctccatggaacccaccgcaccacttgtgactcccccccccaagggcggaggagacatggctgtcgtagtcagtaaggagggctcctgggagaaacccagcgatgactcttttcaaaagtccgaggctcaggctatacccgagatgcctatgtttgagatccccagccccgacttttcatttcacgccgacgagtatttagaggtatatgtatcagcatccgagcaccccaatcacttctggatccagatcgtgggatcacgttccctccagctggataaactggtgaatgaaatgacacaacactacgagaattcagttcctgaagacctcacagtgcacgtgggcgatatcgttgccgcgccactgcccaccaacggaagctggtacagagcccgcgtgcttggcactctggagaatggtaatctggacctgtactttgtagacttcggggataatggggattgccccttgaaggatctccgggcattgaggtcagatttcctgtccctgccatttcaagctatcgagtgctccctcgcgaggatcgcacccagcggagaccaatgggaagaagaagcacttgacgaattcgaccgcctgactcattgtgctgactggaaacctctcgttgctaaaattagctcttacgtgcagactggtatttctacgtggcctaaaatatacctgtacgataccagcaacgggaagaaactagatatcgggctggagctggtgcataaggggtacgcaatcgagttaccagaagacattgaagagaatagggcagtgccggacatgttaaaagatatggcaacagaaaccgacgcttccctcagcaccctcctaaccgagaccaagaagagctcaggagagattacgcatacactttcatgtttgtccctgagtgaggcagcttcaatgagcggtgatgataaccttgaagatgactacctactttag

SEQ ID NO: 31690 - DNA, 1686 bp, Artificial Sequence
  Description of Artificial Sequence: Synthetic coding sequence
atgagtacagagcgaactagctggacaagtctgagcaccatccagaagattgctctcggtctagggattcctgccagtgccactgtggcttatatcctgtatcggcgctatcgggagtccagagaggaaagactcacatttgttggcgaagacgatattgaaatcgaaatgcgagttcctcaggaagcagtaaagctgattatcggccgccaaggcgccaacatcaagcagctgagaaaacagactggcgccagaattgacgttgacaccgaggacgtgggagacgagagggttctactgatcagtggattccccgtccaggtgtgcaaagctaaagctgccatccaccaaattctgacagagaatacccctgttagcgaacagctgtctgtgcctcagaggagtgtggggcgcattattggacgcggcggggaaacgattagatccatttgtaaggccagtggggctaagatcacctgtgataaggagtccgaagggaccttgctgctgagtcgacttataaagatctctggtacccagaaggaagttgccgcggctaaacatctcatcctggaaaaggtgtcagaagacgaggaactgcgcaagcgcatagcccatagcgcggagactagagttcccagaaaacagcccatttcagtcaggcgagaggatatgaccgagccaggcggcgcaggagaaccagccctttggaaaaatacctctagttctatggagcccactgcaccactggtgactcctccacctaaggggggcggagacatggccgtcgtcgtgagtaaagaaggctcctgggagaaacccagtgacgattccttccagaagtcagaagcccaggcgatcccggagatgcccatgttcgaaatccctagtcctgactttagcttccacgccgatgaatacctggaggtctacgtctccgccagcgagcacccgaaccacttctggatccagatcgtggggtctagaagccttcagcttgataaactcgtgaacgagatgactcagcactacgagaattcagtcccagaagacctcaccgtgcacgtgggagatatagttgccgcaccactgccaacaaacggaagttggtatcgcgcccgcgtgttagggactctggaaaatggcaatctcgacctgtactttgtggactttggtgacaatggggactgtcctctgaaggatctccgtgcattgagatccgactttcttagcttaccgtttcaggccatcgaatgctctctggcaagaattgccccttccggcgaccagtgggaggaggaggcattggatgaattcgacaggttgacacattgcgccgactggaagccgctggtcgccaaaatcagttcctatgtgcagactgggatctccacttggcctaaaatctatctctatgacacgtcaaatggaaagaagctggacatcggcctcgaactggtccataaggggtatgccatcgagctgcccgaggatatagaagaaaatcgcgctgtccccgatatgctcaaggatatggcgaccgagaccgacgcctcattaagcacccttctcacagagaccaagaagagtagcggtgaaatcactcataccctgtcttgcctaagtctctccgaagcagcgagcatgtctggggacgataatctcgaggatgattacctgctctag

SEQ ID NO: 31691 - DNA, 1014 bp, Artificial Sequence
  Description of Artificial Sequence: Synthetic coding sequence
atgactgagccagggggagcgggcgaacctgccctctggaagaacacctcctcctcaatggagcctacagcccctttagtgaccccccctcccaaaggcggcggggatatggcagtggtcgtttcaaaagaagggagctgggaaaagcccagcgatgacagttttcagaaatccgaagcacaggccatccccgaaatgcccatgttcgaaatcccatccccggacttctcatttcacgccgatgagtatctcgaagtctatgtttccgccagcgaacaccctaaccatttttggattcagatcgtcggctcacgctccctgcagttggataaactggtgaacgaaatgactcagcattacgagaattctgtgccagaggatctcacagttcacgtcggcgacattgtagcagctccactaccaaccaatgggagttggtaccgagccagggtcctcggcactctggagaacggaaacctggatttatattttgtggattttggagacaacggggactgtcccctcaaggacttgcgagcattaagatccgactttctatcattacccttccaggctatcgaatgctcccttgccagaatcgctccttccggagatcagtgggaggaggaggctctggatgaattcgacaggctaacgcattgcgctgactggaaaccacttgttgccaagatctcatcctatgtgcagacaggaatttcgacctggcccaaaatttatctttacgacacctcaaacgggaagaagctcgacatcggcctggaactagtccataagggatacgcgattgagctacctgaagacattgaggaaaatagagctgtgcctgacatgcttaaggacatggccactgaaactgatgcaagtctcagcaccttactgactgagaccaaaaagtcctccggagagattacccacaccctttcctgcctgtccttaagtgaggccgcaagcatgtcaggggacgacaacttggaggatgactacctactctag

SEQ ID NO: 31692 - DNA, 1686 bp, Artificial Sequence
  Description of Artificial Sequence: Synthetic coding sequence
atgtccaccgagagaacttcctggacttctttgtccactatccagaaaattgccctaggactgggtattcctgcatctgctaccgttgcatacatcctgtaccgccggtaccgggagtcccgggaggaacgcctgaccttcgtcggggaagatgacattgagatcgagatgagggtgccacaggaggccgttaaattaatcattggtcgacagggggcaaatattaaacagcttcgaaagcagactggcgcaaggatcgacgtcgataccgaggatgtgggagacgagcgagtacttctgatttcaggcttcccagtgcaggtgtgcaaggccaaggccgccattcaccagattctcaccgaaaatacaccggtgagtgaacagctctctgtcccgcagagaagcgttggcaggatcattggacgtggaggtgagactattcgatcaatctgcaaggcatctggcgcaaagatcacctgcgacaaagagtccgagggtacactgctgctgagcagacttattaagatcagtgggacacagaaagaagtcgctgccgccaagcatctcatcttggaaaaagtctccgaagacgaggagcttagaaaacgaattgcccactctgccgagacacgtgtgccacgtaagcagcctatcagcgtccgacgcgaggatatgactgaaccaggaggcgcaggtgagcccgccttgtggaagaacaccagctccagtatggaacccactgctcctctggtgactccaccccctaaagggggtggcgatatggccgtggtcgtgagcaaagaaggcagctgggagaagcctagcgacgatagtttccaaaagtctgaagcgcaggccatccccgagatgcctatgttcgagattccaagccccgattttagctttcatgctgatgagtacttggaagtgtatgtgtcagcttctgagcaccccaaccacttctggatccagattgttggtagccgtagcctccagctcgacaagctggttaacgagatgacgcagcattacgaaaactcagtcccggaggatcttacagtgcacgtgggtgatatcgtggcggccccgctgcctaccaacgggtcttggtacagagccagagtgctgggaacacttgagaacggtaatctggatttgtattttgtcgacttcggggacaatggcgattgtcccttgaaggatcttagagcgcttcggtctgattttttgagcctgcccttccaggcaattgaatgctccctcgcacggatagctccttctggcgatcaatgggaggaagaggctctagatgagtttgatcggctgactcactgcgccgattggaaaccactggttgcgaaaatatcctcctacgttcaaactggtatctctacgtggcctaaaatctacttatacgacactagtaacggtaagaaactcgatatagggctggaactggtgcataagggctatgcaatcgagctcccagaggatattgaggaaaaccgggcagtgcctgatatgctaaaagatatggccactgagaccgacgccagtctttccaccctgctgaccgagacgaagaaatctagcggcgagattacacacacactcagctgcctgtccctatccgaagccgcctcaatgagtggagatgataatttagaggacgactatctgttgtag

SEQ ID NO: 31693 - DNA, 396 bp, Artificial Sequence
  Description of Artificial Sequence: Synthetic coding sequence
atgagcacggaacgcacgtcctggacgagtctgtctacgatccagaagatcgcgctaggactggggatccctgcaagcgctactgtagcttatatcttatatcgccgatatagggaaagccgtgaggaaagactgacgtttgtgggcgaggatgatatagagatcgagatgagagtcccccaggaggctgtcaaactcataatcggccgccagggagccaacataaaacagttgagaaagcagaccggagcacgcatagacgtggataccgaagatgttggagacgagagggtactgctgatatccggcttccccgtgcaagtgtgcaaggcgaaggcagccattcatcaaatcctgaccgagaacaccccggtgagcgaacagttgtccgtgtag

SEQ ID NO: 31694 - DNA, 1254 bp, Artificial Sequence
  Description of Artificial Sequence: Synthetic coding sequence
atggccctcaaagtgctgctcgaacaggaaaagaccttctttactttacttgtgttgctaggatacctgtcctgtaaagtaacatgtgaatctggcgattgccggcagcaggaatttagggaccgcagtggcaattgtgttccctgcaaccagtgcggcccaggcatggagctgagtaaagaatgtggcttcggctacggcgaggacgctcagtgcgtcacctgcagactgcatagattcaaagaggattggggctttcaaaagtgtaaaccctgccttgattgcgccgtcgtaaacaggtttcagaaggcaaattgtagcgctacaagcgacgcgatttgcggggactgtttgcccggattttacagaaagacgaaattagttgggtttcaagacatggaatgtgtgccttgtggggaccctcctccaccatacgaacctcattgcgcaagcaaggttaaccttgtcaagattgcatcaactgcctctagcccgagagatacggcactggccgcggtcatttgttctgcccttgctacagtcctgttagccctcctgattctctgcgtcatttactgcaagcgccagtttatggagaagaagcctagttggtccctgcggtcccaggatatccagtataatggcagtgagctgtcctgcttcgatcgcccacagctgcacgagtacgcgcatcgcgcctgttgccagtgtcgtagggattctgtgcagacgtgtggtccggtgcggttactgccctctatgtgttgcgaggaagcctgttcccctaaccctgccacgctggggtgcggggtccacagtgccgcctcactccaggccagaaatgccggacccgccggcgagatggttcccacgtttttcggctctctgacacagtctatttgcggggagtttagtgacgcatggcctctgatgcagaaccccatggggggggataatattagcttttgcgactcttacccggaacttacaggcgaagacatccactctctgaacccagagctagagagctcgacctcactcgactctaacagctctcaagacttggtaggaggcgctgtgccagtgcagtcccatagtgagaatttcactgccgccacagacctatcaagatataataatacattagtcgagagcgccagcacccaggatgcgttaacaatgagatcccagctcgaccaagagtccggcgccgtgatccaccccgctacgcagacaagtctccaagaagcatag

SEQ ID NO: 31695 - DNA, 1272 bp, Artificial Sequence
  Description of Artificial Sequence: Synthetic coding sequence
atggccctgaaagtcttgctggagcaagaaaagacattttttacgcttttggtgctccttggctatcttagctgcaaggtgacatgtgaatctggggactgcaggcaacaggagtttcgtgatcgaagcggcaattgcgtgccctgcaaccagtgtgggcccggcatggaactcagtaaggaatgtggtttcggatatggtgaggacgcccagtgcgtgacatgtcgcctgcaccgcttcaaggaagattgggggtttcagaagtgtaaaccatgtctggactgtgcagtcgtgaaccgattccagaaggccaactgttcagccacttccgacgccatttgcggcgactgtctcccaggattctaccgcaagactaagctcgtgggcttccaggatatggaatgtgtaccttgtggggatccccctcccccttacgagccacattgcgcatcaaaggtgaatctagtaaagattgcttccacagcctcatccccacgcgatacggctctggcagccgtcatttgtagcgctctagcaactgtactgcttgcacttcttattttatgtgttatctactgcaagcggcagtttatggaaaagaagccaagctggtccctgcgtagtcaggacattcaatataatggttcggaactgtcttgttttgaccgcccccagcttcacgaatacgcccacagagcatgttgtcagtgtcggagagacagtgtccagacgtgtggaccggttcgtcttttgccctcaatgtgctgtgaggaggcctgttcccctaacccagctactctcggctgcggagtccacagtgccgcttcactccaggccagaaacgccggccccgccggcgaaatggtacccacattttttggaagcctgactcagtctatctgcggagagttctctgacgcttggccactcatgcagaacccaatgggaggggacaatatatctttctgtgattcatatcctgagcttactggggaagacattcactcactaaatcctgaattagagtcttcaactagtttagattctaacagctcacaggatctggtcgggggcgccgtacctgtccagtctcatagcgagaattttacagcagccaccgacttgtctcggtacaacaatactctggtggaatccgccagtacacaggacgccctcactatgcgatcacaattagaccaggagagcggggctgtgatccatcctgctactcagacatccctccaggtgagacagagactgggcagtctgtag

SEQ ID NO: 31696 - DNA, 1254 bp, Artificial Sequence
  Description of Artificial Sequence: Synthetic coding sequence
atggccttaaaggtgcttctggagcaggagaagaccttctttacactgttggttctcctgggctatctttcctgcaaagtgacgtgtgagtccggagattgtcggcagcaggaattcagggaccgaagcggcaattgtgtcccgtgtaaccagtgtggccctggcatggagctgagtaaagagtgtggctttggatatggggaggacgcacaatgcgtcacatgtaggctacatcggttcaaggaagactggggtttccagaaatgcaaaccttgccttgattgcgcagtggtgaatcgcttccagaaggctaactgtagcgctactagtgacgccatctgcggcgactgcctaccaggcttttataggaagacgaagctggtaggctttcaggatatggagtgtgttccctgtggagatccccccccaccctatgaacctcattgcgccagcaaagtcaacttggttaagatcgcttctacggcttcttcccctcgtgacactgctctcgctgcggtgatatgctcagcactggctaccgtcctgctggcactattaatactgtgtgttatttattgtaagcgccagttcatggagaagaagccttcctggtcactgcgctcacaggatattcagtacaacggatctgagctttcttgttttgacagaccacaactgcatgaatacgctcaccgtgcttgttgccagtgccgaagggactccgtgcaaacatgcgggccagtcaggctcctgccttccatgtgctgtgaagaggcatgtagcccaaatccagctactctcggttgtggagtacatagcgccgctagcctccaggcccgcaacgctggcccagccggagaaatggtgcccaccttctttggttctctaacccagagtatctgtggagagttttctgacgcttggcccctgatgcaaaacccaatgggcggggacaatatcagcttttgtgacagttatccagagctgaccggcgaagatattcattctttaaatcctgaactggagtcatctacctcccttgactcaaatagtagccaggatctggtgggcggagctgtgccagtgcaatcccactctgagaactttaccgcagctaccgacttgtccaggtacaataacacactagtggagtccgcttctacccaggacgcgctgactatgcggtcgcagttggaccaggagagcggggctgtgatccacccggccacacagacaagtctgcaggaggcttag

SEQ ID NO: 31697 - DNA, 858 bp, Artificial Sequence
  Description of Artificial Sequence: Synthetic coding sequence
atggagtgtgtgccgtgcggcgatcctccacctccatacgaaccccattgtgcttcaaaggtcaacttggtgaaaattgcgtctacggcttcgtctccacgggatacagccctggctgccgtgatctgtagcgctctggcgaccgtcctgttagctctgttgatcctatgcgttatctattgcaagcgtcagtttatggagaagaaacccagctggtcactgagatcccaggacatccagtataacggatctgaattatcctgcttcgatagaccgcagctgcacgagtatgcccacagggcatgctgccagtgtcgccgcgactctgtccagacgtgtggccctgtgagactgctccccagcatgtgttgcgaggaggcttgctctcctaaccccgcaacactgggatgcggtgtgcattccgcagcttctctgcaggcacgcaacgcagggcctgctggggagatggtccctacgttcttcggatcattgacccagtctatatgtggagaattctctgacgcatggccccttatgcagaatcccatgggcggagacaacatcagcttctgcgattcttaccctgagctgaccggagaggatatccactctctgaaccccgaacttgagtccagcacatcactggattctaattcgtctcaggatctcgtgggaggtgcagtccccgtccagtctcacagcgaaaatttcactgctgcaaccgatctgagcaggtacaacaacaccttggtagagtcggctagtacccaggacgccctcacaatgaggtcgcaacttgaccaggagagcggggcagtgatacatccagctactcaaacctcgctacaggaagcctag

SEQ ID NO: 31698 - DNA, 570 bp, Artificial Sequence
  Description of Artificial Sequence: Synthetic coding sequence
atggcggccaagcagccccctccattaatgaagaaacacagtcagactgacctggtgtccagactcaagaccagaaagattcttggcgttgggggtgaggatgacgacggggaagtccatagaagtaagatctcccaggtgttgggaaacgaaatcaagttcactatacgggagccactcggcctcagggtctggcagttcgtttcagccgtgctgttctctggcatagcaataatggcactggcctttcccgaccagttatacgatgctgtttttgacggcgcgcaggtaaccagcaagactccaatccggctttacggaggggccctgctctctattagcctaattatgtggaacgcactgtatactgctgaaaaagtgatcatccggtggactctgttgacagaggcttgttattttggcgtgcagtttttggtcgttactgccacgttggcagagactggcttaatgagtctggggatcttgcttctcctcgtcagtcgcctgctgttcgtggtcataagcatttactactattaccaggtcggcaggcggcccaaaaaggcatag

SEQ ID NO: 31699 - DNA, 411 bp, Artificial Sequence
  Description of Artificial Sequence: Synthetic coding sequence
atgaccacaggacggtgtatcgctccaagggtgtggcagttcgtatcagcagtcctattcagcggcatagctattatggctctagccttccctgatcagctgtacgatgcggtcttcgacggcgctcaggtgaccagcaagacccccattcggctgtacgggggggccctgctcagcatttcattgatcatgtggaatgccctgtatacagccgagaaggtgatcattagatggacattgctcacggaggcctgttacttcggagtccaatttctggtagtgactgctacactggccgaaacagggctgatgagcctgggaattttgctgttgctcgtctcaagattactgtttgtggtgatttccatttactattattatcaggtcggccggcgaccaaagaaggcttag

SEQ ID NO: 31700 - DNA, 570 bp, Artificial Sequence
  Description of Artificial Sequence: Synthetic coding sequence
atggccgccaaacaaccccctccccttatgaagaagcactcccagacagatttagtatcccgactgaaaacgcgcaagattctgggtgtgggcggggaggacgacgatggtgaggtccaccgctccaaaatcagtcaggtgctaggtaatgaaatcaagttcaccatccgcgaaccacttggcctcagggtgtggcagttcgtgtccgccgtcctcttcagcggcatcgccatcatggctctggcattccccgatcaactgtacgatgcagtattcgatggcgcccaggtgacatctaagaccccaattagactctacggcggcgccctgctgtctatctcgctgataatgtggaacgcactgtacacagcagaaaaagtgattatccgctggacgctcctcactgaggcctgctattttggggtgcagtttctggtggtgaccgcgaccctggcagagaccggtttaatgagcctgggaatccttcttttgctcgtgagtaggctgctgtttgtcgtgattagcatctattactactaccaggtggggagacggcctaaaaaagcatag

SEQ ID NO: 31701 - DNA, 570 bp, Artificial Sequence
  Description of Artificial Sequence: Synthetic coding sequence
atggcagctaagcagcccccacccctgatgaagaaacactcacagaccgatctcgtgtcccggctgaagacccgaaaaattctcggagttggaggggaagatgacgatggtgaggtgcacaggagtaagatttctcaggtgctgggcaatgaaatcaaatttacaatccgtgagccgttaggcttacgcgtgtggcagtttgttagtgctgtgctgttcagtggtattgccattatggccctcgctttcccagatcagctatatgacgccgtgtttgatggcgcgcaagtaacttctaagacaccaatcagactctacggcggtgccttgctaagcatttcactgataatgtggaacgctctgtacacggcagaaaaggtcatcattcgctggacgttacttacggaggcttgttacttcggggtccaattccttgttgtgaccgctacattggcggagaccggcttgatgagtctgggcatcctgctgctactcgtcagcaggctgctctttgtggtgatcagcatttactactactatcaggtcgggcggaggcccaaaaaggcatag

SEQ ID NO: 31702 - DNA, 297 bp, Artificial Sequence
  Description of Artificial Sequence: Synthetic coding sequence
atggccgctaagcagcctccccctctgatgaaaaagcattctcagactgatcttgtgagccggttgaagacaagaaagatcctaggggtgggaggcgaagacgacgacggagaggtgcacaggtcgaagatctctcaggtgctcgggaatgagataaagtttactatccgagagccactgggcctcagagtttggcagtttgtatcagccgtcctcttttccggcattgcaatcatggcactcgcttttcccgaccagctctacgatgctgtctttgatggggcgcaggtgacctag

SEQ ID NO: 31703 - DNA, 222 bp, Artificial Sequence
  Description of Artificial Sequence: Synthetic coding sequence
atggcagcgaagcagcccccccccctgatgaagaaacactcccagaccgacctggtgtcgaggcttaaaacacggaagattcttggagtgggaggagaggacgacgatggtgaggtacatcgatccaaaattagccaggttctgggaaacgagatcaaatttacaatccgtgaacccctgggtctgagagtgtggcagttcgtgagtgccgtgctattctag

SEQ ID NO: 31704 - DNA, 477 bp, Artificial Sequence
  Description of Artificial Sequence: Synthetic coding sequence
atggcagcaaaacagccaccccctctcatgaagaaacactcgcaaacagaccttgtgtctaggttgaagacaagaaaaatattaggtgtcggaggcgaggatgatgatggcgaagtccatcgctcaaagatcagccaggtattgggcaacgagattaagtttacaataagggaaccactcggccttagggtgtggcaatttgtcagcgcggtgttgttctctggcattgccataatggccctggctttccccgatcagctgtatgatgccgttttcgacggcgctcaagttacctctaaaacccctatccgcctttacggcggggccctgctctctattagtctgatcatgtggaatgctctgtatacagccgaaaaagttattatcaggtggaccttgctgactgaagcttgttactttggcgtgcagttcttagttgttactgccactctggctgagaccggcttaatgagttag

SEQ ID NO: 31705 - DNA, 240 bp, Artificial Sequence
  Description of Artificial Sequence: Synthetic coding sequence
atggccgccaaacaaccacccccattaatgaaaaagcatagtcagactgatctagtcagcaggctgaagaccaggaagatcctgggagtgggaggcgaggacgatgatggcgaagtgcaccggtctaaaataagccaggtactgggtaacgaaattaaattcacgattagggaacccttaggattgcgtgtctggcagttcgttagtgctgtgctgttcagtgggattgccattatgtag

SEQ ID NO: 31706 - DNA, 282 bp, Artificial Sequence
  Description of Artificial Sequence: Synthetic coding sequence
atggctgcaaaacagccaccccccttgatgaaaaagcactctcagacagatctggtgagtcgtctcaagacaagaaagattcttggcgtaggcggggaagacgacgatggagaggtgcatcgtagcaaaatcagtcaggttctcgggaacgaaatcaaatttacaatacgcgagccccttggcctgcgtgtgtggcagttcgtgtctgctgttctattctcgggcatagccatcatggcgctagcatttccagatcagctctacgatgccgtgtttgattag

SEQ ID NO: 31707 - DNA, 189 bp, Artificial Sequence
  Description of Artificial Sequence: Synthetic coding sequence
atggccgccaaacagccccctcctctcatgaagaagcactctcagactgacctggtcagtcgattgaagaccagaaaaatcctaggagtgggcggcgaagatgacgatggagaagtgcatagatccaaaattagtcaagtactgggcaatgagatcaagttcacaattagggagcctctgggcctttag

SEQ ID NO: 31708 - DNA, 570 bp, Artificial Sequence
  Description of Artificial Sequence: Synthetic coding sequence
atggccgccaagcagccacctcccttgatgaaaaagcattcacagaccgatctagtgtcacggttgaagacgagaaagattctgggcgtcggaggagaggacgacgacggcgaagtgcatcggtcaaaaatttcccaggtcctgggaaatgaaataaaatttacaattcgggaaccactcggcctgcgagtttggcaattcgtcagcgcggtactatttagtgggattgctatcatggccctggcttttccagaccagctgtacgacgccgtgttcgacggtgcgcaagttacctccaaaacacctatacggctttatggcggagctctcttaagtatcagcctgataatgtggaacgccctgtataccgctgagaaggtgatcataagatggacactgctgaccgaggcttgttacttcggagttcaattcctagtggtcaccgcaactttagccgagactggcctgatgtctctgggcattctcctattactcgttagccgcctgctgttcgtggttatctctatttattactattatcaagtggggagaagacccaaaaaggcttag

SEQ ID NO: 31709 - DNA, 1182 bp, Artificial Sequence
  Description of Artificial Sequence: Synthetic coding sequence
atggcacctccacccccctcgccacagctgcttcttctagcggcactcgcgcggctactgggcccctcagaggtgatggccggcccagcagaggaggctggcgctcactgccctgaatccctctggccgctgccacctcaggtcagccccagggtgacttacaccagggtgagcccagggcaggcagaggacgtgacatttctgtaccatccttgtgctcacccttggctgaaacttcagctagccctgctggcctatgcttgtatggcaaatcccagtctgaccccggattttagcctgacgcaggaccgccccctggtgctgactgcttggggcctagcacttgagatggcctgggtggagccagcgtgggccgctcactggctcatgcgacgccggaggagaaagcagagaaagaaaaaggcttggatttattgtgagagcctgagcggccctgctccttcagagcccacaccagggagggggcgcttatgccgccgtgggtgtgttcaagcactagccttggcttttgctcttcgttcatggaggcctcccggcacagaagtgacctcccagggacctcggcaaccaagttcttctggggccaagaggcgaagactcagagcggcactgggcccacagcctacccgatccgccctgcggttcccttcggccagtcccggctctctcaaggccaaacagagcatggccggaatcccgggccgagagagcaacgccccctccgttcccaccgtctcactgctgcccggcgctccgggcgggaacgcttcatcccgaactgaggcacaggttcccaacggacagggaagccctggcggctgcgtgtgcagttctcaggcttccccagcacctagggcagccgctcctccgcgcgcagcacgcggtccaacaccacggacggaggaagcagcatgggccgctatggccctgacgttcctactggtgttgctgacactcgcgaccctgtgcacccggctacatagaaatttccggcgtggggagagtatctattggggacccacagctgacagccaggacacggtggcagcagtgttgaaacgcaggcttctgcagccgtccagaagggtgaaacgctctcgccgtcggccgttgctgccaccaacaccagatagcggaccagagggcgagagctccgaatag

SEQ ID NO: 31710 - DNA, 414 bp, Artificial Sequence
  Description of Artificial Sequence: Synthetic coding sequence
gccaagcaatcaatggctggcatacctggcagggagagtaatgctccctccgtgccgacggtgagtctgctgcctggggcaccagggggcaatgcatccagtcgcacagaggctcaggtgccaaatggccagggaccccgtgggctttgcctgttcaagtccgggttccccgggccgagtcggagtagccctagagctgctaggggcccgacacctaggaccgaagaagccgcatgggccgccatggccctcactttcttgctcgtgcttttgactctggccaccctatgcacccggttgcatcgcaacttccggaggggcgaaagcatttactgggggcccaccgcagactctcaggataccacccctcctccagcccacgacagcggccctgaaggggaatcctccgaatag

SEQ ID NO: 31711 - DNA, 1605 bp, Artificial Sequence
  Description of Artificial Sequence: Synthetic coding sequence
atgcaggcggcgagggtggactatattgccccgtggtgggtggtttggttgcacagtgtccctcacgtcggtctgaggctgcagcccgtcaattctactttttcccctggcgacgagtcttaccaagaatctctgctgtttttggggctggttgccgctgtctgcctgggtctcaatctcatatttttggtggcataccttgtctgtgcatgccactgcaggcgggacgatgctgtgcaaaccaagcagcatcacagttgctgcatcacatggacagccgtagtggccggactcatctgctgcgctgccgtcggggtgggattctatggtaacagtgagaccaacgatggagcatatcagctgatgtactcccttgatgatgcaaaccacactttttccggaatcgacgcgttggtaagtggcacaactcagaagatgaaagtagacctggaacaacacctagcgaggctgagcgaaatcttcgcggctaggggtgattacttacagaccctgaagttcatacagcagatggccggatccgttgtcgtgcagctcagtggcttgcccgtgtggagggaggttacgatggagttgacgaagttgtccgaccagactggttacgttgaatactataggtggctgtcttacctgctgttgttcatccttgacttggtgatctgcctgattgcttgtttaggcttggccaagagaagcaagtgtctcctggcctcgatgctgtgttgcggagctctgagcctcttgcttagttgggcaagcctggccgccgatggctcagccgccgtcgccacctccgatttttgcgtggcccccgatacgtttattctaaatgtgacagagggccaaatcagcacagaggttaccagatattacttatattgttctcaatccgggtcctccccattccagcagactcttactacattccagcgggcgcttactactatgcagatccaggtggccggcctactgcagtttgccgtccctcttttcagcaccgcagaggaggatctcctggctatccaactgctgctgaattcaagtgagtctagtctgcaccagctgacagccatggttgactgccgcggcctgcacaaagattacttagatgccctggccgggatttgttacgatggcttacaaggcctgctctaccttgggctcttctcctttttagctgcccttgctttcagcaccatgatctgcgcagggccgagagcgtggaagcactttacgacccggaatcgcgattacgatgacatcgatgacgatgatccctttaatcctcaggcctggcgcatggctgcccactcacctccacgtggacagctgcactccttctgctcatattcatcaggcctaggcagccagaccagcctgcaaccgccagcccaaactatctctaacgcacctgtgtccgaatacatgaaccaggcgatgttgtttgggcggaacccaaggtacgaaaatgtgcccctgatcggtcgggcgagtccacctcctacctactccccgtccatgcgcgctacatatctgtctgtggccgacgagcatctccggcattatggcaaccagttccctgcttag

SEQ ID NO: 31712 - DNA, 642 bp, Artificial Sequence
  Description of Artificial Sequence: Synthetic coding sequence
atgcagatacaagtagccggcctgctgcaattcgctgtgccgctgttcagcaccgccgaggaggatctgctggcaattcagctcctgctcaacagcagcgagagctcccttcaccagctcacagcaatggtcgattgtagaggactgcataaagattatctggatgcattggccgggatttgctacgatggcctgcaagggttgttatatctggggctgtttagctttttggccgcactcgctttctccactatgatttgcgccgggccgcgagcctggaagcatttcacgacaagaaatagagattacgatgacatcgacgacgatgatcctttcaatccacaggcttggagaatggcagcccactctcccccccggggccaactccactcattttgctcgtacagctcagggttgggatctcagacctcactgcagccacccgcacaaactatttccaatgccccagtttcagaatatatgaaccaggctatgcttttcgggcggaacccacggtatgagaatgttccattaataggccgggcatcacctcctcccacctacagcccatcgatgcgcgcaacctacctgtcagtggcggatgagcacctgcggcattacggaaatcaattccctgcctag

SEQ ID NO: 31713 - DNA, 1572 bp, Artificial Sequence
  Description of Artificial Sequence: Synthetic coding sequence
atggccggagtgtcctacgccgctccctggtgggtatcgctcctgcatcggctaccgcatttcgatctgtcctgggaagccacatcaagtcagttccggcctgaagacactgattatcagcaagcccttctgctgcttggtgctgctgctctggcctgcctggctctcgacctgttgttcctcctgttctacagcttttggctctgctgtagacgccggaagagtgaggaacacctggatgccgactgttgctgcaccgcttggtgtgtcattattgctacactcgtatgtagcgcagggatagctgtcgggttctatgggaacggtgagacttccgacggaatccacagagctacttattctctgcgtcatgccaatcgcacagtggctggtgtacaggatcgagtctgggacaccgccgtgggcctgaaccacacagccgaacccagtcttcaaacactggagcggcaactggcaggaagacccgagccattgcgtgccgtccagcgcctccagggtttgctcgaaacgctcctcggttacacagccgccataccattttggcgtaatacggcagtaagcctcgaggtgctggccgaacaggtggacctgtacgattggtaccggtggttaggctatttgggccttctgctgctcgacgtgatcatctgcctcctcgttctggtgggcttgatcagatcgagcaagggcattctcgtgggagtgtgtctactgggcgtgctcgccctggtgatcagttggggcgcactgggactggagcttgcagtttctgtggggagttccgacttctgtgtggaccctgatgcttatgtcacaaagatggtggaggaatattcagtgctctccggagatatactgcaatactaccttgcttgttcacctcgtgcagctaacccatttcagcaaaaattaagcggctcacataaggctctggttgaaatgcaagacgtggtggccgaactgttgcgcacagtgccatgggaacagcctgctaccaaggacccattgctcagggtacaggaggtattgaacgggactgaagtcaacctccagcacctcaccgcactcgtggactgcagaagccttcacctggactatgtgcaggctctaacaggattttgttacgatggcgtagaaggcctgatctacctggcccttttttcctttgtaactgcgctcatgttttctagtatcgtttgttctgttccccacacttggcaacaaaaacggggtccagatgaggatggggaggaggaggcagccccgggacctcgtcaggcgcatgacagtctgtatagagtccatatgccatcattgtattcctgcggttcttcgtatgggagtgagacaagcatcccagcggctgcccacaccgtaagcaatgctccagtcacagaatacatgtcccagaacgccaattttcagaacccacggtgtgaaaatactccactcatcgggagggagtctcccccacccagctacacctccagcatgagagcaaagtacctggccaccagtcagcccagaccagatagttccggcagtcactag

SEQ ID NO: 31714 - DNA, 1059 bp, Artificial Sequence
  Description of Artificial Sequence: Synthetic coding sequence
atgccttctggcgttcccggatgttggcctcaattacctctgaaagggccctggcggccaacaccgaggcctcgcgttccagtcccttggcgtacccccagatttgcgtgtcggtggctcggatatcttggtcttctgctcctggacgtgataatctgtctgttggtcctcgtggggctgatcaggagttctaaaggcatcctggttggcgtatgtctcctcggggtactcgcactagtaattagctggggggctttggggctcgagttagcagtgtcagtagggtcatctgatttctgcgttgaccctgatgcctacgtgaccaagatggtcgaggagtattctgtgttatcaggggatattctgcagtactacctggcctgtagcccccgtgcagcaaacccattccaacagaaactgagtgggagtcacaaggcactggtcgaaatgcaggacgtggtagctgagcttttgaggaccgtcccgtgggaacaacctgctaccaaagacccgctcctacgtgttcaagaagtgttgaacggtacagaagtgaatctgcagcatctgactgcgctagtagactgccggtcgctccatcttgactatgtgcaagccctcacaggcttttgctacgatggtgtggaaggtttaatctacctggctctattcagcttcgtaacagcactgatgttttcctccattgtgtgtagcgtcccccatacttggcagcagaagcgcggtcccgatgaagacggggaggaggaggccgccccgggaccgaggcaggctcatgacagcctctatcgggtccatatgccttctctgtatagctgcgggtcaagctatggctctgagactagcataccggctgccgcacacacggtttctaacgcacctgtgacggagtacatgtcacagaatgctaatttccagaatccccgctgcgagaacacgcctctgatcgggcgggagtcgccgccacccagctacactagctctatgcgtgcaaagtacctagctacgtcacagcctaggcctgactcatctgggagtcattag

SEQ ID NO: 31715 - DNA, 1476 bp, Artificial Sequence
  Description of Artificial Sequence: Synthetic coding sequence
atggccggggtgagttacgccgcaccatggtgggtcagcctgctccacaggctgccccacttcgacctgagctgggaagccacatcgagccagtttcgccccgaggatacagactatcagcaagccttgttgttgctgggcgctgcagcccttgcctgtttggcgctggaccttctctttctactgttctactctttctggctgtgttgtagacgaaggaaatctgaggaacacctggacgccgattgttgctgtacggcttggtgtgttattattgccaccttggtatgcagcgccggtattgccgtcggattttacggcaacggagaaaccagtgatggcatccacagagccacctatagcctgcgacacgccaaccgcacggtggctggggtgcaagaccgggtgtgggatactgccgtgggcctaaatcacacggcggaaccgtcactccagaccttggaaaggcagctcgctggcaggcccgaaccgttacgcgccgtgcagaggttgcaaggacttttagagacactgcttgggtacacagcagcgataccattctggcgtaataccgcagtgtccctggaagtcctggcagaacaggtggatctatatgactggtaccgagtctgcctgctgggtgtactggcactagtcattagttggggagcactgggcctcgaactcgcggtatccgtggggtcaagcgacttttgtgtcgacccagatgcttacgttaccaaaatggtagaagaatattctgttctcagtggggacatactccagtattacctcgcctgcagcccccgggcagcaaatcccttccagcagaaactatctgggtcacataaggctctggtggagatgcaggacgttgtggccgaattgttacgcacagtgccgtgggaacaacccgccaccaaagatcccctgctgcgcgtgcaagaagtgctgaatggtactgaagtcaatctgcagcacctgaccgcgctcgtggattgtaggagtctgcatcttgattatgtgcaggccctgaccggattttgttacgatggcgtggaggggttgatctacctggccctgttcagcttcgtgaccgcgttaatgtttagctccatagtatgttcagtgcctcacacttggcagcaaaagcgcggacccgacgaggacggcgaggaagaggccgcacccgggcctcgccaggctcatgactctctgtatagggtgcacatgccgagcctctattcatgcggcagcagctacggatccgagacaagcatccccgccgcggcccatacagtgagcaacgctccggtaactgagtatatgagccagaatgctaacttccagaacccccgctgtgagaacacccctctgatcggacgtgagtccccaccacccagttacacttctagcatgcgggccaaatacctagctacctcccagccaaggccagatagtagcggttcccactag

SEQ ID NO: 31716 - DNA, 609 bp, Artificial Sequence
  Description of Artificial Sequence: Synthetic coding sequence
atggccgagtacttagccagcatctttggaactgagaaagataaggtcaactgctcattttacttcaagatcggcgtctgccgacacggagatcggtgctctcgcctccacaacaaacccacttttagtcaagaagtctttacagagctccaagagaagtacggagaaatcgaagaaatgaatgtgtgcgacaacctcggagaccacttagtgggaaacgtgtatgttaagttccggagggaggaagacggtgagagggccgttgctgaactgtccaatcggtggttcaacggccaggctgtccacgggaacgtgccagaggttgcatcagccaccagctgcatctgtggcccttttcctcgaacaagccgtggcagtagtatggggggcgacccaggggctggccaccccaggggttccattcttgcgacaatacccgagcgcgggacgatcggcgtgcctttgatcacagggatggcggccagcgaagctctagctccattaccatttacacctaatagggaccggtgcagttggcaggacctgtcttctaaaccaccatccctctcttgtccgatcctgccaagacttcctggctctattatgtag

SEQ ID NO: 31717 - DNA, 546 bp, Artificial Sequence
  Description of Artificial Sequence: Synthetic coding sequence
atggctgagtacctcgcttcaatcttcggcacagaaaaggacaaagtgaactgttccttttatttcaagatcggagtgtgtagacacggggaccgatgctcacgtctacataacaaacccactttttcccaggaggtatttaccgagctgcaagagaagtatggtgaaattgaggaaatgaatgtgtgtgacaacctaggagaccacctcgtcggcaacgtttatgtgaagttcagaagggaggaggacggcgaacgggctgtcgccgaactgtcaaatagatggtttaatggccaggcggtccatggggaattgtcgccagtgactgacttccgggagtcatgctgcaggcaatatgaaatgggagagtgcacccgaggcgggttttgcaactttatgcatcttcggcccatttcgcagaacctgcagaggcagctgtatgggcgcgggcctcgacgtcgatcccctcctaggtttcatactggccaccaccctcgcgagaggaaccacaggtgctcacccgaccactggcacggcaggttttag

SEQ ID NO: 31718 - DNA, 552 bp, Artificial Sequence
  Description of Artificial Sequence: Synthetic coding sequence
atgtgcgccactaccctgggcactacctcttgggctacctccatgtcgtcttccggcggccgcaggatggagtcgggcccttggctgaattctgtgacggccggaagcaccggtcggttatgcaccggtatgtatcccagatggcttttgcaattgcatgcctccgccgcccattttcctgaacccccagaggcagcactatgggctggaacgcaggctcaggttcctcaagaccagccagctatgtctccgcatgttctgaggcccctgtaccctcagatgtcgctgactctgagcccgtcaaaccacgtgcccaagaactttttcttttttttcttttttgaaatggaaccgcactctgtcgctcaagcaggggtgcactggcaccacctgggatcttggcagctcccgcctcctggcttcaaacagttctcagccagcgcgtcgcaaatcgccggcataaccggaacgtgccaccacgcccggctgattttcgtgttcctcgtggaaatgggctttcatcacctgggacaggcaggcctcaattcttag

SEQ ID NO: 31719 - DNA, 663 bp, Artificial Sequence
  Description of Artificial Sequence: Synthetic coding sequence
atggccgagtacctggcctcaatattcggaacggaaaaagataaggttaattgcagcttttatttcaaaatcggcgtttgcaggcatggcgaccgttgtagccggctgcataataagcctacattcagccaaaccatagtgctcctaaatctctaccgcaacccccagaataccgcacagaccgcagatggaagtcattgtcacgtttccgatgtggaggtgcaagagcattatgatagcttcttcgaagaggtgttcacggaactacaggagaaatacggggaaattgaggaaatgaacgtgtgcgacaacttaggcgaccatttggttggtaatgtctatgttaagtttcgtagggaagaagatggcgaaagagctgtggccgagctttccaataggtggttcaatggacaggctgttcacggggaattgtcccccgtgaccgactttagagagtcctgttgccgccagtacgagatgggggaatgcactcgaggtggcttttgtaactttatgcatttaagacctatttctcaaaacctacagagacaattgtatgggaggggcccgcgtcggagatccccccccaggtttcataccggacaccaccctagagagcggaatcaccgctgctctcctgaccattggcacggtcgattctag

SEQ ID NO: 31720 - DNA, 930 bp, Artificial Sequence
  Description of Artificial Sequence: Synthetic coding sequence
atgtgcttctttttctccttacaggaagaattcttggataagcacaccttgatgcgggtgctctcgtctggcgggaagctcggatctcgtggcgaaggcgcacagctgtgttgttggatgttgctctttagctggagggtgtcaggaggacagcagacgcggcggctctgcaggcgcgcattttgttggtcacccgtgccctcgccatcatgttccccttcttcctgtttgacagctcgcagttctttatgcatgacattcactcagagcaggaccacatccagccttgcaccggtattcgccctcttcgtgccattctactgcagcattccccgcgtacaggttgcccagatcctggggcctctgtccattaccaacaaaacactgatatacatcttgggactccagttgtttacatctggatcttacatttggatcgtggccataagcggactcatgtccggactttgttacgattctaaaatgtttcaggttcaccaggtgctctgtatcccatcgtggatggctaagttcttttcctggacactggaacccattttctcaagctctgaacccacctccgaagctcgtatcggaatgggggctactctagacatccagaggcagcaacggatggaactgttggatcggcaattgatgttcagtcagttcgcacagggtcggagacagcggcaacagcaaggtggcatgattaactggaataggctgtttcctcctcttcgacagagacaaaacgtcaactaccaggggggtaggcagagcgaacctgcagcccctcccctggaggtttccgaggaacaagtggcccgccttatggaaatgggattctcccggggagatgccttggaagccctgcgcgctagcaacaatgacctgaatgtcgccaccaacttcttgctccaacactag

SEQ ID NO: 31721 - DNA, 1035 bp, Artificial Sequence
  Description of Artificial Sequence: Synthetic coding sequence
atgttcacctctactgggtccagcgggctctacaaggcccccctgagcaagtcacttcttctcgtcccttcggccctgagtctgctgcttgcactgttgctacctcattgccagaagctcttcgtgtatgacctgcatgccgttaaaaacgactttcaaatttggcgtctgatatgtggacgcatcatctgcctcgaccttaaggacactttctgcagttcgctgttgatctataacttccgcatcttcgagagaaggtatggctcgcgcaaattcgctagcttcctgctgggttcatgggtactcagtgcgctgtttgattttctgctgatagaagccatgcagtactttttcgggattaccgctgcttccaatttgccctccggatttcttgctccagttttcgccttgtttgtgccgttctattgctccatcccgagagtgcaggtcgcacagattcttggccctctgagcatcaccaacaagacactgatttacattctcggcctgcagctcttcacctcaggttcatatatttggatcgttgcgatttctgggttaatgtctgggttgtgttatgactcaaaaatgtttcaggttcaccaagttctttgcatccccagttggatggctaagttcttctcatggacgctcgagcctatatttagtagcagcgaaccaaccagcgaggcccggatcggaatgggcgcgactttggatattcagaggcaacaaagaatggagctgctggaccgccagctgatgttcagccaatttgcgcagggtcggcgccagcgacagcaacagggagggatgatcaactggaatcggctctttccaccccttagacagcgccagaacgtcaattaccaggggggaagacagtctgaacccgctgcaccacctttggaagtctcggaggagcaggtggcccggctgatggaaatggggttctcaaggggggacgcgctggaagccctgagggcctctaacaatgatttgaacgtggccaccaatttcctactgcagcactag

SEQ ID NO: 31722 - DNA, 192 bp, Artificial Sequence
  Description of Artificial Sequence: Synthetic coding sequence
atggctgcggcaacattaacctcaaagctgtactctctgctgttcaggaggacaagcacgtttgctcttaccatcatcgtgggggtcatgttttttgagcgggccttcgatcagggcgctgacgcaatctacgatcatatcaatgaagggaaactttggaaacatatcaaacataagtatgagaataagtag

SEQ ID NO: 31723 - DNA, 399 bp, Artificial Sequence
  Description of Artificial Sequence: Synthetic coding sequence
atggcggccgcgacgctgaccagcaagctttattccctgctcttcaggagaccccctccctcaccttctccttctagctgggctagctgctcttcttctgctcccagtattaaggccagaacattatctaccacaactagtacccggggtagctgtggcaacaccagtagcacatctatgcggacatccagttcacttgaagcacccatccaagcccgacgtaccagaagcactcagcagcttttcgcacagtcctggagcctatctctgaagatgatgctgaaggtgttgttcatggaccaccacagcctgttggccaggaatggcttcacctataagactgacagtcttcccagtgcagtgttcgaagtctgtctcgtgtctatgctgcggaagtag

SEQ ID NO: 31724 - DNA, 189 bp, Artificial Sequence
  Description of Artificial Sequence: Synthetic coding sequence
atggcagccgctaccctgacctcaaagctgtattcactccttttccgtaggacttcaacttttgccctgacaataatcgtgggcgtgatgttctttgagcgggcctttgatcaaggcgcggacgccatttatgatcacataaacgaaggagtgcgtgcctgtgccattcctgatctgggtcctgcctag

SEQ ID NO: 31725 - DNA, 249 bp, Artificial Sequence
  Description of Artificial Sequence: Synthetic coding sequence
atggctgccgcgacactgacaagcaaactttactctctcctcttcagacgcacatcgactttcgcgctgacaataattgtcggagtcatgttcttcgaacgggcttttgatcaaggtgccgacgccatctacgatcatataaatgaaggggtcagggcctgtgctatcccgccgtggaccagacttaggggggattctggcgtcgaaaagttgtggaaacatatcaaacataaatacgaaaataaatag

SEQ ID NO: 31726 - DNA, 171 bp, Artificial Sequence
  Description of Artificial Sequence: Synthetic coding sequence
atggtcactcggttcctaggccctcggtaccgggagttggttaaaaactgggttcccacggcctacacctggggggctgtaggcgcagtcgggcttgtgtgggcgacggattggcgcttaatcttagactgggtcccatatattaacggcaaattcaagaaagataactag

SEQ ID NO: 31727 - DNA, 15531 bp, Artificial Sequence
  Description of Artificial Sequence: Synthetic coding sequence
atggctacgagtggaggtgaggaggcagccgccgcagcccctgccccaggtaccccggccacgggggccgacaccacccctggctgggaggtcgctgttcgtcccctgttgagtgcttcctactcggccttcgaaatgaaagaactgccccagctcgtggcaagtgtgatagaatcagagtctgagatactgcaccatgagaagcagtatgaacctttttattcgtcatttgtcgctctgagcacccattatattactacagtttgctcgttaattcctaggaatcagctgcagtccgtcgcagccgcatgtaaggtgctgatagagttctccttgttgcggctagagaaccccgatgaggcctgcgctgtgtctcaaaaacacctgattctccttattaaagggctgtgcaccggatgtagcagactggacagaacagagatcataaccttcactgctatgatgaagagtgcaaagctcccacaaacagtgaagactctctccgacgtggaagatcagaaggagctcgccagcccagtttctccagaactccgccagaaagaagtccagatgaacttcttaaaccagcttacatctgtatttaacccaaggacagtagcgagccagcccatctcaactcaaactctcgtggaaggagagaatgatgagcagagctcaacggatcaggcctctgctatcaaaaccaaaaatgtcttcattgcgcaaaacgtagcatcactgcaggagctggggggctccgagaaactcttacgggtatgtctgaacctcccctatttcttgcgttacattaatcggtttcaggacgctgtccttgcaaacagtttttttatcatgccggctacagtggcagatgccaccgcagtgcgcaacggatttcactccctggttattgacgtgactatggctctggatacactctcactgccagttctggaaccgctgaacccatcaaggcttcaggacgtcacagttctgtcgctttcctgcttatacgccggcgtttctgtggcgacgtgtatggctatactgcatgtaggatcggcgcagcaggtccgtacgggaagtacttcttccaaagaggacgattacgagagtgacgctgccacaatcgtgcagaagtgtcttgagatctatgacatgattggccaggcaatctcaagctctcgccgggctggtggagaacactaccaaaattttcaactcctgggggcctggtgcttgctcaactcactgttcctgatcctgaacctatcgcccacagctctggccgacaagggaaaggaaaaagatccattggccgctctaagagtgcgagacatactgtcaagaacgaaggaaggcgtgggatctcccaagttggggcccgggaaggggcatcaagggttcggagtactgtccgttattctggcaaaccatgcgataaagctgcttacctctctctttcaagatctgcaggtagaggccttgcacaaaggatgggagacagacggaccgcccgccgctctttccatcatggcccagtccaccagtattcagcgtattcaacggctcattgattcagtgcccctgatgaacctgttactcacattgctctcaacctcctaccgcaaggcctgcgtcctccagaggcagcgcaaaggatccatgagtagcgatgcgtccgcttctactgacagcaacacttactacgaggacgacttctcgagcaccgaagaagattctagccaagacgatgacagcgaaccaattttgggacagtggtttgaagagacgatctccccaagtaaggagaaggccgctccaccccccccacccccccccccccccttagagtcctcacccagggttaaaagtccatccaaacaggcaccgggtgaaaaaggtaatatcctggcctctaggaaggatcctgaactgtttctgggcctggcaagcaacattctgaatttcattacatcctctatgttgaactcgcgtaacaactttattcgcaactacctgtccgtatcattgagtgaacatcacatggcaacactagcttctatcatcaaggaggttgacaaagacgggttaaagggctctagtgacgaagaatttgccgcggccctataccactttaaccacagtctcgtgactagtgatctccagtcacctaacctccagaataccttgctgcagcagttaggggtggcacccttttccgaggggccttggccactttatattcacccgcagtctttaagcgtcctgagccgcctgctcctgatctggcagcacaaggccagtgcacaaggggatccagacgtgcctgaatgcctgaaagtttgggacagattcctttcaaccatgaaacagaatgcccttcaaggggtggtcccttccgagaccgaagacctgaatgttgagcacctgcagatgctcctcctaatttttcataattttacagagactgggaggagagcaatcctgagtttattcgtgcaaattattcaggagctctcggtcaacatggatgcacagatgagatttgttccattgatcctggctcgtctcttattaatcttcgattacctcctgcatcaatactccaaagcacccgtgtatctttttgagcaggtccagcacaaccttctgagtccacccttcgggtgggcttcaggcagtcaggattcaaattcccgccgggccacaactccactctatcatggtttcaaggaggtcgaagagaactggtcaaagcatttcagctctgatgctgtgccccaccctcggttctattgcgtactgtctcctgaagcctctgaggacgacttgaacaggctggatagcgtggcgtgcgatgttttgttctcaaaattggtgaagtacgatgaactctatgccgcacttacagcgctgttggcagccgggagccagttggataccgtccgtcgaaaagaaaacaagaatgtcacagcactggaagcttgcgcattgcaatattatttcctcatcctttggcgcattttgggcatcctacccccctctaaaacatacattaatcagttgagcatgaatagtccagagatgtccgagtgtgatattctgcataccctgcgctggagcagccggctccgtatatcaagctatgtgaattggattaaggaccatctgataaaacagggaatgaaagcagaacacgcctcttcactgctagagttggcctcgacaactaaatgttcaagtgttaagtacgatgttgagattgtggaggaatacttcgcacggcaaatctcctctttttgctctatcgattgcaccaccatactgcagcttcacgaaatcccaagtcttcaatccatctatactctggacgctgccattagcaaagttcaggtgagccttgacgaacatttcagcaagatggctgctgagacggacccacacaagagtagcgagatcaccaaaaacctcctccccgctaccctgcagctgattgacacctacgcttctttcacccgcgcttacctgttgcagaactttaacgaggaaggcacgacagagaagccatccaaggagaagctgcagggtttcgcagcagtgcttgcgatcggttcatcgaggtgtaaagctaacacacttggtccaacactcgttcagaatctgccgagctccgtgcagactgtatgtgaatcctggaataacatcaacacaaatgagttcccaaatatcggcagctggagaaatgccttcgccaacgatacaatcccctccgagtcctatataagcgccgttcaggctgcacatctcgggaccctatgctcccagtcgctgccattagctgcctcactgaagcatactttgctgagcttggtgcggctcactggagatctgattgtttggagtgacgagatgaaccccccacaggtgatccgcaccctgttgcccctattattagaaagtagcacagagtccgtggcagagattagtagtaactcactggaacgcatcctaggaccagccgagtctgatgaatttttggcccgcgtctacgagaaacttatcactgggtgttacaacatactagccaaccatgcagaccctaattccggcctcgacgaaagtatcctggaggaatgtctgcagtacctcgagaagcaactcgaatcaagccaggcccgcaaggctatggaagagttcttctccgattctggggaactggtgcagattatgatggccaccgcgaacgagaatctgagcgccaagttctgtaacagagtgctcaaatttttcactaagctgttccagctgactgagaaatctccaaacccctcactattacatctgtgtggaagcttggcacagctggcctgtgtggagcctgtgaggcttcaagcctggctgaccaggatgactacgtcccctccaaaagactccgaccagttagacgtgattcaagagaatcggcaattattacagctccttaccacctacattgtgcgcgaaaacagccaggttggagaaggcgtctgtgcagtgttgcttggcaccctgacaccgatggcgaccgagatgctggctaacggggacggtactggctttcctgagcttatggtggtgatggccacgctcgcatccgcggggcagggtgcaggccatcttcagcttcacaatgctgcagttgattggctgtctcgatgcaagaagtacctgagccagaagaacgtggtggagaagctcaatgcaaatgtgatgcatggcaagcatgtgatgattctcgagtgcacttgccacataatgagctatctagctgacgtaacaaatgctctgagtcagtcaaatgggcagggccccagccatttgagtgtggatggggaggagcgagcgatcgaagtggactctgattgggttgaggagctggccgtggaagaggaggatagccaagcagaagacagtgatgaagatagtttgtgtaacaaactttgcacctttacgattactcaaaaagaatttatgaaccagcactggtaccactgtcatacctgtaagatggtggatggggtgggggtctgtactgtctgcgcaaaagtttgccacaaggatcatgagatttcatacgcaaagtatggatcctttttctgcgactgcggcgccaaagaggacggcagttgtttggcactggtcaagaggacacccagcagtggtatgtcttctaccatgaaggagagcgcttttcaaagcgaacctaggattagcgagagcctggtgcgacacgctagtaccagcagcccagccgataaggcaaaagtgacaatctcggacggcaaggtcgccgacgaggaaaaacccaaaaaaagttctctctgccgcaccgtggagggatgccgcgaggagctacagaaccaagccaattttagcttcgccccgctggttttggacatgttgaattttttgatggatgccatccagaccaatttccagcaggcctcagcggtgggatcttcctccagagcccaacaggctctgtcggagcttcacaccgttgaaaaagcagtcgagatgacagatcagctgatggtgcctacccttggctctcaggaaggcgcatttgagaatgttaggatgaattattccggggaccaggggcagactatcagacagctgattagtgcccacgtcctgcgcagggtggccatgtgcgttctgagtagcccccatggccgccggcagcatttagcagtttcccacgaaaagggaaaaattacagtgctccagctgtccgcacttttgaaacaagccgactcttcaaagaggaagctcactcttacccgtcttgcttccgctcccgtgcccttcacagtcctgagcctcaccgggaacccatgtaaggaggactacttagccgtgtgcggactcaaggactgtcatgtactcacattttcttcaagcggcagcgtaagcgatcatctggtgctccacccacagcttgccactggtaatttcattatcaaggccgtgtggctcccaggctctcagaccgagttggctattgtgaccgcagactttgtgaagatatacgatctgtgtgtcgacgccctcagtcctacattttattttctgttgccgtcatctaaaatcagggatgttaccttcctgtttaacgaagagggcaaaaatatcattgtgatcatgtcgtcggccggatatatctatactcagctgatggaggaggcgtcttccgcacagcaggggccattctatgtaaccaatgtgctggaaatcaaccacgaagacctgaaggatagtaatagccaggtggcaggtggcggggtatcagtttattattctcatgtgttgcagatgttatttttctcgtattgtcagggcaagtccttcgctgcaaccatctctcggactactcttgaggtgctgcaactatttcctattaacatcaagagcagtaacggcgggtcgaaaacctccccagccctgtgtcagtggagcgaggtgatgaatcacccaggtcttgtgtgttgcgtgcaacagactactggcgtgccgcttgttgtgatggtgaaaccagacacatttctcattcaggagatcaagacgctccccgcaaaagcgaagattcaagatatggtcgcaattcggcacactgcctgtaatgaacagcagcgtactactatgatactgctgtgcgaagacggttcacttagaatctacatggctaatgtggaaaacacaagttactggctgcagccctccttgcaaccgagtagcgtgatctctatcatgaagccagttcgcaagcgtaagaccgccacgataaccacgcgcacgtcctcacaggtgacatttcctatagacttcttcgaacataaccagcaactgactgacgtcgaatttggggggaacgatcttctccaggtttacaacgcacaacagattaaacaccggctgaacagcaccggaatgtacgtcgccaacaccaagccaggaggatttaccattgagattagtaacaataatagtaccatggtaatgaccgggatgcggatccagataggcactcaggcaattgagcgcgccccatcctatatcgaaatattcgggaggacgatgcagctcaaccttagccgcagcagatggttcgacttcccattcacgagagaagaggcactgcaggccgacaagaaactgaacctgtttattggggcatccgtagaccccgccggcgtcaccatgatcgatgctgtgaagatctatgggaagacaaaagagcaatttggatggcccgatgaaccacccgaggaattcccatctgctagtgtgagtaatatctgtccaagtaacctcaaccagtcgaacggaacaggcgactcagatagcgccgccccaaccaccacttctggaaccgtgttagaaaggttggtggtcagcagcctggaagctctggagagctgtttcgcagtcggccctattatagagaaagagaggaacaagaacgcggctcaagagctggccacgctcctgctgagtctcccagccccagccagcgtgcaacagcagtctaaatctttactggcgtcccttcacaccagcaggagcgcctatcacagtcacaaggatcaagctcttctctctaaggccgtgcaatgcctgaatacaagcagcaaagaaggcaaggacctggatcctgaagtgtttcagcggctggtaatcactgctcgcagtatcgcaattatgcgtccaaacaacctcgtccattttaccgaatccaagttaccacagatggaaaccgattgttttttccctcggtgcgcctgttggtcgctcgggattgttggaatcctgattggcgccccacttgagaccccttctcctgagggcatggacgagggcaaggagccacaaaaacagttggaaggagactgctgtagctttattacgcagctcgtcaatcacttctggaaacttcacgctagcaagcccaagaacgcctttctcgctccagcatgcctacccggcctcacccacatagaagccacagtgaatgctctcgtcgacatcatccacggctactgcacttgcgaattggattgtattaatactgccagcaagatctatatgcagatgctgctttgtccggaccccgcagtttcattctcctgcaagcaggccttaattagagtgttgcggccgaggaataaaaggcgccatgtaacgctgccttcctcgcccagatcaaacactcccatgggagataaggatgatgatgatgatgacgacgcggacgaaaagatgcagtcctctgggattcctaacgggggccatatccgacaggagagccaggagcaatccgaggtggaccacggtgatttcgaaatggtctccgagtctatggttctagaaaccgccgaaaatgtaaacaatggcaacccatcacctttggaagctttgctggccggagctgaaggttttcctcccatgcttgacatcccacctgatgcagatgatgagacaatggtggagctagctattgcactgtctttacaacaggaccagcaggcaccagcgtcagatgatgaggggagtaccgctgccacagatgggtcaaccttgcgtacgtcaccagccgaccatggcggtagtgtaggttcggagagtggcgggtctgcggtggactcggtagctggagagcactctgttagcggcaggtcttctgcctatggagacgctaccgccgaagggcatcccgccggccctgggagcgtttccagtagtacgggagctatctcaactactactggccatcaggaaggcgatggatccgagggcgagggagaaggcgagactgagggagatgtccatacaagtaacagactccatatggtgagactgatgctattagagcggttgctgcagaccctcccccaattgaggaacgttggcggtgtgagagctattccttatatgcaggttatattgatgctgacgactgatctggacggggaggacgagaaggataagggggctctagacaaccttcttagtcagttgatcgctgaattgggaatggataagaaagacgtaagcaagaagaacgaacgcagcgctctgaacgaggtccacctcgtcgtgatgcgactattaagcgtttttatgagccgaacgaagagcggctctaagtctagtatctgtgagtcctcttctctgatcagctcagctacagcggcagcactactcagttcaggcgctgtggactactgcctccatgtcctcaaaagtttactggaatattggaaatcccagcagaatgatgaggagccagttgcaacgtcccagctcctgaagcctcacactactagctcaccaccagatatgagtccctttttcctgcgacaatatgtcaaggggcacgctgcagacgtgttcgaagcctacacgcagctccttactgaaatggtcttgagattgccatatcaaattaagaagataacagacaccaattcacgaattccgcctcccgtttttgaccattcttggttttatttcttgagcgagtacctgatgatccagcagactccctttgtaaggcggcaggtgaggaagctgttgttatttatctgtggctctaaggagaagtaccgccagctgagggacctgcacacgctcgacagtcacgtcagaggcattaaaaaactgctcgaagagcagggtatctttctgagggcttccgttgttactgctagttcaggatcagctcttcagtatgatacccttatcagtttgatggaacatttaaaggcctgtgctgagatagccgctcaacggacaattaactggcagaagttctgtattaaggatgactcagtgctctactttttgctgcaggtttcgttcctcgtggacgaaggagtttccccagtattgctgcagctcctgtcttgcgccctgtgtggctcaaaagtcctcgccgcacttgcagcgtccagcggttcatctagtgccagcagctcctcggcgcctgttgcagcatcttccgggcaggccactactcagagcaagagctccaccaaaaaatcaaagaaggaggaaaaagagaaggagaaggatggcgaaacgagcgggtcccaggaggaccaactatgtacggccctggtcaatcaactgaataagttcgccgacaaggaaacacttatacagttccttcgatgttttctgctggaatcaaacagttcctctgtccgttggcaggcacattgcctgaccttacacatttatagaaattcttctaagtcccaacaggagctgttgttagacctcatgtggtcaatttggcctgaactgccagcttacggcaggaaggcagcccagtttgtcgacctcctgggatatttttcactgaaaacaccccaaacagaaaaaaaactgaaagagtacagtcagaaagccgtggaaatccttagaacacaaaatcacatcctcaccaatcacccgaacagcaacatttacaatactttaagcggtctggtggaatttgatggttactatttggagtctgatccctgtctagtttgtaataatccagaggtccctttttgttacatcaagctgagcagcattaaggtcgacacccgttacaccaccacacagcaggtcgtgaagttaatcgggtcgcataccatctccaaagttaccgttaaaattggggaccttaaacgcaccaagatggtgaggacaatcaatctgtattacaacaataggactgtacaggcaattgtcgagttaaagaataaaccggccagatggcataaagctaagaaagtccaactgactcctggccaaacagaggtgaagatagacctaccgttaccaattgtagcatcaaatctgatgattgaatttgctgatttctatgagaactaccaggcctctaccgagacactgcagtgcccaagatgtagcgctagcgtgcctgccaacccaggcgtgtgtggtaactgtggagaaaacgtgtaccagtgccacaaatgtcggtccattaactacgatgaaaaagatcccttcttgtgcaacgcttgtggattctgtaaatacgcgaggttcgacttcatgctctatgcaaagccctgttgcgccgtcgaccctatcgagaacgaggaagacaggaagaaagcagtgagtaacatcaacactttgctggataaagccgatcgggtttaccatcagctcatggggcaccgcccacagctggagaacctcctctgtaaggtaaatgaagcagcccccgagaaacctcaggacgatagcgggacagcaggtggaatttctagcaccagcgccagtgttaacagatacatcctacaactggcgcaggagtactgcggggactgtaagaactccttcgacgagctgagtaagattatccagaaagtctttgcttccaggaaggagcttcttgaatatgacctacagcaaagggaggccgctactaagtcttcccgaacttccgtccaacccaccttcaccgctagtcaatatcgagctctgagtgtactgggatgcggccatacttctagtaccaaatgttacggctgtgcttccgcagtgactgagcactgtatcacactgttacgggccctggctaccaacccagcccttcgccacatattggtgtcccagggactgatcagagagctttttgattacaacctcagacgcggcgccgctgccatgagagaggaggtgcgccagcttatgtgtttacttacgcgcgataatcccgaagcgacccagcagatgaacgatttgattatcggaaaggtaagcacggctctgaagggccattgggccaatcccgacctggcttccagtctccaatacgagatgctcctactgacagattccattagcaaagaggatagctgctgggagttaagactgcgctgcgcccttagcttgttcctgatggccgtgaacatcaagaccccagttgtagtggagaatattacgctgatgtgcctacgcattctccagaaattgataaaaccccctgcccctacatctaagaagaacaaggatgttcccgtggaggccctgacaactgttaaaccttattgtaacgagattcatgcgcaagcccagctttggcttaaacgcgatcccaaagcttcttatgatgcatggaaaaaatgtctgccaatccgcggtatcgacggaaacggcaaggctcctagcaaatccgaattaaggcacctgtatctgaccgaaaaatacgtgtggcgctggaaacagttcctttcaaggcgtggtaagagaacctcccccctggacctgaagctggggcacaataattggcttagacaggtcctgtttacaccagcgacgcaggcagcccgtcaagcggcatgtacaatcgtcgaggcgttagcaaccatcccgtcaagaaagcagcaggttcttgacctactgactagctatttggacgagttgtcaattgcaggagagtgcgcagccgaatatctggcgctctaccagaagcttatcacatcggctcactggaaggtctacctcgccgctaggggggtgctgccttacgtaggaaacctgatcactaaggagattgcgcgattactcgccttagaggaggctaccctgtctacagacttacagcaggggtatgctcttaagtctcttacaggattgttaagctcgttcgtcgaagtggaatcgatcaaaagacattttaagagccgcctggtgggcacagtactcaatggctatttatgccttcggaagctggtcgtccagaggaccaagctgatcgacgaaacccaagacatgctgctcgagatgttggaggacatgaccaccggcaccgagagtgagacaaaggctttcatggctgtgtgtatcgagaccgctaaacgctataacctggatgattaccgcacaccagtttttatatttgaaaggctttgttcgataatctatccagaagagaacgaagtcactgaattctttgtgactctagagaaggatccgcagcaagaagatttcctccaggggcgcatgcccggcaacccgtacagttccaatgaacccggcatcggccctcttatgagggacattaagaacaaaatttgccaggactgtgacttagttgctttattggaggatgattcaggtatggaattactcgtgaacaacaaaattatctctctcgatctgcccgtcgcagaggtgtacaaaaaggtctggtgtaccaccaatgaaggcgagcccatgcggattgtgtaccgcatgaggggcttgttgggcgatgcaactgaagagttcatagaatcacttgactcaaccacggatgaagaagaggatgaggaggaggtgtataaaatggcaggtgttatggcacaatgcggcggactggagtgcatgttaaatcgtctggctgggataagggacttcaagcaagggagacatttgttaactgtgctgctgaaactgttctcatactgtgtaaaggtcaaagtcaatagacagcagttggtgaagctggagatgaacacgttgaacgtcatgctgggcactttgaacctggcactggtggcagagcaggaatcaaaagacagcggtggcgcagccgttgctgagcaggtgctgtccatcatggagatcatactggatgagagtaatgccgagcctctgtctgaagataagggcaacttgctattgactggcgacaaggaccagttggtcatgctccttgaccagattaactcgacatttgtacgctcaaaccccagtgtgcttcagggcctgttacgcattatcccgtaccttagcttcggagaagtggagaagatgcagatccttgtcgagaggttcaaaccctattgtaatttcgacaaatatgatgaagaccactccggggacgataaggtctttctggactgtttttgcaagattgctgccggcatcaaaaacaacagtaatggacaccagctcaaggatctgatattgcagaaaggcatcacccagaatgccctagactacatgaagaagcacataccatcagccaaaaaccttgatgcagacatctggaagaaatttctgagtcggcccgcactgcccttcatactgcgccttctcaggggacttgctattcagcaccccgggacacaagttctaatcggtaccgacagtattccgaatttgcataaactcgagcaggtttcgagtgacgaagggatcgggaccttggccgagaacctgcttgaagcactgcgagaacacccagacgttaataagaagatcgacgccgccaggcgcgagacacgagctgaaaaaaagcgcatggctatggccatgcgtcagaaggcacttggtaccttgggtatgaccacaaatgagaagggccaggtcgtgactaaaactgcgctgcttaaacaaatggaagaactgatcgaggagccaggtctgacatgttgtatctgtagggaaggatataaatttcagcccacaaaggtgcttgggatctatacatttaccaaaagagtggccctcgaagagatggagaacaagccccggaaacagcagggctattccacagtgagccattttaacatagttcattatgactgccatcttgcagccgtcaggttggccagaggaagagaggagtgggaatccgctgcattacaaaatgcaaacaccaagtgcaatggcctgctgccagtttggggcccacacgtgcccgagtcggcctttgccacgtgcctggctcgacacaacacatatcttcaggagtgtacaggccagagggagccaacttatcagttgaatattcacgacataaaactgcttttcctgaggtttgccatggagcagagcttttcagcagatactggtgggggcggtagagagagtaacattcaccttattccttatataatacacaccgtgctctacgtgctcaatacgactcgtgccaccagcagagaggagaaaaacctccaagggtttctggaacagcccaaggaaaaatgggtggagtccgcctttgaggttgacggcccttattactttaccgtcttggctctgcatattctgcctccggagcagtggagggccacacgcgtcgagattctccggcgattgctggtgaccagtcaggcgagagccgtggcaccagggggggctaccaggctgacggacaaagccgtgaaggactactccgcgtaccgctcgagcctgctgttttgggccttggtggacctcatttacaatatgttcaagaaggtgccgacttcaaatactgaaggcgggtggtcttgttcactcgccgagtacataaggcataacgacatgccaatttatgaggcggctgataaggcacttaaaacctttcaggaagaatttatgcccgtcgagactttctcagagttcctcgacgtggcgggtcttcttagcgagatcactgaccctgaaagctttctgaaagacctgctgaattccgtcccctag

SEQ ID NO: 31728 - DNA, 639 bp, Artificial Sequence
  Description of Artificial Sequence: Synthetic coding sequence
atggtgaggacaatcaacctctattataacaatagaacggtccaggccatcgtcgagctgaagaacaagccagccagatggcataaagcgaagaaggtgcagttaacacccgggcagactgaagtgaaaatagatctgccgctcccgattgtggcaagtaatctcatgattgagttcgcagatttctatgagaactatcaggcatccaccgaaacactccagtgtcctaggtgctccgccagcgtaccagccaatccaggcgtttgcgggaattgcggggagaatgtgtatcagtgtcacaagtgccgaagcataaattacgatgagaaggacccttttctgtgcaatgcctgtgggttttgcaaatatgccaggtttgactttatgctctacgcaaaaccttgttgcgctgtggatcctattgagaatgaggaagaccgtaagaaggccgtgtccaacataaacacactgctggataaggccgacagggtgtaccaccagctgatgggacaccgtccacagctggagaatctactctgtaaggtgaatgaggctgccccagagaaaccccaggttgttcccaggtgcaaaggacacctggataaaggtctaggactcgatcagaagaccgcaagctag

SEQ ID NO: 31729 - DNA, 2673 bp, Artificial Sequence
  Description of Artificial Sequence: Synthetic coding sequence
atgctggaagacatgacaacaggaactgaatcagagaccaaagctttcatggccgtgtgtatagaaaccgctaaacgatataacctcgacgattatagaacacctgtgttcatctttgagcggctgtgctccattatttaccctgaggagaatgaggtgaccgagttcttcgtgaccctggaaaaagatccccagcaggaggacttcctgcagggcagaatgcctggcaatccatattcttccaatgagcctggcattggacccctgatgagagatataaagaataaaatatgccaggattgcgacttggtggctctactggaagacgactctgggatggagctgctggtgaacaacaaaattatctcactggacttgccggtggcagaagtctacaagaaggtttggtgcacgactaacgaaggggaacccatgcggattgtgtataggatgagaggcctgctgggtgatgctaccgaggagtttattgaatccctggattctacaacagacgaagaggaagacgaagaggaggtgtataaaatggccggggtgatggcccaatgcggcggactcgaatgcatgctgaaccggttggctgggatacgtgactttaagcaaggacgacacttgctgacggtgctgctcaagctgttttcatactgtgtgaaggttaaggtcaacagacaacagttggtcaagctcgaaatgaataccttgaatgtgatgctgggcactctcaatctggcactagtggccgaacaagagtccaaggacagcggtggcgccgcagtggccgaacaggttcttagcataatggaaatcatcctggatgaaagcaatgccgaaccgctgagtgaggataagggaaatctcctccttacaggagacaaagaccagctggtgatgttgctcgaccagataaattccacttttgtcaggtccaaccccagtgttctgcaaggcctcctcagaatcataccttaccttagttttggagaggtggagaaaatgcagattctcgtcgagcgattcaaaccctactgcaattttgacaagtacgacgaggaccactccggcgatgacaaggtctttctggactgcttttgcaaaatagccgccggaattaagaataactcaaacggacaccaactgaaagacctgattctccagaaaggcattacccaaaatgccctcgattatatgaagaagcatattccttcggcgaaaaacctggatgctgacatttggaaaaaattcctgtcccgcccagcactgcctttcattcttcgattgctcagaggactcgcgattcagcatcccggcactcaggtacttattggaacggacagtattccaaacttacacaaactggaacaggtaagctcagatgaggggattggaacgcttgctgagaatcttctcgaagcactgagagagcatcctgatgtgaataagaaaatcgatgcagctaggcgcgagacaagggccgagaaaaagaggatggccatggcaatgagacaaaaagcgttgggcacactgggaatgaccaccaacgaaaaaggtcaggtggtgacaaagactgctctcctcaagcagatggaagaactgattgaggagccgggactgacctgctgcatttgtcgggagggatacaaatttcagccgacaaaggtcctcggcatatatactttcaccaaacgggtggccttagaggagatggaaaataagcctaggaagcagcagggttattctacagtgtctcatttcaatatcgtccattacgattgccacttggccgccgttcggttggcccgcggccgcgaagaatgggaatctgccgcgctgcaaaacgccaacaccaagtgcaatggcttgctccctgtgtggggcccacatgtgcctgaatctgcattcgctacatgtctggcccggcacaacacttaccttcaggaatgcactggacagagggagccaacctaccagttgaacattcacgatattaagctgctctttcttagatttgccatggaacagagtttcagcgccgacaccggaggagggggcagggaaagcaacatacatctgatcccctacattatccatacggtcctgtacgtgttgaacacaactcgggctacctcacgtgaagaaaaaaacctccagggatttttggaacagcctaaggaaaaatgggtagaaagcgctttcgaagtggacggcccctattactttacagtgttggccctccacatcttgccccctgaacagtggcgggcaaccagagttgaaatcctccggcgcctgcttgtaacctcccaggcccgagcagtcgccccaggaggagcaactcggctcactgacaaagcagtcaaggactattctgcttatcggagttctctattgttctgggctttggttgatctgatctataacatgttcaagaaagttcccaccagcaacacagagggaggatggtcatgtagtttagccgaatacatccgtcataacgatatgccaatatacgaagccgccgataaggctctgaagacctttcaggaggaatttatgcccgtggagacatttagcgaatttctggacgtggctggattactatcagagatcacagacccggaatccttcctcaaggatctgctgaattccgtgccctag

SEQ ID NO: 31730 - DNA, 777 bp, Artificial Sequence
  Description of Artificial Sequence: Synthetic coding sequence
atgggcccaggcaagaagggtcgatgtagggaggaaggtcctggccgtggcagaagggcgtggatcataagaggctctggatccagccgccaaggatgggttggctccgtagagtccagcaagaggtctgccaacgtcacccgacagagacagatcgaacagatattaccagccctggccgctggatcttgctttcacccagcttttatattatcctgcagattctcttcaaggacccgcgctaccagccgggaagaaaaaaatctacaaggcttcttggaacagccaaaggagaagtgggtggagtcggctttcgaggtggatggcccctattattttactgtgttagctcttcatatcctgcctccggagcagtggcgcgctacaagagtggagatattacgccggctgctggtaacatcgcaggccagagccgtagcaccgggcggtgccacaaggttaacagacaaagccgtgaaggattactctgcatatcgttctagcttgcttttttgggctctggtggacctcatctacaatatgtttaagaaggtacccacatcaaataccgaggggggatggagctgttctctggcggaatacatacgccacaacgacatgcctatttatgaagcagccgataaagctctgaaaacctttcaggaggagtttatgccagtggaaacgttctcagagttcttagatgtcgctggccttctatccgagattacggatccggaaagcttcctgaaggatcttctgaacagcgtcccttag

SEQ ID NO: 31731 - DNA, 15480 bp, Artificial Sequence
  Description of Artificial Sequence: Synthetic coding sequence
atggcaacttcaggcggagaggaggccgccgccgctgccccagcgcccggcactcccgcgactggagcagacactactcccgggtgggaagtggctgtgagacctctcctttctgcctcctactccgctttcgagatgaaggagctgcctcaacttgtcgctagtgtgattgagtccgagtctgagatcctccatcatgagaagcaatacgagccattctacagttccttcgtggctctgagtacgcactacattaccaccgtgtgcagtctgatcccgcgaaatcagctgcaatcggttgctgctgcgtgcaaggtccttatcgagttcagcttattacggctggaaaatccggacgaggcctgcgcggtctcacaaaaacaccttatcctgctcatcaagggtctgtgcacaggctgtagcaggttggatcggaccgaaatcattacatttacagccatgatgaagtccgcaaaactaccacagacagttaagacactctccgatgtggaggatcagaaagagctcgcatccccagtgtctcccgagctccgccagaaggaagtccagatgaactttctgaaccagctgacatctgtcttcaatccaaggaccgtggcctcacagcctatttctacccaaaccctagtcgaaggcgagaacgacgagcagagttctacagaccaggcctctgcgatcaagactaaaaacgtcttcatagcacagaatgtcgcaagccttcaagagctgggtggctctgaaaagttgctcagggtgtgtctaaatctgccttatttcctgcgctacatcaatcgtttccaagatgccgtgctggcgaattcattctttatcatgcccgccacggttgcggacgccactgccgtgcgtaacggcttccacagtttggtcattgacgttacaatggccctggacacactcagtctgcctgttttggagcctctcaacccttcacgcctgcaggacgtaaccgttctgagtctttcctgcctgtatgcaggtgtgagtgtggcaacgtgcatggctatcctccacgtgggaagcgcccagcaggtgaggactggttcgacctcctccaaagaggatgactacgaatccgatgcggcaaccattgtacagaagtgtctcgagatctacgatatgatcgggcaggcgatttcctcctccaggcgcgccggaggcgagcattatcaaaattttcagctcctgggtgcttggtgtttgctgaacagtcttttccttattctgaacttgtccccaacggccctcgctgacaagggcaaggaaaaggatccgctggccgctctgagggtccgcgatattctcagccgcaccaaagagggagtgggaagtccgaaacttggtccaggaaagggtcaccagggcttcggagtgttgagtgtaatcctcgctaaccacgccatcaagctgttgactagcctctttcaggatttgcaggtggaagcactgcacaaagggtgggagaccgacggcccccccgctgccctgagtattatggcccagtccaccagcatccaacgcattcaacggttgatcgattctgtgcccctgatgaacctgctactgactttattgagcacctcctaccgcaaagcatgcgtgctgcagcggcaacgcaagggtagcatgagttccgatgcctcggcctccacggattccaacacatactatgaagacgacttctcgagtactgaggaggactcatcccaagacgacgattcagagcctatactaggccagtggtttgaagaaacgatcagccctagcaaggaaaaggctgccccgcctccccctccgccaccacccccactggagagctctccacgtgtaaagtccccctcgaaacaggccccaggcgagaagggaaacattctcgccagccgtaaagacccagaactttttctcgggttggcaagcaacattctgaatttcattacgtccagcatgcttaattccaggaacaacttcattaggaattacctgtcggtctcattgagtgagcatcacatggcgactctcgcaagtatcattaaggaagttgacaaagatgggctcaaagggtcaagtgatgaagagtttgctgctgctctgtatcatttcaatcacagtttggtgacatccgacctgcagtccccgaatctccagaacaccctgcttcagcagctgggggtggcgccgttctccgaggggccctggcctttatacatacacccacagtctctatcggttctgagccgcttgctcctgatatggcagcataaggcgagcgcacagggtgaccctgacgttccggagtgcctgaaggtctgggataggttcctctctactatgaaacagaacgccttgcagggagtcgtcccctcggagacggaggatttgaatgtcgagcatctccaaatgctactgctcatattccacaacttcaccgaaactggacgtagagctattctctcgttgttcgtccaaattattcaggaactgtctgtgaatatggacgcccaaatgagatttgtgcccctgattctcgccaggctgctgctgatcttcgattacctgttgcatcaatacagcaaagcccctgtctacctgttcgagcaggttcaacacaacctactgagccctccctttgggtgggctagcggcagtcaggatagcaactccagaagagcgacaacacctctgtatcacggatttaaagaggtagaggagaactggtctaagcacttttcatccgatgcagtcccgcacccacggttttattgcgtgttgtccccggaggcttctgaagatgatctcaaccgcctggattccgttgcctgcgacgtcctcttttccaaactggtcaagtatgacgagctttacgccgcccttactgcccttcttgccgccggaagccaactggacacagtgcggcgtaaggagaataaaaatgtgactgctcttgaggcctgcgccctgcagtactactttctgatcctgtggcggatacttgggatactcccacccagcaaaacatacattaaccagctttctatgaatagccccgagatgagtgaatgcgatatcctacatactttgcggtggtcgagccgactgaggatcagttcgtacgtcaactggataaaagaccatttgatcaagcagggcatgaaggccgagcacgcttcttcactgcttgagctggcatccacaacgaaatgctcttctgttaagtacgacgtggagatagtagaggagtacttcgccagacagatctccagtttttgcagcattgattgcaccaccatcctccagcttcatgagattccttccctgcaatctatttacaccctggatgctgccattagcaaagtacaagtctctctcgatgagcacttttccaagatggcagctgagactgacccacataaatcatcggaaatcacgaaaaaccttctgcccgcgacgttgcagttgatcgacacatacgccagcttcactagggcatacctcctgcagaatttcaatgaagagggtacaacggagaagcccagcaaagagaagcttcagggtttcgccgcggttctagccatcggaagttcccgctgcaaggccaacaccctgggcccaacactggtgcagaacctcccctcatcagtccagaccgtctgtgagagctggaacaatataaatacaaacgaattcccaaacattgggtcttggcgtaacgcatttgcaaatgacaccataccctccgaatcatatatatcagcagtgcaggccgcccacctcggcaccctctgtagccagtctttacccctcgcagcaagtttaaaacacactttgctgtcactcgtccgcctcactggagacttgatcgtgtggtctgatgagatgaatcccccccaggtcataaggaccctcctcccgctcctgctcgagtcaagcactgagtcagtggccgagatctcgagcaacagtctcgagcgaatcctcggccctgccgagagcgatgagtttttagctagggtatacgagaaactgattacaggttgctacaatattctcgccaaccatgccgatccaaactctggattggacgaaagcattcttgaggagtgcctgcaatatctagagaagcagctggagagttcacaggccaggaaggccatggaagaattcttttccgattcaggcgaattagtgcagatcatgatggccactgccaacgagaacctctcggcaaaattttgtaatcgcgtgcttaaattcttcacgaagcttttccagctgaccgagaagagcccaaacccatctttgcttcacctgtgcggtagtctggcacagttggcgtgcgtcgaacccgtacgactccaggcatggctgactaggatgacaacaagcccccccaaggacagcgaccagctcgacgttatacaggaaaacaggcagctcttgcaactattgacaacttatatcgtgagagagaattcccaggtgggtgagggcgtatgcgcagttctcctggggacacttactcccatggcaacagagatgctagccaacggagatggcaccggcttccccgaactcatggttgttatggccactctcgcctctgccggccaaggcgccggacacctgcagcttcataatgctgcagtagactggctttcccggtgcaagaaatacttatcacagaaaaatgtcgtggaaaagctgaacgccaatgtgatgcacggaaaacatgttatgattctggaatgcacgtgccacataatgtcctatctggccgatgtgactaatgccttgagccagtctaatgggcaagggcccagtcacctctcggtcgacggtgaagagcgggccatagaagtggattctgactgggtggaagagctagcagtggaagaagaggattctcaggccgaagactccgatgaagactctctctgcaataagctctgcaccttcactattacacagaaggagtttatgaaccaacactggtaccattgccatacctgtaaaatggtggatggagtgggcgtgtgcaccgtgtgcgccaaggtttgccataaggaccacgagattagttacgctaagtatgggtcgtttttctgtgactgcggtgctaaagaggacggctcttgtctggctctagtgaaacggactccatcatctgggatgtcatcgaccatgaaagaaagcgcattccagagtgagcctcgaatttctgaatccctggtcagacacgcctctacatcgtcacccgcagacaaggcaaaggtaacaatatctgacgggaaggtggctgatgaggaaaagccaaaaaaaagcagcctttgccggacggtggagggatgtcgagaggaacttcaaaatcaggcaaacttttctttcgcacctttagtcctcgacatgctgaacttcctcatggacgcaattcagacaaatttccagcaggcctctgctgttggaagttcttcccgcgcgcagcaagcactatccgaattgcataccgtggagaaggccgtggagatgaccgaccagttaatggtgcctacactaggcagtcaggagggggctttcgagaacgtgaggatgaattatagcggcgatcagggccaaacaatcaggcaactgattagtgctcacgttttgcggcgcgtagcgatgtgcgtgctgtcctcccctcacggcaggcggcagcatttggcagtaagccacgagaaaggcaaaatcaccgtgctccagctgagcgccctgctcaagcaggccgactctagtaagagaaaacttacactcactagactggcctccgcaccagtacccttcaccgttttgtcactcacaggcaatccatgcaaggaggactatcttgccgtgtgtggattaaaggactgtcacgtgctgaccttctcctcgagtgggagcgtgtccgatcacctggtgcttcacccacagctcgccaccgggaatttcataatcaaagccgtgtggctgccgggcagccagacagaactggcgatcgtgaccgcagacttcgttaagatttacgatctctgtgtagatgccttatctcccactttttatttcttgctaccctcgagcaaaattagggacgttacctttctcttcaatgaggagggcaagaacattatcgtgatcatgagcagtgcgggctacatttatacacagctaatggaggaggccagcagtgcgcagcagggcccattttatgttaccaatgtgctagaaattaaccacgaagacctcaaggacagcaacagccaagtcgccggaggcggagtgagcgtttattattctcacgtgttacaaatgttatttttcagttattgccaaggaaagtcatttgccgctacaataagccggactacactggaagtactgcaattgttccccattaatatcaaatctagcaacggggggtccaagacaagtccagctctgtgccagtggagcgaggtgatgaaccaccctggcctggtgtgttgcgtccaacagacaaccggagtcccattggtggtgatggtgaagcctgacacattcctgatacaagagattaagacactgcccgctaaagccaagatacaagacatggtcgccattagacatacagcttgtaacgaacagcagcgcactaccatgatcttgctgtgtgaggacgggagccttagaatctatatggcaaacgtagagaacacaagttattggctgcagccttctttgcagccatcttcagttatatctataatgaagccagtgagaaagaggaaaacagctacgattaccacaaggacatctagccaggtgacctttcccatagacttcttcgaacataaccaacagctcacagacgttgagtttggcgggaacgatctgcttcaggtctataacgctcagcagatcaagcatcgcttaaatagcaccggcatgtatgtggcaaatacaaagcccggcggcttcaccattgaaatcagcaacaataactctaccatggtgatgaccgggatgaggattcagataggaacccaggccatcgaacgcgcgccttcgtacatcgaaattttcggccgcaccatgcagctgaatttatcacgcagtcggtggttcgattttcctttcacaagggaagaggccctccaggcggacaagaagctgaacctgtttataggcgcgagtgtagaccccgccggagtaaccatgattgatgccgtgaaaatttacggtaaaacgaaggaacagtttggctggcctgatgaaccacccgaggaattccccagtgcaagtgtctcgaacatctgtccttcaaatttgaaccaaagcaacggcaccggtgactctgactcagcagcgccaacaacgacaagcggaactgttctggagtcgagcgaaacagagtctctgaccaagctcgatagattggtagtaagttcattggaggcgctagagagctgcttcgcagtgggtcccatcattgagaaagagcggaataaaaatgcggcccaagagctggccacgttgcttctgagtctgcccgcgccggcaagtgtgcaacagcaatcaaagagtctgttagcatccctgcacacatctaggtcagcttatcattcccataaggaccaggccctgctgagcaaagctgtacagtgcctcaatactagtagtaaggagggaaaagatcttgatcccgaggtctttcagaggttggtgatcaccgcaaggtccattgctattatgcgccccaacaacttggttcactttacagaatctaagctgccacagatggaaaccgagggaatggatgagggcaaagagccccagaaacagctggaaggtgactgctgcagctttattacccagctcgtgaatcatttctggaagctgcacgcgtctaagcctaagaatgcttttctcgcgcccgcgtgtctgcccggcctaacacatatcgaggcaacagtgaatgccttggtcgatatcatccacggctattgcacatgcgagctggactgtatcaacaccgcctctaagatttatatgcagatgctcctgtgtccagatcccgccgtatccttctcatgtaagcaggcactgatccgcgtattacggccacgtaacaagcgtcggcacgtaacacttccgtcatcccccagaagtaacacaccaatgggcgataaagatgacgatgatgacgatgacgcagatgaaaaaatgcagtcaagcggcattccgaatggaggtcatattcgccaagagtcgcaggagcagtccgaggtggaccatggggacttcgagatggtaagtgagagtatggttcttgagacagccgagaacgtgaataatgggaacccaagtcccttggaagccctcctcgccggagcagagggcttccctcccatgcttgacatccctcccgatgctgacgatgagacaatggtcgaactggccatcgctcttagtctgcaacaggaccagcaggctcctgcctctgatgatgaagggagtaccgcagctactgacgggtcaacgcttcggacgtctcccgctgatcacggaggctcggtgggctctgagagcgggggatcagcggtcgacagcgtggcaggtgagcacagtgtaagcggtcgttcaagcgcctatggcgatgccaccgctgaggggcaccctgcgggacccggaagtgtcagtagctccactggcgctatcagtactacaacaggccaccaggagggggacggcagcgaaggtgagggcgaaggagaaactgaaggagacgtgcacacatctaacaggctacacatggttcgcctgatgctcctcgagagactgctccagacattaccccagcttcgcaacgttggaggcgtgcgtgccattccttatatgcaagtaattctcatgttgacgaccgatcttgatggcgaggatgagaaagataaaggcgcgctcgataatttgctttctcagcttattgctgaactaggtatggacaagaaggatgtaagcaaaaagaacgaacgctccgctctcaacgaggtccacctggtcgtcatgagactgttgtccgtcttcatgagccggaccaagtctggtagtaagagcagcatctgcgaatcttcttccttgatttcttccgcaacggcagccgccctcctgtcatcaggcgcagttgactattgcctccatgtcctgaaatcccttctggaatattggaaaagtcagcagaacgatgaggaaccagtggccacctcgcaattactcaaacctcacactacttcgtcccccccagacatgagccctttttttctgaggcagtacgttaagggccacgccgctgacgtgtttgaggcatacactcagctcctgactgagatggttctacggctgccctaccagattaagaagatcaccgacacaaactcacgcataccaccacctgtgtttgaccacagctggttctacttcctgtctgagtacctcatgattcagcagacgccctttgttaggcgccaggtgaggaaattattgctgtttatttgtggttctaaggagaagtataggcagctgagggacctgcacacattggattcacacgttcgagggattaagaagctgctcgaggagcagggaatcttcctgcgtgcatccgtggtcactgcatctagcggctccgctctccaatatgatactcttattagcctgatggagcacctgaaagcgtgcgctgaaattgccgcacagcggactattaactggcagaagttctgcataaaggatgactcagtgctgtatttcctcctgcaggttagttttctggtcgacgaaggggtttctcccgtgctcctacaactgctgagctgcgctctctgcggaagtaaggtcctcgctgccctcgctgcatcctccggatcatcaagcgccagcagcagctccgccccggttgcagcgtcttcagggcaggcaactactcaaagtaagagtagtacaaagaagtcgaaaaaagaggaaaaggagaaggagaaggacggagagacctcaggttcacaggaagatcagttgtgtaccgccctggtgaatcagcttaataaattcgccgacaaggagactctgattcaatttctccggtgctttcttcttgaatctaacagtagtagcgttagatggcaggcacactgtctgacactacacatctatagaaatagctctaaatcgcagcaggaactgcttttggatttaatgtggagcatatggccagagctgccagcttatggccgtaaagctgcgcagttcgtggacttgttgggctacttcagcttgaagacccctcagaccgaaaagaagctcaaggaatacagccagaaagctgttgaaatactccggacccaaaaccacatactcaccaaccacccaaactccaacatctataataccctgagcggcctggtggagttcgacgggtattaccttgagagcgacccctgcctggtctgcaataatcccgaagtgcctttctgctacattaaactgtcctcaattaaagtggatacacggtatacgaccacgcaacaggtggtgaaattgattgggtctcacacaatcagcaaagttacagtcaagatcggcgacctcaaacggactaaaatggtgcgtacgattaacctatactataacaaccgtactgtccaggccattgtggagctgaagaataaaccagctcgttggcacaaggccaagaaagtacaactgacaccaggtcagacggaggttaaaattgacctcccactacccatcgttgcctcgaaccttatgatcgagttcgccgatttctacgagaattaccaagcctccacggagacactacagtgtcctcgctgctccgcttcagtgccagcaaaccccggtgtgtgcggtaactgtggcgagaacgtttatcagtgccacaagtgtcggtccataaactacgatgaaaaagatcctttcttatgtaatgcatgcgggttttgtaagtacgctcggttcgacttcatgctgtacgctaaaccatgctgtgctgttgatccaatagagaacgaagaggatagaaaaaaggctgtctcaaacattaacactcttctggacaaggcagaccgtgtctaccaccagctgatgggacacaggcctcaattagaaaatctgctgtgtaaggtaaacgaggccgcccccgagaaaccccaggacgactctggcacagcaggtgggatcagttcgacttcagcatccgtgaatagatacatcctacagctcgctcaggaatattgtggggattgcaaaaattcttttgatgagctgagcaaaatcattcagaaggtttttgccagccggaaggagctgctcgagtatgatctgcagcaaagggaagctgcgacaaagtctagcagaaccagtgttcagcccaccttcaccgccagccagtaccgggccctctctgtcctggggtgtgggcatactagtagcactaaatgttacggatgcgcctccgctgttaccgagcactgtattactttgctgcgcgctcttgcaaccaacccagccttaagacatattctggtgtctcaaggcttgatcagggagcttttcgactacaacctccgccgaggggccgcggccatgcgggaggaagttagacagcttatgtgtttgctcacacgggacaacccagaagctacgcagcagatgaacgatctgattatcgggaaggtatctaccgcactcaaaggccattgggctaatccggacctggcatcctccttgcaatacgagatgcttctccttaccgattcaatctctaaagaagattcttgttgggagctgcgcctgcgatgtgccctgtctctgttcctgatggccgttaatataaagacccccgtggtagtggaaaatatcactctgatgtgtctcaggatcttgcagaaactgattaagccgcccgcccctacatctaagaaaaacaaagacgtgcccgtagaagctctgacaacagtgaagccatattgtaatgagatacatgcacaggcgcaactatggctcaagagggaccctaaagcaagctatgatgcatggaagaagtgtttacctattagggggatcgatggaaatggaaaagcccccagcaaatctgagttgcgacacctctatctcactgaaaagtatgtctggcggtggaaacaatttctctctaggcggggcaagaggacgtcgcctctcgacctgaagttaggacacaataactggctgcgtcaggtcctgtttacacccgctactcaggctgcccgacaggctgcctgcactatcgttgaggctctggccaccatccctagccggaaacagcaagtgcttgatttattgacttcctacttggatgagctgagcatcgctggtgaatgtgccgccgaatacctggccctgtaccagaagctaatcacatccgctcactggaaagtctacttggccgctagaggggtgcttccttatgtggggaatcttatcactaaagagatcgctagactcctggcgctcgaagaggccaccctcagcacagatttgcagcagggatacgcccttaaaagtctcaccgggctgctatccagtttcgtggaggtggagagcatcaaacggcacttcaagagcaggttggtcggcaccgtgcttaacggatacctttgtctacgcaaactagtggtgcagagaacgaaactcatcgacgaaacacaggacatgctgctcgagatgttggaggacatgacgaccggaactgagagtgaaactaaagccttcatggctgtgtgcatcgagaccgccaagagatataatttagacgattaccggacccctgtattcatattcgaaagactctgttcgatcatctacccagaagaaaatgaggtgacagaatttttcgtgacgttagagaaggacccgcaacaggaagactttctccagggaaggatgcccgggaatccctactcctctaacgagccagggatagggcccctgatgcgagatattaagaataaaatttgtcaggactgcgatctcgtagccctcttggaggatgactcgggaatggagctgttagtgaacaacaagattattagcttggacctccctgtggcagaggtctataaaaaggtgtggtgcacaacaaacgagggggaacctatgcgcattgtgtaccgaatgcggggattgctgggagacgcaaccgaggagttcattgaatccctggactctacaaccgacgaggaagaagacgaagaagaggtttacaagatggccggggtgatggctcagtgcggtggactggaatgtatgctcaacaggctggcaggtattcgtgactttaaacaagggcgacacctgctgactgtgttattgaagctcttttcttactgcgtgaaggttaaggtgaatcggcaacagctggttaaactggagatgaacactctgaatgtcatgctaggcacgctgaacctcgctctggtcgctgaacaggagtcgaaggacagcggcggagctgctgttgccgaacaagtgctatctatcatggagatcattctggacgagagcaacgccgagccattgtccgaagataagggcaatttgctactgaccggggataaggaccaacttgtcatgctgctggatcagattaatagcaccttcgtgagaagcaacccatcagtgctccagggccttctgaggatcattccatacctgagttttggcgaagtggagaagatgcaaatcttggtggagaggtttaaaccctactgtaatttcgacaagtacgacgaagaccactcaggcgatgataaggtcttccttgactgtttttgcaagatcgccgccggaatcaagaataactcaaacggacatcaactgaaggacttaattctgcagaagggtattacgcaaaatgcactggattacatgaagaaacacatcccaagcgctaagaaccttgacgcagacatatggaaaaagtttctgtcccgcccggcgttaccatttatcttaaggctattgcgaggtctggccatccagcacccagggacacaagtgctcatcggcacagattcgatacccaacctgcacaagcttgaacaggtgagctccgacgaagggattggtaccttggctgagaacttgctggaggctctgcgggagcacccggatgtcaataaaaagattgatgccgctaggagagagacccgagccgagaagaagcggatggcgatggctatgcgtcagaaggctttaggcacactgggaatgaccactaacgaaaagggacaggtggtaacaaaaaccgccctcctgaaacagatggaggaattgattgaagagcctggactgacatgttgtatttgtcgcgaggggtacaaatttcagcctacaaaggttctgggcatttacactttcacaaagcgtgtggctctcgaggaaatggaaaataagccacgcaagcagcaaggctactcaaccgtcagtcactttaatatcgtgcactatgattgtcacttggcggccgtgcgcctggcaagagggcgagaggaatgggagtccgcagccttgcagaatgcaaatacgaagtgcaacggactgctccctgtttgggggccccacgtgccagagagcgccttcgcaacgtgcctcgcacgacataacacctacttgcaggaatgtaccggacagcgcgagcccacttatcagttgaacatccacgatattaaactgctcttccttcgcttcgccatggagcagtcctttagcgctgacacgggcggcggtggccgggagagtaatatccacctcatcccatacataatccataccgttctgtatgtgctaaatacaacacgagctacaagcagagaggaaaagaatctccaggggttcctggaacaaccaaaggagaaatgggtagaatccgcattcgaggtcgacggcccctactatttcacggtgctggctttgcacatccttcctcccgaacagtggcgagccacacgggtcgaaattctgaggaggctactggtgacatcccaggctcgcgctgtggcacctggaggggctacacggttaactgataaggctgttaaagactactccgcctacagaagctcgctgctgttttgggcactggtggacttgatttacaacatgtttaaaaaggtacccacatccaataccgaaggtggatggtcttgcagcttggctgagtacatacgccacaacgacatgcctatatacgaagcagctgataaggcgctcaagacctttcaagaagagttcatgcccgtggagacattcagcgaattcctggatgtcgcaggcctgcttagcgaaattacggaccccgaaagctttctaaaggatttactgaattcggtaccttag

SEQ ID NO: 31732 - DNA, 15552 bp, Artificial Sequence
  Description of Artificial Sequence: Synthetic coding sequence
atggccacaagtggcggagaggaagccgcagccgcagccccagcaccgggaacacctgccacaggcgccgacaccacacctggctgggaagtggccgtgcggcctctcctgagtgccagctatagtgcttttgaaatgaaagaactccctcagctagtggccagcgtgatagaaagcgagagcgagatcctccaccatgagaaacagtacgaaccattttacagcagtttcgtagccctgtccacgcactatattacgaccgtgtgttctttgatacccaggaatcaactgcagagcgtggctgcagcctgcaaggtgcttatcgagttttctctcctgcggctggagaacccagacgaggcttgcgcagtgtctcagaaacacctcattctgctgattaaggggctatgtaccggctgtagcagactggataggaccgaaatcatcacatttaccgcaatgatgaagtcagcgaaactgcctcagactgttaagacactgtcagacgtggaagatcagaaggagttggcttctccagtttctccagaactgcggcagaaagaagtccaaatgaacttcctgaaccagctgacttctgtatttaacccacggacggttgcatcgcagcccataagcacacagacattggtggaaggcgagaatgacgagcagtcaagcactgatcaagcgagtgctattaagaccaagaatgtgtttattgcgcaaaatgttgcatcactgcaagaacttggcggtagcgagaagctgctcagagtatgtctaaacctgccttacttcttacgctatataaacagattccaggacgcagtcctggccaattcctttttcatcatgcccgcaacagtcgccgacgctactgccgtgagaaatggcttccactcactggttatcgatgtgactatggccttggacactctaagtctccccgtcctggaacctctgaacccctcccgactccaggacgtgaccgtcttgtcactaagctgcctatacgcaggtgtgagcgtggccacttgcatggccatactccatgtgggctcagctcagcaggtgcgaacaggcagcacatcatcaaaagaagacgattatgagagcgacgcagctactatcgtacagaaatgtcttgaaatttatgatatgatcggccaggcaatttcctctagccgtcgagccggaggagagcactaccaaaatttccaattacttggcgcatggtgcctacttaactccttatttctgatactgaacctgagccccacagctctggccgataagggcaaggagaaagatccattggcagctctgcgcgtgagggacatcctgtccaggaccaaagaaggcgtgggatcccccaaactgggccctggaaagggccaccagggatttggcgttttgagcgtgatcctagctaaccacgccatcaagctgctgactagtcttttccaggacctacaagtcgaggccttgcataagggttgggagaccgatggccctcccgcagcattatcgataatggcccaaagcactagcatccagcgaatacagcgactgattgattccgttcctcttatgaacctgctgctgactctgctctccaccagctaccgaaaagcttgtgttctgcagaggcagcgaaaggggtcaatgagttctgatgccagcgccagcactgattccaatacctactatgaggatgatttttcttccaccgaagaggacagctcgcaggatgacgactccgagcccatactcggacaatggttcgaagagaccatcagcccctcaaaagagaaggctgctcctccccctcccccaccccctcccccgctcgaaagtagtcccagagttaagtcacccagtaagcaggcccctggcgaaaagggtaacatcctagcgtctagaaaggaccctgaactgtttttggggcttgccagcaatattctgaactttatcacgtctagtatgctgaactcgaggaacaactttattaggaactacctctcagtgagcctctccgagcatcatatggcaacgctggctagcataattaaagaggtggacaaggatggcttaaagggttcttctgacgaagaatttgcggccgctctctatcacttcaatcactctctcgtgacttcagatctgcagagcccaaatctccagaatactttactgcaacaactgggcgtagctccattctccgagggcccctggcctctttacattcatccccagagtctgtcagtgctttcaagattgctgcttatttggcaacacaaagcaagtgcccaaggggaccccgacgtgccggaatgccttaaggtctgggaccgattcctgagcaccatgaaacaaaacgcactgcagggggttgttccatctgaaaccgaggatctgaacgtagagcacctgcaaatgctgcttttgattttccacaacttcacagaaaccggaaggcgggccatccttagcctcttcgtccaaattatacaggagctatccgttaatatggacgcacaaatgaggttcgtgcccctgattctcgcaaggttgcttcttatcttcgactatctgttacaccaatacagcaaggcaccagtttacttgttcgaacaagtacagcacaatctcctcagtcccccgtttggatgggcatctgggtcacaagattccaactcccgtagggccaccacacctctgtatcatgggtttaaagaagtcgaagaaaattggtcgaaacacttcagtagtgacgctgtaccacatccacgattctactgcgtactcagtccagaagcaagtgaagacgacctgaaccgtctcgactccgtggcctgtgacgttctgttttctaaattggtcaagtatgatgagctctatgccgctctgaccgccctgttagctgcaggaagtcagttagataccgtcagacgcaaagaaaataaaaatgtcaccgccctagaggcttgtgctctccaatattattttctgattctctggcggattctagggatcctaccaccctccaagacatatattaaccagctctctatgaactccccagagatgtctgaatgtgacattttgcacactcttcgctggtcttctcgcctgcgtataagtagttacgtcaattggatcaaggaccatctgatcaagcagggtatgaaagctgaacatgcctcctcgcttctcgagctcgcctctaccaccaagtgttcgtcagtgaagtatgacgttgagatcgtggaggaatactttgcgcgccagattagctctttctgcagcatcgattgtaccaccatactccagctgcatgagatcccaagtcttcagtccatctatactctggatgccgctatctcaaaggtgcaggtgagtctggacgaacacttctccaagatggcagcagagaccgatcctcataaaagctctgagataaccaagaacttgctgcctgccacacttcagctgattgacacctacgcttcctttacacgcgcctacctgctccaaaactttaacgaggagggtactacggaaaagccgagtaaggagaagctccaggggttcgccgcagttttggccatcggtagtagccgatgcaaagccaacactctcggcccaactcttgtgcagaacctgccctcttcagtacagaccgtttgtgagtcctggaacaatattaacaccaatgaatttccgaacatcggatcatggcggaacgcatttgccaacgatacgattccttctgagtcttacatttccgccgtacaggccgcccacctaggaactttgtgttcgcaaagccttccactcgctgccagtttgaaacataccctcctgagcttggttcggctgactggagacctgatcgtctggagcgacgagatgaatcctccacaggtcataagaacactgttgccacttctgctggaatcctctacagaatccgtcgcggaaattagttcaaacagcctggagaggatcctggggcctgccgagtcagacgaatttctcgcccgggtctacgaaaagctgattaccggttgttataatatcttagcaaaccatgctgatccaaactccgggctggacgagagcatcttagaggaatgcctccaatatctggagaaacagctcgagagcagtcaggcacggaaggcaatggaagagttcttttccgactcaggtgaactggtgcagataatgatggcaactgccaacgaaaatttaagcgcaaagttttgtaaccgggtgctcaagttctttaccaagctgtttcagcttacggagaagagtccgaatcccagcctactccacctttgtgggtcgctggcccagctggcatgcgttgaacccgtgcggttgcaagcctggctcacaaggatgaccactagtccccccaaagattccgatcaactggacgtgattcaggaaaaccgccagttgctgcagctgctgacgacttacattgtgcgggagaatagccaggttggagagggtgtttgcgccgtcctgctggggaccctgacccccatggcgactgagatgttggctaacggtgatggtacaggcttccccgagctgatggtggtgatggctaccctcgcctcggcaggtcagggggcagggcacctgcagctgcacaatgccgccgtcgactggttgtccagatgcaagaagtatttatctcagaaaaacgtggtcgaaaaactgaatgcaaacgtcatgcatggcaagcatgtcatgattttggaatgcacctgccacatcatgagttacttggcggacgtcactaatgccctcagccagtccaatggtcagggcccttcccacctctccgtggacggagaagagagggccattgaagttgactcggactgggtggaagagctcgcagtggaagaggaagattcccaagccgaggatagcgacgaggattctctctgtaataagctgtgcacttttaccattacccaaaaagagttcatgaaccaacactggtatcactgtcatacttgtaaaatggtggacggtgtaggagtgtgcacagtctgcgctaaagtttgtcataaggatcacgagatcagctatgcaaagtacggtagttttttttgcgattgcggtgcgaaagaagatggctcatgccttgccctggtcaagcgtactccctcctccggtatgtccagcacaatgaaagaaagcgcctttcagagcgagcctcggatctctgagtcgcttgttcgccacgcttcaacttctagtcctgccgataaggctaaagttacaatcagcgacggtaaggtggctgacgaggagaaacctaaaaagagctctctctgtaggacagtggagggttgtcgtgaagagctgcagaatcaggctaattttagctttgccccactcgtgctggacatgttgaactttctcatggatgccatccaaacgaatttccagcaagcctccgccgttggttcttcctctagagcccaacaagccctgtccgagctccacaccgtggaaaaagcggtagagatgacagatcagcttatggtgccaacacttggcagtcaggagggtgcattcgagaacgtaagaatgaactacagcggcgaccaaggccagacaatcaggcagctaatctctgcccacgttctacggcgcgttgctatgtgtgttctgagcagcccccatggacgcaggcagcatctcgccgtctctcacgaaaaggggaagatcacagtgctgcaacttagtgccctcctgaagcaggccgactccagcaaacgaaagctaaccctcactagacttgcctcagcccccgtcccgttcacagtgcttagcttgaccggtaatccatgcaaggaagattacctggcagtgtgtggtctgaaggactgtcacgtgctgaccttctccagcagtggaagcgtaagcgaccatttggtactgcatccccaactcgctactggcaacttcattattaaggcagtgtggctacctgggtcccaaaccgaacttgcgatagtaacagcagattttgtgaagatctacgacctgtgtgtggacgcactgtcccccactttttattttctgctcccaagttcaaagatccgggatgtcacgtttttgtttaatgaggagggaaagaacattattgtgattatgtcatccgccggctacatttatacacagctcatggaagaggcctcttccgcgcagcagggcccgttttacgtcaccaacgtcctggaaatcaaccacgaggatctgaaggacagcaacagtcaggtcgccggcggaggcgtcagcgtctactactctcacgtcttgcaaatgctgtttttctcttactgccaaggcaaaagctttgccgctaccatttcaaggacgactcttgaggttctgcagctgtttcccatcaacattaagtcatctaatggcgggtccaagacctctccagctctttgtcagtggtccgaggtgatgaaccaccctggactcgtgtgttgcgtacagcagacaacaggcgtgcccctcgtggtcatggttaaacctgatactttcttgatacaggagatcaaaactctgccagcaaaagcaaagatccaggatatggtcgctatccggcataccgcatgcaacgagcagcaaaggacaacaatgattctgctgtgtgaggatggttctctgcggatttatatggccaatgtggaaaatacctcatactggttacagccgtccctgcaacctagctcggtgatttcaatcatgaaacccgtgcggaaacgaaaaacagcaacaatcactacacgcactagctcccaggtgacttttcccattgattttttcgagcacaaccaacagctgaccgacgtggagttcggagggaacgatctccttcaggtgtataatgctcagcagatcaaacaccgcctgaactctaccggcatgtatgtcgccaatactaaacccgggggctttaccatcgaaatatctaacaataattctaccatggtgatgacaggtatgcgcatacagatcgggactcaagcgatcgagagagccccctcatacatagaaatctttgggagaaccatgcaactgaacctgagtcgatccagatggttcgatttcccatttactcgtgaggaagcactacaggccgacaagaagctgaatctcttcattggcgcatctgtagacccagccggcgttactatgatcgatgccgtcaaaatttatggaaaaacaaaagagcagttcggatggccagacgaacctcccgaggagttcccttctgcttcagtaagcaatatatgtccttctaatctgaatcagagcaacgggacaggcgactctgactctgccgcccctaccacaactagcggcacagtcctcgaacggcttgtggtgtcctctctggaagccctggagagttgctttgccgtcggccccattatcgagaaggagcggaacaaaaacgccgcccaggaacttgcaacgctactattatcactgcctgcgcccgccagcgtgcagcagcaatccaaatcgctgctggcctccctgcatacctctcggtccgcctatcatagtcataaggaccaggcactgctaagcaaagcagtgcagtgtctcaacacatcttctaaagagggaaaagatttggacccagaggtttttcagcgactcgtaatcactgcccgttcaatcgctataatgcgccccaacaacctggtacactttaccgaaagtaaactgcctcaaatggagacagaagggatggacgaaggaaaggaaccgcagaaacagctggaaggggattgctgcagctttatcacccagctggtgaaccacttctggaaactgcatgccagcaaacctaagaatgctttcttagcccccgcctgtctgcccgggctgactcacatcgaggctacagtcaatgcacttgttgacatcatccacgggtactgcacctgtgaactggactgcataaacaccgcatctaaaatttacatgcaaatgctgttgtgtcccgacccagcagtgagcttttcttgcaagcaggctctgataagggtcctgagaccgcgaaataagaggagacacgtgaccctcccttctagcccacgctcaaatactcctatgggcgacaaagatgacgatgatgatgacgatgcagacgaaaaaatgcagagcagcggcataccaaatggagggcacattcgacaggaaagccaagagcagagcgaggtggaccacggcgacttcgaaatggtgtctgagagtatggtgctcgaaaccgcagaaaatgtcaacaacggcaaccctagcccgttggaggctctccttgcaggggctgaaggttttccccccatgctagatatccctcccgacgcagacgacgagaccatggtcgaattagccatcgccctgtccctacagcaggatcaacaggggtctagttcatccgcactcgggcttcagtctctggggcttagcggccaggcaccatccagcagtagcttagacgctgggacgctgtccgacactacagcttctgcccctgcatccgacgacgaagggagcactgccgccacggacggtagcacactacgtacgtcaccggcagatcatgggggctctgttggatccgagagcggggggtccgcagtagattctgtggctggggagcattcggtttctggaagatccagcgcctacggagacgccacagcggaagggcacccagctgggcccggtagcgttagcagtagcacaggggctatatctaccaccactggccaccaggagggcgacgggagtgagggtgagggagagggcgagacagaaggagacgtgcatacaagcaatcggctacacatggtccgcctgatgctcctggagcggctccttcagactctgccacagctgcggaatgtaggtggagtccgagcaattccctatatgcaggtgattctgatgcttaccacagacttggacggggaagatgaaaaggataagggggcgctggataatctgttgagtcaactgatcgccgagcttggcatggataaaaaggacgtaagcaagaagaacgaaaggagcgcactgaatgaagttcacctggtcgtcatgagactactgtccgtgttcatgagtaggacaaagtcaggctcaaaatcttccatctgtgaatcgagttccctgatctcctctgctaccgccgcagcgctgctctctagtggtgccgtggattactgtctccacgtcctaaagtcgctcctcgagtactggaagtcccagcagaacgacgaggagccagtggccacttcgcagctgctcaaaccacataccacaagttcaccacctgatatgtcccccttcttcttgagacagtatgtcaaggggcacgccgccgatgttttcgaagcatatacccaattgctcaccgagatggtgctacgcttgccgtatcagataaaaaagattaccgacacaaactcaaggattccaccaccagtctttgatcactcatggttctatttcttgagcgagtacctgatgatccagcagaccccatttgtccgcagacaagtcaggaaactgctgctcttcatctgcggaagtaaagagaaatatcggcagctccgagaccttcacactctggacagccacgtgaggggaattaagaagctgctggaggagcaaggaattttcctcagggccagtgtcgtgaccgcatcttctggctctgcacttcaatatgataccttgatcagcctgatggagcatttgaaggcttgcgcagaaatcgcagctcagcgcaccatcaactggcagaagttctgtattaaggacgactctgtgctctactttttgctccaggtatcctttctggtggacgaaggcgtgtcccccgtcctcctgcaactgctgtcatgtgccttgtgtgggtcaaaagtgctcgcggctctggcagcttcatcaggcagtagcagcgcatcttccagttccgccccggtggccgcatcaagtggacaggctacaacacagtctaagtcgagcacaaaaaagtctaaaaaggaggagaaggagaaagagaaagacggtgaaacttcgggaagccaggaggatcagctgtgtacagctctagttaaccagctgaataaattcgcagataaagaaacgctgatccagtttcttcggtgtttcctgctggagagcaattcatccagcgtgcgttggcaagctcattgcctgacactgcacatatatcgcaatagtagtaaaagccagcaggaactgcttctcgacctcatgtggagcatctggcccgagttacccgcttatggtcgaaaggctgcccaattcgttgacctcctgggttatttttctctcaagacaccacagactgagaagaagcttaaggagtactctcagaaggctgtggaaattctgcgcacccagaaccatattctgacaaaccacccaaactccaacatttacaacacactcagcggtcttgtggagtttgacggctactatctggaaagcgacccgtgtctggtttgcaacaatcccgaggttcccttctgctacatcaaattgtcaagtattaaggtcgacacacgctacaccacaacacagcaggtggtgaagcttatcggatctcacaccatttcaaaggtgaccgtgaaaattggcgatctgaagagaacaaaaatggtgcgcactataaatctctattataacaaccgtacggtgcaggcaatcgtggaactgaagaacaagcctgcaagatggcacaaggccaagaaagtccaattaacgccaggacagacagaagtgaagatcgatctccctttgccaatcgtcgctagcaatctgatgatagagtttgccgacttctatgagaattaccaggcgagcacagaaacgctgcaatgtccaagatgctccgcatcagtgcctgctaatcccggagtttgtggaaactgcggggagaatgtttaccagtgtcacaagtgtcgctctatcaattacgatgagaaggaccctttcctgtgtaatgcctgtggcttctgcaagtacgccagattcgacttcatgctatatgctaaaccctgctgcgcggtggacccgattgagaacgaggaggaccgtaagaaagctgtctcaaacatcaacaccctcctggacaaagccgatcgcgtttatcaccaactgatgggccatcggccccagctggagaatctgctgtgtaaagttaacgaggctgcccccgaaaagccacaggatgactccggcacagccggcggcatctcatcaacttcagcctccgtgaaccgctatattctccaactggcccaggaatattgcggcgattgtaagaactcatttgacgagctaagcaagattatacagaaagtatttgcctcccgcaaggaactgctcgagtacgatctgcagcagcgggaagcggcgaccaagtcctccaggacctccgtccagccaacctttactgccagtcagtaccgggccctgtccgtgctgggctgcggtcatacatcaagcaccaaatgttacggctgcgcgtctgccgtgactgagcattgcatcacacttctaagagccctcgctactaatccagcgctgcggcacattttagtgagtcagggcttgatccgcgagcttttcgattacaatctccggagaggggccgcagctatgagagaggaagtaagacagcttatgtgtctccttaccagggacaatcctgaagcaacccagcagatgaacgaccttatcatcgggaaggtgagtacagcactgaagggtcactgggccaacccagatctcgcaagttccttgcagtatgaaatgctgctgctgaccgattcaattagcaaggaagactcgtgttgggagcttaggcttcggtgcgccttgtctctcttcctgatggctgtgaatattaagacacctgtggtggtggaaaacattactcttatgtgcctcagaatcctacagaagctgataaagcctccagctcccacttcaaaaaagaacaaggatgtgcctgtggaagcactgacaactgttaaaccctattgtaacgaaatccacgcccaagcccaactctggctgaagagggatccaaaggcatcatacgatgcatggaagaagtgcctcccaattcggggcatcgacgggaatggaaaagcacccagtaagtctgaactccgccatctttatcttactgagaagtacgtgtggcgatggaagcagtttctgagcaggaggggaaaaagaaccagcccacttgacctgaagctggggcacaacaattggctgcgccaagtcttgttcacccccgcaacgcaggccgcgcgccaagctgcatgcaccatcgtggaagccctcgcaacaatcccatcacgaaagcagcaggttctcgatctgctgacatcctatctggacgagctctccatagctggcgaatgtgctgctgagtatctggctttgtatcagaagctgataacaagtgcgcattggaaagtgtacctcgccgccaggggcgttttgccctatgtaggaaacttgattactaaggagatcgcccggctgctcgcacttgaagaagccacattgtctaccgacctccaacaggggtacgccctgaagtccctgacgggcctcctcagctctttcgttgaggtcgagagtataaaacggcacttcaaatccaggctggtgggaactgtgctgaacggctacctttgcttgaggaagttggtcgtccagaggactaagctgattgacgaaacgcaggacatgctgctcgagatgctagaggatatgaccaccggcaccgagtctgaaactaaggcgttcatggcagtttgtatcgagactgctaaacggtacaatctcgatgattatcgcacacctgtcttcatttttgaacgattgtgtagcatcatctacccagaggagaacgaggttaccgaattcttcgtcactctggaaaaagatccacaacaggaggactttctccagggacgcatgccaggtaacccatatagcagcaacgagcccgggattggcccgctcatgagagacattaagaataaaatttgtcaggattgcgacttggtagcactgctagaagacgactccgggatggagttgctagttaataacaagatcattagcctggacctgcccgtcgctgaggtgtataagaaggtttggtgtaccaccaacgagggggagcctatgagaatcgtttatagaatgcgtggactcctgggggacgccactgaggagttcatagagtctctggactccactactgacgaagaggaggacgaagaagaggtatacaaaatggcgggcgtcatggcgcaatgcgggggattagagtgtatgctgaatcgactggccggcatccgagatttcaaacagggaagacatctgcttacggtgctgttaaaattgtttagctattgtgttaaggtgaaggttaatcggcagcagctggtgaagctcgaaatgaacaccttgaatgtcatgctgggcaccctgaacctggctctggtggccgagcaggagtctaaagattccggtggggccgccgtcgccgaacaggtgcttagtataatggagattattctcgacgaaagcaatgctgagcctctgtccgaagacaaaggaaatcttctgctcaccggggacaaagaccagcttgtgatgttgctggatcagatcaattcaaccttcgttagaagcaatccctctgttttgcagggactactgaggattatcccgtatttatctttcggcgaagtcgaaaaaatgcaaatccttgtcgagaggtttaagccctattgtaatttcgataagtatgatgaagaccacagcggagacgacaaggtctttcttgactgcttttgcaagatcgctgccggcatcaagaacaacagcaatggccaccaactgaaggatcttatcctacaaaagggcatcactcaaaatgcccttgactatatgaagaaacatattcctagcgcaaagaatctggatgcggatatttggaaaaagtttttaagtaggccagccctacccttcatacttcgactgcttcgggggctggccatccagcatcccggtacccaagttctgattggaaccgacagcatcccaaacctgcacaagttagagcaagtgtcatctgatgaagggatcgggaccttggccgagaatttgctcgaagcccttagggagcatccggacgtcaacaagaagattgacgcagctagaagggagaccagagctgagaagaaacgtatggcaatggcaatgagacagaaggctctaggaacactgggcatgacaaccaacgaaaagggacaagtggtgacaaagacggctctcttgaagcaaatggaagaactcatagaagaacctggtcttacatgctgcatatgcagggagggatacaaattccaacctacaaaagtgttgggaatttacacctttacaaaacgggttgcactggaggaaatggaaaataagccaagaaagcaacaggggtactctactgtctctcacttcaatatagtgcattacgattgtcaccttgccgccgtgaggttggccagaggccgtgaggagtgggagtcagcagcactccagaacgccaacacaaaatgcaacggcttgttgccggtgtgggggcctcacgtcccagagtccgcctttgctacatgtctggcacgccacaatacatacttgcaggagtgcacaggccagagagaacctacatatcaactgaatatccacgacattaaactcctcttccttcgatttgctatggagcagtcatttagtgcagataccggagggggtgggcgagaatctaatattcatctaataccatacatcatccacactgtattgtatgtgttgaataccacccgcgctacctctcgggaggaaaaaaacctgcaaggcttccttgagcagcccaaagaaaagtgggtcgaatccgcctttgaggtggatgggccgtactatttcacagttttggctctccatatactcccccctgagcagtggcgcgccaccagagtggaaatactgcgccgcctgctggtcacctcacaggctcgggccgttgctcccggtggggcaaccagattgaccgacaaggcagtgaaggattatagtgcttataggagctcgctgctcttctgggctttggttgacctcatttacaatatgtttaagaaagtgcccacatcgaacaccgaaggcggatggtcctgctctctggcagagtatattcggcacaatgacatgcccatttatgaagcagccgataaggcattgaagacctttcaagaggagttcatgcccgtcgaaacctttagtgaattcctggacgtggctggtctgctgagtgagatcacagatcccgagtccttcctgaaagacctattaaattctgtaccctag

SEQ ID NO: 31733 - DNA, 15615 bp, Artificial Sequence
  Description of Artificial Sequence: Synthetic coding sequence
atggccacttcaggtggcgaggaagccgcagcggccgccccggccccaggcacccctgccaccggggcagacaccaccccagggtgggaagtggccgtgcgaccgctgctgagcgcttcatatagtgccttcgaaatgaaggagttgcctcagctcgtagcgtccgtcatcgaaagcgagagcgagattctccatcatgaaaaacaatacgagccattttatagctccttcgtggccttgagcactcactacatcacaaccgtatgctcacttattcccaggaatcagctccaatcggtcgctgccgcctgtaaggtccttattgaattctcgttgctgagacttgagaatcctgacgaggcatgtgctgtttcgcagaagcatttaatcctgctcattaagggcctgtgtactggctgctcgagactcgacaggaccgaaatcataacattcactgcaatgatgaagagtgctaagctaccgcagacagttaaaacactttccgacgttgaagatcagaaggagctggcaagccccgtttcccccgagctgcgacaaaaagaggtgcaaatgaactttctgaaccaattaacatccgtgttcaaccctagaacagtggcatcccaacccatatccactcagacattggtagaaggcgagaatgatgagcaatcttccaccgaccaagcctcagctattaagacaaaaaacgtctttatcgcccagaatgtagccagcctccaagagctggggggctcggagaaactcttacgagtctgcctgaacctgccttatttcctgagatacattaataggttccaggacgcggtactggctaattccttcttcataatgccagcaactgtggctgacgctacagctgtcagaaacggctttcatagtctcgtgattgacgttaccatggctctggacacgttgtcattgccggtgttggagcccttaaatccgagccggcttcaggatgttacggttcttagtcttagttgtctttatgccggggtttcagtggcgacatgcatggccattcttcatgtgggaagcgctcagcaggtgcgaactggctcaacatctagcaaggaggatgattatgagagcgatgcagcaaccatcgtgcagaagtgcctcgagatttatgacatgatcggccaggcgatcagttcatctagaagagcaggaggggagcattatcagaatttccagctgttgggggcctggtgcctgttaaactccctgttccttattttgaacttatctcccactgccctggccgataaagggaaggagaaagatcccctagccgctctgagagtacgggatattttgagccggaccaaagagggagtcggtagtccaaaactgggacccggaaagggacaccaagggttcggtgtgttgtctgttattctggctaatcacgccattaaactactgactagcctgttccaagatttgcaggttgaggctctgcacaagggctgggaaacagatggaccaccagccgccctgagcattatggcacagtccacttccattcagaggatacagcgcctgatcgacagcgtgcctctgatgaatctcctcctaacgctgctatccacctcctacagaaaggcctgtgtacttcagcggcagaggaagggcagcatgtcctcggatgctagcgcgtccacagactcaaacacttactatgaggatgatttcagtagcacagaggaggactccagccaggacgatgattccgaacccatactgggacagtggtttgaggaaacaatttcaccatcgaaagaaaaggctgcccctccccctcctcctccaccccctccattagagtccagcccccgcgtcaaatctccgagtaagcaggcgccgggagaaaagggcaatatcctggcctctaggaaggatcccgagttattcttaggtctggcctctaatattctaaattttatcacctcctcaatgctgaatagcaggaacaattttatcaggaattatttgtccgtcagcctgtccgagcatcacatggccacattggccagtatcatcaaggaggtggacaaggatggactaaaagggagctccgatgaggagttcgcagccgccctgtatcacttcaaccacagcctcgtgactagcgacctgcaatcccctaacctgcagaacacactcctgcagcagcttggcgtggctccattctccgagggaccatggccactgtacatccatcctcagtcgctgtcagtgctgtctaggctgctgttgatatggcagcacaaggcctccgctcaaggtgacccagatgtgccagagtgtctgaaagtgtgggatcggtttctatccacaatgaagcagaacgctctccaaggtgtagttccaagcgaaacagaagatctgaatgttgagcacctacaaatgctccttttgatctttcacaatttcactgaaaccggcaggcgggcaatcctcagcctgttcgtccagataattcaggaactatcagtgaacatggatgcccagatgcgttttgtaccactcatactcgccagattgttgctaatttttgactacctgctgcatcagtattccaaggcaccggtctacctgttcgagcaagtacaacataaccttctgagcccgccctttgggtgggctagcgggtctcaggactctaatagtcggagggctaccacacccctgtatcatggtttcaaggaggtggaggaaaattggtctaagcatttttctagcgacgccgtgccccaccctcgtttctattgcgtcctgtcacccgaggcctcagaagacgatctcaatcgcctggatagtgtagcctgcgatgtgttatttagtaagctcgtgaaatacgatgaattgtacgcagcgctgactgccttgctggctgccggcagccagctcgacacggttaggagaaaggagaacaagaacgtgacagctctagaagcctgtgccctgcagtactatttccttattttgtggcgaattctgggaattctcccgccttccaagacctacatcaaccaattatcaatgaactctcccgagatgtctgagtgcgacatcttgcacaccttgagatggtcttccaggcttaggatatcctcttatgtcaattggatcaaggaccatttgattaagcaagggatgaaagccgaacacgcatccagcctcctggaactggcttctaccactaagtgtagctccgtcaagtacgacgtggagatcgttgaggaatatttcgcaaggcagatttcttcgttctgcagtattgattgtaccactattctgcagctccatgaaatcccttcacttcagtccatctacactttagacgccgccatttcgaaggtccaggtctccctggacgagcacttttccaaaatggccgccgagacagacccacataagtcctccgagatcacaaagaacctcctgcccgccactctgcagctgattgatacctatgccagcttcacaagagcctatctgctccagaacttcaacgaagaaggcacgaccgaaaagccgtctaaagagaaattgcagggctttgccgccgtgctggccatcggaagttcccgttgtaaggcaaacacgctgggtccaactctcgtgcaaaacctccctagtagtgtgcagaccgtgtgcgaatcttggaataacattaacactaatgagttcccaaacatcggtagctggcggaatgcttttgctaatgacaccatcccgagtgagagctatatcagcgccgtgcaggcagcccatttgggtacactgtgttcgcaaagtctgcccctggcagcctcgttgaagcacaccttgttatctctggtcaggctgactggcgacctgattgtttggtcagacgagatgaaccccccacaggtgatacgtaccctgcttcctctcctgctcgaatcatccacagagagcgttgctgaaatttccagcaacagccttgaacgcatactgggtcctgcggagtccgacgagttcctggctcgagtgtacgagaaactgatcacaggttgctacaatatacttgccaaccatgccgatcctaatagcgggttggacgaatctattctagaggaatgcctccagtaccttgagaaacagctcgaaagctctcaggcgcgaaaggcaatggaagaattcttctcagacagcggggaattggtgcagataatgatggccactgcaaatgagaatctgagtgcaaaattctgtaatcgagtactgaagttcttcacaaagttgttccagcttacagagaaaagccctaatccaagcctgctgcatctgtgtggcagccttgctcagctggcttgcgtggaacccgtgaggctgcaggcatggttaacacggatgactacctctcctccaaaggactccgatcaactggacgtgatccaggaaaataggcagcttctgcagctcctgactacgtatatcgttagggagaactcgcaggtgggtgaaggcgtttgcgctgttctgctgggcaccctcactcctatggcaacagaaatgctggctaatggagatggaactggctttcctgagttgatggtagtgatggcaacactggcatctgccggccagggagctggtcatctacaactacacaatgcagcagttgattggttgtctaggtgcaagaagtacctgagtcagaagaacgtggtcgagaaactgaatgccaacgtaatgcacggaaaacacgtgatgattctcgaatgtacatgccatatcatgtcgtacctggctgacgtgaccaacgccctgtctcaatccaatggccagggaccatcccacctgtccgttgatggggaggaacgcgcaatagaagttgatagtgattgggttgaagagttagccgttgaggaagaggactcacaggcagaggatagcgatgaggactctctgtgtaataagttgtgtacgttcactataacccagaaagagttcatgaatcagcactggtatcattgccacacctgcaagatggtagacggagtcggggtatgcacggtttgtgccaaggtctgccacaaggaccacgaaatcagttacgcaaagtacggctcattcttctgcgattgtggggccaaggaggatggcagctgtctggcacttgtgaaacggaccccatcctccgggatgtcaagtacgatgaaggaatctgcgtttcagtccgaaccccggatctctgagtctttggtgcgtcatgcatctaccagcagcccggcagacaaggccaaagtcaccatctctgatggaaaggtagcagatgaggagaaacctaagaaaagctccctttgccgcaccgtggagggatgccgcgaggagctacagaatcaagccaattttagcttcgcgccccttgtcctcgacatgctgaatttcttgatggatgcgatccagaccaacttccaacaggccagcgccgttggctcaagctctagggcccagcaggctctgtcggaactgcatacagtggaaaaagctgtcgagatgaccgatcagctcatggtgcccacgctgggctcacaagaaggcgcatttgaaaatgtccgtatgaattacagtggcgatcagggccaaacgatccgtcaactgatctcggctcacgtattacgccgggtggccatgtgcgtgctctcctctccccatggcagacggcagcacctggccgtatcccatgaaaaagggaagatcactgtgctgcagctctcagctctactaaagcaggccgatagcagcaaacgaaagctgactctcacccgccttgcctccgcgccagtccctttcactgtcctgtcactaacaggaaacccatgtaaggaagactaccttgccgtttgcggtctgaaggattgccacgtgctgacctttagcagtagcggctcagtgtccgaccacttagtgttacacccccagctggccactggcaactttatcatcaaggccgtttggctgcctggatcacagaccgaactcgccattgttaccgcagactttgtaaagatatatgatctctgcgttgacgccctgtcacccaccttttactttttgctcccttccagcaaaattcgggatgtaacttttctctttaacgaggaagggaagaatataatcgttatcatgtcctctgcagggtacatttacactcagttgatggaggaagctagcagtgcccagcaggggccgttctatgtaacaaacgtgctggagatcaaccatgaagatctcaaagatagtaacagccaggtggcgggtggaggcgtgtcagtctattacagccatgttttgcagatgcttttctttagttattgtcagggaaagtcattcgccgctaccatctccagaaccacacttgaagttctgcagctatttcccataaatattaaaagcagtaacggtggatccaagacatctccagccttatgccaatggtcagaggtgatgaaccacccaggcctggtatgctgcgtgcagcaaactaccggcgtcccccttgtcgtgatggtgaaacccgatacgttcctgatccaggagatcaaaactttgcctgcaaaggccaagatccaggacatggtggccatccgccacacagcttgcaacgagcagcagagaactacaatgatcttgctgtgcgaggatgggtctctgcggatttatatggctaatgttgaaaacacgagttactggttgcaacctagcctccaacccagttcagtgatatccataatgaaaccagtacggaaacgaaaaactgcaaccatcacaaccaggacaagtagtcaggttacgtttcccattgatttcttcgagcataaccagcagctgaccgatgtggaatttggcggcaacgatctgctgcaagtgtataacgcccagcagattaaacatcggctcaactctacagggatgtacgtcgccaacacgaagcccggtgggttcacgatcgagattagtaacaacaattcaacgatggttatgacgggcatgcggattcagattggcacacaggcaatcgaaagggcgccatcgtacatcgagatctttggccggacgatgcagctaaatctgtccaggtctcggtggttcgacttcccattcacccgggaagaggctctgcaggcggacaaaaaacttaacctcttcattggcgcctcagtagacccagcgggtgtaaccatgattgatgcagtgaaaatttacgggaagacgaaagaacaattcggctggccagacgagcctccggaggaatttccgtccgccagcgtatccaacatttgcccatctaacctaaatcagagtaatggcactggcgacagcgactctgctgctcctactacaacctctggtacagttctcgaaagactcgtggtttctagcttggaggccctcgaaagctgcttcgctgtcgggcccatcattgagaaggagcgaaataagaatgcggcccaggagctggccaccctcctgctatctctacccgcacctgcctcggttcaacagcagagcaaatctctgctggccagcctgcatacatctcgctcggcttaccactcacacaaagaccaggccttactgtcgaaggcagtgcagtgtctcaacacttcttcgaaagaagggaaagatctggatcctgaagtgttccagcggttggtcatcacggcccggtccatcgccattatgaggcccaataatctagtgcactttacagagagcaagcttccccagatggagactgagggtatggatgaaggaaaggagccacaaaaacagctcgaaggcgattgttgttcttttatcacgcagctggtcaatcatttttggaagctccacgcttctaaacccaagaacgcattcttagccccagcgtgcctccccgggctgacacacattgaagcaactgtcaatgccttggtggacatcattcacggctactgcacgtgcgagctggactgtattaataccgcttcaaaaatctatatgcaaatgctgttgtgtcctgatccagccgtgtcgtttagctgtaaacaagcgctgatcagagtcctccggccccgcaataagcgcaggcatgtgactttgccgtccagccctcgttccaacactccaatgggagataaagatgacgatgatgacgacgacgccgacgagaaaatgcagtctagtggcattcctaacggtggccacataaggcaagaatcccaggagcagagcgaagttgatcacggcgatttcgagatggtcagcgaatcaatggttctggagaccgcggaaaatgtgaataacggcaacccgtcccccctagaggccctactagcaggcgcagaggggttcccccctatgctggacattcctccggatgcagacgacgagacaatggttgagctggctatcgcgctttcgctacagcaggatcagcaaggctcctcatcttcggctctggggttacaaagcctgggactcagtggacaggctccatcttctagctcactcgatgccggaacactcagtgacaccaccgctagcgctcctgcatcagatgatgagggcagtacggccgctacagacggcagcactctgcgcacttcgcccgccgaccatggagggagcgtgggcagcgagtctggtggctccgctgtcgattccgtcgccggcgagcactccgtgtctggccgatcctctgcatacggcgatgctactgcagaaggacacccagcaggccccggctctgtctcctctagcactggtgctatttctacaacaacgggacaccaggaaggtgatggatccgaaggagaaggtgaaggggagactgagggagacgttcacacctccaatcgtcttcacatggtccgcctgatgctgttagagcgtttgctgcaaacattaccccaactccgcaacgtgggaggggtgcgagctattccttacatgcaggtgatcctgatgctcaccactgacctcgacggagaggatgagaaggacaaaggagcactcgataacctcctttcccagctgatcgcagagctagggatggacaaaaaggacgtcagcaaaaagaatgagcgctcggccctgaacgaggtgcacctcgtggtaatgcgcttgttatccgttttcatgtctaggactaagagtggatcaaaaagctcgatctgcgagagttcgtctctgatctccagtgctaccgcggcagcgctcctttcctcaggcgccgttgactattgtcttcatgtcctgaagtctttactggagtactggaagtcacagcagaatgacgaggagcctgtcgccaccagccagctcctcaagccccacaccacctcttcaccccctgacatgagccccttcttcttacgacagtatgtgaaaggccatgccgccgatgtgttcgaagcgtacactcaactgctgacagagatggtcctgcggctcccataccaaataaagaagattactgacacaaattcccgaatcccaccacccgtcttcgatcactcctggttttacttcttatccgagtacttaatgatccagcagactccgtttgtgaggcggcaagtccgaaagttgttactgtttatctgtggctctaaagaaaagtatcggcagctccgggacctgcataccctagacagtcacgtacggggcattaaaaagcttctggaagagcagggaatttttctgcgagccagcgttgtcactgccagcagtggttcggccttgcagtacgatactctaatatcattaatggaacacctgaaagcatgtgccgagattgcagcccaacggactatcaattggcagaaattctgcattaaagatgattctgttttatacttcctgcttcaggtgagctttctggtcgacgaaggggtgagtcctgtgctgctgcaattgctgtcctgcgccctgtgtggctcgaaggtgttagctgctcttgcagcctctagtggaagcagctcagccagcagtagctccgctccagtcgcggcctcaagcggccaggcgaccacacagtcaaaaagtagtactaagaagagtaagaaggaagagaaggaaaaggaaaaagacggggagacctcaggctctcaggaggatcagttgtgtacagcactggtgaatcagttgaataagttcgccgacaaagaaactctgatacagtttcttaggtgcttccttttggagagcaatagcagtagcgtccgctggcaggcgcattgcctaaccctccatatatacagaaatagctctaagtcccaacaggagcttctgctggatctgatgtggagtatctggccagaactacctgcctacggccgaaaagctgcacagtttgttgatctgctagggtatttctcactgaagaccccacaaactgagaagaaactcaaagaatacagtcagaaggccgtggagatccttcgtacacaaaaccacatcttaaccaaccatcccaactctaatatctacaacactctgagcggactggtagagttcgacgggtattacttagaaagcgacccctgtctggtttgcaacaaccctgaggtcccattttgctacattaaactatcctccataaaagtcgatacccggtacactaccacacaacaagttgtgaaattgattgggagccatacgataagtaaggtcaccgtgaaaatcggagatctgaagaggaccaagatggtgcggactatcaatttgtattacaataacagaactgtgcaagctattgtggaactcaagaacaaacctgctcgctggcacaaagctaagaaggtccagctcacccctggccagacagaggtgaaaatcgatctccccctgccgatagtggcttccaacctcatgattgaatttgctgacttctacgaaaattaccaggccagcaccgagacccttcaatgcccccggtgttctgctagtgtccccgcgaatcccggcgtctgcggcaactgcggggagaatgtttaccaatgccacaagtgtaggagcataaattacgacgagaaagatccctttttgtgtaacgcttgcggcttctgcaagtacgcgagatttgacttcatgctgtatgctaaaccctgttgtgctgtcgaccccatagagaatgaggaggaccgaaagaaagcggtgtccaacattaatacactcttagacaaagccgaccgggtctaccaccaattgatgggacatcgcccacagttagagaatctattatgtaaagtcaacgaggcggcacctgagaagccccaggatgactcagggaccgccggaggcatatcctccacgagcgcgtccgtgaatcgatacattctccagcttgcacaggaatactgtggcgactgcaagaattcattcgatgagcttagtaaaatcatccaaaaagtcttcgcttccaggaaagagttgctcgagtacgatctacagcagagagaggccgccactaagtcatccaggacatctgttcagcctacttttacagcttcgcagtatcgcgccctttccgtgttggggtgtggccacacatcaagcaccaaatgctacggatgcgccagcgctgtgacagagcactgtatcacgctgttgagagcccttgctaccaatcctgcgctcagacatattcttgtctctcaaggcctaattcgggagcttttcgattataacctgcggagaggtgcggccgccatgcgcgaagaggtcagacaactcatgtgcttactgaccagagacaaccccgaggctactcagcagatgaacgacctgattatcggaaaagtgtccacagctctcaaggggcactgggcaaatcctgacttagcttccagcttacagtacgagatgctgctcttgaccgactctatctctaaggaagactcctgttgggagctccgcctgagatgcgcgttgagcctgttcctgatggctgtaaatatcaagactccggttgtcgtcgagaacattacactcatgtgtcttagaattctccagaaattaattaagccaccggctcccacctccaaaaaaaacaaggatgtccctgtggaagccctgacgactgtgaagccatattgcaatgagattcatgcccaggcccagctgtggctcaagagagatcctaaagcaagctacgacgcctggaaaaagtgtctacccattcgagggatcgatggcaatggcaaagctccatcaaaatctgagctccgccatttgtacttaacagaaaagtatgtctggcgctggaagcagtttctgtcgaggcggggcaaacgaacctctccgctggatttgaaacttggacataacaattggttaaggcaggtcttgtttacacctgctacacaagccgcccggcaggctgcttgcactatagtggaggccttggccaccattccgagccgcaaacagcaggtgttagacctgttgacctcatatctcgacgagctatctatcgccggcgagtgcgctgcagaataccttgctctttaccaaaaactgatcacgagtgcccactggaaggtttatctagccgcgaggggagtcctcccatatgtgggaaatctcatcaccaaggaaatcgcccggctgctggctttggaggaagctaccctctccacagacctgcaacaggggtacgcactcaaatcccttactgggctgctgtcgtcattcgtggaggttgaatcgattaagcgccacttcaaatcaagactggtcggcaccgtcctcaacggatatctctgccttaggaagctggtcgtgcaaaggaccaaactgatcgacgagactcaggatatgctgctggagatgttggaggacatgactacggggaccgagtccgaaactaaagctttcatggctgtgtgcattgaaactgccaagcgatataacctcgacgattaccggacgccagtgttcatcttcgaaagactatgttcaatcatttatccagaggagaatgaggtgacagagttctttgtgaccttggaaaaagacccccagcaggaggattttcttcagggacgcatgcccggaaacccgtatagcagcaatgagcctgggataggccccctgatgcgggacatcaagaataaaatttgtcaagattgcgacctcgtcgcattgcttgaggatgacagcgggatggaattgcttgttaataataaaatcatcagcctcgatctccctgtcgccgaggtgtacaaaaaggtatggtgcacaacaaacgaaggggagcctatgcgtatcgtgtataggatgaggggtcttctgggcgacgccacggaggaatttattgagtcactcgactctaccacggacgaggaagaggatgaggaggaggtttataaaatggctggtgtgatggcccagtgtggcgggctggaatgcatgctgaacagactggcaggcatccgagacttcaaacaagggagacatcttctcaccgttctcctgaagttgttttcctattgtgtgaaggtaaaggtgaacaggcagcaactcgtgaagttagagatgaacacccttaacgtcatgctggggaccctaaacctggccctcgtggccgaacaagagtcaaaagattctggtggggcagccgttgcagaacaggttctgtcaatcatggaaatcatcctcgacgagagtaacgccgaacccctctctgaggacaaaggaaacttgctactgaccggggataaggatcaattggtgatgctgcttgatcagataaattcaacttttgtgaggtccaatccatcggtgctgcagggcctgctgagaatcattccttacctgtcctttggcgaagtggaaaaaatgcagattttggtggagcgatttaaaccctactgcaattttgacaaatacgatgaggatcactctggtgacgacaaagtgttcctcgattgcttttgtaagatcgctgccgggattaagaacaactcaaatgggcatcagctaaaggacctgatcttgcagaaggggattacccagaacgccctcgactatatgaaaaaacacattccttcggcaaaaaacctagacgccgacatatggaagaagttcttgagcaggcctgccctgcctttcattctgcgcttgctgagaggcctcgctatccagcaccctggcacccaagtgcttattggtactgatagcatcccaaacctgcacaagctcgagcaggtgtccagcgatgaaggcatcggcacgctagcagagaacctcctggaagccctgcgcgagcacccagatgtgaacaagaaaattgatgcggcccgccgagagaccagagcggaaaaaaagcgcatggctatggccatgagacagaaggcactgggtactctggggatgactacgaacgagaaggggcaggtcgtcacaaaaacggcacttcttaagcagatggaagaattgatagaggaaccggggcttacatgctgcatttgccgggagggatataaatttcagccaactaaagtgctggggatctatacttttactaaaagggttgcattagaggagatggagaacaaaccaagaaaacagcaggggtactcaaccgtgagccattttaatatagtccactacgactgtcaccttgctgctgttagacttgcgagaggccgtgaggaatgggagtctgccgcgctgcaaaatgccaacacgaaatgtaacggactcttgcctgtttggggcccccacgtgcctgagagcgctttcgcaacctgtttagctcggcataatacatatctccaggagtgcactggccagcgcgagccaacctaccagctcaacatccacgatattaaactgctcttccttcgttttgctatggaacagtcattttcagccgataccggcggggggggtcgtgagagcaacatccacctgattccctatatcatacataccgtcctttatgttttaaacaccacacgtgccacaagcagggaggagaaaaatttgcaggggtttctggaacaacccaaagagaagtgggtcgagtccgccttcgaggtggacggaccatactacttcactgtattggccctgcatattctgcctcccgaacagtggcgggcaacccgcgtcgagattctccgccgactgttggtgacctctcaagcccgagctgtggctccagggggtgctacaagattgactgataaggctgttaaggattactccgcatatcgcagttcccttttgttctgggccctggtcgacctgatttacaacatgtttaaaaaacaaaccacaccaactgtggggggaattgatacaggctcgttggaaccctgtgtttgcgagaaagtcccaaccagcaataccgaaggaggttggagttgctcactggctgaatacattcggcataacgatatgccaatatatgaagccgcggacaaggccttgaagacatttcaggaggaatttatgcccgtggagactttttctgagtttctggacgtggcgggactgctatccgagataactgatcccgaaagttttttgaaagatctgctgaactctgtgccctag

SEQ ID NO: 31734 - DNA, 6177 bp, Artificial Sequence
  Description of Artificial Sequence: Synthetic coding sequence
ctggtgcggcttactggcgacctgatcgtatggagcgatgagatgaatccccctcaagtcatcaggacactgctaccgttactcctggagtcatctacagaaagcgtggcagagatctcatcaaattctttagaacggatactgggcccagcggagtccgacgagtttctagcacgcgtgtatgagaagttgataacaggctgttataacatcctggctaaccacgctgatcctaactcaggtttagacgagtccatactggaggagtgtttacagtacctcgagaagcagctagagtcaagccaggcacgcaaagcgatggaagaattctttagcgacagcggagagctggtccaaatcatgatggccaccgccaacgagaacctgtcagcaaaattttgtaacagggtgctgaagttctttactaagctgttccaactcactgagaagagccctaatccgtcccttctgcacctgtgcgggagtctggctcagttggcctgtgtggagccagtgcgtcttcaagcatggcttacgaggatgacaacgagtccacctaaagattccgatcaactggatgtgatccaggaaaatcgacagctgctccagctgctgaccacatacattgtccgtgaaaactctcaggtgggtgaaggggtttgcgcagttcttctcggcacacttacccccatggcaactgaaatgctcgcaaatggagatggaacaggcttccccgaactgatggtcgtgatggctaccttggcctcagccggccaaggtgctggccatctgcaactgcacaacgctgccgtggactggctgtcccgctgcaagaaatatttgtctcagaagaatgtggtggaaaagcttaacgcgaacgttatgcacggcaaacacgtgatgatactggagtgcacgtgccacattatgtcttatctggccgacgtcacaaatgccctgtcacagtcaaatggccagggcccatcgcatctgtctgtggatggcgaagaacgagcaattgaagttgactccgactgggtggaggagctggccgttgaagaagaggattcacaggctgaggattctgatgaagatagtctgtgtaataagctgtgtacattcactataactcaaaaggagtttatgaaccagcactggtaccattgtcacacttgtaagatggtggatggtgtgggggtatgtactgtgtgtgccaaggtctgccacaaggaccacgaaatatcctatgctaaatacggaagctttttttgcgattgtggagccaaggaagacggatcctgcctggcactggttaagcgaacccccagctccggtatgtcaagtactatgaaggaatctgcctttcagtcagagcccagaatttccgagagtctcgtacgccacgcttccacttcctcacccgcagacaaagctaaagtcacgatcagcgatggtaaggtcgctgatgaggaaaagccaaagaagtcaagtctgtgtaggacagtggaggggtgcagagaagaactgcaaaaccaggcgaacttcagcttcgcaccactagtactcgacatgttgaattttctcatggatgccattcagacaaatttccagcaggctagtgctgtagggtcctccagccgggctcagcaggcactcagcgagctccataccgtggagaaggccgtggagatgacggaccagctcatggtgccaaccttggggtcccaggaaggagcattcgaaaacgttaggatgaattacagcggcgaccaaggtcagaccatcagacagctaattagtgcccacgtgctgcgacgggtggccatgtgcgtcctgtcttcaccacacgggagacgacaacaccttgccgtctcacacgagaagggcaaaatcacagtcttgcaactaagcgctctactcaagcaagccgattcaagcaagagaaagttaaccctcacaaggttagccagcgctcctgtgcctttcactgttctgtcactgacagggaacccgtgcaaggaagattatctggccgtatgcgggttgaaggactgtcacgtgctcacatttagctccagtggcagtgttagcgatcatctggttcttcacccacagctagccaccggcaacttcatcatcaaggccgtgtggttgccaggctcacagacagagttggctattgttactgcagacttcgtgaagatctatgatctatgcgttgacgccctcagtcctacattttactttctgttacctagttctaagattagagacgttacattcctgtttaacgaagaggggaagaatatcatcgtcatcatgtcctccgcagggtacatctacacacagttaatggaggaagctagtagcgcacagcaggggcctttctacgtaacaaatgtgttggagataaaccacgaagacctgaaggatagtaacagtcaggtggcaggaggcggcgttagcgtgtattactcccatgtgctgcagatgctgttcttttcatattgccagggtaagagtttcgccgcaacaatctctagaacgactctggaagtcctgcagctgtttcccattaacattaagtctagcaacgggggcagcaaaacctcccctgctctgtgtcagtggtccgaagtgatgaaccaccctggattggtctgctgtgtccaacagaccaccggagtccccctagtcgttatggtaaaacctgatacattcctcatccaggagattaagactctgcctgcgaaggctaagattcaggacatggtggctatccggcatacggcatgcaatgagcagcagagaaccacaatgatcttgctgtgtgaagatggctctctcaggatttacatggccaatgttgagaacacatcctactggctacagccctcgctgcaacccagcagcgttataagcattatgaaacccgtgcgcaaaagaaagactgcaactatcaccacgaggaccagctcccaggtgacctttccaatcgacttctttgaacacaatcagcagctcactgacgtcgagttcggcggaaacgatttgcttcaggtctataacgctcagcagatcaaacataggctgaactcaacaggaatgtatgtcgctaacactaaacctggaggctttacgatcgagattagcaataacaattcaaccatggtcatgacgggcatgaggatacaaattggaacccaggctattgagcgggctccaagttacattgagatcttcggccggactatgcaacttaatctctcccggtctcgctggtttgatttccccttcactcgcgaggaagccctgcaagccgacaagaaactcaatctttttatcggagcaagtgtggatcctgccggtgtcacgatgatcgacgccgtcaaaatttacggtaagacaaaggagcagtttggatggcctgacgagccccctgaggaatttccgtccgcctccgtttctaacatatgtccaagtaacctaaaccagtccaacgggactggcgattccgatagtgcggctcctacaactactagcggtaccgtcctggaaagcagtgaaactgagtcattaacgaagctggacagattggtggtgagctccctcgaagcattagagtcctgttttgccgtcggccctattatcgagaaggaacgaaacaagaatgccgcccaagagctagcaaccctcctgttgtctttaccagcacctgcttctgtccagcaacagtctaagtctttactggcatcactacacacttcccgcagcgcctatcatagccataaagatcaggcactattgtccaaggccgtgcagtgtttgaatacatcgtccaaggaaggaaaggacctcgaccccgaggtgtttcagagactggtgataactgctcgctctatcgcgattatgagaccgaataatctagttcacttcaccgagtctaagcttccacagatggagacagaagggatggacgaaggaaaagagccacaaaagcagctagagggagactgctgttccttcatcactcagttggtaaatcacttctggaaactccacgcttccaagcccaaaaatgcctttcttgccccggcttgcctgcccgggctgacccatatcgaggcgacagtgaatgcacttgtggacatcatccacggctactgtacatgcgaactggattgcatcaatactgcttctaagatctatatgcagatgctactgtgccccgacccagccgtttcgttctcatgtaagcaggccttgatcagggtgctgcgacctagaaataaaaggaggcacgtaacactcccgtccagcccaaggtctaatactccaatgggagataaagatgatgacgatgacgacgatgcagatgagaagatgcaatctagcggcataccgaatggaggacatattaggcaggaaagccaggagcagagcgaagtggaccatggggatttcgaaatggtctcggaatcaatggtgctagagaccgccgagaacgtgaacaacggcaatccgagccctcttgaggccctgctggctggcgccgaaggcttcccaccaatgctcgacattccacccgacgccgatgacgagactatggtggagctggcgattgccctgtcactacaacaagaccagcaggccccagcttctgacgacgaaggcagcaccgcagcgaccgatggctctaccctgcgcacctctcctgctgatcatggcgggtcagttggttcggaatcaggggggtctgccgtcgattccgtcgccggagagcacagtgtctccggaaggtcctcggcctatggcgatgccaccgccgagggacatccagctggacccggcagtgttagctcctccacaggggccatcagcacaactaccggccatcaagagggagacggcagtgagggggagggcgaaggtgaaaccgagggcgatgtccatactagtaatcggctccacatggtgcgactgatgcttctcgagagactcctccagacactcccccagctgcgtaacgtgggcggcgttcgggccatcccctatatgcaggtcattctgatgcttactaccgatctagatggcgaggatgaaaaagacaaaggtgccctagacaacctcctgtcacagttaatagctgaattaggcatggataagaaggacgtatctaagaagaacgagcgctccgccctaaatgaagttcacctggtggtgatgaggctcttatctgtttttatgtctcgtactaaatcaggttctaagagctccatatgcgaatcgtctagcctgattagctccgcaaccgctgctgctctcctgtctagcggggccgtcgactactgcttacacgtgttgaaaagcctgctcgagtactggaagtcgcaacagaatgacgaagaacctgtggcgactagtcagctcctgaagcctcacactacctccagtcctccagatatgtctccatttttcttgagacagtatgtgaagggacacgctgccgatgtctttgaggcctacacacagctcttaacagagatggtgttgcgcctgccctatcaaataaaaaaaataactgacacgaactcaagaatccctcccccagtgtttgaccattcctggttttatttcctgtccgaatatctgatgattcagcagactcctttcgtccgacggcaggtgcggaaattgctcctcttcatctgcggttccaaggagaagtacagacagctgcgcgatctgcacactctcgactcgcacgttagaggaataaaaaagttgctggaagagcagggtatttttcttagggctagcgtggtgactgccagcagtggttctgcccttcagtatgatactttgatttcactgatggagcatcttaaggcctgcgccgagattgcggctcaaaggacgattaattggcaaaaattctgcattaaggatgacagcgttctctacttcctgctgcaggtgtcatttctcgtggacgaaggcgttagtcccgtgttactccagctcttaagctgcgccttgtgtgggagcaaagtgctggctgcactggctgcgagctccgggagctctagcgcgtcatcgtcgtccgcccctgttgccgctagtagcggccaggccaccactcaatctaagagcagcaccaagaaatcaaagaagtag

SEQ ID NO: 31735 - DNA, 5019 bp, Artificial Sequence
  Description of Artificial Sequence: Synthetic coding sequence
agattcctgagtactatgaagcagaatgccctacagggtgtggtgccaagtgagactgaggatctcaacgtggaacacctccaaatgctgcttctcatctttcacaacttcactgagaccggccggcgagctatcctaagcctcttcgtacaaatcatccaggagctcagcgtgaacatggacgctcagatgcgatttgtaccactgatccttgcacgcctcttgcttattttcgactacttgctccaccagtattctaaggctcccgtctacctattcgaacaggtccagcataaccttctttctcctcccttcggctgggcctccggttcccaggattcgaattctcgcagagctactaccccgctgtaccatggcttcaaagaggttgaggagaattggtctaagcacttctcttcagacgcggtccctcacccgaggttctattgtgtgttgtctccagaggccagtgaggatgatctgaaccgcctggacagcgtggcatgcgacgtgttgttctccaagctggtgaagtatgacgaactgtacgcagccctcacagccctgttagcagctgggtcccagcttgacacagtacggcgtaaggagaataagaatgtcacagcactggaggcttgcgccctccagtattactttctgatcctgtggcgaatcttaggcatccttccaccgtcaaagacatacattaaccagctaagtatgaatagtccagaaatgtctgagtgtgatatacttcacactttgcgctggtcaagccgcctgcggatctcatcctacgtgaactggattaaggaccaccttattaaacagggcatgaaagcagagcatgcgtcatccttactggagctggctagtactaccaagtgttcgagcgttaagtatgacgttgaaattgtggaggagtattttgccaggcaaatctccagcttttgctccatcgactgcactaccatcttgcaattgcatgagatccccagtctgcagtctatttacactctggacgcagcgatttctaaggtgcaggtgagtctagacgaacatttttccaagatggcagccgaaaccgatccgcataaaagttccgagattaccaaaaatctcctacccgcaactcttcagctgattgacacatacgcctcattcactcgggcatacctgctacagaattttaatgaggaaggtaccaccgaaaagccgagcaaggagaaactgcagggttttgccgccgtgctggcaatcgggtccagccgctgtaaagctaatacactcgggcccacacttgtgcagaatttaccatccagtgtgcaaaccgtgtgtgagtcatggaacaatataaacaccaacgagttccccaacatcggaagctggcgaaacgcttttgcaaacgatactatacctagtgaatcctacatctccgcggtgcaggccgcccacctcggcacgctttgttctcagtcattgccactcgctgcttctctaaaacataccttgttgtccctggtgcgcttaaccggcgatttaatcgtgtggtctgatgagatgaaccccccacaggtaattaggactctccttccactcttgcttgagtcttccacggagtcagtggcagaaatcagttcaaactccctggagagaatcctagggccagccgagtctgacgaatttctggctagggtatacgagaaactgatcacaggctgttacaacattcttgcaaatcatgccgaccctaactccggcctggacgaaagcatactggaagaatgcctccagtatttggagaaacagctcgagtcttcccaggcccgaaaggcgatggaagaattctttagcgacagcggcgaattagttcagataatgatggccactgcgaacgagaacctgtcggccaagttctgcaatagagtcctgaagttttttaccaagctcttccagcttactgagaagtctcccaatccctctctgctgcatttgtgtgggtcactggctcagttagcctgtgtcgagccagtcagactgcaggcttggttgaccagaatgacgacctcacccccaaaggattccgaccagctcgacgtcatacaggaaaataggcaacttttgcaactcctaacgacttacatcgtgagagaaaactctcaggttggtgaaggcgtatgcgcagtgttgctgggaacgcttactccaatggccactgagatgttagcaaacggagatggaacagggtttcccgagttgatggtagtcatggccactctggccagcgccggacagggcgccggccacctgcagctccacaacgcagccgtggactggctttctagatgcaagaagtacctgagccaaaaaaatgtagtggaaaaacttaacgccaacgtcatgcacggcaagcatgtcatgattttagagtgcacgtgtcacatcatgtcctacctagcagacgtgaccaatgccctgagccaaagtaatggccagggaccctcccacctctcagtggacggggaagagcgggccatcgaagtcgacagcgactgggttgaggaacttgctgtggaggaggaagactcacaggccgaagacagcgacgaggacagcttatgtaataaactttgcactttcaccatcactcaaaaggagttcatgaaccagcactggtaccactgccatacatgtaaaatggtggacggggttggagtatgcaccgtttgtgccaaagtatgtcacaaagatcatgagatcagctacgccaagtacggatcattcttctgtgattgcggggccaaggaagatggctcctgcctggcgctggtgaaacggacaccttccagcgggatgagctcgaccatgaaagaatcagcatttcagtctgaacccagaattagtgagtctttggttagacacgcatccacatcctcacccgctgataaggcaaaagtgacaatatcagatggaaaagtcgccgacgaggagaaaccgaagaaatcgagcctctgccgaaccgttgaaggatgtagggaggagctgcagaaccaggccaactttagtttcgcccccctcgtactagacatgttaaatttcttgatggacgccatccagactaacttccagcaggctagcgccgtgggatcaagctcccgagcacagcaggccttgagcgagcttcacacggtcgagaaagctgtagaaatgaccgatcagctaatggtccctaccctcgggtcccaggagggggcttttgagaatgtgcgcatgaattacagtggggaccagggacagaccattagacagcttatttctgcccacgtgctgagacgcgtggctatgtgtgtgctgtcctcccctcatggccggagacagcacctggccgtttcacacgagaagggaaagattaccgtgctgcaattgtctgcgctcctgaagcaagctgactcatccaaacgcaagctcactcttacacgtctagctagcgctcctgtgccatttaccgtgctgtctctgacaggaaatccatgtaaggaagactatctggctgtctgcgggttgaaggattgtcacgtcctgaccttttcctcatcagggtccgtgtccgatcaccttgttctgcatccacaacttgctacaggcaattttatcattaaagcggtctggctgcctgggagtcagactgagctggccattgttaccgccgactttgttaagatctacgacttgtgtgttgatgctctgagtccaacattctatttcctgctgccgtctagtaaaattagagacgtcaccttcctcttcaatgaagagggcaagaacattattgtgatcatgagctccgctggctatatatacacccagctcatggaggaggccagcagcgcgcaacagggccccttctacgttaccaatgtgttggagatcaatcacgaggacctgaagcaagacagtaattctcaggtcgcagggggaggcgtttctgtctattattctcatgtgctgcagatgctctttttctcctactgccaaggcaaatcctttgctgcaacaatcagccgcacaactttagaggtgctccaacttttccctattaatatcaagtcctctaatggaggctcgaagaccagcccggccctgtgccaatggtccgaggtgatgaatcacccaggtttggtctgctgcgtgcagcagacaacaggcgttcctctggtcgtcatggtcaaaccggatacctttctgatacaagaaatcaagactctgccagccaaggcgaagatccaggacatggtggccatacggcacactgcctgcaacgaacagcagcgaaccactatgatccttttatgcgaagacggatctctgcggatctatatggctaacgtcgaaaatactagctattggctgcaaccctcgctccagccttcatcggtaatatctattatgaagccggtgcgtaagagaaagacagccacaattacaactcggacttcctcacaggtgactttccctatcgatttcttcgagcataatcagcaacttacagacgtggaatttggcggtaacgacttactgcaagtgtataacgcccagcagattaaacaccgcctgaatagcaccggaatgtatgtcgccaacacaaagcctggcggattcactatagagatttccaacaacaacagtacaatggtgatgacaggaatgcgtatccagattggaacccaggccatcgagcgagcccctagttacatcgaaatttttggaagaacaatgcaactcaatttatctcgctctcggtggttcgactttccatttacacgcgaggaggcactgcaggcggacaaaaagcttaatcttttttccgagtccccaacaccgggggccgatagtgtgctgattgtcaccgctaaactgggcgcaacaggcctctggctctctaatattctcggctccttgcatagcgctgactttagcgttctgtcttctggaaactttgagctgcacctgatgtactag

SEQ ID NO: 31736 - DNA, 2955 bp, Artificial Sequence
  Description of Artificial Sequence: Synthetic coding sequence
gacttcccgtttactcgggaagaggcattacaggccgacaagaaactcaacctattcattggagcgagcgtagacccagccggcgtcaccatgatcgatgccgtgaagatctacggtaaaaccaaggaacagtttggctggccagacgagcctcccgaggagtttccctccgccagcgttagcaacatctgcccatcaaacttgaatcagtccaacggtaccggcgacagcgactccgcggcacccactaccacgagtgggacagttcttgaacgcctggtcgtgtcttcactggaggcattagagtcctgcttcgctgtgggacccattattgagaaggagcgtaataaaaatgcagcacaggaactggctaccctgcttctctccttgccagcccctgcctccgtccagcagcagtctaaatctctcctggcatctttgcatacctcacgcagtgcttaccactcacacaaggaccaagctttgctgtccaaagccgtccagtgcttgaatacctcatccaaagagggaaaggatctggatcctgaggttttccaacggctcgttatcaccgctcgttccatcgctattatgcgcccgaacaacctcgttcactttacagaaagtaagctgccacaaatggagacggactgttttttcccacgatgcgcctgttggagcctcggcatcgtaggcattttgatcggggctccccttgagacaccatcccctgagggtatggatgagggtaaggagcctcagaaacagcttgagggagactgctgtagcttcatcactcagctggttaaccatttttggaagcttcatgcttccaagcccaagaatgcatttcttgctccggcctgccttcccggtctcacacacatagaagcaaccgtgaacgcactggttgatattattcacgggtactgtacctgtgaattggactgtatcaatacggcctcaaagatttatatgcagatgctgctgtgtcctgatcctgcagtttccttctcttgtaagcaggccctgatccgagttctgcggccaaggaacaagaggcgacacgtcactcttcccagtagccctaggtcaaacacccccatgggggataaagatgacgatgatgacgatgacgctgacgagaagatgcaatcctctggaatcccaaatgggggacacatacgacaggagtcccaggagcagtcagaggtcgatcacggggacttcgagatggtttcagaaagtatggtactggagaccgccgaaaatgtgaataacggcaacccttcacccctggaggccctgttggcaggtgccgagggcttcccccctatgctcgatatcccccctgacgccgacgatgaaacaatggtggaattggctattgcactctcacttcagcaggaccagcaggcccccgcatccgatgatgaaggctcgactgccgctacagacggtagtacacttcggacatcaccggcggaccatggtgggtcagttggttcagaatcaggaggctccgccgtggatagtgtggctggcgaacattcagtttcaggaagatccagcgcctatggtgatgctactgcggagggtcaccccgccggcccaggttctgtgagtagcagcacaggagcaatttccaccactactggtcaccaggaaggagacgggtctgagggtgaaggggagggggaaacggagggcgacgttcatacgagcaatagactgcacatggtgagactgatgctgcttgaaagactgctgcagactctgcctcagctgcgtaatgtgggcggggtgcgtgctataccttacatgcaagttattctgatgctcactacggatctggatggcgaggatgagaaggataaaggagccctggacaacctgctgtcccaactgattgccgaacttggaatggacaaaaaggacgtgtccaaaaagaacgagaggagcgcactcaacgaagtgcacctggtcgtcatgcgcctgctgtccgtttttatgagtagaacgaagtctgggtctaagagttctatatgcgagtcaagctctttgatatcctctgccacagccgccgctctactgagctcaggcgctgtggactattgcctccacgtgctaaaaagcctgctagagtattggaaatcacagcagaacgatgaagaaccagtggctacctctcagctgttgaagccccatactacctcatcccctccagacatgagcccctttttcctccgtcaatacgtgaaaggacacgctgccgatgtcttcgaagcttacactcagctcctgacggagatggttctgaggctcccttatcaaatcaaaaaaatcaccgatacaaactcacggattccaccaccggttttcgaccatagctggttttacttcttgtccgagtatctcatgattcagcaaacaccatttgttagaagacaggttcgcaaactcttactgtttatatgcggctctaaagaaaagtacaggcagctgagagaccttcatacattagatagccatgtgagaggcattaaaaagctcttagaagagcagggcatctttctccgggcgagcgtggttaccgcttcaagcggttcagccttgcagtacgacactcttatcagtctgatggagcatctcaaagcctgtgctgagatagccgcacagcgcactatcaactggcagaaattctgcattaaagatgattctgtcctatactttctactccaggttagctttttggtggatgaaggtgtgtcccctgtgctcctacagctgctgagctgcgccctctgtggcagtaaggtccttgccgcactggctgccagtagcggctctagttcagctagttcttccagcgcgccagtggccgcttcatctggccaggctacaacccagagcaagagctctaccaaaaagtcaaagaaggaggaaaaggagtag

SEQ ID NO: 31737 - DNA, 2121 bp, Artificial Sequence
  Description of Artificial Sequence: Synthetic coding sequence
atgcgaatagtgtaccgcatgcgcgggcttttgggagacgctaccgaggagttcatagagagtctggacagcactaccgacgaggaagaagacgaggaggaggtgtataagatggccggcgtcatggcccaatgcggggggctggaatgtatgttaaaccgtctggccggaattcgggatttcaaacagggacggcacctgttgacggttctgctcaagctgttcagctactgtgttaaggttaaggtcaatagacaacagctagttaagctggagatgaacacactaaatgtgatgctgggaacattgaatctcggaaatctcctattgacgggcgacaaagaccagctggtgatgctcctggatcagattaactccacctttgttcgaagcaacccctctgtcttgcagggccttcttcgcattatcccttacctcagcttcggcgaagtggagaagatgcagatactggttgagaggttcaagccatattgtaatttcgacaagtacgatgaagatcatagcggtgatgacaaagtgtttttggactgtttctgtaagattgccgcgggaattaagaataactctaacggccaccagctcaaggatctgatactccagaagggtatcacacagaatgctctggactatatgaaaaaacacataccatctgctaagaatctcgacgcagacatttggaagaagtttctctcccggccagctctgcctttcatcctgcgcctgttaaggggactcgcaatccagcatcccggaacccaggtcctcatcggcaccgatagcattccgaacttgcacaaactcgaacaagtgtctagtgacgagggcatcggaaccctcgcagagaacctcttggaagcgctgagggaacaccctgacgtaaataaaaagatagatgccgcccggcgcgagacaagggccgagaaaaaaaggatggccatggccatgcgtcagaaagctttgggtacccttggaatgacaactaacgaaaaggggcaggtagtcactaagaccgctttacttaaacagatggaggagttaattgaagaacctggattgacctgctgcatctgtagagagggatataaattccagcccacaaaagtgctggggatatatacattcacgaaacgggttgctcttgaggaaatggaaaacaagcctagaaagcaacaagggtattccaccgtttcccacttcaacatcgtgcactatgactgtcatctagccgcagtgagactcgcgagaggacgcgaagaatgggagagtgccgctctgcagaacgcaaataccaagtgcaatggcctcctgccggtgtggggtcctcacgtccccgagtctgcttttgctacatgtctggccaggcacaacacctacttacaggagtgcacaggccagcgcgaaccgacataccagctgaatatccacgatattaaacttctcttcctgagattcgcaatggagcagtctttctcagctgacaccggggggggcgggcgggagagcaatatccacctgatcccgtacatcatccacacagtcctctatgtgctgaatactactcgtgctacatctagagaagagaagaatctgcaggggttcctggaacagccaaaagagaaatgggtggaatccgcttttgaggttgatggaccctattatttcacagttctggccttacacatcctgcctcctgagcagtggagagcaactagggtcgaaatcctccgccgcttgctggtgacatcccaggctcgggccgtggcccccgggggtgccacccgcctaacagacaaggccgttaaagactactctgcctaccggtcatcccttctattttgggccctggtggacctgatctacaacatgtttaagaaggtgcctacatctaacacggagggagggtggtcctgttcactggccgagtacattcgacataatgacatgcctatctacgaagccgctgataaggccctcaaaaccttccaggaggagttcatgcccgtggagaccttttccgaattccttgatgtcgcaggtctgttatctgagatcaccgaccccgagtcattccttaaggacttgttgaactctgtcccttag

SEQ ID NO: 31738 - DNA, 2544 bp, Artificial Sequence
  Description of Artificial Sequence: Synthetic coding sequence
atggcagtttgcatcgaaaccgcaaaacgatacaacctggatgactaccgaaccccagtgttcatatttgagcgactgtgttctatcatctacccagaggaaaatgaagtgaccgaattcttcgttaccctcgagaaagacccacagcaggaagacttcctgcaggggcggatgccaggaaatccctatagctccaatgagcccggaattggaccccttatgagagacataaaaaacaaaatctgtcaggattgtgatttggttgctttactagaggacgacagtggtatggagggcgagcccatgagaatcgtgtatagaatgcgcggcctgctgggagacgctacagaggagtttatcgagtccctcgattccacgacagatgaggaggaggatgaagaggaagtgtacaagatggccggcgtgatggcgcagtgcggagggctcgaatgcatgctgaacagactggcggggatacgcgatttcaagcaggggaggcatctgttgactgtgctattaaaactattcagctactgtgtcaaggtcaaagtcaatagacagcagctggtgaagctggagatgaacactcttaacgtcatgctgggcaccctgaacttggccctggtggccgagcaggaatctaaggattcgggtggcgccgcagtggcagaacaggttctatctattatggagattatactggatgagtccaacgccgaaccgctatcagaagataaagggaacctgcttctaacgggagataaggatcaattagtcatgctgctcgaccagatcaactccacgttcgtgaggtccaatccttccgtcctgcagggcctcctgcgtattattccttatctcagttttggggaagtggagaagatgcagatcctcgttgagcgtttcaaaccttattgtaattttgacaaatacgatgaggatcactcaggcgacgataaggtttttctagactgtttttgtaagattgctgcgggcataaagaataatagtaacggccaccagcttaaggatctgattctgcagaaggggattacccagaatgccctcgattatatgaaaaagcatatcccaagtgctaaaaacttggatgcagacatctggaagaagtttttgagccgccccgcccttcctttcatacttcgcctgttaagaggactggcaatacagcatcccggcactcaagttttaatcggcaccgacagcatcccaaacctgcataagttggaacaggtgtcctctgatgaaggaatagggaccctggcagagaatctgctcgaggcactgcgggagcacccagacgtaaataaaaaaattgacgccgctcgacgtgagaccagggcggagaagaaaaggatggctatggccatgcgccaaaaggccttgggaactcttggtatgacgaccaacgagaagggacaggttgtgaccaaaaccgcactcctgaagcagatggaagagttaatcgaggagcctggtctgacatgttgcatttgtcgggaggggtataaatttcagcctaccaaggtgctgggaatctacacgttcaccaagagagtcgccctggaggagatggaaaataagccgcggaaacaacaagggtattccacagtctcccattttaacattgtccattatgattgccacctggctgccgtccggcttgcacgcgggagagaggagtgggagagtgccgcactgcagaacgcgaacacaaagtgcaacggcctcctcccagtttggggacctcatgtaccagaaagtgcatttgcgacctgcctcgctcggcacaatacatatctgcaggagtgtaccgggcagcgggaaccaacttaccagcttaatatccacgatattaaacttctgttcctccggttcgccatggaacagtccttcagcgcggatactggtggtggcgggagggagagcaacatacaccttatcccgtatattatccatacggtgttgtacgtgctcaacaccacaagggcgacaagccgcgaagagaaaaacttgcagggcttcctggagcagcccaaggaaaaatgggtggagagcgccttcgaagtcgatggcccttactacttcacagtccttgcccttcacatactcccgccagagcagtggcgcgcaacgagagtggagatcttgcgtaggctgttagtgaccagccaagccagggctgtggctccgggaggggccaccagactgacggacaaagctgtaaaggattacagtgcatatcggagtagtctcctgttctgggctctcgtggatcttatctataacatgtttaagaaagtaccaacatccaatacagaagggggctggagctgttctctagccgagtatatccggcataacgacatgccaatctacgaggcggctgacaaggccttgaagacatttcaggaagaattcatgccggtggaaactttttccgagtttctggacgtcgccgggctcctcagcgagatcaccgaccctgaatctttcctaaaggaccttctaaactctgtcccctag

SEQ ID NO: 31739 - DNA, 3957 bp, Artificial Sequence
  Description of Artificial Sequence: Synthetic coding sequence
atgtctggtggagcctcagctaccggtcctcgaaggggccctcccgggctggaagataccaccagcaagaagaagcagaaggatcgagcaaaccaggagtcaaaagatggagatcccaggaaggagacggggtctcgctacgtggcccaagccggactggagccactagctagcggggatccatctgcgtccgcatcccacgccgccggaatcacgggcagtcggcaccggacacgactgtttttcccctcaagtagtggtagcgcttcgaccccgcaagaagaacagacaaaggaaggcgcctgcgaagatcctcacgacctcctggcaacacccaccccagaattactgctggattggagacaatcagccgaagaggtgattgtgaaactccgcgtgggtgtcggacctctccaactggaggatgtggacgcggcctttactgacacagattgtgtagtgagatttgctggcgggcagcaatggggcggggttttttacgcagagataaagtcatcatgtgctaaggtacagaccagaaagggtagtctgttacatctcacccttccaaaaaaggtgcccatgctcacatggcctagcctcctggttgaagctgacgaacagctctgcataccgccgctcaatagccagacatgtctcctgggatctgaagagaacctcgccccgctcgccggggaaaaagccgtgcctcccggcaacgacccagtgagccccgctatggtgcggtcccggaacccaggcaaggacgattgcgccaaggaggagatggcagtcgccgccgatgccgcaacgttagtcgatgaacctgaatcaatggtaaacctggctttcgttaaaaatgattcttacgagaaaggccccgactcagtcgtcgtccatgtctacgttaaggagatctgccgcgacactagtagagttcttttcagggaacaggactttacgttgatttttcagacacgagacggcaactttctaagactccaccccggatgtggaccacataccacatttaggtggcaggtgaagctccgtaacctgatcgagcctgagcaatgtaccttctgctttaccgccagccggatcgacatttgcctgagaaagcggcaatcccagagatggggagggttggaagcaccagctgctagagtaggaggcgcaaaggttgcagtccctacgggacccacaccgctggactccaccccacccggtggcgccccacacccacttacgggccaagaggaggccagagctgtggagaaggacaagtcaaaggctcgctctgaggataccgggctggacagcgttgccacccggactcctatggagcatgtgacccccaagcccgagacgcatctggcctctccaaagcctacctgtatggtccctcctatgccgcattccccggtaagcggggactccgtggaggaagaggaagaggaagaaaagaaggtgtgcttgccagggtttacagggctggtcaaccttggaaatacttgcttcatgaatagtgtcatacagtcgctatcaaatacaagagaactccgcgatttttttcatgaccggagcttcgaagctgagattaattataacaatccgttgggaaccgggggtaggttggccattgggtttgccgttcttctgcgagccctctggaagggcacacaccacgctttccagccatccaaattgaaggcaatcgtggcaagtaaggcatcccagttcacaggatacgcacagcacgacgcccaggagttcatggcctttctgctagacggcctccacgaagaccttaaccgcattcagaataaaccatatactgaaactgtggacagcgatggacgccccgatgaggtggtggccgaagaggcatggcaaagacataagatgagaaatgactcatttattgtggatctcttccagggacagtataagtccaaactggtgtgccccgtctgcgcaaaggtatcaattacattcgatccgtttttgtatttgcccgtacccctcccacaaaaacagaaggtgttacccgttttttatttcgctcgggaaccacatagcaagccaatcaaattcctggtcagcgtctctaaagaaaactctaccgcatctgaggtgctggattctctgagtcaaagtgtccatgtgaagcctgaaaacctccgcctagctgaggtcataaaaaataggtttcaccgagtgttcctcccatcccactctctcgataccgttagtcccagcgacacgctgctttgcttcgaactcctgagttccgaattggccaaggagcgtgtggtggtgttagaggtgcagcagcgccctcaggtaccgagcgtgccaatctcaaagtgcgccgcttgccagcggaagcagcagtccgaagacgaaaagctgaaacgatgcactagatgctatagggtcgggtactgtaatcaactgtgtcagaagactcactggccagatcacaaagggctctgcaggcctgagaatatcggttatccattccttgtgtctgtgcctgcctctaggctgacctatgcccgcctcgctcagctcctggaggggtacgcacgctactcagtgagcgtcttccagccccctttccaacccggccgaatggcactggagtcccagtctccaggatgcaccactctgctgtccaccggatctttggaagctggggattcggaaagagatcctattcaaccacccgaacttcagctggtgacaccaatggccgaaggcgacacgggactgccccgcgtgtgggccgcccccgaccggggaccagtgccctctacctctggtatcagcagcgaaatgttagcatctggcccgatagaggttgggtccctgcccgccggagagagggtctctcgaccagaggccgctgtacccggatatcagcatccctcagaagcaatgaacgcccatacaccgcagttctttatatacaagattgactccagtaacagagagcagcgactggaggataagggcgacactccactcgaactcggagacgattgtagcctcgctcttgtgtggcggaataacgagaggctccaggaattcgtcctggtcgcttcaaaggagctggagtgtgccgaagatccgggtagcgcaggggaggccgcgagggctggccattttaccctggaccaatgcctgaatttatttacgagaccagaagtgctggctcccgaagaagcttggtattgcccccagtgcaagcagcatcgagaagcttcaaagcagctccttctgtggcgcctacccaatgtgctcatagtgcagctgaagcgcttcagttttcgctccttcatatggcgtgataagatcaacgatctagtggaattccccgttaggaacctggatctgagtaagttttgtattgggcagaaagaagagcagctgcccagttacgacctgtacgctgtgattaatcattatggaggcatgatcgggggtcactataccgcctgtgcgcgactgcctaacgacaggtcttctcaaagatcagacgttggctggagactcttcgacgattctacagtgacaaccgtggacgagtcccaggttgtcacccggtacgcgtacgtcctcttttaccggaggcgcaattccccagtcgaacggccccccagggccggccacagtgagcaccaccctgatctgggaccggccgcggaggcagccgctagccaggccagtcgaatttggcaggagctggaagccgaagaggagccagtgcctgaagggtcaggaccactcggcccatggggtcctcaggactgggtgggaccgttgccacggggacccactactcctgacgagggttgtctgcggtatttcgtcttgggcacagtcgcagccctcgtggcattggttctcaatgtgttctaccccctggtgagtcagagtcgttggaggtag

SEQ ID NO: 31740 - DNA, 1548 bp, Artificial Sequence
  Description of Artificial Sequence: Synthetic coding sequence
atgagcggaggggcgtccgcaacagggccgaggcgggggcctcctggccttgaagacactacctcaaaaaaaaaacaaaaagaccgcgcaaaccaggagtctaaggacggcgatccaaggaaggaaaccggtagcaggtatgtcgcccaagccggcctggaacctctggcatctggcgacccctccgcctcggcctcacacgctgccggaattacagggtctcggcacaggacgagattattctttccgagcagctccggctctgcctctacgccccaggaggagcagactaaggaggaattgctactagattggcgccaatctgccgaggaggtcatcgttaagttgagagttggtgtgggaccactccaactggaagatgtggacgcagcatttacagacacggattgtgtagtgcgttttgcagggggccaacagtgggggggggtgttttacgcagagataaaatcatcctgcgctaaggtgcagaccagaaaaggatcactcttgcatctcacccttcccaagaaggtgcctatgctcacatggccctcacttctgaagaagccgctgggtacccaggaactggtgcctgggctaagatgccaggagaatggccaggagctgtctcccatcgctctcgaaccaggccccgagccgcatcgggccaaacaagaagccagaaaccagaagcgggcacagggcaggggcgaagtgggtgccggcgccggaccgggggcacaggccggtcctagtgcaaaacgcgcagtgcacctgtgccgtggccccgagggggacgggtctagggacgaccctggtccccgtggcgacgcccctccgtttgttgccgaccccgccacacaagtcgaggcagacgagcagctttgcatccctcctctgaattcccaaacttgccttctgggtagcgaggagaacttggctcccctggccggcgagaaggctgtgccccctgggaatgacccagtcagtccggcaatggtacggtcgcggaaccccgggaaagacgattgcgccaaggaagagatggcagtggccgccgacgcagccacattggtcgacgagcctgagtctatggtgaacctcgcttttgttaaaaacgacagttacgaaaagggtcccgacagcgttgtggtgcacgtttacgtgaaggaaatatgtcgggacacaagccgagtgctctttcgggagcaggatttcaccctaatcttccagacccgcgatggaaatttcctcagactgcaccccggctgtggcccccacactaccttcagatggcaggtcaagttgaggaaccttattgagccggaacagtgtaccttctgttttaccgccagcaggattgatatatgccttcgcaagcgccaaagccagcgctggggtccgggcgggcccggctgtaccaggtgctctggctggtgcaaaggttgccgagcggatcggtctaatccttctgggttcaatccaacccggcgatgttctcctccgcccgatcgcccgggggggggaccgggttgtggggaaggttag

SEQ ID NO: 31741 - DNA, 4155 bp, Artificial Sequence
  Description of Artificial Sequence: Synthetic coding sequence
atgtcagggggtgcatcagccacgggccccaggagagggcctccaggtctggaggatactacatctaagaaaaaacaaaaagatcgcgccaaccaggagtctaaggacggcgatcctcggaaagaaaccggctctcggtacgttgcgcaggccggcctcgaacccctggcctcaggcgacccttccgcatctgcgagccatgccgccggtattaccggctcacgtcataggactagattgttcttcccgtcatcgtcaggttccgcctcgacccctcaggaggaacagaccaaggagggcgcttgtgaagatcctcacgatctcctcgccactcccactcccgagctgctgctggattggagacagagcgccgaagaggtaattgtcaagctgagagtgggggtcggtccactccagctggaagacgtcgatgccgcatttactgatacagattgtgttgtgagatttgccggcggccagcaatgggggggcgtgttttacgccgagattaagtcctcgtgcgctaaagtgcagactaggaaaggttctctactgcatcttaccttgcccaaaaaggtcccaatgcttacttggccctctctgctgaagaagcccctgggcacacaggagcttgtgccggggctgcggtgccaggagaacgggcaggaattgtcccccatagcacttgaacctgggcccgaacctcacagagctaaacaggaagcccggaatcagaagcgagcccagggccggggagaagtgggagccggggctggcccaggagcccaagctggcccatcagctaagcgtgctgtgcacttatgcagggggccggaaggcgatgggtccagggacgatcctggcccaaggggggacgcccctccttttgtggcagatcctgcaacacaggtggaggcagatgagcagctctgtattccccctttgaacagtcagacatgcctgctcggatccgaggagaaccttgcacctctggctggcgagaaggcggtccccccgggaaacgacccagtttcccctgccatggtgcggagcaggaatccaggaaaagacgactgtgccaaagaagagatggccgttgctgcagatgctgctacccttgtcgatgaaccggagtccatggtaaacctagcctttgtgaagaacgactcttatgagaagggaccagatagtgttgtggtccacgtttatgtgaaggaaatctgtcgggataccagcagagtgttgttcagggagcaggacttcaccttaattttccagacacgtgacggcaattttctcaggttgcacccagggtgcggccctcatacgactttccgctggcaagtgaagttacggaatctgatcgaacctgagcagtgcactttctgcttcacggcaagcaggatcgatatctgtctccggaaacggcaatctcagcgctggggcggactagaagcacccgcggctcggggagctgtcggcggggccaaggttgccgtcccgaccggaccaacgccccttgactctacgccccctggcggtgctcctcaccccctcactggccaggaagaagctcgcgctgtggaaaaggataagtctaaggccagatcggaggatacaggccttgacagcgtggcaacccgaactcccatggagcatgtaacccctaagccggaaacacacctcgcgagtcccaagccaacctgcatggttccacccatgcctcactcacctgtctccggcgatagcgtggaggaggaagaggaggaggaaaaaaaagtttgcctccctgggttcaccggccttgtgaacttaggaaacacctgcttcatgaattcggtgatacagagcctcagcaacacaagggaactccgcgatttctttcacgatagatcatttgaagctgaaataaattataacaaccccctgggaacaggcggccgactggcaatcgggttcgcagtcctgctgcgagccctctggaagggcacacaccatgctttccaaccctctaagctgaaagccattgtggccagtaaagctagtcagtttaccgggtatgcccagcacgacgctcaggaatttatggccttcctgctggacgggctgcatgaagacctgaacaggattcaaaacaagccgtacaccgagacggtggacagtgacggtaggccggacgaggtggttgcagaggaagcttggcaaaggcataagatgagaaacgacagctttatcgtggatctttttcagggccagtataagtcgaaactcgtgtgtccagtgtgcgcaaaggtgtccattacttttgatccatttttgtacctgcctgtgcctctgccacaaaagcagaaggtcttacctgtgttctattttgctcgagaaccccactcgaagcctattaagtttctggtctccgtcagtaaggaaaattctaccgccagcgaagtgttggatagtctgtctcaaagtgttcacgtgaaacctgagaaccttcgacttgccgaagtgatcaagaatagatttcacagagtgttcctaccatcccatagccttgataccgtcagcccgtctgacactctgctttgttttgaacttctttcatcagaactagccaaagaacgagttgtggtgctggaggtccagcagcggccccaggtcccttcagtgccgatttctaaatgcgctgcctgccagaggaagcagcaatctgaagatgagaagctgaagcgctgcactcgctgttatcgggtgggctattgcaaccagctgtgccagaaaactcactggccggatcacaaaggcctctgtaggcctgagaatatcgggtacccttttctcgtgtctgtgcctgcttcgcgactaacctacgctcggctggcccagctactggagggttatgctcgatattccgtgagcgtgtttcagccacctttccagccaggccgtatggccttggaaagccagtcgcctggctgcactacattgcttagcacgggatctctcgaagcgggagatagtgaaagagaccccattcagcctccagaactgcagctggtcacgccaatggccgagggggacacgggacttcctcgggtttgggccgcccccgaccggggtcccgttccgtcaacttcaggcatttcttctgagatgctggcaagtgggcctatagaagtaggaagcctgcccgctggtgagcgcgtgtcccgcccggaagcagcggtgccgggctatcaacacccttctgaggcaatgaacgcccacactccgcaattcttcatctacaagattgactcaagtaaccgcgagcaaaggctcgaggacaaaggagataccccgctcgagctcggggacgactgctctcttgctcttgtctggagaaacaacgaacgtctccaagagtttgtgctcgtcgcatctaaggaacttgagtgtgccgaggatcccggctcagcaggcgaggcggccagagctggtcattttacactggatcagtgcctaaacctgttcacgagacccgaagtcctggctcccgaggaagcttggtattgcccccagtgcaaacaacaccgagaagccagtaagcagctccttctctggagactccccaacgtactgatcgttcagttaaaaagattttctttccgttccttcatttggcgggacaaaattaatgacctagtcgaattcccagtccgcaatttggacctctcaaagttctgcatcggccaaaaagaagagcagctcccgtcttacgatctttacgcagttatcaaccattatgggggcatgattggaggccactacaccgcctgcgctagactaccaaacgaccgatccagtcagcgtagtgatgtaggctggaggttgtttgacgatagcactgtgacaacggtggacgagagtcaagtcgtcaccaggtacgcatatgtcctcttttacaggcggagaaactctcctgtggaacgccctccacgggccggccattcagaacatcaccccgacctgggccctgctgctgaggcggctgcctcccaaggcctcggacccgggcaggccccggaagtcgccccaacccgtaccgcccccgaacgctttgctcctcccgttgatagacctgcacctacatactctaatatggaagaggtggactag

SEQ ID NO: 31742 - DNA, 4260 bp, Artificial Sequence
  Description of Artificial Sequence: Synthetic coding sequence
atgtctgggggcgcatcagccactgggcctaggcgcgggcctcccggactcgaagacactacctccaaaaagaaacagaaggaccgggctaaccaagagtcaaaagatggcgatccccgcaaggagactggatctaggtacgtcgcccaggccggacttgagcccctggcttccggggatccttccgcgagcgccagccacgctgcaggtatcacaggtagtaggcaccggacacggcttttttttccgtcatcttcaggatccgccagtaccccccaggaagagcagaccaaggagggcgcatgcgaggatcctcatgacctgcttgcgacccctacgcccgagctgttgctggactggaggcagtccgcggaggaagtgattgtaaagctgagggtcggggttggacccctccagctggaagatgtggatgccgccttcaccgacactgattgtgtggtgagattcgcaggtggccaacagtgggggggtgtcttttacgccgagatcaaatcgtcctgcgccaaagtgcagactaggaagggaagtttgttacatctgactctgcctaagaaggtgccaatgctgacctggcctagcttattgaagaaacccctgggcacacaggaactcgtgccggggttacggtgccaggaaaatgggcaggagttaagcccaatagcgctcgagcccgggccagaaccccatcgagccaagcaggaggctcggaaccagaaacgcgcgcagggccggggggaggtgggcgccggggccggaccaggtgctcaggctgggccttctgcgaagcgcgcagtacacctgtgtcgcgggcccgaaggcgatggcagcagagacgacccagggcccagaggcgatgctcctccgtttgtggcagatccggccactcaggtggaagctgatgagcaattatgcatcccacccctcaattcccagacttgcctgttgggcagcgaggagaacttggcaccgcttgccggcgagaaagctgtgcccccaggtaacgacccagtgagcccagccatggtgcgctctcgtaacccaggtaaagatgactgtgcgaaggaggaaatggctgtcgcagctgacgcagcaaccctcgtggatgaacctgagagcatggtcaatctcgcgtttgtcaagaacgactcctacgagaagggtcccgactccgtagtggtgcatgtctacgtcaaagagatctgtagggacaccagcagagtgctcttcagggagcaggactttaccttgatcttccagacgcgcgacggtaattttctccgcttacatccggggtgcggaccacacactacattcagatggcaggtgaaattgcgtaacttaattgaaccagagcagtgcacattttgctttaccgcctcgcggatcgacatctgccttcgtaagcggcagtctcagcgatggggtgggctggaagctcccgcagctagggtggggggtgctaaagtggccgtccctactggaccgaccccccttgactcaacacccccgggaggcgcgccacacccactgaccgggcaagaagaggcccgcgcagtagaaaaagacaagtctaaggcgaggagcgaagacaccggattggacagtgtggctactcggacaccaatggagcatgtcacacccaagcctgagacacatttagcatcccctaagccgacatgcatggtcccccctatgcctcactcacctgtcagcggcgattcagtagaggaggaggaggaggaggaaaaaaaggtgtgtctgcctggctttaccggtctggttaacctcggcaatacttgctttatgaatagcgtgattcagtctctgtctaatacaagagaactaagagactttttccacgatcggagtttcgaagcggagatcaactacaataaccccctcggaacaggtggacgcctcgcaataggctttgccgtgctgcttcgtgcgttatggaaaggaactcaccatgcgttccaaccctctaagctgaaagcgattgttgcgtctaaggcctcccagttcacaggatatgcccagcatgacgctcaggaattcatggcgtttctgttggatggactacacgaggacctcaaccgaatccagaataaaccgtacaccgagacagtggattcggacggaagaccggacgaggtcgtcgcggaggaggcctggcagaggcacaaaatgcgcaacgatagtttcatcgtggatctgttccagggtcaatataaaagcaaactcgtatgtcccgtgtgtgcaaaagtcagtatcacttttgaccccttcctttacctgcctgtcccgctcccacagaagcagaaagttcttcctgtcttctattttgcccgtgaacctcacagcaagccaatcaagtttctcgtcagcgtcagcaaagaaaactctacagcatccgaagtattggatagtttgagccagagcgtgcatgtcaaacctgagaatcttagactggctgaagtcataaagaatagattccacagagttttcttgcctagccactccttagacactgtctctccctcagacacattgctgtgtttcgagttgttgagcagtgagcttgccaaggagcgagtggtggtgctggaggtgcagcagcggccacaagtcccgtctgtgcctatctcaaagtgcgcagcctgtcagcggaaacagcagagcgaagacgaaaagctgaagaggtgcactcgctgctaccgggttggatattgtaaccagttatgtcaaaagacacactggcccgatcacaaaggcttgtgcaggcctgagaacattggttaccccttcttggtctctgttcctgcttcacgactgacgtacgctaggttggcccaattgctggagggttatgctaggtactccgtgagcgtgtttcagcctcccttccagcctgggcggatggcactggagagtcaaagtcctggatgtaccactctcctgagcaccggctccctggaggcaggggattcggagcgggacccaatccagcctcctgagttgcagttggtgaccccaatggctgaaggagacacaggccttcccagagtgtgggcagccccagatagaggaccagtgcccagtacctccggcatcagcagtgaaatgctggctagcggacctatagaagttggttctctgcctgccggagagagggtgagccggccagaggccgccgtgcctggctatcagcacccttctgaagccatgaacgctcacaccccccaatttttcatctataaaatcgactcgtccaaccgtgagcagagactggaagataagggtgatacacctcttgagctgggcgatgattgctcacttgctctggtgtggcgaaataatgagcgtctgcaggagtttgtactggtcgcatctaaagaattagagtgtgccgaagatccaggcagcgccggggaagcagcccgcgctggtcacttcaccctggaccagtgccttaacctctttaccagacccgaggtgctagccccggaagaggcatggtactgcccacagtgcaagcaacatcgcgaagcctccaaacaattattgctctggagactgccgaacgtgttgatcgtgcagctgaaacggttcagcttccggagcttcatatggagagacaaaataaacgatctagtcgagttcccggtgagaaacctggatctgtccaaattctgtattgggcagaaagaggaacagcttccctcctacgacctttacgctgtgatcaaccattatggcggcatgatcggaggtcactacacggcctgcgctaggctgccaaatgatcgcagcagccagcgcagtgatgtgggttggaggctttttgatgattcaaccgtaacaactgtggacgaatctcaggtggtcacccgctacgcctacgttctgttttaccgtcggagaaattcccctgtggagaggcctccaagggccgggcactcggaacaccatcccgatctgggccctgcggcggaggccgctgccagccaggcgagcagaatctggcaggagttggaagccgaggaagagcccgtgcccgagggctcagggccgctcggcccgtggggaccacaggattgggtcggcccgctgccccgggggcccactactcctgatgagggttgtctgaggtattttgtgctgggaacggtcgcagccctggtagcgctagtcctcaatgttttctaccccctggtaagccaatctcgttggcggtag

SEQ ID NO: 31743 - DNA, 4119 bp, Artificial Sequence
  Description of Artificial Sequence: Synthetic coding sequence
atgtcgggcggcgcatcagctaccggcccaaggcgaggacctcctgggctggaggatacaacatccaagaagaagcaaaaggacagagccaaccaggagtcgaaagatggagatcctcgcaaagaaaccggatcaaggtacgtggcacaggcagggctcgagcctctggcttctggggaccccagcgcctcagcttcccacgctgcagggattacgggttcccggcacaggacccgcctcttctttccgtcctcctcaggctccgcatctactccacaagaagagcagactaaggaaggggcttgtgaagaccctcatgatctgctagctacccccacacctgagctgctcctggattggcgacagtcggctgaagaagtgatcgtgaagctcagggtgggggtcggacctctgcagctggaggacgtggatgctgccttcactgacactgactgcgttgtgcgatttgcaggagggcagcagtgggggggggtgttttacgcagaaattaaaagctcttgtgccaaagtccagactagaaagggctctctgctgcatctgaccctgcctaaaaagaaaaaaccactcggcacacaggagctggtgcctggtctgaggtgtcaagagaacggtcaggagttgtccccaatcgcgcttgagcccgggccggaaccccaccgggctaagcaggaggcacgcaaccagaagcgagcccaaggacgtggtgaggtgggagcaggagccggccccggggcacaggctgggcccagcgccaagcgggcggtccatttatgtagggggccagaaggggacggatcacgggatgatcctggtccgcgcggagacgcacctccttttgttgccgatcctgcaacacaggtggaagcagatgaacaattgtgtatccctcctctcaatagtcagacctgtctactgggctcggaagagaacttggcaccactagcgggcgagaaagcagttcccccaggaaacgatccggtgagtcccgcaatggtgcggtcacgcaatccaggcaaggatgactgtgccaaggaagagatggcagtggctgctgacgcagctactttggtggacgagcctgagagtatggtgaacttagccttcgtgaagaacgacagctacgaaaaaggtcctgactccgtcgtggttcatgtttatgtgaaggaaatttgccgtgatacctcacgggtgctgtttagagagcaggatttcactcttatttttcagactcgtgacgggaactttctgcggctccaccccggttgtggtccccacacaacctttaggtggcaggtcaagctcaggaacctaatcgaaccagagcaatgcacattttgctttaccgcatcacggatcgatatctgcctgcggaagaggcaatcccagcgctggggcggtctcgaagctccagccgcccgcgtcggcggggcaaaggtggccgtgcctactggacctactcctctcgactctactccccctggaggagccccccaccctttgacaggccaagaagaggctcgggccgtcgaaaaggacaagagcaaggccagaagtgaggacaccgggctggacagcgttgcgaccaggacgcccatggagcatgtgacccccaagcccgagactcacctggctagccctaaaccaacttgcatggtgcctccgatgccacatagtcccgtctcaggcgatagcgtggaggaggaggaagaggaagagaagaaggtctgcctacctggcttcaccggacttgtaaatctcggcaatacatgtttcatgaattccgtgatccagagcttgtccaacactcgggaactgagggactttttccacgatagaagctttgaggccgaaatcaattacaacaatcccctgggtactggcggcaggctcgcaattggtttcgccgtcttgctcagggccctgtggaagggaacccaccatgcattccaaccttccaaattaaaagcaattgtggcgagtaaagcctcacagtttacaggctacgcacagcatgatgcccaggaattcatggcttttctgttggacggtctacatgaggaccttaatagaattcagaataaaccctatacagaaacagtggactcggacggaaggccggacgaggtggtcgcagaagaagcctggcaacggcacaaaatgcgcaatgatagctttatcgtggacctcttccagggccagtataagtccaaactggtgtgtcccgtgtgcgcaaaggtgagtattaccttcgatccattcctctacctgcccgtgccactcccacaaaagcagaaggtgttgccagtcttttattttgcccgtgaacctcatagcaagcctatcaaattcctggttagtgtgtccaaggaaaacagcactgcctccgaagtgctcgattccctgtcacagtcggtccacgtaaaacctgaaaaccttagactggccgaggttattaaaaaccgcttccatcgcgtctttttgccgtcccacagccttgatacggtgtctccttcagacactctgttgtgtttcgagttattaagcagtgagctggcaaaagagagagttgtggttctggaagtgcagcagcgccctcaagtcccatctgtgcccatttccaaatgtgcagcatgtcagagaaaacagcagagcgaagatgaaaaactcaagcggtgtactaggtgctatagggtgggctattgtaatcaactatgccagaaaacccattggcctgatcacaaaggcttgtgcagaccggagaacatcggctatccattccttgtgtcagtgccagctagtagattaacctacgcccgtctggcccagttgctagaaggctacgctagatattcagtgagtgtcttccagccaccctttcaacccggccggatggcactcgagtcccagtctccaggatgtaccactcttttgagcactggatcactggaggccggcgactctgaaagggaccctattcagcctcctgagctacagctcgtgacccctatggcggaaggcgataccgggctgcccagagtatgggccgcgccagaccggggtccggttccatccacatcgggcatctcaagtgaaatgctggcttctgggcccattgaggtgggctctctgcccgcaggcgaacgtgtaagccggccggaggctgcagtccctggttaccagcacccatctgaagctatgaatgcccatactccccagttttttatctacaagatcgacagcagtaacagagagcaacgcctggaggataagggagatacaccccttgagttgggcgatgattgctctctcgctcttgtgtggcggaacaacgagaggctccaggagttcgtgttggtcgcatccaaggaactggaatgcgcagaggacccagggtcagctggtgaggcagctagagccggccacttcactctggaccaatgcctcaacctgtttacaagaccagaagtactggccccagaggaggcatggtattgcccacagtgtaagcaacacagggaggcatccaagcagctcttactctggcggctgccaaacgtgcttatcgtgcagctgaaacggttttcatttaggtcgttcatttggcgcgataaaatcaacgaccttgtagagtttcccgtcagaaatctcgatctcagcaagttttgcattggccaaaaggaagagcaactgcctagttatgacctctacgcagttattaaccactatggtggcatgatcggaggccactatacagcctgcgcaagactgccaaatgaccggagtagccagaggtccgatgttggatggcgactctttgatgacagcactgtcactactgtggatgagagtcaggtggtgacacgttatgcgtacgtcctgttctaccgacgcagaaattcccctgtggagaggcctcctcgggctggccactctgaacaccatcccgatttgggacctgccgcggaggctgcagcttcccaggggcttggccctggccaggctccagaagtggccccgaccagaacagccccagagcgatttgcgccaccagtggacaggcccgctccgacttactctaacatggaagaggtggactag

SEQ ID NO: 31744 - DNA, 3357 bp, Artificial Sequence
  Description of Artificial Sequence: Synthetic coding sequence
atgccggccgtcgcgagtgtccccaaggagctctatttgagctcatcactcaaggacctgaataagaaaacagaggtaaaaccagaaaaaataagtaccaaatcatatgtgcattcagcgttaaagattttcaaaactgctgaagaatgccggctcgaccgcgacgaggaaagagcctacgtgctgtacatgaaatacgtcactgtgtacaatctgatcaaaaaacgacccgactttaaacaacagcaggattattttcattcaatcctgggccccggcaatattaagaaggcggttgaggaggccgaaagattgagtgagtctctgaagctgcgttacgaagaggcggaagtgagaaagaagctggaggagaaagatcgacaggaggaagcccaaagacttcagcagaaaaggcaggagacaggacgcgaagacggtggaacattggcgaagggaagtcttgagaacgtgttggatagtaaagacaaaacccagaagagcaatggggagaaaaatgagaaatgtgagacaaaagagaagggcgccatcaccgccaaagagctttatactatgatgaccgataagaacatttctctcataatcatggatgcccggaggatgcaggactatcaggactcatgcatcttacattctttaagcgtgcctgaagaggccatctcaccaggtgtcactgctagttggatcgaagcccatctgcccgacgactcaaaagacacctggaaaaagagggggaacgtggagtatgtcgtccttctcgattggttttcatccgctaaagatctgcagatcggcaccacactaagaagcctgaaggatgccttgtttaagtgggaatcaaaaacagtgctgcggaatgaacctctcgtgctcgagggcggctacgaaaattggctgttgtgttatccgcagtacaccactaacgcgaaggtgacccctccacctcgtcggcagaacgaagaggtgtcgatttcgctcgacttcacttaccctagtctggaggaatctattcccagtaagccggccgcacagactccccccgcgagtattgaggtggacgagaatattgagctgatctctggccagaacgagaggatggggccactgaatattagcactcctgtggaacctgtggccgcaagtaagtcggacgtttcccccataatacagcccgtgcccagtattaaaaacgtacctcagatcgaccggactaagaaacccgcagttaaactgccagaggagcatcgcatcaagagcgagtcaactaaccacgagcagcagtcccctcagtctggtaaagtgatcccagataggagtacgaagcccgtggtgttttcccccacactgatgctcacagatgaggaaaaggctcggattcatgcggagacagctcttctgatggagaaaaacaaacaggaaaaagaattgcgggagaggcagcaggaggaacagaaggagaagttgcgcaaagaagagcaggaacagaaagctaagaaaaaacaggaggccgaggagaatgagataacagaaaaacagcagaaagccaaggaagaaatggagaaaaaagaaagtgaacaggccaaaaaagaggacaaggaaacgtccgctaagcggggcaaggaaatcacgggggtcaagaggcagtctaaatccgagcatgaaacatcagatgccaagaagtccgttgaggacaggggcaagagatgtcctacaccagagattcagaagaagagcactggggatgtaccccacacaagtgtgacaggcgattcaggttccgggaagccattcaaaattaaaggccagcccgagtcaggcattctgcgaaccgggacctttcgggaggatacggatgatacagaaaggaacaaggcgcagagggagcctttaacacgcgctcggagcgaggagatgggacggattgtgcctggtttgcctagcggttgggccaagttcttggaccctattacaggtaccttcagatactaccattctcccaccaatacggtccacatgtatccaccagagatggccccatccagcgcaccaccgagcacgccacccacacacaaggctaagccacaaatcccggcagagagagacagagagcctagtaagctaaaaagaagctactccagtcccgatataacacaagcaatccaggaagaggaaaagcggaaacccacggtgacacccacagtcaaccgggaaaacaagcctacctgttatcccaaggccgagatctcgagactgagcgcttcccagattcgcaacctgaatcccgtctttggagggtccggtcctgccctcactggtctgcggaacctgggaaatacctgttatatgaattcaatcttgcaatgcttgtgtaatgctccccacctagcagattactttaacaggaactgctaccaagatgatattaacaggtcgaacttattgggacacaaaggagaagtggctgaggaattcggcattattatgaaggctctgtggacgggtcagtataggtacatctcccccaaggacttcaaaatcaccattggcaagattaatgaccagttcgctggatacagtcaacaggactctcaggaactcttgctcttcctgatggatggtttgcatgaagatttgaacaaagcagataaccggaagaggtacaaggaagaaaataacgaccatctcgatgactttaaagctgcagagcatgcctggcaaaagcacaaacaacttaacgagagtataatcgtagccctgtttcaggggcagttcaaatctactgtgcaatgcctgacttgccataagaaaagccgaacattcgaggcttttatgtacctctccctgccactcgcttcgaccagtaagtgtacactccaggattgtttgcggcttttctccaaggaagagaagttgactgataataatcggttttattgttcgcattgccgggcccgtcgcgactcactaaaaaagatcgaaatttggaaactcccccctgtactgcttgtccacctgaaaagattctcttacgacggcaggtggaagcagaagttacagaccagcgtggacttccctcttgagaaccttgatctgtcacagtatgtgatcggccccaaaaacaacctgaagaagtataacctgttcagcgtctctaaccattacgggggtttggacgggggccattatactgcatactgcaaaaatgccgcccggcagagatggttcaaatttgatgaccatgaagtgagcgatattagtgtgtcctctgtgaaatccagcgcagcatatatcctcttctacacctcactggggcctagagtcacggatgtcgccacctag

SEQ ID NO: 31745 - DNA, 996 bp, Artificial Sequence
  Description of Artificial Sequence: Synthetic coding sequence
ctcacaggcttacgtaatctgggcaacacctgttacatgaattctatccttcagtgcttgtgcaacgcccctcacctggccgattacttcctgactggcaagtacatgagtaatcttctggggcataagggtgaggtcgctgaggagttcgggattatcatgaaggctttgtggaccggacaataccgatatatttcaccaaaggactttaagataactattggtaagatcaatgatcagttcgcggggtatagtcagcaggattctcaggagctgttactgttcctgatggatggactgcatgaagatttgaacaagtttcaggccgacaaccgcaagcgatacaaagaggaaacagccgaacatgcatggcagaaacacaaacaattgaacgaaagcataatagtggctctcttccagggccagttcaaatctacagtgcagtgcttaacatgtcataagaaaagtcgtactttcgaagcttttatgtatctgagcctgcccctcgccagcacgagcaaatgtaccctccaggattgtctgcgcctcttcagcaaggaggaaaagcttacagataataatcgcttctattgcagtcactgtagggcccgcagagattccctgaaaaagattgagatctggaagttgccaccagtgctcttggtgcacttgaagcggttctcctacgatggcaggtggaaacagaagttacagaccagcgtcgatttcccacttgagaacctggacttaagccagtacgtaattggtccaaaaaacaatttgaagaaatacaaccttttctctgtgtcaaatcactatgggggactcgatggagggcactataccgcttactgcaaaaatgccgcccgccagaggtggttcaagtttgacgatcacgaggtgtctgacataagcgtgtctagcgtcaagagttccgccgcttatattctgttctacacttctctcgggccccgggtgaccgacgttgcaacttag

SEQ ID NO: 31746 - DNA, 3357 bp, Artificial Sequence
  Description of Artificial Sequence: Synthetic coding sequence
atgccagccgtggcttctgtgcctaaagagctgtatctgtcctcatccctgaaggacttgaacaagaagactgaggtaaaaccagagaaaattagcacaaaaagctacgtacactcggccctgaaaatctttaagactgctgaggagtgcagactagacagggacgaagagcgggcatatgtgttgtacatgaagtatgtgacggtgtacaacctaattaaaaagaggccagacttcaaacaacagcaggattactttcactccatcctaggcccggggaacataaaaaaagctgtagaggaggcagagagactaagcgaaagcctgaagctgcgctacgaggaagcggaagtgcggaagaagctagaagaaaaggatagacaagaagaagctcagagattgcagcagaaacgacaggagacaggacgggaagacggtgggacactggctaagggtagtctggagaacgtgttagatagcaaggataagacacagaagtcaaacggagagaaaaacgaaaaatgcgagacgaaggagaagggtgcaatcactgctaaggaactgtatacaatgatgacagacaagaatattagtctgataataatggacgcacgcagaatgcaggactatcaggattcctgcatcctacactcattgtccgtgcccgaagaagctattagtccgggcgtcacagcaagctggatagaggcccatctgccagacgacagtaaagacacttggaaaaagaggggcaatgtcgaatacgtagtgctcctcgactggttcagctctgctaaagaccttcagataggcacaactctgcgaagcctgaaggacgctcttttcaagtgggaatctaagacagtgctgcggaatgagccactcgtgcttgagggcggatatgagaactggctcttgtgttatcctcagtacacaacgaatgcaaaggtgaccccccctcctagacggcagaatgaggaggtgtctatttccctggacttcacttaccccagtctggaagagagtatcccgtctaaacccgccgctcagacgcctccggcttccatcgaagtcgatgagaatatcgagctcatctcgggacaaaacgaaaggatgggtcctttaaatataagtacccctgtggaacctgtggctgcatcaaaaagcgatgtttctcccataattcaacccgtaccctcaatcaagaatgtccctcagatcgatagaacgaaaaaaccagcggtgaagttgccggaggaacaccgcatcaagtcagaaagcactaatcacgaacaacaatcgccacagtcagggaaggtcatccccgaccgatccacaaagccagtagtattctcacccactctcatgctaaccgatgaagaaaaggcaaggattcacgccgaaacagctttgcttatggagaaaaacaaacaagagaaagaattacgggagaggcagcaggaggaacagaaggagaaactgaggaaagaggaacaggaacagaaggcaaagaagaagcaggaagccgaggaaaacgagattactgaaaaacagcagaaggccaaggaggagatggagaaaaaggagagcgagcaggccaagaaggaggacaaggagacatctgctaagcggggaaaggagattacaggtgtcaagcgacagagtaagtccgaacatgaaacaagcgacgcaaagaaaagcgtcgaggatagagggaagcggtgcccaactccagaaatccagaaaaaaagcacaggagatgtgccacacacctcagttactggggacagtggaagtggaaagcccttcaaaatcaagggacagcccgaaagtggcatacttcggacaggcacctttcgggaggataccgatgatacggaacgaaataaggcacagcgggaaccactcactcgcgctcgatcggaggaaatgggccggatagtacctgggttaccctctggatgggctaagtttctggatcccataaccgggactttcaggtattaccattcgcccactaacaccgttcacatgtacccacctgagatggcccccagttccgccccaccgagcacgccccccacacataaggccaagccccagattcctgccgagcgcgatcgggaaccatcaaagctgaaaaggtcctactcgtctcctgacatcactcaggctatacaggaggaagaaaagagaaagcccacagtcactcctacagtgaaccgcgagaataagccaacctgctatcccaaggctgaaatatcaagattaagcgcatctcagattcgaaacctaaaccccgtgtttggaggatccggacccgctcttaccggtctgcgcaacttgggtaacacctgctacatgaactcgatacttcagtgcctctgcaatgcaccacatctggccgactatttcaaccgcaactgttatcaagatgacattaatcggtccaatctgctgggccacaaaggcgaggtagctgaagagttcggcattatcatgaaagcactgtggactggccaatacaggtacatatctcctaaggacttcaagatcacaattggcaaaattaacgaccagttcgctggctactctcaacaagacagccaggagttgttgctgttcctgatggacggactgcatgaggacttgaataaggccgataatcgcaaacgatacaaagaagaaaacaatgatcatcttgatgactttaaagccgcagaacatgcctggcagaaacacaaacagctcaacgaaagtatcattgtggccctatttcagggccagttcaagagtaccgtgcagtgtctcacctgtcacaagaagtccaggacgtttgaagccttcatgtatctgtcattaccgcttgctagcacgtccaaatgcaccctgcaggactgtctcaggctatttagcaaagaggagaaactcaccgacaacaatcgcttttactgctcccactgtcgggcccgccgagatagtttgaagaagattgagatttggaaactcccacccgttcttctggtgcacctcaagcgtttctcatacgatggaaggtggaaacagaagctccagacctccgtggacttcccactggaaaatcttgacctgtctcagtatgtgattggacccaagaacaacctgaagaagtacaatctgtttagtgtctcgaaccactatgggggtttggatgggggacactacaccgcgtattgtaaaaatgctgcccggcagcgatggtttaaatttgacgaccatgaggtctcagacatttcagtgagtagtgtgaagtcatccgccgcctacatccttttttacacttccctaggaccacgggtcacagacgtagctacttag

SEQ ID NO: 31747 - DNA, 3357 bp, Artificial Sequence
  Description of Artificial Sequence: Synthetic coding sequence
atgcccgccgtcgcatccgtgcccaaagagctttatctgagcagcagcctgaaagacttaaacaaaaagacggaagtaaagcccgagaagatttcaacaaagagttatgtccacagcgccctgaaaatcttcaaaaccgccgaagaatgtagactggaccgagacgaggaaagggcctacgtgctctatatgaaatacgttacggtatacaatctcatcaagaagaggcccgatttcaaacaacagcaggattacttccatagtatactcggtcccggcaacatcaaaaaggccgtcgaggaagccgagcgcttatctgaatccctaaaactaaggtatgaggaagctgaggtgcggaagaagctcgaggagaaagatcgccaagaagaagcacagcgcctgcagcaaaaacgccaggaaactggccgcgaggatgggggtacacttgctaagggtagcttggaaaatgtgctcgatagcaaggacaaaacccagaaaagtaacggggagaaaaacgagaagtgtgagacaaaggagaagggagccataactgccaaggaactgtacactatgatgactgataaaaatatttcacttatcatcatggatgctcgccggatgcaggactatcaggattcatgcatcctccactctctttccgtgcccgaggaggccatttctcccggcgttacagcttcttggattgaggctcacctccctgatgacagtaaggatacttggaagaagcggggcaacgtagagtatgtggtactgctggactggttctcgagtgcgaaggatcttcagatcgggacaacgttaaggtctctgaaagacgctctctttaagtgggagtcaaaaaccgtcttacgtaatgagcccttggttttagagggagggtatgagaattggctgctatgttacccgcagtatacaaccaatgcaaaggttaccccaccccccagacgccagaatgaggaagtctctatctcacttgactttacatacccatctttggaagaatctatcccatctaagcccgcagcgcagacacctcctgcttccattgaagtcgatgagaacatcgagctaatttccggacagaatgaacgcatgggacccctgaatataagtacccccgtggagccagtggcagcttccaagtccgacgtgagccctatcatccagccagtgccaagtattaagaatgttccacaaattgaccgcaccaaaaagccagcagtcaagctgcccgaggagcatcgaatcaagagtgagtccacgaaccatgaacagcaatccccccagtccggcaaagtgattccagaccgatcgacaaaacctgtcgtcttcagcccgaccctgatgctgactgatgaagagaaagcaaggatccatgccgagacagctcttctcatggagaaaaacaagcaggagaaggagttgagagaaaggcagcaggaggaacagaaggaaaagctgcgcaaggaagagcaggagcaaaaggcaaagaaaaaacaagaggccgaggagaacgagataactgagaaacagcagaaagccaaggaggagatggaaaaaaaagagagtgagcaggcaaaaaaggaggacaaggaaacctctgcaaagcggggaaaggaaatcactggggttaagcgtcaatccaaaagcgagcatgaaactagcgatgccaagaaatcagtggaagaccggggcaaaagatgtcctactcctgagatacagaagaaatccactggagacgttcctcacacatccgtgacaggggacagtgggagtggtaagcctttcaaaatcaagggacaacccgagagtggtattttacggacaggaacatttagagaagatactgatgacaccgagcgaaataaagcccagagggaaccactcactcgcgcaaggtccgaagaaatgggtcgcatagtgcctgggctccctagcggctgggccaaattcttggatcctatcacagggaccttccgatactaccactcacccacgaacaccgtgcatatgtatccacccgagatggccccatcatccgcacccccctctacgccacctacccacaaggccaaacctcaaatacctgcagagagagaccgggaaccctccaagttaaaaaggtcctactctagtcctgacattacacaggctattcaggaggaggaaaagagaaagccaaccgtcacacctaccgttaaccgggagaacaagcctacttgttacccaaaggccgaaatttctagactgagtgccagtcagatccggaatctgaacccagttttcggcggctcagggccagccctaactggcttaaggaatctcggaaacacttgttacatgaactctatcctccagtgcctctgcaatgcaccacacctggcggattatttcaataggaactgttaccaggatgacatcaacagatcaaatctgttgggtcacaagggagaggtggccgaggagtttgggatcatcatgaaggcactgtggaccggacagtacaggtatatcagtcccaaagatttcaagatcacgattggcaagattaatgatcagttcgcgggttactcccagcaagactcacaagaactcctacttttcctcatggacggcctccatgaagacctcaataaagcagataaccgaaagcgttataaagaagaaaataacgatcacctcgatgactttaaggcggccgagcacgcgtggcaaaagcacaagcagctgaacgagtccattatcgtagccttgttccagggacaattcaagtccacggtgcagtgtctcacgtgccacaagaagtccaggactttcgaggcttttatgtacctatctttgcctctagctagcacctcaaagtgtacactacaagactgcttacgcctgtttagcaaagaggagaagctaacagataacaacagattttattgctctcattgtcgggctcggcgtgattccctcaaaaagattgagatttggaaactgccccctgtgctgttggttcacctgaagagattctcatatgatggccgttggaaacaaaagctacagaccagtgtcgatttccccctggagaaccttgacttgagccaatacgtcataggtcctaagaacaacctgaagaagtacaacttattctcagtgtcaaatcattacggaggacttgacggggggcattacacagcctactgtaaaaacgcggcccggcagcggtggttcaagtttgacgaccatgaggtgtcagacatcagcgtaagtagcgtgaaaagctcagctgcctacatcctgttctacacctcactgggcccacgagtaacagacgttgctacctag

SEQ ID NO: 31748 - DNA, 408 bp, Artificial Sequence
  Description of Artificial Sequence: Synthetic coding sequence
atgccagctgtggcctcagtgcctaaggagttgtacctttccagttcgctgaaggacctcaataagaagaccgaagttaaaccagagaaaattagcacaaagtcttacgtccacagtgcgctgaagatctttaagaccgcagaagaatgccgcctcgatagggatgaggagagagcatacgtgctatatatgaagtacgtgacagtgtataatttaatcaagaagaggccagattttaagcagcagcaggattactttcattccatcctgggacctggcaacatcaagaaagccgtggaggaggctgagcgacttagtgaatccctcaagctccggtatgaagaagccgaggtacggaaaaagctcgaggaaaaagacagacaggaggaggcccaaaggctccagtag

SEQ ID NO: 31749 - DNA, 291 bp, Artificial Sequence
  Description of Artificial Sequence: Synthetic coding sequence
atgccagctgtagcaagcgtgccgaaggaattgtacctgtcttcgtcactgaaggacctgaataaaaagacggaagtgaaacctgagaagattagcacaaagagctacgtgcattctgccctcaaaatttttaagacagccgaagagtgccgactagaccgggatgaggagcgggcatatgtgctgtacatgaaatatgtaaccgtgtataatctgatcaagaagcgaccggactttaaacagcaacaggattattttcacagcatcctgggaccagggaacatcaaatag

SEQ ID NO: 31750 - DNA, 222 bp, Artificial Sequence
  Description of Artificial Sequence: Synthetic coding sequence
atgcccgccgttgcctccgtgccgaaggaactgtatctttctagcagcctaaaggaccttaacaaaaagaccgaagtcaaaccagaaaagatttccacaaagagctatgtgcactccgccctgaaaatatttaaaacagctgaagagtgccggttagatagggacgaggagcgggcatatgtcttgtacatgaaatatgtgacggtgtacaatctgatttag

SEQ ID NO: 31751 - DNA, 132 bp, Artificial Sequence
  Description of Artificial Sequence: Synthetic coding sequence
atgagctctacctctagcaaacgagcacccacgaccgctacacagaggctgaaacaagactacctgcggatcaagaaggatccagttccctacatctgcgcagaaccattgccttctaacatcttggaatag

SEQ ID NO: 31752 - DNA, 957 bp, Artificial Sequence
  Description of Artificial Sequence: Synthetic coding sequence
atggagactcggtataacctgaagtcccctgcagtgaagagactgatgaaggaagctgctgagttgaaggatcccacagatcattaccacgcacagccgttggaggataacctgttcgagtggcatttcaccgtgcgcggaccacccgattctgactttgatggaggggtgtatcatggcaggatcgtgcttcctcctgaatatcccatgaagcctccgtcgatcattctactcactgctaatggccgtttcgaagttggcaaaaaaatctgccttagtatcagcggtcaccacccggaaacatggcaaccttcatggtcaatccgcacagctttactggctatcatcggctttatgccaaccaagggcgaaggtgctattggttcactggattacacccctgaagaacggcgggccctcgccaaaaaatcccaagacttttgttgtgaagggtgcgggtcagccatgaaggacgttttgttgcccctgaaatccggtagcgatagcagtcaggcggatcaggaagccaaagaactggcgaggcagatttctttcaaagccgaggtaaacagctccggcaagacgatttctgaaagtgacctgaaccattcattcagcctgaccgacttgcaagacgacattcccacaaccttccaaggcgccacagcttctacctcttatgggctacaaaactcctcagccgcttcctttcaccagccaactcagcccgttgctaagaatacatccatgtccccaaggcagagacgtgctcagcagcagtcccagaggaggctatccacttctccagacgtcattcaggggcaccaaccaagagataatcacacggaccatggggggtccgctgttctgattgtgattttgaccctcgccttagcagcacttattttcagaagaatttacctggctaatgaatatattttcgactttgagctgtag

SEQ ID NO: 31753 - DNA, 912 bp, Artificial Sequence
  Description of Artificial Sequence: Synthetic coding sequence
atgaaggaagctgcagagttgaaggaccctacagaccattatcacgcccagccacttgaagacaacttgtttgagtggcacttcaccgtccggggacctccagactcggattttgacggcggagtctatcacgggagaattgtcctgccaccagaataccctatgaaaccaccttcaatcatccttctgacggccaatggtcgtttcgaagttgggaaaaagatttgcctcagcattagcggacaccacccggaaacttggcaaccaagttggtccattcggacagctttactcgccattataggcttcatgccaacaaagggggagggcgccattggcagtctggactatacacctgaagaaagacgcgctctagcaaaaaagagccaagacttttgctgtgaggggtgcggctcagctatgaaggacgtcctgctcccattgaagagcgggtccgattcatcccaggctgaccaggaggccaaagagctggctcgacagattagcttcaaggccgaggtgaacagctccggtaagactatctccgaatctgatctgaaccattcattctcattgactgaccttcaagatgatattcctaccaccttccagggagcaactgccagtacatcttatggccttcagaactccagtgccgccagtttccatcagccgacacagccagttgcaaagaatacctcgatgagtcctaggcagagacgtgcccagcagcaatcacagaggcgcctaagcacttcacccgacgtgattcagggacaccagccccgggacaatcacacagatcatggcgggtcagcagttctcatagtgatcctgactctggccctggctgcccttatcttccgtcgtatatatctagctaacgaatatattttcgacttcgagttatag

SEQ ID NO: 31754 - DNA, 675 bp, Artificial Sequence
  Description of Artificial Sequence: Synthetic coding sequence
atgtggccacaagatattgccgggcggcattacgtggtccggggaccagagatgaccccctacgagggcggttactatcatgggaagttaattttcccaagggaattcccttttaaaccgccaagtatttacatgataacacccaatggtaggttcaagtgtaatacaagactctgcttgagcatcactgactttcatcccgacacctggaatcctgcctggtccgtgtcaacgatcctgactggattattgagcttcatggttgagaagggccccactcttggctccatcgagaccagtgattttactaaacggcagctggctgtacagtctctggctttcaatctgaaagacaaagtgttctgtgagttgttccccgaggttgtggaagaaattaagcaaaagcagaaagcccaggacgagttgtcttcgagacctcagacactgcccttgcccgacgtggtgccggatggcgaaacacatctggtacagaacgggattcagttgctcaacggccacgccccaggcgcagtgcccaacctggccggtcttcaacaggcaaatagacaccacgggctgttggggggggccttggccaacctgttcgtgatcgtgggctttgccgcatttgcatacactgtgaagtatgtgctccgcagcatcgcccaggagtag

SEQ ID NO: 31755 - DNA, 624 bp, Artificial Sequence
  Description of Artificial Sequence: Synthetic coding sequence
atgacaccatatgagggcgggtactaccacggcaagttaatttttcctcgagagttccccttcaaacctccatccatatacatgatcacccccaacggccgctttaaatgtaatacccgcctttgcctgagcattactgattttcaccccgatacatggaatccagcatggtctgtctctacgatccttacaggtttgctcagctttatggtggagaaaggtcctactctgggcagcattgagacttccgacttcacaaaacggcagctggccgttcagtccctggcatttaacctcaaagataaagtattttgcgaacttttcccggaggtagtcgaggaaataaaacagaaacagaaggcacaggatgagctatcgagtcggccacagaccctaccactacctgacgtggttccagatggagagacgcatttggtgcaaaatgggatccaactgctgaacggacacgcacccggcgccgtgccaaacctggcagggctccagcaggccaatcggcaccacgggctgctaggcggagccttggcaaacctgttcgtgatcgttggattcgctgcttttgcctacaccgtcaagtacgtcctgcggtcgatagcccaggagtag

SEQ ID NO: 31756 - DNA, 624 bp, Artificial Sequence
  Description of Artificial Sequence: Synthetic coding sequence
atgactccctacgagggaggctactaccatgggaagttgatttttcctagagagttcccctttaagccccccagtatttatatgattacgccaaatggaagattcaagtgtaatacacgcctatgcctctccatcactgattttcatcctgacacatggaaccctgcgtggtcagtgtccacaattctcactggcttgctaagtttcatggtcgaaaagggaccaaccttagggtccatcgaaaccagcgatttcactaagaggcagctcgcagtacagtccttagcttttaacctcaaggacaaggtcttctgcgaattgttccccgaggtggttgaggagataaaacagaagcagaaagcacaggatgagctgtcttcccggcctcagactctgcctttgccggatgtggtgccggacggcgaaacccacctagtccagaacgggattcaactcctgaacggtcatgctcctggcgccgtgcccaatctggctgggttgcagcaggctaatcggcaccacggtcttttagggggggctctggccaatctctttgtgatcgtgggttttgctgcatttgcatatactgtgaagtacgtgttgaggtcaattgctcaagagtag

SEQ ID NO: 31757 - DNA, 780 bp, Artificial Sequence
  Description of Artificial Sequence: Synthetic coding sequence
atgtcctccacctcaagtaaacgagcacccacaaccgctacccagcgcctgaagcaggattacctacggataaagaaagaccccgtcccctacatctgcgccgagccactgcctagcaacatccttgagtggcattatgtcgtgagggggcctgagatgactccttatgaaggcggttattaccacgggaaactgatttttcccagagaatttccattcaaacctcccagtatttatatgattacaccgaacggtaggtttaagtgcaatactagattgtgtctgtctataacggatttccatcctgatacatggaacccggcctggtctgttagtaccatcctgactggcctgctttctttcatggtggaaaaaggccctaccctcggctctatcgagacttctgacttcaccaaaaggcagctcgcggtccagagcctggccttcaatttgaaagataaagttttttgtgagttattccccgaagtggtcgaagaaatcaaacaaaaacaaaaggcacaggatgagctaagctcaagacctcagacgttaccactcccagacgtggttcctgacggtgaaacccacctggtgcagaacgggattcagctgcttaacggacatgctccaggcgctgtacccaatctggccggccttcagcaggccaatagacaccatggtctgctaggaggcgccctcgccaacctctttgtgatcgtgggttttgccgcatttgcctatacagtgaaatatgtgctacggtctattgcacaggagtag

SEQ ID NO: 31758 - DNA, 780 bp, Artificial Sequence
  Description of Artificial Sequence: Synthetic coding sequence
atgtcctccaccagctcaaaaagagctcccaccacggctacacagaggctgaaacaagactacctgagaatcaaaaaggatcccgtgccatacatctgcgctgagcctctgccaagcaacattttggagtggcactacgtggtgaggggacctgagatgacaccctacgagggcggctattatcatgggaagttaatctttccgcgagaatttccatttaagcccccttctatatatatgataacccctaacggaagattcaagtgtaatacccggctctgcctctctatcaccgatttccacccagatacgtggaacccggcctggtcagtatcaaccatcctcaccggtctccttagcttcatggtagagaaaggacccaccttgggcagcatcgagactagcgattttacgaagaggcaactggctgtccagtctctcgcctttaacctgaaggataaggtgttctgcgaattgttccccgaagtggtcgaggaaataaaacagaaacagaaggcccaggatgaacttagctccagaccacagacgctgccattaccagacgtggttcctgacggagaaacgcaccttgttcaaaacggcatacagctcctgaacggccacgcgcctggggcagtgccaaacctggcggggctgcaacaggcgaatcggcaccacggtctgttaggaggcgcactggccaatctgtttgtgatcgtcggattcgctgcttttgcatataccgtgaaatatgtgctgaggtccatcgctcaggaatag

SEQ ID NO: 31759 - DNA, 624 bp, Artificial Sequence
  Description of Artificial Sequence: Synthetic coding sequence
atgaccccatacgaggggggctactatcacggcaagcttatattcccaagggagttcccctttaagccacccagtatttatatgataactcctaacggccgatttaagtgtaatacccgtctctgcttatctatcactgatttccacccagacacttggaatcccgcctggtcagtgtcgactattttgaccggccttctgtcttttatggttgaaaagggacccactcttggatctatagaaacaagcgattttactaagcgccagttagccgtgcagtccctggctttcaatctgaaggacaaggtcttttgtgagttgtttccagaggtagttgaggaaatcaagcagaagcagaaggcacaagacgagttaagcagcagaccccagacactgccccttcctgacgtagtcccagatggggagactcatctagttcaaaatggtatccaactgctcaatggacacgcccctggagcagttccaaacctggcgggactccagcaggccaaccgacaccacggcctccttggcggcgctctggctaacctctttgttatcgtgggtttcgcagccttcgcatatacagtgaaatatgttctgcggtctatcgcccaggagtag

SEQ ID NO: 31760 - DNA, 828 bp, Artificial Sequence
  Description of Artificial Sequence: Synthetic coding sequence
atgtcatcaacaagctccaagagagcccccacgaccgctacccaacgcctaaagcaggattacctgcgcatcaaaaaagaccccgtcccatacatttgtgccgaacctcttccctctaatatcctggaatggttcaaaaggtttagctggctgtctctgttgtctagctgggactaccgccactacgtagtgagggggcccgagatgactccctacgaaggtggttactaccatggtaagttaatatttccgcgtgagttccccttcaagccaccaagcatttacatgattacccctaatggacgatttaaatgcaacacccggttgtgcctgtccataactgatttccaccctgatacatggaacccggcatggtccgtcagcacaattcttactggactgctgtcattcatggtggaaaaaggacccactttggggtctatcgagacaagcgatttcactaagcggcaacttgctgtccaatcactcgccttcaaccttaaggataaggtgttctgcgaactttttccagaggtggtcgaagaaatcaagcagaagcaaaaagcccaggacgagctttcttctcgtccacagacactaccactacctgacgttgtgccagatggagagacccacctggtccagaacggcattcaattgctcaatggtcacgcaccaggcgcagtcccaaatcttgccggattacagcaggccaaccgacaccacggtttactcggaggcgccctagctaatctgtttgtcatcgtgggttttgctgcctttgcttataccgtgaaatatgtcctccgaagcattgcacaggaatag

SEQ ID NO: 31761 - DNA, 306 bp, Artificial Sequence
  Description of Artificial Sequence: Synthetic coding sequence
atgtctagcaccagcagcaaaagggcccccaccacagcaactcagaggctaaaacaagattatctgagaatcaagaaggatccagtgccatatatctgcgccgagcccctgccaagcaacatcttagagtggtttaaacgcttttcctggctgtctttactgtcttcttgggattaccggcattatgtggtaaggggccctgagatgactccttacgagggcgggtactatcatgggaaactgatatttccccgggaattcccgttcaagcctccaagcatctacatgattacacccaacgggtag

SEQ ID NO: 31762 - DNA, 591 bp, Artificial Sequence
  Description of Artificial Sequence: Synthetic coding sequence
atgtcctccacgtcttccaagagagctccgacaacagccacacagcgacttaaacaggactacctgcgaataaagaaggaccctgtcccttacatttgcgcggaaccactccctagcaacatactggagtggcactacgtcgttcgagggcctgagatgactccatatgaaggaggatattaccacggaaagctgatctttcccagagagttccctttcaagcccccgtctatctacatgattacccctaatggaaggttcaagtgtaatactcgactgtgtctgtccatcacggacttccatcccgatacatggaatccagcctggagcgtgtccacaatactcactgggcttctcagctttatggtggagaaggggcccacactggggagtatcgagacctctgacttcaccaaacgccaacttgccgtccaaagccttgcttttaatctgaaggataaagtcttctgtgagctcttcccagaagtggttgaagagataaagcagaaacagaaggctcaggacgaactctcgagccggccacagacactgcccctgcctgatgtggttcccgacggagagactcactag

SEQ ID NO: 31763 - DNA, 132 bp, Artificial Sequence
  Description of Artificial Sequence: Synthetic coding sequence
atgagtagcacctcatctaagcgggcacccactactgccacgcagcgattgaagcaggactatctccgaattaagaaggatcctgtgccctacatctgtgcagagccactgcccagcaacatcctggagtag

SEQ ID NO: 31764 - DNA, 216 bp, Artificial Sequence
  Description of Artificial Sequence: Synthetic coding sequence
atgtctagtacgagcagcaaaagggccccaaccaccgccacccagagactaaagcaggactatctgagaataaagaaggaccccgtgccttacatctgtgctgagcccctcccttctaatatcctggagtggcactacgttgtccgcggacccgagatgacaccctatgagggcgggtactatcatggaaagttaatctttcctcgggagttctag

SEQ ID NO: 31765 - DNA, 444 bp, Artificial Sequence
  Description of Artificial Sequence: Synthetic coding sequence
atggcattgaagcgaattaacaaagagctcagcgatttggcgcgggacccccccgcccaatgctctgcaggacctgtgggcgacgacatgtttcactggcaggctaccattatgggccctaatgactctccttaccagggcggggtctttttcttgaccattcactttccgacggattatccattcaagccacccaaggtggctttcaccacacggatttatcatcccaacatcaatagcaacgggagcatttgtttggatatccttaggtcccaatggtcccctgcacttactatcagcaaagtcctactgagcatttgttcactgttgtgtgaccctaaccccgacgacccactcgttcccgagatcgcccgtatctataagactgatagagacaaatataatcggatcagcagggagtggactcaaaaatatgcgatgtag

SEQ ID NO: 31766 - DNA, 444 bp, Artificial Sequence
  Description of Artificial Sequence: Synthetic coding sequence
atggctctgaagagaatcaacaaggaactgagcgacctcgctagggaccccccggcccaatgttctgccggtccggtgggggacgacatgttccattggcaggcaacaatcatggggcccaacgactctccttaccagggcggagtcttcttccttacaatccacttcccaactgattacccttttaagccgcctaaggtcgccttcaccacccggatataccatcctaacattaatagtaacggatctatttgtttggatatcctgcgctctcagtggtccccggcactgaccatctccaaagttctcctgagcatatgctccctgttgtgtgaccctaatccagacgaccctctcgtacccgaaatagcccggatctacaaaaccgaccgggacaaatataatcggatctcccgggagtggactcagaagtatgccatgtag

SEQ ID NO: 31767 - DNA, 447 bp, Artificial Sequence
  Description of Artificial Sequence: Synthetic coding sequence
atggccctgaagcgtattaacaaggagctttcggatctcgcccgggacccaccagcgcagtgctcagccgggcccgtgggtgatgacatgttccattggcaggccaccataatggggccaaacgattccccttatcagggcggagtgttctttctgacaattcatttcccgacggattatccatttaagccaccaaaagtggcctttaccacccgtatctaccacccgaacataaactcgaatggcagtatttgtctagatatcctgcggagtcagtggagtccggctctgacaataagtaaggtcctgctgtccatctgctctttgctgtgtgacccaaacccagatgacccattggtgcccgagattgccaggatttataaaacagatagagataaatataataggctggcgcgggagtggactgaaaagtacgctatgctttag

SEQ ID NO: 31768 - DNA, 444 bp, Artificial Sequence
  Description of Artificial Sequence: Synthetic coding sequence
atggcactgaaacgtataaacaaggaactctccgacctagccagggaccctcccgctcaatgcagcgcaggtccggtgggcgatgacatgtttcactggcaagcgacgatcatgggacccaacgactcgccttaccagggaggggttttcttcctcactatacacttcccgacagactatccatttaagccaccaaaagttgcattcacaacacggatctaccaccccaacattaactcaaacggctcaatttgtctcgacatcctgcgaagtcagtggtcaccagcactgacgatctctaaggttctgctgtcaatctgctcactcctgtgtgaccccaacccagatgacccactagtgcctgaaatcgccaggatctataaaacagatagggataagtataaccggatctctcgggagtggacgcaaaaatatgcaatgtag

SEQ ID NO: 31769 - DNA, 450 bp, Artificial Sequence
  Description of Artificial Sequence: Synthetic coding sequence
atgcttagcaaccggaaatgtctgtcgaaggagttatcggatttggctcgagatccccctgctcagtgttcagcaggccccgtcggcgacgacatgtttcactggcaggccactatcatgggcccaaatgattccccatatcagggaggtgtgttctttctgacaatacacttccccacagactatccatttaagccaccgaaggtcgcattcaccactagaatctaccacccaaatattaacagcaacgggagcatctgcctcgacatattgcggtcccaatggtctcctgccctgacaatctcaaaagtattactgtcaatctgttctctcctctgtgatccaaaccccgatgatccattagtccccgaaatagcccgaatatataagacagatcgggacaagtataataggatttcacgcgaatggacccagaaatatgccatgtag

SEQ ID NO: 31770 - DNA, 444 bp, Artificial Sequence
  Description of Artificial Sequence: Synthetic coding sequence
atggcgctcaagcgcatcaacaaagagctgtcagacctcgcaagggacccccccgcccagtgcagcgctgggccggtcggcgatgacatgtttcattggcaagccaccatcatgggacctaatgactccccctaccaaggaggggttttttttctcactattcatttccctacagactaccccttcaaacccccgaaggttgcctttacaacgcgcatttaccacccaaatattaattccaatgggtctatttgtctcgacatcttacgttcccagtggtctcccgcactgaccatttcaaaggtactgcttagcatttgtagcctcctctgcgatccaaatccagacgacccattggtgcccgaaatcgcaagaatctataaaacggacagggacaaatacaaccgtattagccgagagtggacgcagaaatatgctatgtag

SEQ ID NO: 31771 - DNA, 444 bp, Artificial Sequence
  Description of Artificial Sequence: Synthetic coding sequence
atggccttaaaacgaataaataaagaactcagcgacctcgcccgcgaccctcccgcgcagtgtagcgccggaccggttggtgatgacatgttccactggcaggctactataatgggtcccaatgatagcccctaccaggggggagtgtttttcttaacaatccatttccccactgattacccatttaagccacccaaagtcgctttcactacccgcatctaccaccctaatattaattcaaacggaagcatctgcctcgacattctgcgctcccagtggtcgcctgccctgaccatctcaaaggtactactgtccatctgtagtctgctgtgcgacccaaatccagatgatcctctggtgcctgagatcgcccgaatttacaaaacagacagagacaagtataacaggatctcgcgggagtggacacagaaatacgcaatgtag

SEQ ID NO: 31772 - DNA, 444 bp, Artificial Sequence
  Description of Artificial Sequence: Synthetic coding sequence
atggcactcaagaggatcaacaaggaactctcagaccttgcgcgcgaccctccagcacagtgctccgccgggcccgttggggatgacatgtttcactggcaggctacaatcatggggcccaatgattccccataccagggaggagtgtttttcttaacaatccacttccctacagactatcccttcaaaccccctaaagttgcttttaccacccggatctaccaccccaatatcaacagcaatggtagcatctgcctggatatcctccgaagccagtggtccccagcactcacaatcagtaaagtcttgctctcaatctgcagcttactgtgtgacccaaaccccgacgatccgctggttcccgagatcgccaggatctataaaaccgacagagacaagtacaatagaatctccagagaatggactcagaaatacgccatgtag

SEQ ID NO: 31773 - DNA, 444 bp, Artificial Sequence
  Description of Artificial Sequence: Synthetic coding sequence
atggcactcaagcggatcaataaggagctgtcggacctggcccgcgaccccccggcacagtgcagcgccgggccggtgggagacgacatgtttcactggcaggctacaatcatggggcctaatgattctccataccagggcggcgtgtttttcctgacaatccatttcccaaccgattacccattcaagcccccgaaagtggcatttacaactcgcatctaccatcctaacataaactccaacggcagcatctgcctcgatatcctgcggtctcaatggtcaccagccctgacaatctctaaggtattactaagtatttgctcactgctctgtgaccccaatcctgacgatccacttgtccccgaaattgctcggatctacaagactgatcgcgacaagtacaatcgaatttcacgagaatggacgcagaagtacgctatgtag

SEQ ID NO: 31774 - DNA, 237 bp, Artificial Sequence
  Description of Artificial Sequence: Synthetic coding sequence
atggccttgaaacgcatcaacaaggaactatccgacttggcgagggacccccccgcgcagtgttcagcgggcccagtgggggacgacatgtttcattggcaggccacaattatgggccctaacgatagcccctaccaggggggagtcttttttctgactatccattttcccactgactatccgttcaagcctcctaaagtggcattcactacaagaatttatcatcccaatatttag

SEQ ID NO: 31775 - DNA, 291 bp, Artificial Sequence
  Description of Artificial Sequence: Synthetic coding sequence
atggcactgaagcggatcaacaaggagctgagcgaccttgcccgcgacccccctgcccaatgttctgctggccctgtgggggacgatatgtttcattggcaagccacaatcatgggcccgaacgactctccataccaagggggcgtgtttttcctgacaattcactttcccactgattatccgtttaaaccccccaaggtcgcctttactacccggatctatcaccccaatattaattctaatggttcaatctgcttagacatactgcgatcccagtggtctcccgcatag

SEQ ID NO: 31776 - DNA, 150 bp, Artificial Sequence
  Description of Artificial Sequence: Synthetic coding sequence
atggctctgaaaagaatcaacaaggagctgagtgacctggcacgggatccgcctgcccagtgcagcgctggcccggtgggcgacgacatgttccactggcaagcaactattatgggcccgaacgactccccctatcagggtggagtttag

SEQ ID NO: 31777 - DNA, 1527 bp, Artificial Sequence
  Description of Artificial Sequence: Synthetic coding sequence
atgctgtggtttcagggtgcaattcccgcagcaattgccaccgctaaacgatccggcgccgtctttgtggtttttgtggctggagacgatgagcaatctacacagatggccgcaagctgggaggatgataaagtgacagaagcatcttccaacagtttcgtcgcgattaagatcgatacaaagtctgaggcctgccttcagttttctcagatatatccggtggtgtgcgtgccctctagcttctttataggggatagcggtatccctcttgaggtgatcgccggcagcgtgtcagccgacgagttggtgacccgaatccataaggtgcggcaaatgcacctcttgaagagtgaaactagcgtcgccaacgggtcgcagagtgaatcctccgtatccacaccttctgcgagttttgagccaaataacacatgcgagaatagccagtctagaaacgcagagctttgtgagattcctccaactagcgatacaaaaagtgacacagctactggcggtgagagtgctggacacgctacaagtagccaggaaccctctgggtgcagcgatcagaggcccgccgaggacctgaacatccgcgtagaaagactgacaaagaagttggaagagaggagagaggagaagcgcaaggaagaggaacagagggagatcaagaaggaaatcgagaggaggaagacaggcaaggagatgttagattataagcgcaaacaggaggaagagttgactaaaaggatgttagaagagcgcaatcgagagaaggccgaagatcgggcagcaagagagcgaatcaagcaacaaatcgctctggatagagcagaacgcgcagcacgattcgccaagaccaaggaggaggttgaggctgccaaggccgcggctctcctggccaagcaggcagagatggaggtgaaacgagagtcctatgccagggagcgctccacagttgcccggattcaatttaggctgcccgatggttcaagcttcacaaaccagttcccttcagacgctccgctggaggaggcgcggcagtttgcagcccagactgttggaaacacgtacggtaacttctccctggccacaatgttcccacgtcgcgagttcacaaaggaagattacaagaaaaagctcctggaccttgaattggcccctagtgcgtctgtggttttactgccggcaggccgtcccactgcctcaatcgtgcacagctcatccggtgacatctggaccctcctcggaactgtattatatccatttctggccatatggagactgatcagcaatttccttttttctaaccctccccctacacagacgtccgtgagggtcacttcatccgaacctccaaaccctgctagctcctccaaaagcgagaaacgggaaccagtgcggaaacgcgtactggaaaagcgtggagatgacttcaagaaagaggggaagatataccggctgcggactcaggatgacggagaagatgaaaataacacgtggaacggaaattctacgcagcagatgtag

SEQ ID NO: 31778 - DNA, 1473 bp, Artificial Sequence
  Description of Artificial Sequence: Synthetic coding sequence
atgctttggttccaaggggcgatcccagcggcaatcgctactgccaagcggagcggagctgtgtttgtcgtttttgtagcgggcgacgatgagcagtccactcaaatggctgcgtcttgggaggacgacaaagtgaccgaagcaagctcaaactccttcgtggcaatcaaaatcgataccaaaagcgaggcatgcctgcaattctctcagatctatcctgtcgtgtgtgtgccaagttccttcttcatcggagacagtggtatccctcttgaggtcatcgccggatcggtaagtgccgatgaacttgtgaccagaatacataaggtccgacagatgcatttgctgaagaccgcctcattcgagcccaataatacttgcgagaactcccagtcacgcaatgccgaactatgtgagatacctccaacctccgacactaaatccgacactgccactgggggggaatctgccgggcacgctacaagtagccaggagccatccggttgcagtgaccagagacccgcagaggatctcaacatccgcgtggagagattaacaaaaaaactggaagagaggcgggaggagaagcgcaaagaggaagaacagagagaaattaagaaggaaatcgagagaagaaagacgggcaaagagatgctagactataagcggaaacaggaagaggaattgacaaagaggatgttggaggaacgaaatcgtgagaaagctgaagatcgagcagccagagagagaattaagcaacagattgctctcgaccgagccgagcgggctgcccgctttgctaaaaccaaggaagaagttgaggcggctaaagctgccgccttacttgccaaacaggccgaaatggaggtgaagcgcgagtcctatgctcgagaaagatccaccgtcgccagaatccaatttagactgcctgatggaagttcattcactaatcagttcccctccgacgcaccactcgaagaagcacgtcaattcgcagctcagactgttggcaatacctatggaaacttctctctcgccaccatgttcccccgtcgggagtttactaaggaagattacaaaaagaagctcctcgacctcgagctggccccatccgctagtgtggtactgctccctgctggacgacccactgcgtctattgtgcacagctcttcgggggatatctggacactgctgggcacagtgttatatcccttcctcgcgatctggcggctcatcagcaatttcctgtttagtaacccccctccaactcaaacctctgtgagagtaacgtcatctgaacctccaaaccctgcctctagcagcaaaagcgagaagcgtgaaccagtacgcaagcgggtgctggaaaagcggggggacgactttaaaaaagaagggaagatctaccggctgagaacgcaggatgatggagaggacgagaacaatacttggaacggaaattcgactcaacagatgtag

SEQ ID NO: 31779 - DNA, 1470 bp, Artificial Sequence
  Description of Artificial Sequence: Synthetic coding sequence
atggctgctcacggaggctcggctgcttcctccgctcttaaaggcctgatccagcagttcaccaccatcactggagctagcgagtcagtgggcaaacatatgctggaggcttgtaataacaatctggagatggccgtgacgatgtttctagatggaggtggaattgccgaggagccttccactagcagtgccagcgttagcaccgtcaggcctcatactgaggaggaggtgcgagcccccatacctcagaaacaagagattctggtagagcccgaacccctgtttggagcgcccaaaaggcggcggcctgccagatcgatttttgatggctttagagacttccagacagaaactatcaggcaggaacaggaactcagaaacggcggagccatcgataagaagctgacaacactggccgatttgttccggccacccatagaccttatgcacaagggcagttttgaaaccgccaaagagtgcggtcagatgcagaacaagtggctgatgatcaatatacagaacgtacaggacttcgcttgccagtgcctgaatagggacgtttggagtaacgaggctgtgaaaaacattatcagagaacatttcatcttctggcaggtctaccacgatagcgaagagggccagcgctatatccaattttacaaattgggggacttcccctacgtgagcatcctagaccccaggaccggtcaaaagctcgtcgagtggcaccagctggatgtcagttctttcctggaccaggtgaccggctttctgggagaacacggccagctcgacggcctctcttcctctcctcccaaaaaatgcgcccggtcagaatctctaatcgacgcctcagaagattcccagctggaagccgctattcgagcttccctgcaggaaactcatttcgatagtacacagactaaacaagattctcgctccgatgaggagtcggagagcgagctattttcaggttccgaggaattcatcagtgtgtgcgggagcgatgaggaagaagaggtggaaaacctggccaaaagcagaaagtccccacacaaggatttgggccatcgtaaggaggagaacaggcggcctttgactgagcctccagtgagaactgaccctgggactgcaactaaccaccagggattacccgccgtagatagcgagattctcgagatgccacctgaaaaggctgatggtgtagtggagggcattgacgtgaatggcccgaaagcccagctgatgttgcgttatccagacggcaagcgggaacagattacccttcctgagcaggctaagctgctcgccctggttaagcacgtacagtccaaaggctacccaaacgaaaggtttgaactcctgacgaatttcccccgcagaaagctctctcatcttgactatgatataacattacaggaggccggcctgtgcccccaagaaaccgtcttcgttcaggaaagaaactag

SEQ ID NO: 31780 - DNA, 1026 bp, Artificial Sequence
  Description of Artificial Sequence: Synthetic coding sequence
atgcacaaggggtccttcgaaacagcaaaggagtgcggacagatgcagaataagtggcttatgatcaacattcaaaatgtgcaggatttcgcctgtcagtgcctcaaccgtgatgtgtggtccaatgaggccgtgaagaacataattagggagcatttcatcttctggcaagtttatcacgacagcgaggagggacagagatatattcagttctataagcttggggatttcccctacgtctccatcctggacccacggaccgggcagaaattagtggagtggcaccagcttgatgtgagtagtttcctcgatcaggtgacgggcttcttgggcgagcacggtcagcttgatggcctctcttcttcccccccgaagaaatgtgcgcgttccgagtctcttattgacgcttctgaagactctcagctggaagcagctattcgggcctcactgcaggagacccacttcgactctactcaaacgaagcaggactccaggagcgatgaggaatcggaaagcgagctcttttcaggctccgaggaattcatcagcgtgtgcggttcagacgaggaagaggaagtggaaaatctcgccaaatctcggaaatcccctcacaaggatctgggacaccgcaaagaggagaacaggaggcctttgacggaacccccagtgagaactgaccccgggaccgcgacaaatcaccagggcctacctgccgtcgacagcgagatcctcgagatgcctcccgaaaaagccgacggagtggttgaagggatagacgtgaacggcccaaaggcacaactaatgttacgttacccagacggcaagcgcgaacagattaccctgccagagcaggccaagttactggcactggttaagcacgtacagtcaaaaggctaccctaatgaaagattcgaattgctaaccaactttccacgcagaaaattgagtcacttggattatgacatcaccctgcaggaggcagggctgtgcccccaggagactgtcttcgtgcaagaaaggaactag

SEQ ID NO: 31781 - DNA, 1584 bp, Artificial Sequence
  Description of Artificial Sequence: Synthetic coding sequence
atgcggtctgacaaatcagccctggtattcctgctactacagcttttttgtgtgggatgcggattctgcggaaaagtgctggtctggccctgtgatatgagccactggctgaacgttaaggtaattctcgaagagctgatcgtgaggggtcatgaagtcacggttctgacccattccaagccatcccttatcgactaccggaaacccagcgctctcaaattcgaggtggttcacatgccccaggatcggaccgaggagaacgaaattttcgtggatcttgcccttaacgtgctgcccggcctttctacatggcagtccgtgattaaactgaacgatttcttcgtggagatccggggcacgctgaagatgatgtgcgagtcattcatttataatcagactctgatgaagaagctgcaggagaccaactatgatgtcatgctgatcgacccggtgataccttgtggggacctcatggcagaactgcttgctgtcccctttgtgctgaccctgcgtatttccgttggaggcaatatggagcgctcatgtggcaagttacctgcgccactctcttacgtcccggtcccgatgaccggtctgacagatcgaatgacatttctggagagagtgaagaacagcatgcttagcgtgctgtttcatttttggatccaggattatgactaccacttttgggaggaattctactccaaagccctggggagaccaaccaccctttgcgaaaccgttgggaaggctgagatatggctcatcagaacctactgggacttcgagttcccccagccataccagccaaactttgaatttgtcggcggcctgcactgcaagcccgccaaagctctcccgaaggagatggagaatttcgtacaaagttctggtgaggacggcattgttgtgttttctctgggctctttgttccagaatgtaacagaagagaaggcaaacatcatagcaagtgcattggcacagatccctcagaaggtcctctggcggtacaaaggtaagaaaccatcaaccctgggcgctaacaccaggctgtacgactggattcctcaaaatgacttgctggggcaccctaagacaaaagctttcatcactcacgggggtatgaacgggatctatgaggcaatctaccatggggtacctatggtgggagtgcccatcttcggagatcagctcgataacatcgctcacatgaaagctaaaggcgctgctgtggagatcaactttaagaccatgacctcagaagacctcctacgggctttgcggaccgtgatcaccgatagttcttacaaggaaaacgctatgcgcctgagcaggatccaccacgatcagcccgtcaaaccactggatcgagcagtattttggatcgagtttgtgatgcgccataagggagctaagcatctccgctccgcggcacacgacttgacttggttccaacactactctatcgacgttataggcttcctacttgcctgcgtggctactgccatcttcctgttcacgaaatgtttcttattctcatgccagaaattcaataaaaccaggaagatagagaaacgggagtag

SEQ ID NO: 31782 - DNA, 717 bp, Artificial Sequence
  Description of Artificial Sequence: Synthetic coding sequence
atggaaaatttcgttcagtcctctggcgaggacggaattgtggtgttttcccttggtagcctctttcagaacgtgaccgaggaaaaagctaacatcattgcatcagctctcgctcagattccccagaaagtgttatggcggtacaagggcaagaaaccgagtacgttgggcgccaacactcggctgtacgactggattcctcagaacgatctgctgggacatcccaagactaaagcattcatcactcacggcgggatgaacggcatctatgaggctatataccatggagttccaatggtaggtgttcctatatttggggaccagctcgataatattgcccatatgaaagcaaagggtgcagccgtagagatcaacttcaaaacgatgacaagcgaagaccttttacgggccttacgtaccgtcattacagactcctcctataaggagaatgcaatgcgcctaagtcgaatccatcacgaccaacctgtcaagcctctcgatagggccgtgttctggattgaattcgtgatgcgtcataagggggcgaagcatttgcgctccgccgctcacgacctgacttggtttcaacattactcaatcgatgtaataggctttctgctcgcctgtgttgcaacagcaatctttttattcacaaagtgtttccttttttcttgtcagaaatttaacaagacaagaaaaattgaaaaaagggagtag

SEQ ID NO: 31783 - DNA, 1587 bp, Artificial Sequence
  Description of Artificial Sequence: Synthetic coding sequence
atggcccttaaatggactacagtactcctgattcagttgtcattctatttttcctccggttcttgcggcaaagtcctggtatgggcagccgagtatagcttgtggatgaatatgaagactatccttaaggagctggtgcagcgcggtcatgaagtaaccgtgctcgctagttctgcctccattttgttcgatcctaacgactcctctactctgaagttggaggtgtatcccacctctttgaccaaaaccgagttcgaaaatatcattatgcaactggtgaagcgtttgtctgaaatccagaaggatactttctggcttccattcagtcaggaacaagaaattctgtgggccatcaatgatattatacgcaacttctgcaaagatgtcgtgagcaacaagaaactgatgaagaaactccaggagtcgcgatttgatatcgtattcgcagacgcatacttgccttgcggcgagctactggctgaactgttcaacattcccttcgtatattctcatagtttcagcccgggctactcatttgaaaggcatagcggtggatttattttcccaccgtcatacgtgcctgtggtgatgagcaagttgagtgatcagatgacttttatggagcgcgtgaagaatatgctgtatgtgctgtattttgacttctggttccagattttcaacatgaaaaaatgggaccagttctatagtgaggtgcttggtcggccaaccacactcagcgaaaccatgaggaaggcagacatttggctcatgaggaactcctggaacttcaaattcccacacccctttctgcctaacgtggacttcgtgggtggtctccactgtaagcctgcaaaacccctcccaaaggaaatggaggagtttgtacagtccagtggcgagaatggcgtcgtggtgttcagtttgggatcaatggtgagcaacatgactgaggaaagggcgaatgtcatcgccaccgcactggcaaaaattcctcagaaggtgctgtggcgattcgacggcaacaaaccggatgccctgggcctcaacacaagattgtacaaatggatacctcaaaacgatctgcttgggcatccaaaaacacgggcgtttatcacgcacgggggcgcaaacggaatttacgaagctatttaccatggcatcccaatggtgggaatcccgttatttttcgatcagccagataatattgcacacatgaaggccaaaggggccgctgtgagggtggatttcaatacaatgtcctcaacagacctgctaaacgccctgaaaactgtcatcaatgatccaagctacaaggagaatattatgaagctatcgcggatccagcacgatcagccagtcaagccacttgaccgggccgtgttctggatcgaattcgtgatgcgacacaagggagctaaacacctgcgggtcgctgcacataatctgacttggttccagtatcattctttggacgttattgggttcctgctggcttgtgtggctacagttttattcattatcaccaagtgctgccttttttgcttctggaaatttgctcggaaggggaagaaaggaaagcgcgactag

SEQ ID NO: 31784 - DNA, 1572 bp, Artificial Sequence
  Description of Artificial Sequence: Synthetic coding sequence
atggtggggcaaagagtgctgcttttagttgccttcctgctgagcggggtgttgcttagcgaggctgcaaaaatcctcacaatatcaaccttgggcggatcacattacctgctgctggaccgcgtctcacagattctccaggaacatggccataacgttactatgctgcaccagtccggcaaatttctgatacctgacattaaggaagaggagaaatcctaccaggtgatcaggtggttttcgccggaagaccatcagaaacgaattaaaaagcactttgattcctacatcgagacagctttagatgggagaaaggagagtgaagctcttgtgaagctgatggaaatctttggaactcaatgttcttacctgttgtcgcgcaaagatatcatggacagcttgaagaatgagaactacgacctggtatttgtcgaggctttcgacttctgcagcttcctcattgccgaaaagctcgttaaaccctttgtggctatcctgcccacaaccttcggatcactggactttgggctgccgagtccattatcctatgtgcccgttttcccctctctgcttacagaccatatggacttctggggaagggtaaaaaatttcctgatgtttttctctttttccaggagtcagtgggacatgcagtccacttttgacaatacaatcaaagagcactttccggagggctccagaccagtgctgtcacatctgttgctcaaggctgagttgtggttcgttaactcagatttcgcgttcgacttcgccaggcctctcctcccgaatacggtctacattgggggtcttatggagaagcctatcaagcctgtgccacaggatctggataacttcatcgccaatttcggagacgcaggattcgtgctcgtggccttcgggtccatgctgaatacgcaccagagtcaggaagtactgaagaaaatgcataatgcctttgctcacctcccccagggagtcatatggacttgtcagtctagccattggccgagggacgtccacctggcaaccaacgtcaagatcgtggattggctgcctcagtctgacctgctcgcgcatccaagcatccgtttattcgtgacccacggcgggcagaacagcgtgatggaagctattaggcacggcgttcccatggtaggattgccggtcaatggtgatcagcacggcaacatggtacgagttgtggcgaaaaactacggcgtgagcattcggctgaatcaggtaactgcagacaccctgacgctgactatgaagcaagtgatcgaagataaaaggtataaatccgcggttgtggccgcttccgttattctgcacagtcagccactgtcccccgctcaacgcctggtcggatggatagaccacattctccaaactggaggcgccacccacctcaaaccctatgcttttcagcaaccgtggcacgagcagtacctgatcgacgtttttgtctttttactcggtctaaccctggggacaatgtggttgtgcggcaaactacttggggtggtagccaggtggctccggggcgctagaaaggtgaagaagacttag

SEQ ID NO: 31785 - DNA, 759 bp, Artificial Sequence
  Description of Artificial Sequence: Synthetic coding sequence
atgttacaccagtctggcaagtttctcattccagatatcaaggaggaagagaagtcgtaccaggttattaggtggttctcgcccgaagaccaccagaagcggatcaagaagcactttgacagctacattgagactgccctggacggaaggaaggagtccgaggctctggtgaaactgatggagatcttcggaacgcaatgttcctacctgctgtcccgtaaagatattatggactccctcaagaatgagaactatgatttagtgtttgtagaggcctttgacttctgttccttcctcattgcagaaaaactcgtgaagccattcgtggccatactgcccactacctttggtagtttggatttcggactgccttcaccactgtcttacgtccccgtgttcccatctctgcttacagatcatatggacttctgggggagagtgaagaactttctgatgtttttctcttttagcagatcccaatgggacatgcagtccacctttgacaatacaattaaagaacattttcccgaaggtagccgcccagtgctatctcatctactgcttaaggccgagctctggtttgtaaattccgatttcgcgttcgattttgctagacctctactgcccaacacagtgtacatcgggggtctgatggagaaaccaattaagcccgtcccacagaacggccagcccgctttatttaccaccccatccctgttttcttcaggtgtctatcctgagccacttaggtggttgtag

SEQ ID NO: 31786 - DNA, 1626 bp, Artificial Sequence
  Description of Artificial Sequence: Synthetic coding sequence
atgaaaagctatacaccttattttattttgctatggtccgcagtcggcatcgcgaaagccgctaagattatcattgtaccccctatcatgtttgaaagtcacatgtatatatttaaaaccctagcaagcgccctgcatgaacgggggcaccacacagtattcctgctctctgaaggccgggatatcgccccttccaaccattacagtttgcagcggtatcctggcatcttcaatagtacaacttctgacgcttttctgcagagcaaaatgcgcaatatcttcagcggccggcttactgccatcgaactctttgacattctcgaccactacactaaaaactgcgatttaatggtgggcaaccatgcactgatccaaggtctgaagaaggagaaatttgacctgctccttgtagatcccaacgacatgtgcgggttcgtgattgcccaccttcttggcgtgaagtacgctgtgttttccacaggcctctggtatcccgccgaggtgggggcccctgcgcctttagcctacgtaccagaatttaacagtctgttgactgacaggatgaacctgttgcagcggatgaagaataccggcgtgtatcttatctcccggcttggagtctcgtttctagttcttcctaaatacgaacggatcatgcagaagtataatctgcttcctgagaaatcaatgtacgacctcgttcacggatcctcactctggatgctgtgtacggacgtcgctcttgagttcccccggcctacacttcctaacgtcgtctatgtcggcggaatcctgacgaagccagcatctcctctgcccgaagacctgcaacgatgggtgaacggcgctaacgagcatgggttcgtcctagtttcattcggcgctggtgtgaaatacctttcggaagatattgctaacaaattggccggcgcgctcggacgcttgccccagaaagtgatatggcgcttttcaggcccaaagcctaaaaacctggggaacaacactaagctgatcgagtggctccctcagaacgatctgcttgggcactcaaagatcaaagctttcctcagccacggaggtctgaactctatttttgagactatctatcacggagtgccagtggttgggatcccccttttcggtgaccattacgacacaatgacacgggtgcaggctaagggtatgggtatattgctggaatggaagaccgttactgaaaaagagttgtatgaagctctggtcaaggtgatcaacaacccaagctatcgacaacgcgcgcaaaagttgtcagagatccataaggatcagcccgggcaccccgtgaacaggaccatatactggattgactatatcatcaggcacaacggcgcacaccacttaagagcagcagtccaccaaattagcttctgtcaatatttcctccttgacattgcctttgtcttgttgctaggcgctgcattgttatatttcttactctcgtgggtaaccaagttcatttaccggaaaattaaatccttgtggagtcgtaacaaacattccacagtaaatggccactaccacaatggtatcctgaacggcaaatacaagcgtaatgggcacataaagcatgaaaaaaaggtgaaatag

SEQ ID NO: 31787 - DNA, 1626 bp, Artificial Sequence
  Description of Artificial Sequence: Synthetic coding sequence
atgaaatcgtacacgccttatttcatcttgttatggtccgctgtaggtattgcaaaagccgcgaaaataatcattgtgccaccgatcatgtttgaaagccatatgtatattttcaaaacccttgcgtctgccctgcatgaaaggggtcaccatactgtatttctgctaagcgaaggacgggacatcgctccatcgaatcattactcactccagagatacccaggaatcttcaactcgacaaccagtgacgcgttcctgcagtcgaagatgagaaacatcttctcagggcggcttacggccatcgaacttttcgatattctcgaccactacactaaaaactgtgatttaatggtggggaatcacgccctgattcaagggctgaagaaggagaaattcgacctgctactggtagatcctaacgacatgtgcggattcgtcatagcacacctcctaggcgttaaatatgctgtgttcagtactggactgtggtaccccgccgaagtaggtgcccccgctcctctggcatacgttcctgagttcaatagcctgctaaccgatcggatgaacctgctccaacgcatgaaaaacacgggggtctacctcatttctagactcggcgtgagctttctcgttttgcccaaatatgaaagaattatgcagaagtacaacttgctgccagaaaagagcatgtacgacttggtgcatggaagcagcttgtggatgctctgtactgatgtggctcttgagtttcctagacccaccctgccgaatgttgtctacgttggagggattcttaccaagcccgcgagtcctcttcctgaagatctgcagaggtgggtcaacggcgctaatgagcacgggttcgtattggtgtctttcggcgctggagtcaagtatctcagcgaagacatcgccaacaaacttgcaggcgcactcggaaggctaccccagaaggtgatctggcggttctctgggcccaagcccaagaatctaggcaacaacacaaaactgattgagtggcttccccagaacgacctgctgggtcacagcaagatcaaagcttttctctctcacggggggctgaatagcatttttgaaactatttatcatggcgttcccgtggttggcattcccctctttggtgaccactacgacaccatgacaagggttcaggctaagggcatgggcatcctcctggaatggaagacggtcacggaaaaggagctgtatgaggcactggtgaaagtgataaataacccctcataccgtcaaagggcccagaagctaagtgaaatccataaagatcaacccggccatcccgtgaacagaacgatctattggattgactatatcatcagacacaacggagcgcaccatctgagagccgcggttcaccagataagtttttgccagtactttctcttagacatcgcatttgtccttctgctgggtgccgctttactctactttcttttgagctgggtgacaaagtttatttacaggaaaatcaaatcactgtggagccgtaacaagcactcgacagtaaatggccattatcacaacggaattctcaatgggaaatataaacgcaacggccacatcaaacatgagaaaaaagtgaagtag

SEQ ID NO: 31788 - DNA, 426 bp, Artificial Sequence
  Description of Artificial Sequence: Synthetic coding sequence
atgaagtcatacaccccctactttatattgctttggtcagctgtaggcatcgccaaagcagcaaagataatcatcgtcccacccatcatgtttgaatcacatatgtacatttttaaaacgctcgcctctgctctgcacgagcgaggacaccataccgtgttcctgctgagtgaaggccgagatatcgcacccagcaaccactacagcctacaacgctaccctggcatctttaactccaccacctccgacgcctttttacagagcaagatgagaaacatcttcagcggtcgattgactgcgattgaactgttcgatatactggaccattacacgaagaactgcgaccttatggtgggcaatcacgcactgatccagggtctgaaaaaggagaaattcgatctgttgctcgtggatcctaacgactag

SEQ ID NO: 31789 - DNA, 990 bp, Artificial Sequence
  Description of Artificial Sequence: Synthetic coding sequence
atgaagctgctccggagagcctggagaaggcgggcggccttaggcttggggacactggcattatgcggcgcggccctgctgtacctcgctcgatgtgccgctgagcccggggaccctcgggcaatgtcgggccgttcacctccgcctcctgcccccgctagggcagcagcttttctcgccgtgctggtcgcgagcgcaccccgggcggccgaacggcgaagcgtaattcgttctacatggctggctcggagaggggccccaggcgatgtgtgggctaggttcgcagtgggcacagctggcctgggagctgaagagagacgggcgctggaacgggagcaggctcggcacggggacctgctgttactgccagctctgcgggatgcttatgaaaatctgaccgccaaggtgctcgccatgctggcatggcttgacgagcatgtggcgttcgaattcgtgctcaaagctgacgacgattccttcgccaggttggacgccctgctggcggagttgagggcaagagaaccagcccgacgccgtagactatactggggtttcttctccggtcgcggccgagttaaaccaggggggcgatggcgggaggctgcctggcaactttgcgattactacctaccatatgctctggggggtgggtatgttcttagcgccgatctggtgcactatctccggctaagccgcgactatcttcgggcgtggcatagcgaggatgtatccttaggagcttggctggcaccggtggatgtgcaacgagagcatgaccctcgcttcgacacagagtacagatcacgagggtgctctaaccagtatctggtgactcacaaacagagtctagaggacatgttggagaaacacgccacgctggcacgggaggggcgtttgtgcaagagggaggtccagttaagactgtcctatgtgtacgattggtctgctccgccttctcagtgctgtcagcgaagggagggtattccatag

SEQ ID NO: 31790 - DNA, 981 bp, Artificial Sequence
  Description of Artificial Sequence: Synthetic coding sequence
atggcctctaaggtttcatgcctgtatgtcctgaccgttgtctgttgggcctctgcactatggtacctaagcatcacacgccccacgtctagttatacgggaagcaaaccgttttctcacctcactgtggcaagaaagaattttactttcggcaacatccgcactaggccaattaatccccactcttttgaattcctgattaatgaacctaacaaatgcgaaaagaatataccattcttagtaatattaatctccaccactcacaaagagttcgatgcgagacaagccattcgagagacctggggcgatgagaacaatttcaagggtatcaaaattgctaccctatttctgcttgggaagaatgctgatccagttctcaatcaaatggtggaacaggaaagccagatttttcatgacattattgtcgaagatttcatcgactcctatcacaatctcaccctcaagaccctgatgggaatgcgatgggtagctactttttgttcaaaggccaaatatgtgatgaagactgatagtgacatttttgtgaacatggataacctaatttacaagctactcaaaccttctactaaaccgcggcggaggtacttcaccggctacgtgatcaatgggggtccaatccgagacgtacggtctaaatggtatatgcctcgagatctgtaccctgacagtaactacccccctttttgttccggcaccggatacattttttcagctgatgtggccgaactgatctacaaaacatccctgcacactcgcttgttgcacctggaagacgtttatgtcggcctgtgtttacgtaaactgggtattcacccctttcagaatagcggatttaatcattggaaaatggcctattccctttgccgttacaggagggtcatcaccgtgcatcagatttctccggaagaaatgcacagaatttggaacgatatgtctagtaaaaaacacctccgttgctag

SEQ ID NO: 31791 - DNA, 981 bp, Artificial Sequence
  Description of Artificial Sequence: Synthetic coding sequence
atggctagcaaggttagctgtctgtacgtactcactgtagtctgttgggcctctgcactctggtatctatcaatcactaggcctacatcttcatacaccgggtccaaacctttctcacatctgacggtggccagaaaaaatttcacatttggcaatataagaacccggcccatcaatcctcactcctttgaatttctaattaatgaaccaaacaagtgcgagaagaacataccgttccttgtcatcctgatttctacaacacacaaggagtttgacgcgcgtcaggcaattagggaaacttggggtgatgagaacaactttaaaggcattaagatcgcgaccctttttctacttggcaaaaatgctgacccagtcctgaatcaaatggtcgaacaggaatctcagatattccacgatataattgtagaagacttcattgactcgtaccacaacttaactttgaagacactcatggggatgcggtgggtggctactttctgcagtaaggcaaagtacgtgatgaaaacagactccgatatctttgtcaacatggataacctcatctataaactgcttaaacccagcacgaagccacggcggcgttacttcaccggatacgtgatcaatggaggcccgattagagacgtgcgctccaagtggtatatgcctcgcgatctgtatccagatagtaactatcctcccttctgcagtggaacgggttacatattctcggcggacgtcgccgaattgatatataagacttcgctgcatacacgtctcctacacctggaggacgtgtatgtgggcctgtgcctgagaaagcttggcattcacccctttcagaactcaggctttaaccactggaaaatggcttatagcctatgccgctacaggagggtgattactgtccatcagatcagtcctgaggaaatgcatcgcatctggaatgatatgtctagcaagaagcatctccggtgctag

SEQ ID NO: 31792 - DNA, 1248 bp, Artificial Sequence
  Description of Artificial Sequence: Synthetic coding sequence
atgcaaatgtcttatgctattcggtgcgccttctaccagctactgctggctgcccttatgcttgtcgctatgctgcagctgctctacctgtctctactctctggattgcacggacaagaggaacaggaccagtatttcgaattttttccccctagcccgagaagcgttgatcaggtcaaagcccaactcagaaccgctttagctagcgggggcgtgctcgatgcatccggtgattatagagtttataggggcttgttgaaaactacgatggacccaaacgacgtgattctcgccacgcatgcgtctgtggataatctgttgcacctttccggtctgctggaaaggtgggaagggcctctatctgtttccgtcttcgccgccaccaaggaggaggcacaattggcgactgttctggcttatgcattgagtagccactgccctgatatgagggcccgagtggcgatgcatctggtgtgcccctctcgttacgaggccgcagtgcccgacccccgagaaccaggagaattcgctctgctgcgctcctgtcaggaagtgttcgataaactggctcgagtggcccagcctggcatcaactatgctctcgggacgaatgttagttatccgaataacctgctccgaaacctggcacgggaaggggcaaattacgctttggtcattgatgtggatatggtgccctcagaaggcctttggagagggctgcgagagatgctcgatcagtcaaaccagtggggagggactgcactggtggttccggcgtttgaaatcaggagggccagacgaatgccgatgaataagaacgagctcgtgcagctgtatcaagtcggagaggtccgccccttttactatggcctgtgcaccccttgtcaagccccaaccaattattccaggtgggttaatttgcctgaagagtccttgctacgacctgcgtacgttgttccttggcaggatccttgggagccattctacgtcgccggcggcaaggtaccaacttttgacgaacggttcaggcagtatggttttaatcgcatcagtcaggcctgcgaactgcatgttgctggttttgacttcgaagtactcaatgagggctttctcgtgcacaagggcttcaaagaggcactgaaatttcaccctcagaaagaggcagagaatcagcataataagatcctgtaccggcagttcaagcaagagctaaaggccaaataccccaactctcctcgcagatgctag

SEQ ID NO: 31793 - DNA, 561 bp, Artificial Sequence
  Description of Artificial Sequence: Synthetic coding sequence
atggtgccatcagaagggttgtggcgcggactcagagagatgctggatcagtcaaaccaatggggcggtaccgctttagttgtccccgccttcgaaatcagaagagcacgccggatgccgatgaataagaatgagctggttcagctctatcaggtgggtgaggtgagacccttttactatgggctgtgcacaccctgccaagccccaacaaattacagccgatgggtcaacctgccagaggaaagcttgttaagacccgcatatgtggtaccttggcaagacccctgggagccattctacgttgctggaggaaaggtccctacctttgacgaaagattccgccagtatgggtttaacaggatctctcaggcttgtgaactgcatgttgcgggctttgattttgaggtcttaaacgagggcttcctcgtgcacaagggatttaaagaagcactgaagtttcatcctcagaaggaggctgagaaccaacacaataaaattctgtaccgccagttcaaacaagaacttaaggctaaatatcccaacagccccagaagatgctag

SEQ ID NO: 31794 - DNA, 1194 bp, Artificial Sequence
  Description of Artificial Sequence: Synthetic coding sequence
atgtctgtgggtcggcgacgaataaaactgcttggaatccttatgatggcgaacgtgtttatttactttataatggaagtgtctaaatcgagctcccaggaaaaaaacgggaagggggaagtcattataccaaaagaaaagttttggaaaatttcaacgccccccgaggcctattggaatagagaacaagagaagctgaatcgccagtacaatccaatcctgagcatgctgactaaccagactggggaagcaggtcgcctttcaaatatttcccacttgaattactgcgaacccgacctgagggtgacctctgtggtgaccgggttcaataatcttccggatcgttttaaggattttctcctttacctccgatgtcgcaattactccctactgattgatcagcccgacaaatgtgccaagaaaccgtttctgctgctggccatcaaaagccttaccccgcattttgctcgccgacaggcaatccgtgagtcttggggccaggagagcaacgcaggaaaccagactgtcgtgagagtgtttctactgggacagacccctccagaagataaccatcccgacctgtcagatatgttgaagttcgaaagtgagaagcatcaagatattctgatgtggaattatcgcgatactttcttcaaccttagcctgaaggaggtgctgtttcttagatgggtgagcaccagttgccccgataccgaattcgtgttcaaaggtgacgacgacgtgttcgttaatactcatcatatactgaactatcttaactctctatctaagactaaggctaaggatttgtttattggcgacgtgatccacaacgcaggacctcatagagataagaagttgaagtactacatccctgaagttgtgtattcaggcctctaccccccatacgccggcggcggcggctttctgtatagcggtcacctggcccttcgcctgtaccatattaccgatcaggtgcacctgtaccctatcgacgacgtttatactgggatgtgtctgcagaaactgggactggtgccggagaagcacaagggcttccggaccttcgacatcgaggaaaaaaacaagaacaacatctgcagctatgtagatctgatgctcgtccacagccggaagccccaggagatgatcgatatctggagccaactgcagtctgctcacctcaaatgttag

SEQ ID NO: 31795 - DNA, 1194 bp, Artificial Sequence
  Description of Artificial Sequence: Synthetic coding sequence
atgtccgttggtcggcggcggatcaaactactgggaatcttaatgatggcgaatgtttttatttatttcatcatggaagtttccaagagttctagccaggaaaaaaacggcaaaggagaggtcattatccctaaagagaaattttggaaaatatccacacccccagaggcttactggaatagggagcaagaaaaactgaacagacagtacaaccccatcctatcgatgctcactaatcagacgggcgaggccggacggttgagtaatatctctcatttgaattactgtgaaccagatctgagggtgacatctgtggttactggattcaataacttacctgaccgcttcaaggactttctgctttatcttcgatgcagaaactattcacttctaattgaccagccagataagtgtgccaaaaaaccattcctcttgctcgccattaaaagtctgacgcctcactttgctcgaagacaggcgattcgggagtcgtgggggcaggagtccaacgccgggaatcaaacagtcgtccgggtctttctgctaggacagacccccccggaggacaatcaccctgatctctcggatatgttgaagttcgagagtgagaaacaccaagacatcctgatgtggaactaccgtgatacttttttcaatttatctctgaaggaagtactgtttcttagatgggtgtccaccagctgcccagacacggaatttgttttcaagggagatgacgatgtgttcgtcaacacacatcatatcctgaattatttgaattctctatctaaaaccaaagcaaaagatttgtttatcggagacgtgattcataatgccggcccccaccgcgataagaagctgaaatactatatccctgaggttgtgtacagcggcctttacccaccctacgcgggaggcggtggttttctttattcagggcacctggctctgagattgtatcacatcacagatcaggtgcatttatatcccatagacgacgtgtatacaggaatgtgcttacagaaactggggctggtgccagaaaagcacaagggcttccgcacatttgatattgaggagaaaaacaagaacaacatatgctcctacgttgacctgatgctggttcactctaggaaaccccaggagatgattgacatctggagccaactgcaatccgctcacctgaaatgttag

SEQ ID NO: 31796 - DNA, 1137 bp, Artificial Sequence
  Description of Artificial Sequence: Synthetic coding sequence
atgcgcatgctggtgagtggccggcgcgttaagaaatggcagctaattatccagctgttcgccacctgtttcttagctagtttgatgtttttttgggagcctattgacaatcacatagtttcacacatgaaaagttattcatatcggtacctgatcaattcctatgattttgtgaacgataccctaagcttaaagcatacgagcgctggaccgaggtaccagtacctgattaaccataaagaaaaatgccaggctcaggacgtcctgctcctgctgttcgtaaagaccgctcccgaaaactacgacaggaggagcgggattagacgaacatggggcaatgaaaactacgtgagatcgcagctgaatgccaatatcaagacactgttcgccttagggactcccaaccccttggagggagaagaactccagcggaagctagcgtgggaggaccagcgctataatgacattatacagcaggactttgtggattcattctacaacctcacactgaagctgctcatgcagttcagttgggccaacacttattgtcctcacgccaaatttctcatgactgcagacgacgatatattcatccatatgcccaacttgattgagtacttgcagagccttgaacagataggagtccaggacttttggatcggccgggtccacagaggcgccccaccaattcgggataaaagttcaaaatactatgtaagctacgagatgtatcagtggcccgcctacccggattacacagccggagctgcctacgtcatctcaggggatgtggccgcaaaggtatatgaagcatcgcagactctcaattcctctctgtatatagatgacgtcttcatgggtctgtgcgcaaacaaaatcggtatcgtccctcaggatcatgtgttctttagcggagagggcaaaacgccctaccatccctgcatctatgagaagatgatgacgtcccatggtcatcttgaggatctgcaggacctgtggaaaaacgcgactgaccctaaagtgaaaaccattagcaaggggttctttggtcagatatactgccggcttatgaaaattatcctgctgtgtaaaatttcatatgtcgatacttatccgtgtagagctgccttcatctag

SEQ ID NO: 31797 - DNA, 1137 bp, Artificial Sequence
  Description of Artificial Sequence: Synthetic coding sequence
atgcgcatgctggtatccggtagaagagtgaaaaaatggcaactgatcatccaattgtttgcaacgtgttttctggcttcgctgatgttcttctgggagcctattgataaccacatcgtcagtcacatgaaatcctatagctatcggtatcttatcaatagttacgatttcgtaaacgataccctgtctttaaagcacaccagcgctggcccacgctatcagtaccttataaatcacaaggaaaagtgccaggcacaagatgtgttattgctgcttttcgtcaagacggcaccagagaattacgatcggcgttctggaattagacggacatggggtaatgagaattacgtgaggtctcagttaaatgcaaatatcaaaactctgtttgcgttaggaacccctaatcccctggagggggaggagttgcagagaaagctggcatgggaagaccagcgctacaatgacatcatacagcaggacttcgtggactccttctacaatttaacactgaaactactgatgcaattctcctgggccaatacttattgtcctcacgccaagtttcttatgactgctgacgacgatattttcattcacatgccaaatttgatagaatatctgcagagcctggagcagatcggggtacaggatttttggattggaagggttcataggggcgcccctccaatccgtgacaaatccagtaaatactacgtaagctacgagatgtatcagtggcctgcataccctgactataccgctggggctgcatatgtcatctcgggcgacgtagccgcaaaagtctacgaagctagtcagacactgaattcgtccctttacatcgacgacgtattcatgggcctctgcgccaataaaatcggaatcgtgccacaagaccacgttttcttttccggggagggcaaaaccccataccacccatgtatttacgagaagatgatgacaagccacgggcacctggaggacctgcaggatctgtggaagaacgcgactgatccaaaggtgaaaacaataagtaagggtttctttggtcagatttactgcagactgatgaaaattattcttctgtgtaagattagctacgttgatacctatccatgtagagccgcatttatctag

SEQ ID NO: 31798 - DNA, 189 bp, Artificial Sequence
  Description of Artificial Sequence: Synthetic coding sequence
atgcgaatgttagtgtcaggccggcgggtaaagaagtggcagctgatcatacagctgtttgctacatgttttcttgccagcctgatgtttttctgggaaccgattgataaccacattgtgagtcacatgaagtcatattcctacaggtacttaataaactcctatgacttcgtgaatgacacgttatag

SEQ ID NO: 31799 - DNA, 246 bp, Artificial Sequence
  Description of Artificial Sequence: Synthetic coding sequence
atgcgcatgcttgtgtcagggaggcgagtgaagaaatggcaactgataatacaactctttgccacatgttttctagcctccttaatgttcttctgggagcccatcgacaaccacatcgtctctcacatgaaaagttacagctatcgctacttaatcaattcttacgattttgtgaatgataccttatctctgaagcacacaagcgctggtcctcgttaccaataccttatcaaccataaggaatag

SEQ ID NO: 31800 - DNA, 1137 bp, Artificial Sequence
  Description of Artificial Sequence: Synthetic coding sequence
atgcgaatgctcgtcagtggtagacgcgttaagaagtggcagctgattatccagctgttcgcgacttgttttttagctagcttgatgtttttttgggaacccatagataatcatatcgttagccacatgaagtcctattcatacaggtacttgatcaattcatatgatttcgtcaatgacactctgagcctgaagcacactagtgcagggccacggtatcagtatctgattaaccataaagagaaatgtcaggcccaggacgtgctgctgctgctttttgtaaagactgctcctgaaaactatgacaggcgcagcggcatccggaggacctggggtaatgaaaattatgtgcgatctcagctgaatgctaacatcaaaaccctgtttgcgttgggcacaccaaatcccctcgagggcgaggaactgcaaagaaaattagcgtgggaagaccagagatacaacgatataatccaacaggacttcgttgactctttctacaatctcacattgaagctgttgatgcagtttagttgggccaacacttattgtccccatgcaaaattcctgatgaccgccgatgacgatatttttatacacatgcccaatcttatcgagtatcttcagagtctggagcagattggggtccaggatttttggatcggtagggtgcaccggggagctccgcccatccgggataagtctagcaagtattacgtttcctacgaaatgtaccagtggcctgcatatcccgactatactgctggcgctgcctacgttatctccggagacgtggctgccaaggtgtatgaggcctctcagacattaaattctagcttatacatcgatgacgtgtttatggggctgtgcgccaataagataggcattgtaccacaggaccatgtcttcttctcgggcgagggaaagactccataccatccgtgtatttatgaaaagatgatgacaagtcatgggcacctggaggacctgcaggacctgtggaagaacgcaaccgatccgaaagtgaaaaccattagtaagggattcttcggtcaaatctattgcaggctgatgaagataattttattgtgcaagatctcttatgtggatacttatccatgtagggcggcctttatttag

SEQ ID NO: 31801 - DNA, 153 bp, Artificial Sequence
  Description of Artificial Sequence: Synthetic coding sequence
atgaggatgcttgtcagcgggagacgggtgaagaagtggcaactgattattcagcttttcgcgacctgtttccttgctagcttgatgttcttctgggagccaatagacaaccacatagtgtcccatatgaagtcctactcttataggtactag

SEQ ID NO: 31802 - DNA, 1206 bp, Artificial Sequence
  Description of Artificial Sequence: Synthetic coding sequence
atgtccttatggaaaaagaccgtctacagatcactgtgcctcgctttagctctgctggtggcggtgactgtcttccagaggtcactgactcctggacaattcttacaagaacctccccctccaactcttgaaccacagaaggcccaaaaacccaacggccagctggttaacccaaacaacttctggaagaatcctaaagatgtggctgcaccgacccctatggcgagccaggggccccaggcctgggacgtgactaccacgaattgcagtgccaacattaacctgacgcatcaaccttggttccaggttttggaaccccaattcaggcaatttctgttctaccggcattgtcggtacttccctatgctgttgaaccaccctgaaaagtgccgaggagacgtttacctgctggtggtagtgaagagcgtcatcactcagcacgatcgacgcgaagccatccggcagacatggggccgcgagcggcagtcagcgggcgggggccgcggtgctgtaaggacattattcctattgggtacggcttcaaagcaagaggagagaacacattatcagcagctgctggcctacgaggacaggctgtacggtgatattctccagtggggctttctcgatacatttttcaaccttacgctgaaagagatacacttcctgaaatggcttgatatctattgtcctcacgtcccgtttatattcaagggcgacgatgatgtgttcgtgaatcccaccaatttacttgaattcctggcagacagacagcctcaggagaaccttttcgtgggtgacgttctgcagcatgccagacccatccgcaggaaagacaacaaatactatataccaggcgcactgtacggaaaggcctcatatcccccttacgctggtggcggcggttttctcatggctggctcactcgcaaggagactacaccatgcatgtgacactttggagttgtatcccattgacgacgtgttcctaggaatgtgtctggaggttctaggtgtgcaacctacggcccacgagggatttaaaacctttgggatctctagaaatagaaatagccggatgaacaaagaaccatgtttttttcgcgcaatgcttgttgtacacaaattgttaccccctgagcttctggcaatgtggggtctggtgcactcaaatctaacatgcagcagaaaactgcaggtgttatag

SEQ ID NO: 31803 - DNA, 1194 bp, Artificial Sequence
  Description of Artificial Sequence: Synthetic coding sequence
atgcgctgtcctaagtgcttgctctgtctgtctgccctcttgacacttttaggtctgaaggtctacatcgagtggacctccgaatcccgcctaagcaaagcctatccttcaccacgcggaaccccgccatcccctactcctgccaaccctgaaccaactctgcctgcaaatctgagcacacgtcttggtcagacaatccctttgccctttgcctactggaaccagcagcagtggaggctgggaagtctaccaagcggcgattctactgagacagggggatgtcaggcctggggggccgccgcggcaactgagatcccagattttgcaagctatccaaaggatttgcgacgcttcttactgtccgctgcttgtaggagctttccacaatggctgccaggtggtggaggaagccaggtgtctagctgttcggataccgacgtcccatacctacttctcgcagtgaagtctgagcctggacgattcgcagagaggcaggccgtgcgcgagacatggggctccccggcgcccggcattcggttattgttcctgttgggcagcccagtaggcgaggccggcccagatctcgattctctcgttgcctgggagtcccggaggtactctgacctacttttgtgggattttcttgacgtgccttttaaccaaaccctgaaggatcttctactgttagcctggctcggacggcattgcccaactgtgagctttgtgcttcgcgcccaggatgatgctttcgttcatacgcccgctctgcttgcacacctacgcgctctgccccccgcgagcgctagaagcctgtatcttggtgaagtgttcactcaagcgatgccactgcggaaacctggggggcctttttacgtacccgaaagtttttttgaagggggctatccggcttacgcatcgggaggaggctacgtaattgcaggcagactggccccttggctgttaagggcagccgcgagagtggctcccttcccattcgaagatgtgtatactggcctctgcatccgcgcgctcggtttagtgcctcaggctcatccagggttcctgacagcatggcctgccgataggactgccgaccattgtgcgttccggaatctactcttggtgcgcccgctggggccccaagcatccatacgcctctggaaacagctccaggatccaaggctgcaatgctag

SEQ ID NO: 31804 - DNA, 1209 bp, Artificial Sequence
  Description of Artificial Sequence: Synthetic coding sequence
atgagacgaagacttcggctccgtcgtgatgccttactgacgctactcctgggtgccagcttgggcttgctgctttatgcccaacgcgacggcgcagcacctaccgcatctgcaccaaggggcaggggtcgggccgcaccccggcccactccagggccacgggctttccagctgccagatgccggagccgccccccccgcatacgaaggcgatactccagctcctccaacccccacaggcccgttcgatttcgcacgctacttacgagcaaaagaccagaggcgtttccctctcctcatcaaccaaccccataaatgcagaggggacggcgcaccagggggaaggccggatctgctgattgccgtcaagtccgtggctgaggactttgagcgtcgccaggcagtcaggcaaacgtggggagccgaaggtcgtgtccagggagctctcgtcaggagagttttcctcttgggggtgccaagaggtgcagggagcggcggcgccgacgaggtcggcgagggggctcgcacacattggcgcgccttgctgagggccgagtccctcgcgtacgccgatattctcctgtgggcctttgatgacacttttttcaatttgaccctgaaagagatccacttcctcgcttgggcatccgccttctgtcccgacgttagatttgtctttaagggagacgcagacgtgttcgtcaatgttgggaatctgcttgaatttctcgcccctcgcgatcctgcgcaggatctcctagcaggcgacgttatcgtgcacgcaaggccgatccgaacccgagcctccaagtactacatccccgaggctgtctatggcttgccagcttacccagcctatgccggaggtggcggattcgtgttatccggcgccacactccatcggctggctggagcctgtgcgcaagtggaactgttccccatagacgacgtctttctgggaatgtgtttacagcggctccgtcttacccctgagccccacccagccttcaggacattcggcattccacagccctctgcagcgcctcacctttccaccttcgatccctgcttctatcgggagttggtagtggtccacgggctgtccgcggcagatatttggcttatgtggcgtcttctgcatggtccacatggacctgcttgcgcacacccacaaccagtcgccgccgggccctttcagtgggatagctag

SEQ ID NO: 31805 - DNA, 1584 bp, Artificial Sequence
  Description of Artificial Sequence: Synthetic coding sequence
atgcgaagcgacaagagcgcactggtgtttttgctgctgcagctgttctgcgtcgggtgcgggttttgcggtaaggtcctagtgtggccctgcgatatgagccactggcttaacgtgaaggttatcttagaggagttgatagtgcggggccatgaggttacggtactgacacacagcaagccatccttgattgactaccggaagccctccgctctgaaattcgaggtggtccacatgccccaggatagaacagaggaaaacgaaattttcgttgacttagcgctgaacgtactacccgggctcagtacatggcaatccgtgattaagcttaatgatttcttcgtggaaataagagggacgctcaagatgatgtgtgagtcctttatttacaatcaaactcttatgaagaaactgcaggaaacgaattatgatgttatgctaattgatcctgttataccctgtggcgaccttatggccgagttgctggcagtgccatttgtgctgacattgcggatatccgttggggggaacatggaacgtagctgcggtaaattgcctgccccactgagttacgttccagtcccgatgaccggactaacggatcggatgaccttcctcgagagagtgaagaactctatgctgtcggtgctgtttcacttttggatccaagattacgactaccacttttgggaagaattctatagcaaggcgctcggtcggcctacgacgttgtgtgaaaccgtgggcaaggccgaaatatggctgatccggacttactgggatttcgaatttccacagccttatcagccaaactttgagtttgttggcggcttacattgtaaacctgctaaggcattgcccaaagagatggagaatttcgttcagagttctggggaggacgggatcgtcgtgttctcccttggctccctatttcagaatgtgactgaagaaaaggctaatattatcgccagtgcgctggcacagatccctcagaaggtcttgtggcgttacaagggcaaaaagcccagcacactgggcgcaaacactcggctctacgactggattccacagaacgatctgctcggacacccaaagaccaaggcctttataacccacggaggcatgaatggaatctatgaagctatctatcatggagttccgatggtaggcgtcccaattttcggggatcagctcgacaacatcgcccatatgaaggccaagggggcggccgtggagattaatttcaagacgatgacctccgaggacctcctaagagctcttcgcaccgtgataacggattccagctacaaagagaatgctatgagacttagtagaatccatcatgatcagccggtcaagccattggatagagcagttttctggatcgagttcgtgatgagacataaaggagcgaagcatcttcgtagcgcagcccacgacctgacatggtttcagcattactctattgatgtgatcgggtttttgctggcttgtgtggcaaccgccatttttttgtttacaaagtgctttctcttttcctgccagaaattcaacaagactcggaaaattgaaaaacgggaatag

SEQ ID NO: 31806 - DNA, 717 bp, Artificial Sequence
  Description of Artificial Sequence: Synthetic coding sequence
atggagaattttgttcagtcaagcggagaggatggcatcgtggtgttttctctcggaagcctattccaaaacgtgactgaggagaaggcaaatattatcgcctcggcactagcacagatcccacagaaggtgctgtggaggtacaagggcaaaaaaccctctacgcttggggccaatacacgactgtatgattggattccccagaacgacttgctaggacaccctaagaccaaggccttcatcacacacggggggatgaatgggatttacgaagcgatataccatggagtcccaatggttggcgtgcccatttttggcgaccagctggataacatcgctcatatgaaggctaaaggtgcagctgtcgagatcaactttaagaccatgacgtcagaggacctgctgcgggccctgaggacagtaatcaccgatagcagttataaagagaacgctatgaggttgtccaggattcaccatgaccagcccgtgaagccgttggacagagccgtcttttggattgaattcgttatgaggcataagggcgcaaaacacctgcgctctgcagctcacgatcttacatggttccaacactacagtattgacgtcattgggttcttgcttgcctgtgtggccaccgcaatatttctcttcacaaagtgttttcttttctcttgccaaaagtttaataagacccgcaagatagagaagcgcgagtag

SEQ ID NO: 31807 - DNA, 1587 bp, Artificial Sequence
  Description of Artificial Sequence: Synthetic coding sequence
atggcccttaagtggactacagtgcttctgatacaactgagtttttatttttccagcggctcttgtgggaaagtcctggtatgggctgcagaatattccctgtggatgaatatgaaaacgatattgaaggaactggtccaaaggggccacgaggtgacagtgctggcctcctccgcctcaatcctgtttgaccctaacgactccagcactctgaaactcgaggtgtaccccacgtcactgacaaagacagaatttgaaaacatcataatgcagttagtgaagcggctatcagagatccagaaggatacattttggctccccttttctcaggagcaggagatcctctgggccattaacgatatcattcgcaatttctgcaaagacgtggtttccaataaaaaactaatgaagaagctccaagagtcccgttttgacattgttttcgcggacgcctacctgccctgtggcgagctcctggctgaactctttaacataccgttcgtgtattcacactcctttagcccaggctacagtttcgaacgacactcagggggtttcatcttcccccccagttacgttccagtcgttatgagcaagttgtctgaccagatgaccttcatggagagggttaaaaacatgctctacgtgctgtattttgacttctggttccaaattttcaatatgaaaaaatgggatcaattttactccgaggtactgggcaggcccacaacgctgagcgagaccatgagaaaagctgatatctggctgatgcgaaacagctggaattttaaatttccacaccccttcctgccaaacgtcgatttcgtcgggggccttcattgtaagcccgccaaacccctgcctaaggaaatggaggaatttgtgcagagtagcggcgagaacggagtcgtggttttcagtctcgggtccatggtaagcaatatgactgaggaaagggccaatgtgatcgccaccgccttagctaaaattccacagaaggtgttgtggaggttcgacggtaacaagccagatgcgctggggttgaatacgagactgtacaagtggatcccacagaatgatctactaggacatcccaagacccgggcttttatcacccacggaggggctaacggcatctacgaagcaatttaccacgggatccccatggtagggatcccactgtttttcgatcagcccgacaacatcgcccatatgaaagcgaagggcgctgctgtaagagtggacttcaacaccatgtcttccactgacttactgaatgccctgaagacagtgatcaatgacccgagctacaaggaaaacatcatgaagctgtccagaatccaacatgaccagcccgtcaagcctttggatagggcggtcttctggattgagttcgtcatgaggcataaaggagccaagcacctgagggtggccgcccacaacctcacctggttccagtatcatagcctggatgtcatcggctttctcctcgcatgcgtggcaacagtgctgtttatcattacaaagtgttgtctgttttgtttttggaaatttgccagaaaaggaaaaaagggaaagcgggattag

SEQ ID NO: 31808 - DNA, 1827 bp, Artificial Sequence
  Description of Artificial Sequence: Synthetic coding sequence
atgggctcagttactgtgaggtacttttgttatggatgcctgttcaccagcgccacttggaccgtgttactttttgtgtatttcaatttctcagaagtgactcagccccttaaaaatgtgcccgtgaaggggtcaggccctcatggaccctctcccaaaaagttttatcccaggtttactaggggccctagccgggtgctcgaaccacagttcaaggcaaacaaaatcgatgatgtcattgatagtagagtggaggaccctgaggaggggcacctgaagtttagctctgaacttggcatgatctttaacgagcgcgaccaagagctgcgggacctggggtaccagaagcacgcgttcaatatgttaattagcgaccggcttggatatcaccgcgatgtgcccgatacacgaaacgctgcttgcaaagagaagttctacccgcctgacctacccgcggcttccgtggtgatctgcttctataatgaggctttttcagccctgctgcggaccgtgcacagcgttattgatcgcacccctgcccacttgctccatgaaataattctagtggatgacgacagtgattttgatgacttgaaaggagaattggatgagtatgtgcaaaagtacctcccaggcaaaatcaaagtcatcaggaatactaaacgggaagggctcatccggggacgcatgattggggccgcccacgctacgggagaggtcctagtgttcctggactcacactgtgaggtgaatgtgatgtggctgcagccgctgctggccgcaatacgagaggacagacacactgtagtctgcccagtgatcgacatcatcagcgcggatactttggcctactcctcctcccctgtggtcaggggcgggtttaactggggtctgcattttaaatgggatcttgtcccccttagcgagttgggtcgcgccgagggagctaccgcccctatcaaatcacctaccatggcaggaggcttattcgctatgaatcgacagtacttccacgagctcgggcagtatgactcagggatggacatttggggtggcgaaaatctggaaatttctttccgtatctggatgtgtggagggaagttattcataatcccatgctcaagggttggtcacattttcaggaaacggaggccttacggatcaccggaaggccaagacaccatgacgcataacagtctccggttagcccatgtctggctggacgagtacaaggaacagtacttttccctgagacccgatctcaaaactaaaagctatggaaacatctcagagcgagttgaactaaggaaaaagcttggctgtaaaagttttaaatggtatctggataacgtttatcctgaaatgcagatttctggaagccatgctaagccccagcagcccatcttcgtgaataggggccctaaaagaccaaaggtgctccagcgcggcagactctatcacctgcagaccaacaaatgtctcgtcgcgcagggcagaccttctcaaaaaggcggtctggtggtcctcaaagcatgcgattactccgacccgaatcaaatatggatatacaacgaggagcatgagctcgtcctgaacagtttactctgtttggatatgagcgaaacccgctctagcgatccgcctcgcttaatgaagtgccacggatccggaggctcccagcagtggactttcggaaaaaacaacagactgtaccaggtgtcagttggtcagtgcttgagagccgtagaccccctgggccaaaagggcagcgtggccatggccatctgcgatggctccagcagtcagcagtggcatctggaaggctag

SEQ ID NO: 31809 - DNA, 609 bp, Artificial Sequence
  Description of Artificial Sequence: Synthetic coding sequence
atgggaagtgtcacagtgcggtatttctgctatggatgcctgttcacatccgccacatggaccgtgttgctgtttgtctacttcaatttctctgaagtgacccagccgctgaaaaatgttcctgtgaaaggtagcggcccccatggccccagtcctaagaaattttatcctcggttcacaagaggaccttcacgggtattagagccccaatttaaggctaacaagattgatgatgttatcgatagccgtgtggaagatcccgaggagggccaccttaagttctccagcgaactgggtatgatttttaacgaacgcgatcaggagttgcgggatctgggctaccagaaacacgcatttaacatgctgatcagtgatcgactcgggtaccaccgggatgtgccagacaccaggaacgcagcctgcaaggaaaaattctatccccccgacctgcccgccgcgagcgtggttatttgcttctacaacgaggcttttagcgcgctgctccggaccgtgcatagcgttatagaccgcacccctgcacacctgctgcacgagatcatactcgtcgatgatgatagcgacttcggcaaagagtgttgtacctggtag

SEQ ID NO: 31810 - DNA, 561 bp, Artificial Sequence
  Description of Artificial Sequence: Synthetic coding sequence
atgggttccgtgaccgttaggtacttctgctatgggtgcttattcacttccgcaacatggacagttctactgtttgtatacttcaatttttctgaagtgactcagccactcaagaacgtacctgtgaagggctcaggacctcatgggccttctcctaaaaaattctaccccaggtttaccagagggccatccagagtgttagaaccgcaatttaaggcgaacaagattgacgatgtcattgatagtcgtgttgaagatcctgaagaggggcatctgaagttttcgagcgaactcggcatgatcttcaacgagcgagaccaggaactccgcgatctggggtatcagaagcacgctttcaatatgctcattagcgacaggcttgggtatcacagagacgtgcctgacactcgtaatgctgcctgtaaggagaagttttaccctcccgatctgcctgccgccagcgtcgtgatttgtttctacaatgaggcattcagtgctcttctaaggactgtgcactccgtgatcgaccgcacccccgcacacctcttgcatgaaatatag

SEQ ID NO: 31811 - DNA, 402 bp, Artificial Sequence
  Description of Artificial Sequence: Synthetic coding sequence
atgggctctgtgactgtcaggtacttttgttatggctgcctgttcaccagcgcgacgtggaccgtcctgctatttgtctatttcaatttctccgaggttactcaacccctcaaaaacgttccagtgaagggctccggaccgcacggaccaagcccaaaaaaattctacccccgtttcacccgaggaccaagtcgggtcctggaaccccagtttaaagccaataaaattgatgacgtgattgatagcagagtcgaagaccccgaggagggccacctcaagttttcatccgagctagacgttaaaaagtctagcacacatctcacttgtcaattactcgtgctgctgagtgtcagcataatgaagaggtttcttccctgctttgggcagtgtacagtctcctag

SEQ ID NO: 31812 - DNA, 1827 bp, Artificial Sequence
  Description of Artificial Sequence: Synthetic coding sequence
atggggagtgtgacggtacggtatttctgttacggctgtctctttacgagcgccacatggactgttcttctctttgtgtacttcaacttctcagaggtcacccagccactgaagaatgtgccagtgaagggctccggaccccatgggccaagccctaagaagttctacccacgcttcactcgaggcccatcaagagtgctcgagccgcagtttaaggcgaataagatcgacgatgtgatagacagccgcgtagaggacccggaagaaggtcatttgaaattctcgagcgaattgggaatgatcttcaacgaacgcgaccaggagctgagggacctggggtaccagaaacacgccttcaacatgctgataagcgacaggcttggctaccaccgggatgtacccgacaccaggaatgcagcctgcaaagagaagttttacccacccgacctgccagccgctagtgtcgtaatttgcttttacaatgaagccttttccgcattattgcggaccgttcactccgtgatcgaccggacaccggcgcaccttctccacgagattattctggtggatgatgactctgactttgacgacctaaaaggggaactggacgaatacgtgcagaagtatctccctgggaagattaaggttatccggaatacaaagagggagggactaatcagaggcagaatgatcggcgccgcacacgcaacgggcgaggtgctggtgttcctcgattctcactgcgaggtgaatgtcatgtggctgcagcccctgctggccgcaatcagggaagacaggcataccgtggtgtgcccagttatcgatatcattagcgctgacaccctggcttatagctcttccccagtggtccggggaggcttcaactggggactacatttcaaatgggatctggtcccgctgagtgagttaggccgtgccgagggcgcgactgcgcctattaagtctcccaccatggccgggggcctgttcgctatgaaccggcagtactttcacgagttggggcagtacgactctggtatggacatttggggaggggaaaacctggaaatcagcttcaggatttggatgtgcggtggtaaactgtttatcattccttgcagcagggtcggccatattttccggaaacggagaccctatggctccccagaaggacaggacaccatgacacataactctttgcgcctcgcccatgtgtggctggatgaatataaggaacagtacttctccctgaggccagatttgaagaccaagtcgtatgggaacatctccgaaagggtcgagttacgcaagaaactcggatgcaaatcattcaaatggtaccttgacaacgtctaccccgagatgcaaatttcaggctcacacgccaaaccacagcagccaatatttgtcaataggggaccaaaaagaccaaaggtgctacaacggggcagactttaccaccttcagactaataaatgtttggtcgcgcaagggcgaccatcacagaaaggcgggctggtggtcttaaaagcctgtgactacagcgatccgaaccagatttggatctacaatgaggagcacgagttagtcttaaatagcctgttgtgtctggacatgtctgagacccggagtagcgatccccccagactcatgaagtgtcacgggtcagggggttcccaacagtggacattcgggaagaacaaccgactgtaccaagtctctgtggggcagtgcttacgagcggtggatcctctgggacaaaaaggcagcgtggccatggcgatctgcgatggatcaagttcccaacagtggcacctcgaaggctag

SEQ ID NO: 31813 - DNA, 297 bp, Artificial Sequence
  Description of Artificial Sequence: Synthetic coding sequence
atggggtccgtgactgtccgttatttctgttacgggtgccttttcacaagtgcgacctggaccgttttgctcttcgtgtattttaactttagcgaagttacgcagcccctcaaaaatgtccctgtgaaagggtctggaccacatgggccgtcccccaagaagttttacccaaggttcacgagaggacctagtcgggtcttggaaccccaatttaaagccaacaaaattgacgacgtaatcgacagtagggtcgaagaccccgaagagggccacctgaagttttccagcgagctgtag

SEQ ID NO: 31814 - DNA, 1827 bp, Artificial Sequence
  Description of Artificial Sequence: Synthetic coding sequence
atgggaagcgttacggtgaggtacttttgctacggctgtctgttcacttccgcgacatggactgttctgctctttgtctacttcaatttttcagaggtgactcagcccctgaagaatgtgcccgtgaagggctccggacctcacggccctagccccaaaaagttttacccccgtttcacaagaggcccttcccgcgtgctcgaaccccagtttaaggctaataagatagacgatgttatcgacagccgcgtggaggatccagaagaaggacacctgaagttttcaagcgaactgggcatgatctttaatgaacgcgatcaggaactccgtgatctgggctaccagaaacacgcttttaatatgctgatatcagatagactggggtatcacagggacgtcccagacacgcggaacgcggcctgcaaggaaaagttttacccaccagatctgcctgccgcatccgtggtgatctgtttctataatgaagccttttctgcacttctgaggactgtgcactctgtgattgacagaacccccgcccatctgctacacgagataattttggtcgatgatgacagcgatttcgacgacctgaagggggagttggatgagtatgtccagaaatatctcccgggcaagataaaggtgattcgcaacactaaacgtgagggactgatccgggggcgaatgataggggccgcacacgcgaccggagaagtgctggtgtttctggatagccattgtgaggtgaatgtgatgtggctgcagccactgctggccgcaatccgagaagataggcataccgtggtctgcccagtgattgacatcatctctgctgatactctggcttacagctcctctcccgtcgtgagaggagggtttaactggggcttgcactttaaatgggacctggtgcccttgtcggagctgggaagagcggaaggggcaactgcgcctatcaaatctcccaccatggcaggtggcctgttcgctatgaatcggcagtacttccatgaactaggacagtacgacagcgggatggacatctggggcggcgagaacctcgagatctccttcaggatttggatgtgtggaggaaagctgttcattatcccatgctctagagtgggacatattttccgaaagcgcagaccttatggatcacccgagggacaggatactatgacgcacaatagcctgagactggctcacgtttggctggacgaatataaggagcagtacttttccctccgacctgatctgaagacaaagtcatacggcaatatctctgaaagggtggagcttaggaaaaaattgggctgcaaatccttcaaatggtacctggataacgtctacccagaaatgcagatttctggctctcacgctaagccacaacagccaatattcgtcaatagagggcccaagcgtcccaaagtcctccagcgcggccgtctctatcacctacaaactaacaagtgccttgtggcgcagggcagacccagccagaaaggagggctggtggtgctcaaggcctgcgattactcagaccccaaccagatctggatctataacgaggaacacgagctggtgcttaattcactcctctgcctggacatgagtgaaactcgttctagcgatcccccgcggctgatgaagtgccatggtagtggcggatctcagcagtggaccttcgggaaaaacaacagactgtatcaggtctcagtcggccagtgtctgagggctgtcgatcctctgggtcagaagggctccgtggccatggcaatctgcgatggaagctcttcgcaacagtggcaccttgaagggtag

SEQ ID NO: 31815 - DNA, 1827 bp, Artificial Sequence
  Description of Artificial Sequence: Synthetic coding sequence
atgggctctgttaccgtcaggtacttttgctacggatgcttattcactagtgccacctggacggtgttgctattcgtctactttaacttctcagaggtgacacagccactcaaaaacgtccccgtaaagggcagcggcccccatggcccaagtcctaagaagttttaccccagattcactaggggacccagtcgggtcctcgagccccagtttaaggcgaataaaatcgatgacgtgatcgacagtagggtggaggatccagaagagggccacctgaagttctcttcagagctgggaatgatatttaatgaacgggaccaagaactccgtgatctcggttaccagaagcacgcatttaacatgttaatctctgatcggctcggatatcatagggacgtgccagacacaagaaatgccgcctgcaaggagaagttttatcccccagacttgcccgccgccagcgttgtgatctgcttttacaatgaggcatttagcgctctgcttaggaccgtgcatagcgtcattgaccgtacaccggcgcacctgttgcatgagattattttagtggacgacgactctgactttgacgatctgaagggagagctggatgagtatgtccaaaaatatctgccaggcaagattaaggtgattcgtaataccaaaagagagggccttatccgtgggaggatgattggcgccgcacacgccaccggcgaggttctcgtgtttctcgatagccattgcgaggtcaatgtgatgtggctacagccactgctcgcggctattcgcgaagatcggcacacggtggtgtgtcctgtaatagatattatttccgccgacacactcgcttacagcagtagccctgtggtgcgcggcggtttcaactggggtctacacttcaaatgggacctggtacctctctctgagctgggcagagcggagggtgccactgctcctatcaaatctccgacaatggccggtggcctgtttgccatgaatcgccagtactttcatgaattgggtcagtatgatagcggcatggatatctggggaggggagaatctcgagatctccttcagaatctggatgtgcggaggaaagttgtttatcattccatgctcgagagttgggcacatcttccgcaagcggcgcccctacggcagtcccgaaggccaggataccatgacacacaactcactgcgtctggcccatgtatggctggatgaatataaagagcagtacttctcgctgcgacctgatctcaaaacaaaatcgtatggcaacatatcagagagggtggaattgcgcaaaaagctcgggtgtaaatcatttaaatggtacctcgataacgtttaccccgagatgcagattagtggaagccacgcgaagccacaacagcccattttcgtgaatcgggggcctaagcggcctaaggtacttcagagaggaaggctctaccatctccagacaaataagtgcctcgttgctcagggccgcccgtctcagaagggcggcttggtcgtgcttaaagcatgcgactattcggatcccaatcagatctggatttacaacgaagaacacgagctagtgctcaatagcctgctgtgtctggatatgtccgagacaagatcctctgatcctccacgtctaatgaagtgtcacggctcagggggtagccagcagtggacctttggaaaaaacaatcgcctgtatcaagtgtccgttggtcagtgtttgagagccgtcgatcctctgggccaaaagggttcagttgctatggctatctgtgacggcagctcatctcagcaatggcatttagagggttag

SEQ ID NO: 31816 - DNA, 483 bp, Artificial Sequence
  Description of Artificial Sequence: Synthetic coding sequence
atgggatcggttacggtccggtacttttgctacggctgcctgtttacatccgctacttggactgtccttctctttgtatactttaatttcagtgaggtaacacagccattgaagaatgtgcccgtcaaaggatccggacctcacgggccaagtcctaaaaagttttatccaagatttacacgaggcccttccagagtattggagcctcaattcaaagcaaacaagattgacgatgtgatagattcccgggtcgaagacccagaagaaggtcatttaaagttttcctccgaactgggaatgatctttaatgagagggatcaggagttgagggacctgggatatcaaaagcatgcattcaatatgttgatctcagaccgacttggttaccaccgggatgtgcctgatacgcgcaatgcagcctgcaaggagaagttttatcccccagacctcccggccgcctccgtcgtcatctgcttttattag

SEQ ID NO: 31817 - DNA, 1584 bp, Artificial Sequence
  Description of Artificial Sequence: Synthetic coding sequence
atgcctcaacccgaatcccagaaggccgctattcttgggtgtggccaaggcgggatgatcttcaatgagcgggatcaggaactgcgagacctcgggtaccagaaacatgctttcaatatgcttatttccgaccgcctcggttatcaccgggacgtgcccgataccaggaacgccgcttgtaaagagaagttctaccctccggatctgcccgccgcctcggtcgttatttgtttctacaacgaagccttcagcgcacttcttcgcactgtgcacagtgtcatagaccggacaccagcccacctgctccacgagatcatcttggtggacgacgattcagactttgatgatctgaagggcgagctcgatgaatatgtccagaaatacctgcctggaaagataaaagtgatcagaaacacaaagcgcgaaggattaattagaggcaggatgatcggcgccgcacacgccacaggagaggtgctagtctttctcgacagtcactgcgaagtaaacgtcatgtggcttcaacccctcctggccgctatacgggaggatagacatactgtggtgtgccccgtgatcgatattataagtgccgacactctcgcatactcaagttctcccgtggtgcggggtggctttaattggggactgcatttcaaatgggatctcgtgccactatccgaactgggccgggccgaaggagccacagctcccattaaaagcccgaccatggcagggggactgtttgctatgaaccgacagtacttccatgaattagggcagtacgactctggaatggatatctggggaggcgaaaaccttgagatcagctttcgtatatggatgtgcgggggcaaactcttcattattccttgctctagagtaggtcatatctttaggaagagaaggccctatggatctcctgaggggcaggatacgatgacacacaacagcctgagactcgcccacgtatggctcgatgagtacaaggagcagtatttttcattgagacccgatctaaaaactaagtcctatgggaacatcagtgagcgcgtagagctgcgcaaaaaactgggttgcaaaagcttcaaatggtatctcgataacgtgtaccctgagatgcagatctccggttcccacgctaagccccagcagcccatctttgtaaatcgtggccctaagcggcccaaagttttgcaacgtggaagactttaccacctgcagactaataagtgcctcgtagcccagggaaggccttctcagaagggcggtctggtggtgttaaaggcgtgtgactattctgaccctaatcagatctggatttacaatgaggagcacgagctggtgttgaatagcctcttatgcctcgacatgtctgagacccgttctagcgaccctcccaggctcatgaaatgccacgggagcggaggttcacagcagtggacttttggtaaaaacaaccggttataccaggtctccgtgggccagtgtctgagagccgttgatccgctgggccagaagggctccgtggcaatggctatatgcgacggatcgtcaagtcagcagtggcaccttgaaggatag

SEQ ID NO: 31818 - DNA, 2823 bp, Artificial Sequence
  Description of Artificial Sequence: Synthetic coding sequence
atgaaccggatccgaaagttctttcgcggatctggaagagtccttgcctttatttttgtggcctctgtgatctggctgcttttcgacatggctgccttgaggctcagttttagcgaaatcaatacgagggtgattaaagaagatatcgtaaggcgagagagaataggatttcgagtccagcccgatcaaggaaagatattctactccagtattaaggagatgaagccaccactaaggggacatgggaaaggggcttggggcaaagagaacgtgcgcaagacggaagaatccgtactgaaggttgaggtcgacttggaccaaactcaaagggaacggaaaatgcagaatgccttaggaaggggcaaggtggtaccgctctggcatcctgcccacctgcagacgctgccggttacgccgaacaaacagaaaacagacgggcgcgggactaaaccagaagcatcatcccaccagggtactcctaagcagaccacagcccaaggggcaccaaagacaagctttatcgctgccaagggtacccaggtggtcaagatttccgtgcatatgggaagagtgtccttgaagcaggagccacggaagtcgcattcaccttcttccgataccagcaaactcgccgcggagcgtgacctcaatgtgacgatctcattgtctacggataggcctaaacagcgaagccaagcggtagccaatgagcgggctcaccctgcctccacagccgtccccaagagcggcgaggctatggcactgaataagacaaaaacccagtctaaagaagttaacgctaacaaacacaaagcaaatacctcccttccatttccgaagtttacagttaactctaatcgactacgcaaacaatccatcaatgaaactcccctgggatcattgagtaaggacgacggagcccggggggcacacggaaaaaaactgaactttagtgaatcacacctggtcattatcaccaaggaggaagagcagaaagccgatcctaaagaagtgtccaactcgaagaccaagactatttttccgaaggtgctgggaaagagccaatctaagcacatttcccggaatcgaagcgagatgagttccagttctttagcgccacatagagtcccgcttagtcagactaaccatgctctgacaggagggctggaacccgcgaaaatcaacatcacagcgaaggcgccaagtactgagtacaaccaatcccacatcaaggcccttctccccgaagactccggtacccaccaggttttaagaattgatgtgactctgtcccctcgcgacccaaaagctccaggccagttcggccgccctgtggtggtcccacacggcaaagaaaaggaggccgagaggcggtggaaggaaggtaatttcaacgtgtatctgtccgacctgattccagttgacagagctattgaagacacccgccccgctgggtgtgctgagcagctcgtgcataataacctccctaccacatcagtcatcatgtgctttgtcgacgaagtatggagcacacttttgcgctcagttcattcagtgatcaaccgttctccaccccatctgataaaggaaattcttctggttgacgacttttcaacgaaagattatttgaaagataatctggataagtacatgtcgcagtttcccaaagtgagaattttaaggttgaaggagcgccacgggctgatcagagctagactggccggcgcacagaatgcaaccggggacgttctgaccttcctcgatagtcacgtcgaatgcaacgttgggtggcttgaaccactactggagagggtgtacctttcccgaaaaaaagtcgcctgcccggttatcgaggttattaatgataaagatatgagttatatgactgttgacaactttcaaagggggatcttcgtgtggccaatgaacttcggatggagaactatcccccctgatgtgatcgctaagaaccggattaaggagacagacacgattagatgccccgtgatggcggggggcctcttcagcattgataaaagctacttctttgagctgggaacgtacgatcccgggttggatgtttggggcggcgagaatatggagttatccttcaaggtatggatgtgtggcggtgagatcgagataatcccatgttctagggtcgggcacatctttagaaacgacaatccatactccttccctaaagacagaatgaagacagttgagcgcaacctcgtgagggtggccgaggtgtggttggacgaatataaagaactattctacggccacggggaccatctcatagaccagggactggatgtcgggaatctgacacagcagcgagaactgcggaagaagctcaagtgtaagagcttcaaatggtatctggaaaacgtattcccagatcttcgggcaccaatcgtccgagctagtggtgtgctgatcaatgttgcactaggcaaatgcataagtattgagaataccaccgtgatcctggaagactgtgatggcagtaaagaacttcagcaattcaactatacctggctaaggctgattaaatgcggcgagtggtgcattgctccaatcccagacaaaggagctgttagattgcatccctgtgacaatcggaataaaggcctcaaatggctgcataagtcaacgagcgtgttccaccccgaacttgtgaaccatatagtgtttgagaacaaccaacaactgctttgcctggaagggaatttttctcagaagatcctgaaagtggcagcatgtgaccctgtgaaaccataccagaagtggaagtttgaaaaatattatgaggcctag

SEQ ID NO: 31819 - DNA, 1677 bp, Artificial Sequence
  Description of Artificial Sequence: Synthetic coding sequence
atgcgaaagattcgggcaaacgcaattgcaatcttaacagtcgcttggatcttgggtaccttttattatctgtggcaggataatagggcccatgctgcctcctccggtggtagaggggcgcaaagagccgggcgcagaagtgaacagctgcgcgaggataggacaatcccactaattgttactggcaccccttccaaaggtttcgatgaaaaggcatacctttccgcgaagcagctgaaagccggggaagacccataccgacaacacgccttcaaccaattggagtctgacaagctgtccccagaccgtcccatccgtgatacccgtcattactcttgcccttctgtgtcttactcttcggacctgcctgcaacatcggttatcattaccttccataacgaggccagatcaactttattaaggacagttaaaagcgtacttaatagaacgccagccaacctgatacaggaaattattttggtagatgatttttcctctgaccctgaggattgtctccttcttaccagaatacctaaagtcaaatgcctgcgaaacgatagacgcgaaggcctaatccggtctcgtgttaggggggctgacgtcgctgctgccacagtacttacatttcttgacagtcactgcgaggtaaacaccgaatggttgccccctatgttacagcgtgttaaagaggaccacacaagggtggtgtccccaatcatcgatgtcatctccctcgacaactttgcgtacctggccgcctctgcggacttgcgcgggggattcgactggagcctgcactttaagtgggaacagattcccttagagcaaaagatgacgcgcactgaccctacacggccaattcgcacaccagtcattgcaggcggtatcttcgtgattgacaaaagctggtttaaccatctgggcaagtatgacgcccagatggatatctggggcggcgaaaacttcgagttgagcttcagggtgtggatgtgtggggggtcccttgaaatcgtaccttgctcccgagtgggccacgtttttagaaagagacatccctacaacttcccggagggcaacgctctgacctacatccgaaacactaagaggactgccgaagtttggatggacgagtacaaacagtactattacgaggcacgaccatccgctatcggcaaggcatttggtagcgttgccaccaggattgagcagagaaagaaaatgaattgcaagtcatttcgttggtacctggaaaacgtataccccgaactgacagtacctgtcaaagaagcactgccgggaattatcaaacaaggggtgaactgtctcgaatctcagggccagaataccgccggcgatttcctgctgggcatgggcatttgtcggggctctgccaaaaatccccagcctgctcaagcgtggcttttttcagaccacctgatccagcaacaggggaaatgcctggccgccacatcgaccctgatgagcagccccgggagccccgtgatcctgcaaatgtgcaatccccgcgagggtaaacagaaatggaggcggaagggtagtttcatccagcacagcgtgagcggcctgtgtctcgagactaaacctgcccagctagtgactagcaagtgccaggctgacgctcaggcccagcagtggcaactactcccacatacgtag

SEQ ID NO: 31820 - DNA, 1677 bp, Artificial Sequence
  Description of Artificial Sequence: Synthetic coding sequence
atgcggaagatacgcgctaacgctatcgcaatcctgacagtggcctggattctaggaactttctattacctgtggcaggacaatagggcccacgcagcatcatcaggcgggaggggtgcccagcgggcaggtcggcgctccgagcaactgagagaggataggactatccccttgattgtgaccggtaccccaagcaaggggttcgacgagaaggcttatctcagcgccaaacaacttaaagccggagaggacccttaccgacagcacgcttttaaccaactagaatccgacaaactttcccctgacagacctatcagagatacccgacattattcatgcccctccgtttcctattcttcagacttaccagctactagtgttataataaccttccacaacgaggccaggagcaccctacttcgaacagtgaagtcggtgctaaacagaaccccagcaaatctcattcaagagataattctggtcgacgatttttcatccgacccagaagattgtctgttgttgactcgaatcccgaaggtgaagtgccttagaaacgaccggcgcgaggggctaatccggtcccgtgtgagaggcgccgatgtagcagccgccacagttctcacttttctcgacagccactgcgaagtaaataccgaatggctcccgccaatgcttcagagagtgaaggaagatcacacccgtgtggtgtcccctattattgacgtgatctctcttgataactttgcatatctcgccgcttcagccgatctccgtggaggctttgattggtcgttgcatttcaagtgggagcagattccactcgaacagaagatgactaggacagaccctacacggccaatccggactccggttattgccggaggtatctttgttatagataagagttggtttaaccatctagggaagtacgatgcacagatggacatctggggcggcgaaaatttcgagctgagcttcagagtctggatgtgtggcggaagccttgaaattgtgccatgcagcagggtcggacatgtgtttcggaagagacacccttataattttccggaaggaaatgcactcacttatattcggaatactaagcgtaccgccgaggtctggatggacgaatacaagcagtattactacgaggcacgacctagcgccattgggaaagcattcgggtccgttgccaccagaattgagcagcgcaaaaagatgaactgtaaatcctttagatggtatctagaaaacgtgtacccagagctgaccgtgcccgttaaagaagctctccctggtataatcaagcaaggcgtgaattgcctggagtcccaggggcagaacacagcgggggattttttactgggaatgggcatctgccgtggctctgccaagaaccctcaacctgcacaggcctggctgttttccgaccatctcatccagcagcaaggcaagtgcctggctgcaacttcaacactgatgagcagccccgggagccctgtcatcctgcagatgtgcaacccccgggaaggcaaacagaaatggcgcagaaaggggagttttattcagcactctgtatcaggtttatgtttggagactaagccagcccaattggttacttccaagtgccaggctgatgcccaggcgcagcagtggcagcttcttccacacacttag

SEQ ID NO: 31821 - DNA, 555 bp, Artificial Sequence
  Description of Artificial Sequence: Synthetic coding sequence
atggatgagtataaacagtattactatgaggcaagacccagcgctatcgggaaggcctttggctcagttgctactcgaattgaacagagaaaaaaaatgaattgcaagagctttcggtggtaccttgaaaacgtttatccagagttgaccgtcccggttaaagaggctctcccaggaatcataaaacagggggtcaactgcttggagtctcaaggccaaaataccgcaggtgatttcctccttggcatgggaatctgccggggcagcgccaagaacccacagcccgcacaggcgtggctgttttccgatcacctcatacagcagcagggcaaatgcttagccgcgacctccacccttatgagtagccctggttcccccgtcatcctgcagatgtgtaatcctagggaagggaagcagaaatggcgccgcaaagggtcgttcatccagcattctgtttcggggctgtgcctggaaaccaagccagcccaactggtcacctctaaatgtcaggcagacgctcaggcccagcagtggcagctcctaccccatacttag

SEQ ID NO: 31822 - DNA, 1629 bp, Artificial Sequence
  Description of Artificial Sequence: Synthetic coding sequence
atgcgcaaaattagagccaacgccatcgccatactgaccgtagcatggattctaggcactttttactacctctggcaggacaatcgcgcgcatgccgcctccagtgggggcagaggtgcccagagggcaggtcggcgaagcgagcaattacgcgaggaccgaacaatacccctcatagttactggcacaccctctaagggtttcgatgagaaggcctacctgtccgccaaacaattgaaagctggcgaagacccttaccggcagcacgcgttcaaccagcttgaaagtgacaaactctcccccgacagacccatccgtgatactcgccattacagctgcccgtctgtctcatatagctctgatctgccggcgacctctgtaataatcactttccacaacgaagctaggagcaccctcctgcggactgtgaaatctgtgctgaatcgtacaccggcaaatctgattcaggagatcattctagtggacgacttcagtagcgaccccgaggattgcctcctgctgacgagaatcccaaaagtcaagtgcttacgaaatgaccgtagagaaggcctcatccgctccagagtgcgtggcgcagacgtggcagctgcaaccgtcctcactttccttgattctcactgtgaagtgaatacagagtggttgcctcccatgctgcagcgcgtcaaggaagatcatacccgcgttgttagtccaattattgacgtgatctccttggataatttcgcttatctcgcagcctccgccgatctgcgagggggttttgactggtcgctgcacttcaagtgggaacagatcccactcgagcaaaaaatgactcggactgatcctactcgccctatcaggactccggtaatcgccggcgggatttttgtcattgacaagtcctggtttaatcatcttggaaagtacgacgctcaaatggatatttgggggggggaaaatttcgagctgtccttccgcgtgtggatgtgcgggggaagcctcgaaattgtaccatgttcccgggtgggtcacgtctttcgtaaacggcatccctacaatttcccagaaggcaacgccctgacctacatccgtaacacaaagcgcaccgcagaggtgtggatggacgagtataaacagtactactacgaggccagaccaagtgccattgggaaagcatttggttcagtggccactcgtattgagcaacgtaagaaaatgaattgtaaaagcttccgctggtacctggaaaatgtctaccccgagctcactgttcccgtgaaagaggcactgccaggcatcatcaaacagggggtgaactgccttgagtcccagggccagaacactgctggcgatttcttgctgggaatgggcatctgtcggggatccgccaagaatccacaacctgcccaggcctggctcttttctgaccacctcattcaacagcagggtaagtgcctggccgcaaccagcacgctgatgagttctccaggtagccctgtgatccttcagatgtgcaacccaagggaaggcaagcaggtgtcattactggctagtggtcccgaggctcagcagcccgaaggaccatgtctgcgggtggccgacctgggccgacgggctcctgattag

SEQ ID NO: 31823 - DNA, 1920 bp, Artificial Sequence
  Description of Artificial Sequence: Synthetic coding sequence
atgctgctgagaaaaagataccggcatcggccctgtcgactgcagtttctgctgctgttgctgatgctcgggtgtgtgctcatgatggttgcgatgctccatcccccacatcatacactgcaccaaactgttacagctcaggctagtaaacattcaccagaagctaggtaccgcctggacttcggagaaagccaagattgggtgcttgaggctgaggatgagggcgaagagtactccccactggagggcctgccaccgtttataagtctgagggaggaccagctgttagtggcagtcgctctaccccaggcacggcgcaaccaaagccaggggcggcggggaggaagctacaggctgataaagcagccccgccggcaagataaggaggctcctaagcgggattggggggccgatgaggatggagaagtctcagaagaggaggagttaacccccttctccctggacccacgcggcctacaggaggccctctcggcaaggatcccactacagagagcactcccagaggtgcggcaccccttgtgcttgcagcaacaccctcaggattccttacctacggcttctgttatcctatgctttcatgatgaggcctggagcaccctgctacggacagttcattcgatcctcgacaccgtgccccgggccttcctgaaggaaattattctggtggacgacctttctcagcaggggcagctgaagtctgcactttctgagtacgtggcgaggcttgagggcgtgaagttactccggagcaacaagagactcggtgcaattcgtgcacgcatgctaggggctactagggctactggcgacgtactggtcttcatggacgctcactgcgagtgtcaccccgggtggctggagcccctgctgtctagaatcgctggggatagatcaagagtggtgtccccagtcatcgacgtcattgattggaaaacttttcagtattacccttccaaagatctacagagaggggttctggactggaaactcgactttcattgggaaccactacccgaacatgtgcgaaaggccctgcaatctccaatatcccctattcgctctccagtcgtgcctggcgaagtcgtggccatggaccgccactactttcagaacacaggggcatatgacagcctgatgtcacttcgcggaggcgaaaatttggaattgagcttcaaggcatggctgtgcgggggcagtgtggaaatacttccatgctcccgtgtgggtcatatctaccagaatcaggattcccacagccccttggaccaggaggccactctgcgcaatcgcgtgagaattgctgaaacctggctgggcagctttaaagagactttttataaacatagcccagaggcattctctctgtcaaaggcagaaaaacccgactgcatggaacgactgcagctgcaaaggagactgggttgtagaacattccactggttccttgctaacgtttatccggagttatatccttcagagcccagaccctccttttctgggaagctgcataatacgggcctgggactttgcgccgactgtcaggcagaaggagatattcttggatgtcctatggttctagcaccatgcagcgatagcagacaacagcagtatctgcagcacacaagcagaaaggaaatccattttggaagcccacagcacctctgtttcgctgtgcgccaggagcaagtgattcttcaaaactgcaccgaagagggcctcgctatccatcagcagcactgggactttcaggagaacggtatgatcgtgcacatactgtccgggaaatgtatggaggcagtcgtgcaggaaaacaataaggacctgtatctgaggccttgcgacgggaaggcgcgtcagcaatggagattcgaccagatcaatgcagtggacgagcggtag

SEQ ID NO: 31824 - DNA, 591 bp, Artificial Sequence
  Description of Artificial Sequence: Synthetic coding sequence
atggaacgcctgcaactgcagagacgcctggggtgtaggactttccattggttcttggccaacgtgtacccagagttgtaccccagcgagccccggcccagcttctccggcaaactccataatactggtctgggtctctgcgccgactgccaagctgaaggagacattctgggctgtcccatggtgcttgcgccttgctcagactctaggcaacagcagtaccttcagcacacatcaagaaaagagattcacttcggctccccccagcacctctgctttgccgttcggcaggaacaggtcattctccaaaattgtactgaggaaggcctcgctatccaccagcaacactgggactttcaggagaacggaatgatagtgcacatcctaagtggaaagtgcatggaggccgtggttcaagaaaataacaaagacctgtatttgcggccatgtgacgagaagcccgcatcttccggcgtcctgacccgttcgatgctatggatgaatgacgagtgccaatgccagaaggagaaaagaattctggctatcaagatacagctgcaagtgaacctgaagtccctgtatatctcctag

SEQ ID NO: 31825 - DNA, 1737 bp, Artificial Sequence
  Description of Artificial Sequence: Synthetic coding sequence
atgcttccctgtctggtcgtattgctggccgcccttttgagccttcgtctggggagtgatgcccatggcactgagctgccctccccaccatctgtgtggtttgaggcagaatttttccaccatattctccactggacccctatcccaaaccagtccgagtctacctgctatgaagtggccctactgagatacggtattgagtcttggaatagcatatctaattgttctcagactctgtcttatgatctaacggctgttacacttgatctataccactccaatgggtaccgggcaagggtccgagccgtagacggatcgcgacattcaaattggaccgtcaccaatactcgattcagcgtcgacgaagtaactctgaccgtcggctcagtaaaccttgagatccacaatgggtttattctcgggaaaatacaactaccacggccaaaaatggcaccggcaaatgatacctacgagagtattttttcccatttcagggagtacgagatcgcaattcgcaaggttccaggaaattttacgtttacccataagaaggtgaagcacgagaatttttcactactgacttccggagaggtaggagagttctgtgttcaagtaaaacccagtgtggcaagtcgctccaataaggggatgtggagcaaggaggaatgtatttctctgacccgtcagtactttacggtgacaaacgttataatcttcttcgcgttcgttctattactgtctggagctcttgcatactgccttgccctacaactgtatgttcggaggcgaaaaaaactgccaagcgtgctgctgttcaaaaaacccagcccttttatcttcattagccagcgaccatcccccgaaactcaggatactattcaccctttagatgaagaagctttcttgaaggtaagtcccgaactaaagaacttggatctccatggctcgaccgattcaggcttcgggagtaccaagccttctctccagactgaggaaccgcaatttttattacctgatccccatccccaggcggacaggactctggggaaccgcgagcccccagtactgggcgactcttgttcatcgggttctagtaatagtactgacagcggcatatgtctgcaggagcctagtctaagtcccagcaccggtcccacttgggagcaacaggtgggcagcaattcacgcggtcaagacgattcgggcatcgacttggttcagaatagtgaaggcagggctggtgatacacagggaggctctgccctgggtcatcactccccaccagagccagaggttcccggggaagaggacccagctgccgtcgcctttcaaggctacctgcgacagacaagatgcgctgaagagaaggcaacaaagaccggatgtctcgaagaagagagcccactgaccgacggccttggcccgaaattcggtcgatgccttgtggacgaggccggactgcacccacccgcccttgctaagggctacttaaagcaagatcctctagaaatgaccctcgcatcatccggcgcacccacggggcagtggaatcagcctaccgaagaatggtccctcttggcactgtcatcctgctcggacctgggcatatcagattggtcttttgctcacgaccttgcacctttaggctgtgtcgccgcacctggcggccttctgggcagtttcaatagcgacctcgtgacattacctttgataagctctctgcagagctcagagtag

SEQ ID NO: 31826 - DNA, 1332 bp, Artificial Sequence
  Description of Artificial Sequence: Synthetic coding sequence
atgagaaacgcaattatccagggcctcttttatgggtcactgaccttcggaatctggaccgctctgctgtttatatacctgcaccacaatcacgtgtcatcgtggcagaaaaaaagtcaggaacctcttagcgcgtggagccccggcaagaaggtgcaccagcaaattatctatggcagcgagcagataccaaagcctcatgtaatcgtgaagagaactgatgaggacaaggccaagtccatgttaggaactgattttaatcacacgaatccggagcttcataaagagctgctcaaatacggctttaatgtcattatttcccgtagcttaggcatcgagcgcgaggtgccagatacaagaagtaagatgtgtcttcagaaacactatcccgctaggttgccgaccgcgtctattgtgatatgtttttataacgaggagtgtaacgccttatttcagaccatgagttcagtgaccaacctgaccccccactactttctggaagagatcatcctagtcgacgacatgtctaaagttgatgatttgaaggagaaattagactaccacctggagactttccgtggcaaggtgaaaataataaggaacaagaagagggaaggcctgatccgcgcacggcttatcggggcttcccacgcttcaggtgatgtgttggtcttccttgactcacactgtgaggtgaacagggtgtggcttgaaccactcctgcatgcgatagctaaagaccccaaaatggtggtgtgccccctcattgatgtgatcgatgatcgcacactcgagtacaagcctagtcccctcgtgcgagggaccttcgattggaatttgcagttcaaatgggacaacgtgttctcatatgaaatggacggtccagagggctcaactaagcccattaggtcacccgctatgtcaggaggtatttttgcaattcgccggcactactttaacgagatcggccagtatgataaggacatggacttttggggaagagaaaatctggaactgagtctgcggatctggatgtgtggtggacagctgtttattatcccttgcagccgcgtgggccacatatcgaagaagcagaccgggaagccaagtacgattattagcgctatgacacacaactatctcagattggtccacgtgtggttggacgagtacaaggagcagtttttcctcagaaagccgggcctcaaatacgttacctacggaaacatcagggagcgtgtggagctgaggaaaagattgggttgcaaatccttccagtggtacctcgataatgttttcccggagctcgaagcttctgtcaacagcctctag

SEQ ID NO: 31827 - DNA, 1332 bp, Artificial Sequence
  Description of Artificial Sequence: Synthetic coding sequence
atgcgtaatgccatcattcagggcctgttttacggaagcctcacctttgggatctggacagccctgctgtttatttatttacaccacaaccatgtgagctcctggcaaaagaaaagccaagaacctttgtcggcatggagtcctgggaagaaggtgcaccagcagatcatctacggatccgaacagattcctaagccccatgtcatagtgaaacgcactgacgaagacaaggccaagtcaatgcttggtacagactttaatcatactaatcccgaactccacaaggagctgctgaaatatggctttaacgtgatcatatcgaggtccctgggcatagagcgtgaagtccctgatacccggagcaagatgtgtctgcagaaacattaccccgccagactacctacagcctctattgtgatctgcttctataatgaggagtgtaatgccctgttccagaccatgtcttctgtgacaaaccttactccacattattttctagaggaaatcattctggttgacgacatgtccaaggtcgatgacctcaaagagaaacttgactatcatcttgagacctttcgcggcaaagtgaaaattattagaaacaaaaaaagagagggattaatccgtgcccgcttgatcggcgcctctcacgccagcggcgacgtcctggtatttttagattctcattgtgaggtgaacagagtgtggcttgagccactattgcacgccatcgccaaagatccaaagatggtcgtttgtccactgatcgatgtgatagatgatcgcaccctggagtataagccctctcccctggtccgaggcacattcgactggaatttacagtttaaatgggataacgtgttctcatacgaaatggacggacctgaggggagcacgaagcctattcggtcccccgccatgtcgggtggaatctttgccatcagaaggcactactttaatgagatcgggcagtacgataaggacatggacttctgggggagggaaaatctggagctgtcgctgcgaatctggatgtgtggaggccagctctttataatcccttgttcccgtgttgggcacataagtaagaagcaaaccggcaaaccttccaccatcatttcagccatgacacacaactacctccggctcgtacatgtgtggctggacgagtacaaggagcagttctttctcagaaagccaggactgaaatatgtgacctacggaaatatcagagagagggtcgagctgcgaaagcgcttgggctgtaaaagtttccagtggtatctcgacaatgtattccctgagctggaggcatccgtcaattccctatag

SEQ ID NO: 31828 - DNA, 681 bp, Artificial Sequence
  Description of Artificial Sequence: Synthetic coding sequence
atgaagagaaaacagaagcgcttcctgcagatgactttactcttcactgtcgctcttattttcctgccgaatgtgggactatggtcgctgtacaaagataagcaccttgtgaagtctgcagaacccggtgaacagcagacttttcctctcggcctcggagatgggcagttctatagttggaccgacggtcttaggagaaaagactggcacgactacgagagcattcagaaagaagctatgaggtctggcaagggagagcatgggaaaccatacccgttaacagaggaagatcacgacgattcggcatacagggagaacgggttcaatatctttgtttctaacaatatcgccctagagaggagtctccccgacatcaggcacgccaattgtaaacacaaaatgtacctggaacgcctgccaaacacttcaatcattattccattccacaatgaagggtggactagcctgctgcgcaccattcactctatcattaatagaacccccggatcactgattgcggaaattatacttgtcgacgacttctctgagcgcgaacatctgaaagacaagttggaagaatacatggccaggttttccaaggtgaggatcgttcgtaccaaaaaacgtgaggggtcaggccctgtgagctggggccacctgtggcccgaagagaagagttag

SEQ ID NO: 31829 - DNA, 1806 bp, Artificial Sequence
  Description of Artificial Sequence: Synthetic coding sequence
atgaaacggaaacagaagagattcctgcaaatgaccctcttattcacagtggccttgattttcttgcccaacgttgggctgtggagtctgtacaaggacaagcacttagtgaagagcgccgagccaggggagcagcagaccttcccactgggactgggagacgggcagttttattcctggaccgacggcttgcgcagaaaggattggcatgattatgagagcatacagaaggaagctatgcgctctggcaagggtgaacatgggaaaccctaccctctgacagaggaggaccacgatgactctgcttatagggagaatgggttcaatatatttgtctcaaacaacattgcactcgagcgatccctcccagacatacggcacgccaattgtaaacataagatgtacctggagcgcctgcctaataccagtatcatcatccctttccataatgaaggatggacatccctgctccggaccatccactccatcattaatagaacaccaggcagtctgattgccgaaatcatcctcgtcgacgacttctccgagagggaacatctcaaagataagcttgaagagtacatggcccgattttctaaagtcagaatagtgcgcacaaaaaaaagagaaggcctaattcgcactaggcttttaggggccagcatggcacgaggggaagtgctcacgttcctcgactcccactgcgaagttaatgtgaactggctcccccctctcctaaatcaaatcgcactcaaccacaagaccattgtttgccctatgatcgacgtgattgaccataaccacttcggctacgaggcacaggcaggcgacgccatgaggggcgcgtttgactgggaaatgtattataagagaattccaattccgccggaattacagcgggcagacccatcagatccattcgaatccccagtgatggccggtgggcttttcgctgttgatcgtaagtggttctgggagctgggggggtatgacccgggactggagatatggggtggtgaacagtacgaaatctcattcaaagtctggatgtgcggaggcgagatgttcgacgtcccatgcagcagagtaggtcacatctaccgcaagtacgtaccgtacaaagtccctagtgggacttcacttgcgcgaaaccttaaaagggttgccgaaacttggatggatgaattcgcagaatacatttatcagcggcgtcccgaataccgacatttgtccactggagacatctcagcacaaaaggagctgagaaagcagctgaaatgcaaagattttaaatggtttatggctgctgtggcatgggatgtgcctaagtactaccctcctgtggaaccaccacccgcagcctggggcgaaatccgaaacgttgcggcgaatttatgtgtggattctaaacatggcgcaacaggaaccgaactgcgactggatatttgcgttaaggacggtagtgaacgaacctggtctcacgaacaattatttactttcggatggagggaagatatcaggccgggtgaaccactgcatactcgcaagttttgctttgatgccataagccacaatagccctgtaactctctacgattgtcacggaatgaaaggcaaccaattgtggggctacaggaaagatcgaacactgtttcatcctgtgtccaactcttgcatggactgcaaccctgctgaaaagaaaatattcatggcaagatgtgaccctctgtctgaaacccagcaatggatattcgagcacattaacatgactgtgctcgagaaatttaatcaccatgctaactcatag

SEQ ID NO: 31830 - DNA, 1569 bp, Artificial Sequence
  Description of Artificial Sequence: Synthetic coding sequence
atgaatattaacgatcttaagctgacactgtccaaggctggacaggagcacttgctgcgtttctggaacgagttggaggaggctcagcaggtagagctctatgcggaacttcaggcaatgaatttcgaagaactaaatttcttctttcaaaaagctatcgagggattcaaccagagcagccatcaaaagaacgtggatgcgcgcatggagccagtgccaagagaagtgttgggcagtgcgacacgcgatcaggaccagttacaggcttgggagagcgagggcctgtttcaaatcagtcagaataaagttgcggtgctcttgcttgccggaggccaaggaacgcggctgggagtggcatatccaaagggtatgtatgacgtgggcctgccctccaggaagacactatttcagattcaagcagagcgaatcctcaaactacagcaggtcgctgagaaatattacggaaacaaatgtatcatcccctggtacattatgacatcaggacgaacgatggaatcaaccaaggagttctttacaaaacataagtacttcggcttgaagaaggaaaatgttattttttttcagcaaggaatgctccctgccatgtcgttcgacgggaagataatccttgaagagaaaaataaagtatctatggcccctgatggcaacggggggctgtaccgcgccctggctgctcagaacatcgttgaggacatggagcagagaggtatctggtccatccatgtatactgcgtcgataatatcttggtgaaggtggctgacccgcggtttatcgggttctgcatccaaaagggtgctgattgtggcgctaaagtggttgaaaaaaccaatcctacggagcctgtcggcgtggtctgccgcgtggatggcgtctaccaggtggtggaatactccgagatcagtctggcgacggcacagaagaggagtagcgatgggcggctgctgttcaacgcgggcaatatcgccaatcatttttttacggtgcccttcttgcgggacgttgtaaacgtttatgagcctcagctccagcaccatgtggcccaaaaaaagatcccatatgttgacacgcaaggtcaactgatcaagccagataaaccaaatggaattaagatggaaaagtttgtgttcgatatatttcagttcgccaaaaagtttgtggtttacgaagttcttcgagaagatgagttttctcccctcaagaatgctgactcacagaatggcaaagacaatcctacgacagcacggcacgccctgatgagtttgcatcactgttgggttctcaacgcgggtggccactttatagacgaaaatggaagtcgactccccgccattccccgtagcgccaccaatggcaaaagtgagacaatcaccgcagatgtgaatcacaacctgaaggacgccaatgatgtgccaatccagtgtgagatctcgcctcttatatcctacgcgggcgagggcctcgagtcttatgtcgctgacaaggagttccacgctcctttgatcatcgacgagaatggcgtccacgagctggttaaaaacggaatttag

SEQ ID NO: 31831 - DNA, 1566 bp, Artificial Sequence
  Description of Artificial Sequence: Synthetic coding sequence
atgaacatcaacgacctcaagttgaccctgagcaaagcgggtcaggaacacctcctgagattttggaacgaactcgaggaggcccaacaggtcgaactatatgctgagctacaagcgatgaatttcgaagagctgaacttcttcttccagaaggccatcgagggattcaaccagtcttctcaccaaaaaaacgtggacgcccggatggaacccgtcccgcgggaggtcttgggcagtgccacaagggatcaggatcagctacaagcctgggaaagtgaaggtttatttcagatctcccagaataaggtggccgtgctgctactcgctggcggccagggcacacgtcttggggtcgcctaccctaaaggaatgtatgacgttggcctcccttccaggaagacccttttccagatccaagccgagaggatcctaaaacttcagcaggtagcagaaaaatattatggcaacaagtgtataatcccatggtacattatgacttcgggacgcaccatggaatccactaaagaatttttcactaaacacaagtattttggcctgaaaaaggagaatgtgattttttttcaacaagggatgttgcccgcgatgtcattcgacggaaagatcatcctggaggagaagaataaggtgtctatggctcccgacggaaatggtgggctgtatagagccctggctgcccagaacatcgttgaggatatggagcagcgcggaatatggagtatccatgtttattgcgtagacaatatcctcgtgaaagtggcagatcccaggtttatcgggttttgtatccagaagggggctgattgcggcgccaaagttgtggaaaagaccaatcctacagagcccgtcggggtggtctgtagagtagatggggtttatcaggtggtcgaatactctgagatcagcctagcaacggctcagaagagatctagcgatgggcgactgctttttaacgccggaaacatcgcaaatcattttttcacggtgccatttctcagagacgtcgtaaatgtgtatgagcctcagcttcagcaccacgtggcccaaaaaaaaatcccatatgtggacacccaaggacaactgatcaagccagacaagccgaatgggatcaagatggaaaaattcgttttcgacatctttcagtttgccaaaaagttcgtggtttatgaagtactgcgtgaagatgaattttcgcccctgaagaatgctgactcccagaacggtaaggacaatcccacaaccgcacggcatgccttgatgtcactgcatcattgctgggtcctcaatgcaggcggtcatttcatcgacgagaacggttcccggctgcccgctatccccagagctactaacggcaaaagcgaaaccatcacagcagatgttaatcataacctgaaggatgcaaatgatgtgccaatccaatgcgaaatcagcccacttatttcctatgcaggcgagggcttagagtcttatgtggccgataaagaatttcatgccccattaatcatcgatgagaacggggtccatgaactggtcaaaaacgggatatag

SEQ ID NO: 31832 - DNA, 1569 bp, Artificial Sequence
  Description of Artificial Sequence: Synthetic coding sequence
atgaatattaatgacctgaaattaaccctttctaaggcaggccaggaacatctcctgagattctggaacgagctagaggaggctcagcaggtagagctgtacgctgaacttcaggcgatgaacttcgaggaactcaatttcttcttccagaaggcaattgagggatttaatcagtcctcgcaccagaagaacgttgacgcgcgaatggaaccagttccccgcgaggtcctgggcagcgcaaccagggaccaggatcagctccaggcttgggagtcagaaggtctcttccagattagccaaaacaaggtcgctgtcctattattggctggcgggcagggaacccggcttggtgtggcataccctaagggtatgtacgatgtgggattgccctcacggaagacgttattccagatccaagccgaaagaattctgaagctgcaacaggtggccgaaaaatattatggcaataaatgcatcattccgtggtatataatgacttcagggcggacgatggagtctacaaaggaatttttcaccaagcataagtacttcggcctaaaaaaggaaaacgtcatattctttcaacaaggaatgctcccagccatgagttttgacgggaagatcatcctggaagaaaaaaacaaagttagcatggcccccgatggcaacggaggtctgtaccgcgcccttgctgcccagaacatagtggaggacatggagcagaggggcatttggtctatccacgtctactgtgtggacaatatccttgtcaaggttgcggacccacgcttcatcggtttctgtattcagaaaggagcggactgcggcgctaaggtggttgaaaaaaccaacccaactgagcccgtcggcgtggtatgccgcgttgacggagtgtaccaggttgtggaatactctgagatctcactagcgacagcccagaagcggtcgtctgacgggcgtctcctctttaacgctggcaatattgctaaccacttctttactgttccgtttctgcgggacgtggtaaatgtatacgagccccaactccagcatcatgtggcccagaagaaaatcccatacgttgacactcagggtcagctgatcaaaccagataagccaaacggaattaagatggagaagtttgtctttgatatcttccagttcgctaagaaattcgtcgtgtatgaggtcctgcgcgaagacgagttttcgccactgaaaaacgccgacagccaaaacggcaaagacaacccaaccacggcccgccatgctttaatgagtctgcaccactgctgggtgctaaatgccggcggtcacttcatcgacgaaaacggatcacggcttcctgccatccccaggtccgctaccaacggtaaatcagaaactattaccgccgacgtgaatcacaacctcaaggacgcgaacgacgtccccattcagtgcgagatctcaccgctcatttcctatgcaggggaaggccttgaaagctacgtggcagacaaagaattccatgctccactaatcatagacgagaacggggtgcacgaattagtcaaaaatggcatctag

SEQ ID NO: 31833 - DNA, 1518 bp, Artificial Sequence
  Description of Artificial Sequence: Synthetic coding sequence
atgaatattaacgacctgaaactgaccctcagtaaagccggccaagagcacctgctcagattttggaatgaattggaggaggctcagcaggtggaactctacgcagagctgcaggcaatgaactttgaggaactcaatttcttttttcaaaaagccatcgagggatttaaccagtcttctcatcagaagaatgtggacgcccggatggagcctgtcccccgggaggtcttggggtctgccaccagggatcaggatcagctccaggcatgggaatccgaaggcttattccaaatctcacaaaataaagtggctgttctgctgcttgctggggggcaaggcacacgtctcggcgtagcctaccccaagggtatgtacgatgtcggcctgccctcccgcaaaacccttttccagatccaagccgaacggatcctgaaattgcagcaggttgccgaaaagtactacgggaataaatgtattataccatggtatataatgacgtcgggtaggacaatggagagtactaaagagtttttcaccaaacataaatactttggcctgaaaaaagaaaacgttatctttttccagcagggcatgcttccggcaatgtcctttgacggcaagatcatcttggaggagaaaaacaaagtatctatggctccggatggaaatggggggctctaccgggctctggctgctcagaacattgtggaagatatggagcagagagggatatggagtattcacgtgtactgcgtggacaacatcctcgtgaaggtggctgaccctcggttcatcggtttttgcattcagaaaggtgctgattgcggtgccaaggtggtggagaaaacgaatcctacggaaccagtgggggttgtgtgtcgtgttgacggcgtctatcaagttgtggagtattctgagatttccctggcgaccgcacaaaagcggtcttcggatggtagactactcttcaatgctggaaacattgcaaaccacttctttacggttccattcttgagagatgtggtcaacgtctacgagccccagctgcagcatcatgtcgcacagaagaagattccctatgtagacacgcagggccagctgataaagcctgataagcctaatggaattaaaatggagaaatttgttttcgacattttccagttcgctaaaaaattcgtagtttacgaagtcctgcgggaggacgagttctctccccttaaaaacgccgacagccaaaatggcaaggacaaccccaccaccgctaggcacgctctgatgagcctgcaccactgctgggtgctcaacgcaggcggacactttatcgatgaaaatggcagcagactgcctgctatcccaaggcttaaagacgctaacgatgtgccaatccagtgtgagatcagtccccttatctcctacgctggtgaaggtctagaatcatatgttgctgataaggagtttcatgcacctctgatcattgacgaaaacggtgtgcacgagttggttaaaaatggaatctag

SEQ ID NO: 31834 - DNA, 663 bp, Artificial Sequence
  Description of Artificial Sequence: Synthetic coding sequence
atgaatattaacgatctaaagttgactctttctaaggctggccaggagcatctgctgagattctggaatgaactcgaggaggcccagcaggtcgagctctacgctgagctgcaggccatgaattttgaagaactaaacttcttttttcagaaggcaattgaaggcttcaaccagagctcccaccagaaaaacgtcgacgctcggatggagccggttccaagggaagtcttgggctccgctaccagagatcaggatcagcttcaagcctgggaaagtgaggggttgttccagattagtcagaacaaagttgcagtcctgttactggctggcggacagggcacccgcctgggagtagcctatccaaaaggaatgtatgatgtgggactgccttcacggaaaactctttttcagatccaggcagaaaggatcctgaagcttcagcaggttgccgagaaatactatgggaacaagtgtataataccctggtacatcatgacgtcagggcggacgatggagtccacaaaagagttttttacaaaacacaaatactttggtctgaaaaaagaaaatgttattttcttccaacagggcatgctgccggctatgtcctttgatggaaaaattattctggaggagaagaataaggtttcaatggcaccatag

SEQ ID NO: 31835 - DNA, 4776 bp, Artificial Sequence
  Description of Artificial Sequence: Synthetic coding sequence
atgtccctcctttgcgtacgggtgaagcgtgccaaattccagggatctccggacaaatttaacacttatgtgactctcaaggtgcaaaatgtcaagtccacgactgttgctgtgcgcggagatcagccaagttgggaacaggatttcatgtttgagatatcccggctcgacctcggcctcagtgtggaggtatggaacaaaggactgatttgggataccatggtgggcacagtgtggattgccctcaaaacgattcgacagtccgatgaggaaggtcccggcgagtggtccaccctggaggctgagactttgatgaaagatgatgaaatttgcgggactagaaaccctacgcctcacaagatcctcttagacactcgatttgagcttccttttgatattccagaggaggaagctcgctactggacatacaagtgggaacagatcaacgctttaggtgccgataatgagtactcaagtcaggaggagtcacagcggaagccactgcccacagctgcggcccagtgttcattcgaagatcccgacagcgcagtcgacgatcgtgatagcgattatcgctccgagacaagcaattccttcccccccccatatcatacggcctcccagcctaacgcttccgtgcaccagttccccgttcccgtacgttccccgcagcagcttctactgcaaggctctagccgagatagttgcaatgacagcatgcagtcatatgacctcgactatcccgaacggagagctatctccccaacttcctcaagtcgatatgggtcctcctgcaatgtaagccagggaagcagccagctctccgagctggatcagtaccatgagcaggatgacgatcatcgagaaacagactcaattcactcttgccattcctcccactctctgtctcgcgatggacaggccgggttcggtgaacaagagaaaccactggaggttaccggacaggctgagaaggaggccgcgtgtgagccaaaggagatgaaagaggacgctacaacgcatccccctcccgatctcgtcttacaaaaggaccattttctgggtccacaagagtctttccccgaagagaatgcatcttcacctttcacacaagcccgggctcactggatacgcgccgtcacaaaggtaagactccagttacaggagatcccagacgacggtgaccccagcctgccgcagtggcttccagagggccccgcagggggtctgtatggcatagacagcatgcctgacctgcgtaggaaaaaaccattgccattggtctcagacttgagtctggtgcaatcccgcaaggctggcattacgtcagcaatggctacccgaacctccctgaaggacgaggaactgaagtcccacgtttataaaaaaaccctccaggctctgatctatcccatctcatgtactacgccccacaacttcgaagtgtggaccgccactacaccgacgtattgctatgagtgcgaaggactgctttggggtatcgcccggcagggcatgaggtgcagcgaatgcggtgtgaagtgtcacgagaagtgtcaggatctgctgaacgctgactgcctgcagcgcgcggctgagaagagctgcaagcatggagctgaggatcgaacgcagaatataatcatggcaatgaaagatcggatgaagatccgcgagcgtaacaagcccgagatttttgaggtgattcgagatgtgtttaccgtcaacaaagcggcacatgtccagcagatgaagacagttaaacaatccgtgcttgacgggaccagcaagtggtctgccaagataacaatcacagtagtttgtgcccaggggctacaagccaaggacaagacgggcagctccgacccttacgtgacagtgcaggtttctaaaacaaaaaaacgcacgaaaacaatttttggtaacctgaacccagtttgggaagagaaatttcacttcgaatgtcacaacagcagcgatagaattaaggtgagggtctgggatgaagatgatgatatcaagagccgggtaaagcagcgcctgaagcgcgagagcgatgatttcttgggccagaccatcatagaagtgcggactctttccggggagatggatgtgtggtacaacttggaaaagcggactgacaaatctgcagtcagtggggcaattagacttcagataagtgtagagatcaagggcgaggaaaaggtggcaccataccatgtccagtacacatgcctgcatgaaaacctgtttcattatctgacagacatccagggttctggaggcgtgcggatccccgaggccagaggtgatgacgcatggaaagtgtattttgatgagacagcgcaggagattgtggacgagtttgcgatgcggtacggcatagagagcatttatcaggccatgacacactttgcgtgtctcagttccaagtacatgtgtcctggagtgcctgcggttatgagcacattgctggcaaacattaacgcttactacgcccatacaacagccagcacgaacgtgagcgcctcagacagattcgcagcaagcaattttgggaaagaacggttcgtgaagttgctggaccaactccacaactctttgcggatcgacttaagtacgtataggaataacttcccagctggctcacccgaacggctccaagatctgaagtcgactgtggacctcctgactagtataactttttttcggatgaaagtccaagagctgcaatcaccacctagggccagccaggtggtcaaagactgcgtgaaggcatgcttgaacagcacatacgagtatattttcaacaattgtcatgatctgtattccaggcagtatcagctgaaacaagagctcccacccgaagaacaaggaccctccatccgtaacctagatttctggcctaagctgattacattaatcgtatccatcattgaggaggacaagaacagctacacaccggtcctgaatcagtttccacaagagctgaacgtgggaaaggtgtccgccgaggtgatgtggcacctctttgcacaggatatgaagtacgcccttgaggaacacgagaaggaccacctctgtaagtctgcagactatatgaatctgcattttaaggtgaaatggctccacaacgagtacgtgagagatcttcccgtcttacaaggacaggtacctgaatatccagcatggtttgaacaatttgtcctccagtggttggacgaaaatgaagacgtgtcacttgagtttctgcggggggccctggagagagacaagaaggatggcttccaacagacctcagaacatgccttattctcatgctcagtggtggatgtgttcacccagctgaatcagagtttcgaaattatcaggaagcttgagtgccctgaccctagcatcctggctcattacatgaggagatttgccaaaaccataggcaaagtgcttatgcagtatgcagacatactgagtaaagactttcctgcttattgtaccaaagagaagctgccgtgcatactgatgaacaacgttcagcagctcagggtgcagctggaaaagatgtttgaagcaatgggggggaaggagctggacctggaggcagcagactcactgaaggagcttcaggttaagttgaataccgtcctggacgagctgtcgatggtttttgggaactcctttcaggtcagaatagacgaatgcgttaggcaaatggcagacattttaggacaggttagaggaacaggcaacgccagcccagatgcaagagcctccgcggcacaagacgcagacagtgtgctccgtcccttgatggatttcctcgacggcaacctgaccttgttcgcgacggtgtgcgagaaaactgtgttgaagagagtcctgaaggagctgtggcgcgttgtcatgaatactatggaaaggatgatcgtgcttccaccactgaccgaccagacaggcacacaactcatctttacggccgccaaggagctctcccaccttagtaagctgaaggaccatatggtgagagaggagacgcgaaatctgactccgaaacagtgtgctgtgctcgacctggccctggacaccataaaacagtacttccatgccggtggtaacggcctgaagaaaaccttcctggaaaaatcaccagacttgcagtccctccgttatgccctgagcctctatacacagacaacagacactctcatcaagaccttcgtgcggagtcagaccactcagggctccggcgtggacgacccggtcggcgaggtatccatccaggtcgatctcttcacgcatccgggaacaggggagcataaggtcacagttaaggtggtagcagccaacgatctgaaatggcagactgctgggatgttccgacccttcgtcgaggtaacaatggtgggaccccaccaaagtgacaaaaaacgaaagttcacaaccaagtctaagagtaacaactgggcccccaagtacaatgagacgttccacttcctgttaggcaatgaagaaggacccgagagttacgagctgcagatttgcgttaaagactactgcttcgcacgagaggatcgggtgcttggactcgccgtaatgcccctacgcgacgttaccgcgaagggttcttgcgcttgctggtgcccattgggaagaaagattcatatggatgagaccggattaacaatcttgcgcattctgtctcaacgttctaacgacgaagtagcgcgcgaatttgtgaaactgaagtccgagagccgatccactgaagaggggtcatag

SEQ ID NO: 31836 - DNA, 4833 bp, Artificial Sequence
  Description of Artificial Sequence: Synthetic coding sequence
atgtctcttttgtgtgtgcgggtgaagcgagctaagtttcaaggcagccccgataaatttaacacgtacgttacactgaaagtgcagaacgtgaaatcaacaacagtcgctgtccgcggcgaccagccctcatgggaacaggattttatgttcgaaatcagtcggcttgatctgggcctgtccgttgaagtgtggaacaagggtttaatatgggatacaatggtggggacagtttggattgcactgaaaacgatacgccagagcgacgaggagggcccaggcgagtggtccacactcgaggccgagactctgatgaaagatgacgaaatttgtggcacccgaaatcctaccccgcacaagattttgctagacactcgattcgaactcccattcgacatacccgaggaggaagcccggtattggacatataaatgggaacaaattaacgccctgggggctgacaatgaatacagtagccaggaggagtctcaacgcaagccacttccaacagccgcggcccagtgttcgtttgaggaccctgattccgctgttgacgaccgggacagcgattaccgaagcgaaaccagcaactcttttccacctccgtaccataccgcctcacaacccaatgcaagtgtccatcagttccctgtgcccgtacgctcaccacagcagcttctacttcaaggcagctcccgagactcttgcaatgactccatgcaatcctacgatctagactatccagagaggcgggcgatctcaccaacatcatcaagccgttacgggtccagctgcaacgtcagtcagggttcatctcagctgtccgaactggatcagtatcatgaacaagacgatgaccatcgggaaacggacagcattcattcctgccacagctcacacagcctctccagagatggtcaggctgggttcggcgagcaggagaagccccttgaggttaccggacaggctgagaaagaggctgcatgcgaaccaaaggagatgaaggaagatgccacgacgcacccaccccccgatttggtcctccagaaggatcattttctggggccccaggagtcctttcctgaggagaatgctagctcaccttttacccaggcgagggctcattggatcagagcagtgacgaaggtgcgtttacagctccaggaaattccggatgatggggatccgtctctgcctcagtggctccccgagggacctgcaggaggtctctatggaatagacagcatgcccgatttgaggaggaaaaaacccctccctttggttagcgacctgtccttagtgcagagccgcaaggcaggtataacctctgccatggctacaaggacctcacttaaggacgaagaactcaagtctcacgtctacaaaaagaccctgcaagctctgatttatccgatatcgtgcaccacccctcataattttgaggtatggacggcaactactcccacatattgttacgaatgcgagggcctcctttggggaattgccagacaaggcatgcgctgttcagagtgcggagtgaaatgccatgagaagtgtcaagacctgctaaatgcggactgcctgcaacgggctgcagagaagtcttgtaaacacggtgccgaggatcggacacagaacataataatggccatgaaggaccgtatgaagattcgtgaacgaaacaaaccagaaattttcgaagtgatacgtgacgttttcacggtgaacaaagcggcacatgttcagcaaatgaaaacagtgaagcagtctgttctggacgggacttctaagtggagtgcaaagatcaccatcaccgtggtttgcgcccaaggtttacaggcgaaagacaagaccggctcaagtgacccttacgttacggtacaggtcagcaaaacaaaaaaacggacgaaaacaatcttcggtaatcttaaccctgtctgggaagagaaattccactttgaatgtcacaactcatccgaccggatcaaagtgagagtctgggacgaagatgatgacatcaagagtcgagtaaagcagagattgaagcgagagtccgatgactttctcggacagacaatcatagaggtgagaacactgtccggagaaatggatgtatggtacaacttagagaagaggacagataaatccgccgtcagtggagccattagactgcagatttccgtggaaattaaaggtgaagaaaaggtcgctccgtaccacgtgcagtatacttgcctgcatgagaacctctttcattaccttaccgatatacagggctcaggaggagtgcgcattcccgaagccaggggagatgacgcttggaaggtttattttgacgagactgctcaggaaattgtggacgagttcgccatgcgctacggtatagagtccatctatcaagcgatgactcactttgcctgcctctccagtaagtatatgtgtcctggtgttcctgcggtgatgagcacactgttggccaacatcaacgcctactacgcccacacaaccgcgtcaactaatgtgtcggcatccgatagattcgccgcgtcaaatttcggtaaggagagatttgtcaagctgctggatcaactgcataattcgctccgtatagatctgtcaacctatcgcaacaattttccagccgggtctccagagaggctgcaagacctgaaatctactgtcgaccttttaacatcaatcacattctttaggatgaaggttcaggaactgcagtccccccccagggctagccaagtcgtgaaggactgtgtaaaggcttgtctcaattccacgtacgaatacatctttaacaattgccacgacctttattcgaggcagtaccagcttaagcaggagctccccccggaggagcagggaccatccattaggaacctggacttctggccgaaactaattaccctgattgttagcattatagaagaagataaaaattcttatacaccagtgctgaaccagtttccacaggagctgaacgtcggaaaggtttccgcagaggtcatgtggcacctgttcgcccaagacatgaaatacgccctggaggaacatgaaaaggaccacctgtgcaagtctgccgactacatgaacttgcacttcaaggtgaagtggctacacaatgagtacgtgagggatttgcccgtactgcagggtcaggtgccggaatatccagcctggtttgagcagtttgtgctccagtggctggatgagaacgaagatgtgagcctggaattcttacgcggcgcccttgaacgcgataagaaggacggattccaacagacttccgagcacgctctgtttagctgtagcgtggttgatgtgttcacccagctgaaccagagctttgagatcattcgcaagctcgaatgcccagacccaagcatcctggcccactacatgcggaggtttgccaaaacaattggtaaagtcttaatgcagtacgcggatatcctctccaaagactttcctgcctactgcacaaaggagaagctaccgtgcattctgatgaataacgtgcagcaactccgcgtgcaacttgagaaaatgtttgaagccatgggagggaaagaacttgatctggaggccgccgactccttaaaggaactccaggtcaagttgaacactgtactcgacgagctctctatggtgtttggaaactcattccaggtgcgcatcgacgaatgtgtgagacaaatggccgacattcttggccaagtaagaggaacaggcaacgcgagtcccgatgccagagcttccgcggcccaagacgcagactcagtgttgcggcccctgatggactttctcgacggaaatctgacactttttgccaccgtgtgcgagaagacagtcctgaagcgcgttttaaaggagctgtggcgcgtcgtgatgaatacaatggagcggatgatcgtgctccctcccctcacagaccaaactggcacacaactcatttttacagctgcaaaagaattgtcgcatctgtctaagctgaaagatcatatggtgcgggaagaaacaagaaatctgacccccaaacagtgcgctgtgctggatctggccctagacacgataaaacagtactttcacgcgggagggaatggattgaagaaaacctttctggagaaatcacctgacctgcagagcttacgatacgccctatccctctatacccagacaacagatactcttatcaaaacctttgtgcggtcacaaaccacacaggttcatgacggcaagggaattcggtttacggctaatgaagacataaggccagaaaaaggatctggggttgatgaccctgtgggcgaagtgtctatacaagtggacctatttacccaccccggaacaggagaacataaagtcaccgtgaaagtggtggccgcaaatgatctcaaatggcaaactgcaggtatgttccggccgtttgtcgaggtaaccatggtaggtcctcaccagagcgataagaagagaaaatttaccacaaaatccaaatctaacaattgggctcctaagtacaatgaaacatttcactttctgctcggcaatgaggagggccccgaatcgtacgaactgcaaatatgcgttaaggattactgctttgctagagaggacagagttctcggactggctgtgatgcctttacgggacgtgacagccaaggggtcctgcgcctgctggtgcccccttggccgcaaaatccatatggatgagaccggactgactattttaaggatactctctcagcggagcaacgatgaggtcgctagagaattcgtgaagttgaagagtgaatcccgctcaactgaagaaggcagttag

SEQ ID NO: 31837 - DNA, 4869 bp, Artificial Sequence
  Description of Artificial Sequence: Synthetic coding sequence
atgtccctgctgtgtgtcagagttaaacgagccaaattccaggggagccccgacaaattcaatacgtatgtcactcttaaggtgcagaatgtcaaaagcaccactgtggccgtgcgcggtgatcaaccaagctgggaacaagacttcatgtttgagatttctaggctggatcttggtctcagtgtggaggtgtggaacaagggactcatttgggatactatggtcggtactgtctggattgcactgaaaaccattaggcagtctgatgaggaaggccctggcgagtggtcgacacttgaagccgaaactctgatgaaggatgacgaaatttgcgggacacgaaaccccactccgcataaaattctcctcgacaccaggttcgagcttccctttgacatccctgaggaagaggcaaggtactggacatataaatgggaacagatcaacgcactgggagcggataacgagtatagttctcaggaggagtctcagaggaaacctctgcctactgctgcggctcagtgctgtcactggacatacctgggatggggcgaacaacagacgtttgaggacccggattccgcggtagacgatagagatagtgattatcgatctgagacctccaactccttccctccaccttatcacaccgcatctcagccaaacgcctctgttcatcagttccccgtgccggtgcgatcacctcagcagcttcttcttcagggatcatctcgagactcgtgtaatgatagcatgcagagttacgacttagactaccccgagagacgggccataagccctacgagcagtagccggtacggaagttcttgcaacgtctcccagggctcttctcaattgtctgagctagatcaataccacgaacaggacgacgaccacagagagacagactccatccactcttgtcattcaagccatagcctgtccagagatggccaggcaggctttggcgagcaggaaaagccattggaggttacaggccaggccgaaaaggaggccgcatgcgagccaaaagagatgaaagaagatgcaaccacacaccccccgccagaccttgttctccagaaagatcactttttgggtccacaagagtccttccccgaggagaatgcatcctcccccttcacccaggcgagggctcactggattcgcgctgttacaaaagtgcgactgcagctccaggaaatccctgacgatggcgacccttctttaccacagtggctcccagaaggtccggccggtggcctctacgggatcgactcaatgcctgatctcagaaggaaaaaacctcttccacttgtgtcagatttgtcactcgtgcagtcaagaaaggccggcattaccagtgccatggctacacgcacctctctaaaggatgaggagcttaagtcccacgtgtacaaaaagacactgcaggcgctgatttaccctatctcttgcaccacgccccacaatttcgaagtgtggactgcaacgacccctacgtactgctacgagtgcgaaggattactttgggggattgccagacagggcatgcgatgtagtgaatgtggagtcaaatgtcatgagaagtgccaagatctccttaacgccgactgtctccagagggctgcagaaaagtcctgcaagcacggcgctgaggacagaactcagaacattattatggctatgaaggacaggatgaaaattagggagcgcaacaagccagagatctttgaggtgatcagagatgtcttcaccgtgaacaaagcagcacatgttcaacagatgaagactgttaaacaatctgttctggacggaacgtcaaaatggagcgcaaaaattactattactgtggtctgtgcccaagggctacaagcgaaagacaagaccgggtcctctgatccctatgtaaccgtgcaagtttcaaaaacaaagaaacgtacaaagacaatttttggaaatcttaaccctgtctgggaggagaaatttcacttcgagtgccataattcgtcagatcgtattaaagtgcgcgtgtgggacgaagatgacgatatcaaatctagggtgaagcagaggcttaaacgcgagtccgatgacttcttgggacagactatcattgaagtccgaacactctccggcgaaatggacgtgtggtataacctggagaagaggacagataaatccgctgtgagtggggcaattcggttacagatcagtgtggagattaagggggaagagaaagtggctccttaccatgtgcagtatacctgcctgcacgaaaatttgttccactatcttacagatatacagggctctggtggggtgagaatacctgaggcccgaggcgatgacgcctggaaagtgtacttcgacgagacagcccaggaaattgtcgacgagtttgcaatgcggtacggaatagagtccatctatcaggccatgacccactttgcatgtcttagctccaaatatatgtgcccgggcgtgccagccgtcatgtcaactctattagctaacattaatgcctactatgcgcatactacggcttctacgaacgtgtcagcttctgaccgcttcgctgcttccaacttcggtaaagagcggttcgtcaagttattggatcaactgcataactccctgcgcatcgacctgagtacgtaccggaataattttccagccggctcacctgaaagactgcaggatctgaagagcactgtcgatctgctgacgtcaatcacattctttagaatgaaggttcaggagttacaatccccccctcgcgcttcgcaggttgtgaaggattgtgttaaggcttgcttgaactccacttacgagtacatctttaataattgccatgacctctactcccgccagtatcagctgaaacaggagttaccccccgaggagcagggaccctccattcggaatctggatttctggccaaagctcataacccttattgtaagcatcatcgaggaagacaagaactcgtacacacccgtgctgaatcaattcccccaggaactgaatgtagggaaggtgtccgccgaagttatgtggcacttgttcgcccaggacatgaaatatgcccttgaagagcatgaaaaagaccacctctgtaaatccgctgactacatgaacctccactttaaggttaagtggctgcataatgaatacgtaagggatcttcccgtcctgcagggacaggtacctgaatatcccgcatggttcgaacagtttgtgctgcagtggctggatgagaatgaggacgtttccctcgagttcctgaggggcgctctggagagagataagaaggatggatttcaacaaacctctgagcacgccctcttctcatgttctgtggttgacgtgtttacacagctgaaccagtccttcgagatcatccggaagctggaatgcccggacccctcgatcctagcccactacatgcgcagatttgctaaaaccatcgggaaggtcttgatgcagtacgccgatattctctcaaaagatttccccgcgtattgtaccaaggagaagctgccatgcatcttgatgaataacgtacaacaactgagggtacagttagagaagatgttcgaggccatgggaggaaaggagttggatctcgaggccgccgacagcctgaaggagctacaagtgaagcttaacacagtcttagacgagctaagtatggtgtttggcaattctttccaggtccgtattgatgaatgcgtgagacagatggccgatattcttggacaggtgcgggggactgggaacgccagccccgatgctagagcgtctgctgctcaggacgccgatagcgttctacgtccactgatggacttcttggatggaaatcttactcttttcgcgactgtgtgtgaaaagacggtgctgaagagggtcctaaaggagctttggcgagtcgtgatgaatactatggagcggatgatcgtgctgcccccccttacagaccagaccggcacacagttgatatttactgcggctaaggaattgtctcacctttctaagctgaaagatcacatggttagagaagaaacccgtaacctcacacctaaacaatgcgccgtgcttgacctggcactcgatactattaaacagtactttcacgccggaggtaacggactaaagaagactttcttggagaagtctccagacctacaaagtctccggtatgctctgtccctgtacactcagacgaccgacacattgatcaagacttttgtgcgctcccaaactacccaagttcacgacggtaaaggcattaggttcacagccaatgaggatatcaggccagaaaaaggatcaggcgtggatgaccccgtcggagaggtctccattcaggttgacctgtttacccatccaggcacgggggagcacaaagtaactgtaaaggttgtggcagccaacgaccttaagtggcagaccgccggaatgtttaggccctttgtggaagtgaccatggtgggcccccatcagtctgacaagaaaaggaagttcaccaccaagtccaagtccaataattgggctcctaaatacaacgaaactttccacttcctgctgggtaacgaggagggaccggaatcctacgagttacaaatctgtgtgaaagactattgctttgccagggaagatagagtgttgggtctggccgtgatgccactcagggatgtcacagcaaaggggtcatgcgcttgctggtgccctttgggaaggaagatccatatggacgaaaccggacttactatcctgcgaatcctctctcagcgcagcaatgacgaagtggctagagaattcgttaagctgaagtcagaatctaggtcaacagaggagggctcctag

SEQ ID NO: 31838 - DNA, 3594 bp, Artificial Sequence
  Description of Artificial Sequence: Synthetic coding sequence
atgcctgatcttagaagaaagaagccgctgcccttggtgtctgatcttgtgaagtctctggtacagtcacgaaaggcaggcatcacatcagccatggccacccggaccagtctgaaagacgaagaattgaagtctcacgtctataagaagacactgcaggctctcatctaccccataagctgcactaccccgcacaactttgaagtgtggactgccacaacccccacttactgctacgagtgtgaggggctgctttggggtattgctcgccagggtatgagatgcagcgagtgcggcgtcaagtgccatgagaaatgccaggatctacttaacgccgattgcctgcagcgggcggctgaaaagtcttgcaagcacggtgccgaagataggacacagaacatcattatggccatgaaggacaggatgaaaatcagggagcggaacaaaccggagatattcgaagtgatcagagatgtgttcactgtgaataaggctgctcatgtgcagcagatgaagacggtgaagcaatctgtattggatggcacctccaagtggagcgcaaaaattaccatcacggtcgtctgtgcccagggcctgcaggctaaggataaaactggaagctctgatccatatgtgacagttcaagtatccaagacaaagaaaagaacaaagaccatattcggcaacctcaatcccgtttgggaagaaaagttccactttgaatgtcataattcctcagatagaatcaaagtgagagtgtgggacgaagacgacgacatcaagagtagggtgaagcagagacttaaacgcgaatcggacgactttttgggtcagaccatcattgaagtgcgtactctttctggggaaatggacgtgtggtataacctcgagaaaaggactgacaaatccgctgtgtctggagcaatccgtcttcaaatttcagttgagattaagggagaggaaaaggtcgcaccataccacgtgcaatatacctgtctgcatgagaatttgtttcattatttgaccgacattcaggggtctgggggcgtccgcattccagaggccagaggtgacgatgcctggaaggtttatttcgatgagacagcacaggaaatcgtggacgaatttgccatgaggtacggaatcgaatctatttaccaggcgatgacacattttgcatgtttaagttctaaatatatgtgccccggagtcccagctgtgatgtctacactgcttgctaacattaatgcctactatgctcatacgaccgcaagcactaatgtgtctgccagcgacaggtttgctgcctccaactttggaaaagaacgattcgtaaagctattagaccagttgcacaacagtctaaggatcgacctttctacatacagaaataactttcccgccgggagtcctgaacggctacaggatctgaagtccacagtggatctgctgacgtccattactttcttccggatgaaagtacaggaattgcaatctcctccccgggcaagtcaggtggtgaaggattgtgtgaaagcctgcctcaatagcacttacgagtacatcttcaataactgccatgacctgtattccaggcagtaccaactgaagcaggaattgccccctgaagagcagggtcccagtatccgtaacctagacttctggcccaaactcataaccctgatagtgtcaattattgaggaggacaaaaattcctacacccctgtgctgaaccagtttccccaagaattgaatgtggggaaagtgtcggccgaagtgatgtggcacctgttcgcacaggacatgaaatatgccttggaggaacacgaaaaagatcacttgtgtaagtcggctgactatatgaatctccattttaaggtgaagtggctccacaatgagtacgtgagggacttacccgtgcttcagggtcaggtccctgagtatcctgcttggtttgagcagttcgtcctgcagtggctcgatgagaatgaggatgtcagtctggagttcctcaggggggccttggagcgggataaaaaagacggctttcagcaaaccagcgaacatgctctgttcagttgttcggtagtggacgtgtttactcagttgaatcagtcgtttgagatcatccggaaactagagtgtcccgaccctagtatcctcgcccactacatgcggcggttcgcaaaaacaattggaaaagtgctgatgcagtatgctgacatattgagcaaagatttcccagcatactgcacaaaagaaaagttaccatgtattcttatgaacaacgtacagcaactgagggtgcagcttgagaagatgttcgaggccatggggggaaaggagctggatctggaggctgctgacagtctcaaagagctgcaggttaagttgaataccgttttagacgaactgtcaatggtgttcgggaacagttttcaagtgaggatcgacgaatgtgtgaggcagatggccgacattctggggcaggttcgaggcaccggtaacgccagtccagatgcacgcgcttccgcagctcaggatgcagactccgtgctccggccccttatggactttctagatggcaatctgaccctctttgccacggtgtgcgagaagaccgtcctgaagagggttcttaaagagttatggcgcgtggtgatgaacacaatggagcgtatgatcgtcctccctcccctgacggatcaaacaggcactcagctgatcttcacagccgcgaaagaactcagccacttgtctaaactgaaggatcatatggtgcgtgaagagacacgaaatttaactcctaagcagtgcgcggtactggatctcgccttagacacgattaagcagtacttccacgctggcggcaacggtctcaagaagacgtttctggagaagtccccagacctgcagagtctccgctacgctttgagtctgtacacacagacaacggatacattaatcaaaaccttcgtacggagccaaactacacaggtccacgacggaaagggaatccgattcacggctaatgaggacattcgaccagagaaaggatcaggagtggacgatcctgtcggagaagtcagtatccaggtggacctatttacccaccctggaacgggggaacacaaggtcaccgttaaagtcgtagctgccaatgacctgaaatggcagactgctgggatgttcagacccttcgtcgaggtgaccatggtcgggccccaccaatctgataaaaagaggaaattcactaccaaaagcaagtctaataactgggcgcccaaatacaatgaaacattccactttcttctaggcaatgaggagggccccgaaagttacgagctccagatatgtgttaaagattactgcttcgcacgcgaagatcgggtgctgggattggcagtcatgccactacgagatgtgacagctaaaggttcatgtgcctgctggtgcccactgggaagaaaaatacatatggacgaaactggattgaccatactgcggatcttgtctcagagatctaatgatgaggtcgcacgtgagtttgtgaagctgaaatcagagtcgcgatcaacagaggagggatcatag

SEQ ID NO: 31839 - DNA, 6645 bp, Artificial Sequence
  Description of Artificial Sequence: Synthetic coding sequence
atggtggctaacttctttaaatctctgatactgccatacattcacaaactctgtaaagggatgttcaccaagaaacttggaaacacaaacaagaacaaggagtataggcagcagaagaaggaccaggacttccccacggctggccagacaaaatcgcctaaattctcctacacattcaaatcgaccgtcaaaaaaatcgcgaaatgctccagtacacacaaccttagtaccgaggaggacgaggcaagcaaagagtttagcctgtcacctactttctcttatagagtagctatcgctaacggattacagaagaacgccaaagtaactaacagcgacaacgaagatttacttcaggaactttccagcattgaaagcagctacagcgaatccctcaatgaactgaggtcatccacagaaaatcaggctcagtcaactcatactatgccagtcaggcggaaccggaaatctagttccagccttgctcctagtgaaggatcctctgacggagaaaggacgctgcacggactgaagctcggagccttgcgaaaactcaggaaatggaagaaatctcaggaatgcgtcagctccgattctgaattaagcaccatgaaaaagtcatggggcatacgaagcaagagcctcgatcgcactgttagaaaccctaaaacaaatgccttggagcccggcttctcctcttccgggtgcatcagtcagacacatgatgtaatggaaatgatttttaaggaattgcaaggaattagccaaatcgaaaccgagctctcagagctgaggggtcacgtcaatgcactcaaacattcgattgacgagatctcgagcagcgttgaggtggtgcagagcgaaatcgagcagctccggaccggcttcgtgcagagccgacgggaaacacgcgacatacacgattacattaaacatctgggacatatgggctctaaagcgtccctgaggtttttgaacgtaactgaagagcggttcgagtatgtcgagagcgtcgtgtaccagattctgatcgataaaatgggattttcggacgctcctaatgccattaaaatagagttcgcgcagcggattggacatcagcgggattgccccaatgctaaaccaaggccgattcttgtgtactttgaaacgcctcagcaaagggacagtgtcctgaaaaagtcttacaagctgaaaggcaccgggatcggcataagtaccgacattttgactcacgatatacgagaaaggaaggagaagggtattccgagttcccagacctacgaaagcatggcgattaagctcagtacccccgaaccaaagatcaaaaagaataactggcagtctcccgatgattctgacgaggatctcgagtcagacctgaaccgcaatagctacgccgtcctttctaagtctgagctactcacaaaggggagcacgagcaagccaagttccaagagtcatagcgctaggtccaaaaataagacagcgaactcatctcgcatctcaaacaagagcgactacgataaaatcagcagtcaacttcctgaatccgacatcttggagaagcagacaacaactcattacgcggatgctacgcccctatggcattctcaaagcgacttttttacagctaagctgagccggagcgagagcgattttagcaagctgtgccaatcatactccgaggacttcagtgaaaaccaattcttcacccggacgaacggcagctcactcctgtcctctagtgatagagagttatggcagaggaaacaggaggggactgccactctgtatgattcacccaaagaccagcacctgaatgggggggtccaggggatacagggccaaaccgagactgagaataccgaaacagttgattccggaatgagtaacggcatggtgtgcgcatctggcgacaggagccactacagcgacagccagttatcattgcatgaagatctgagcccatggaaggagtggaaccagggagccgaccttggcctggactccagtacgcaggagggctttgactacgaaacaaattctttgttcgaccaacagctggacgtttacaacaaggacctcgagtacctgggcaagtgccactcagatctgcaggacgactcagagtcctacgatctgacccaggacgacaactcctccccttgccctggcctcgataatgaaccccagggccagtgggtggggcagtacgattcttaccaaggggccaatagtaacgagctctatcagaatcagaatcagcttagcatgatgtaccgctcccagtcagagctccagtcggacgacagtgaggacgcaccccctaagagttggcactcaaggctgtccattgacctttccgacaaaaccttctcctttcctaaattcgggagtactttacagagagcaaaatctgccttggaggttgtgtggaacaagtcaacacagtcactctctgggtacgaagatagcggcagctctcttatggggcggtttagaaccctgtcacagtctactgccaacgagtcaagtacaacgctggattccgacgtctatacggagccttattattataaagcagaagacgaggaggactatacagaacctgtggctgataatgaaactgactacgtggaggttatggaacaggtcctagccaagctggagaacaggacaagtatcactgagacagacgagcagatgcaagcatacgatcatctcagttacgagaccccctatgaaactccacaggatgagggttacgatggaccagcagatgatatggtgtctgaagagggactggagcccctgaacgagacctccgccgaaatggaaatcagggaggacgagaatcaaaatatacctgaacagccggttgagattaccaagccgaaacgcattcggcccagcttcaaggaggcagcactacgcgcatacaaaaaacaaatggctgagcttgaagagaaaatcctcgctggcgattcatcatctgtggacgagaaggcaagaatagtgagtggcaatgatctagacgcctccaagttctccgctctacaggtctgtgggggggcagggggcgggctgtatggtatagatagcatgccagacctgagaagaaagaagactctgccaattgtgagagacgtggccatgactctcgcagctcgaaagagcggactatccctggccatggtgattcggacatccctgaacaatgaagagttgaagatgcatgttttcaagaagactctgcaggcactgatttacccaatgtctagtaccattccgcataattttgaggtttggacagctactacccctacctactgttatgagtgtgaagggctgctctggggtatcgccaggcaggggatgaagtgcctcgaatgcggcgtaaagtgccacgagaaatgccaagacttacttaacgcagattgcttacagagagccgctgagaagtcatccaaacacggagcagaagacaaaacgcaaacaataattactgctatgaaggagagaatgaagattagggagaaaaatagaccagaggtcttcgaggtcatccaggaaatgtttcagatctcaaaagaggatttcgtgcagttcacaaaggccgctaaacaatcagtactagacggaactagcaaatggagtgcaaagattacaattaccgtggtgagtgcccagggcctccaggcaaaagataagactggcagcagcgacccttacgtcactgtgcaggtggggaaaaacaagagaaggaccaagacaatttttggcaatctgaaccctgtctgggatgaaaagttctactttgagtgtcacaactccaccgaccggattaaagtccgggtgtgggacgaggacgatgatattaaatcccgagtcaaacaacacttcaagaaggaaagcgatgactttttgggccagacgattgtggaagtgcgcacactctccggtgaaatggatgtctggtacaatctcgagaaacgaactgacaaatctgcggtgtctggagccatacgtctcaagattaacgtcgagataaaaggagaggagaaagtcgcaccttaccacatacaatatacttgcctgcatgaaaacctctttcactacctgactgaggtgaaatccaatggtggggtcaagatccctgaagtgaaaggtgatgaagcatggaaggtgttttttgacgatgccagccaagagatcgtggacgaattcgccatgagatacggaattgagtctatataccaggccatgacacacttctcttgtttatcctcaaaatatatgtgccccggggtgccagctgtgatgagtactctactggccaacattaacgccttctacgctcatacaacggtgagcaccaatattcaggtgagcgcttcagatcgctttgccgccaccaattttggtcgggagaagtttatcaagctcctggatcagctgcacaatagtctacggatagacttaagcaaatatagagagaatttccctgccagtaataccgagaggttgcaggacttaaagtccactgtggatttattgacaagcataaccttcttcaggatgaaggtcttggaactccagagcccacctaaggcatctatggttgtgaaggattgcgttcgggcgtgtcttgacagtacatataagtacatatttgacaattgtcatgagctgtactcacaactgaccgatccatccaaaaagcaagacatcccccgcgaggatcaggggccgaccacaaaaaacttggacttctggccacagctgatcacactcatggtcaccatcatcgacgaagataagaccgcgtatactccagtcttaaaccaattcccacaggagcttaatatggggaaaatttccgctgaaatcatgtggactctgttcgccctggacatgaaatacgcactggaagagcatgagaaccagcggttgtgtaagtccaccgattatatgaatttgcacttcaaagtcaagtggttttacaacgagtacgtacgcgagctgccagcatttaaggatgccgtgcctgaatactcactgtggtttgagccctttgtgatgcaatggttggacgagaatgaagatgtgtcaatggaatttctgcatggtgcattgggcagagataagaaggatgggttccaacagacgagtgagcatgccctgttttcatgcagcgtcgtggatgtctttgctcagctcaatcagtcattcgaaataatcaaaaaattagagtgcccaaatcccgaagccctatcccacctgatgagacgatttgccaaaaccattaacaaggtgctcttgcagtatgctgccatcgttagctcagacttcagttcacactgcgataaggaaaatgtcccttgtatcctcatgaacaacattcagcagctcagagtacagcttgagaagatgtttgaatcgatgggcgggaaggagttggattcggaagcaagcaccattttgaaagaattacaagtcaagctcagtggagtgctcgatgaactgtccgtaacatatggtgagtcatttcaggtgatcatcgaggaatgtatcaagcagatgtcgttcgagctgaatcagatgagggcgaacggaaacactacaagtaacaagaactccgccgctatggatgccgagatcgtgcttaggtcgctgatggactttctggacaaaacactaagcctttcagccaagatctgtgagaagacggtgctgaaaagagtgcttaaggagctgtggaagctagttcttaataagatcgagaagcagattgtcttaccgcccctcacagatcagacaggcccacagatgatatttattgctgccaaagacctcggccagttgtcaaaattgaaagagcacatgattcgcgaggacgcccgcggcctcacgcctcggcagtgtgctataatggaagtcgttctggcaactattaagcagtattttcacgctggcggcaatggcctcaagaagaattttcttgagaagtctcccgatctacagagtctgcggtacgccctgtccctgtacacgcagacaacagacgccctcatcaaaaagttcatagatactcaaacatctcagagccgcagcagtaaggatgccgtgggacaaatttcagttcacgttgacatcacggccactcccggaacaggcgaccacaaggtgactgttaaagtcatcgcaatcaatgacttaaactggcagacaactgcaatgtttagacccttcgtcgaagtgtgcattttaggtccaaacctgggtgataagaaaaggaagcagggaaccaagacaaagtccaatacgtggtccccgaaatataacgagacttttcaattcatcttgggcaaggagaaccggccaggtgcatatgaactgcacctttcggtaaaggactattgtttcgcaagggaagataggatcatcggcatgacagtcattcagctgcagaacatcgccgagaaggggtcttatggtgcctggtatccacttcttaagaacattagtatggacgagaccggcctaaccattctgaggatattaagccaacgaacaagtgacgatgtggctaaagagtttgtccgcctaaagtctgaaactcgttccacagaagaaagcgcatag

SEQ ID NO: 31840 - DNA, 6639 bp, Artificial Sequence
  Description of Artificial Sequence: Synthetic coding sequence
atggtggcgaattttttcaaatccttaattctaccatatatccacaaactttgcaaaggaatgttcacgaagaagctcgggaacactaacaagaacaaagagtaccgccagcagaaaaaagatcaggattttcctacagcaggacagacgaaaagccccaagttctcgtacactttcaagtctaccgtgaaaaagattgctaaatgcagcagcacacacaacctaagcaccgaagaggacgaggcctctaaagaattcagtctttctcccaccttcagctacagggtggctatcgctaacggtcttcaaaagaacgctaaagttaccaacagcgataatgaggatctgctccaggagctatcaagcattgaatcttcatactccgaatcccttaatgaactgcggtctagcaccgaaaatcaagctcagtcgactcacactatgcctgtaaggagaaaccgaaaatcctcctcatcgcttgcacccagcgaggggagttctgatggcgaaaggacgctccacggacttaagctcggtgccctgcggaaattgcgcaagtggaagaagagtcaggagtgcgtatcgtctgatagcgagctgtccaccatgaaaaaaagctggggaatccgttctaaatctctggaccgtaccgtcaggaacccgaagaccaacgcgctggaacccggcttttcatcctccgggtgtatctcacagacacatgatgttatggaaatgatctttaaagagctgcagggcataagtcagatagagaccgagctatcagaactcaggggccatgttaacgcactcaagcactctatagacgagatttcctctagcgtggaggtcgtgcagagcgagatcgaacagttgaggacaggttttgtgcagtcgcgaagagaaactcgtgatattcacgattacatcaaacatcttgggcacatggggagtaaggcctcgttacggtttcttaacgtcacggaagagagatttgagtatgtcgagtccgtagtttatcaaatcctcatcgacaagatgggcttctctgacgccccaaacgcaattaagatcgaattcgcccagcgtattgggcatcagcgcgattgtcctaatgccaaaccacggcctatcttagtgtatttcgaaactccccaacagcgcgatagcgtgcttaagaaatcttataagcttaaagggacgggcatcggaatatcaactgatattttgacccacgatatcagggagagaaaggagaagggcattccaagctcccaaacatacgaatccatggctattaaactgtctacgccagagcctaaaattaaaaagaacaattggcagagccccgatgattctgacgaggatctggaatccgatctaaacagaaactcttacgctgtcctttcgaaatccgagctgctcacaaaaggatctacgtccaaaccctcctccaaaagtcattccgcacgttccaagaacaagacagccaactccagccgtatttctaacaagtccgattatgataagatctcatcccagctgccagagagtgacattcttgaaaaacaaaccaccacacactacgcggatgcgactcctctgtggcatagtcagtccgacttcttcaccgctaagctatctcgctctgagtcggacttctctaaactttgccagagctactctgaagacttctcagaaaatcagttcttcacacgtactaatgggtcaagtctgcttagtagtagcgaccgagaactgtggcaacggaagcaagaggggaccgccactctctacgactcaccaaaagatcaacacctgaatggaggcgttcagggcatacagggtcagactgaaaccgaaaatactgaaactgtcgattcaggtatgtccaatggaatggtttgcgccagcggagatcggtcccactactccgattcacaactctcactgcatgaagatctatcaccttggaaggaatggaatcaaggggccgacttgggactggacagctctacacaggagggtttcgactacgagacaaatagtctatttgaccaacagttggatgtgtataacaaagatctcgaatatctgggaaaatgccacagtgatctgcaagatgacagtgagtcatatgatcttacccaagatgataactccagcccctgtccaggactcgacaatgaaccacagggtcagtgggtggggcagtatgatagttatcaaggcgcaaacagcaatgagctctatcagaaccagaatcagttgtcgatgatgtaccgatctcagagtgaactgcagagcgacgactcggaagatgcgccgcccaagtcatggcattctcggctgtctatagacttatccgataaaaccttttctttccccaagttcggcagcacgcttcagagggcaaaatcagccctcgaggtggtctggaacaaatctacccagtccctatcaggatacgaagactcaggctcaagtctgatgggccggtttagaactctgtctcagagcactgctaacgagtcctcaaccaccttggattccgatgtttatacggaaccatactactacaaggcagaggatgaggaggactacaccgagcccgtcgctgacaatgagaccgactatgtcgaagtgatggagcaggtcttagcgaaactggaaaaccggacttcaattaccgagacagacgagcagatgcaggcttacgatcacttatcttacgaaaccccttatgaaacaccacaggacgaggggtacgacggaccagctgatgacatggtttcagaagaaggattagagcctctgaacgagacatctgccgagatggagattcgtgaggatgagaaccagaatattccagaacaacctgttgagatcaccaagcccaagcgcatacgtccttcttttaaggaggccgccctgagggcctacaaaaaacaaatggccgagctcgaagagaagatcctcgcaggagactccagctccgtggatgaaaaggctaggattgtctctgggaacgatcttgacgcctcgaaattcagtgcattacaggtctgcgggggcgctggaggggggctctacggcatagattccatgcccgatctgagacgaaaaaaaacgcttcccattgtgcgcgatgtcaccctagcagccaggaagagcggactgtccctggccatggttattagaacctctctgaataatgaggagctcaaaatgcacgtgttcaagaaaaccttacaggccctgatttatccaatgtcatccaccataccacataactttgaggtgtggaccgctaccacccccacttactgctacgaatgtgagggcttgttgtggggtattgcccgtcagggtatgaagtgccttgagtgtggtgtgaaatgtcacgaaaagtgccaagaccttctgaacgccgactgcttgcagcgagctgctgaaaagagctctaaacatggagcggaagacaagacccagaccatcatcacggccatgaaggagcgcatgaagatcagagagaagaaccggccggaggtcttcgaggtgatacaagaaatgtttcagatctctaaagaggactttgtgcagtttaccaaagcagccaagcagagcgtgttagacggcacgagtaaatggtccgctaagatcaccatcaccgtcgtgtctgcccaaggtctgcaggctaaggacaaaaccggctcctcagacccttacgtgaccgttcaggtggggaagaataagcggcgtactaaaacaatcttcggcaatctcaatcccgtgtgggacgagaagttttatttcgaatgtcataattccactgataggattaaagtgagagtctgggatgaggacgacgacatcaagtccagggtaaaacaacatttcaagaaagagtccgatgacttcctgggacagaccattgtggaggttaggacccttagcggcgaaatggatgtatggtacaatcttgaaaaacgcaccgataagagcgccgtttctggggccatccgcctgaaaatcaatgtcgagatcaaaggggaggaaaaagttgccccttaccacatccaatatacttgcctccacgaaaatctgttccactatctgacagaagttaagagtaatggaggggttaagattccggaggttaaaggtgatgaggcctggaaagtgttttttgacgacgcatctcaggagattgtagatgagtttgctatgaggtatggcattgaatcgatctatcaggccatgacccatttcagttgcttatccagcaaatacatgtgcccaggagttcctgccgtcatgtcaacattattagctaatatcaatgccttctacgcccacaccactgtgagcactaacattcaggtgagcgcctccgaccggttcgctgctacaaacttcgggagggagaaattcataaagctgctggaccagctgcacaactctttacgaatcgatctctctaagtaccgggagaacttcccagccagcaacaccgagagactccaggacttaaaatctactgtggaccttctaacaagcattacgtttttccgcatgaaggtgctggagctgcagtcacctcctaaggcctcaatggtggtaaaagattgcgtccgggcctgtctggattccacttataagtacatctttgataattgtcacgaactgtactctcaacttacagatccttctaagaagcaggatattccaagggaggatcagggtcctacaaccaagaatcttgatttctggccccagctgatcacactgatggttacaatcatcgatgaggacaaaacagcttacactcccgtcctgaatcaattcccccaagaactaaacatgggaaagatctccgccgaaataatgtggacgttgttcgccctagacatgaagtacgccctggaggagcacgaaaaccagagattgtgcaagtcaaccgattacatgaatcttcacttcaaagtgaagtggttctataacgagtatgtaagggagttgccagcctttaaggatgcagtgccagaatacagcttgtggtttgagcccttcgtgatgcagtggttggacgagaacgaggacgtgtcaatggagttcctccacggagcccttggtcgagacaagaaggacgggttccagcaaaccagtgaacacgctctttttagctgtagtgtggtcgatgtgttcgcccagctaaatcaaagcttcgaaatcattaagaaactcgagtgtcctaacccagaggctctgagccacttaatgagaagatttgccaagacgattaacaaggtccttctgcaatacgcagctattgttagctctgatttcagcagtcactgtgataaggagaacgtcccttgtatactcatgaacaatatccagcagctccgtgtgcagctggagaaaatgttcgagtctatgggcggaaaagagcttgatagcgaggctagcacaatcttgaaagaactgcaggtgaagctaagcggggtcctggacgagctatccgtgacctatggagagtcgttccaagttattatcgaagaatgcattaaacaaatgtcttttgagctcaatcagatgcgcgctaacggcaacacgacttcaaataaaaactccgccgccatggacgctgaaatcgtgcttaggagcttaatggacttcctggataagactctgtccctaagtgcgaagatatgtgagaaaaccgtgctcaagagggtgctcaaggagctgtggaagctggtgctgaacaagattgaaaagcagatcgtcctgcctcctttgaccgaccaaacgggcccccaaatgattttcatagctgccaaggatctggggcagctgagtaagctgaaggaacacatgatccgcgaggatgccagagggctaaccccaagacagtgcgctatcatggaggtcgtgctcgccaccatcaagcagtattttcacgccggagggaatggacttaagaagaatttccttgaaaagtcacccgacctgcagtccctgcggtacgccttgagtctatacacacagactactgatgccctgatcaaaaagttcatcgatacccagacttcacagagtcgctccagcaaggacgccgtcggacagatctctgtacatgttgatatcactgccacacccggaaccggtgatcataaggttactgtaaaggtgatcgcaatcaacgacctcaactggcaaactacggctatgttccgcccgttcgtggaagtgtgcatacttgggcccaacctgggagacaagaaacgcaagcaggggacgaagacgaagtctaacacttggtcacctaagtacaatgaaacattccagttcatccttggtaaggaaaacaggccgggagcctacgaactccacctgtccgtcaaggactattgtttcgccagagaggacaggatcattggcatgaccgtgatacagctgcagaatattgcagagaaaggtagctacggggcctggtaccctctgctaaaaaatatctccatggatgagaccggtttgacaatcctccgcattcttagccagaggactagcgatgatgtggcaaaggagtttgttaggcttaaatcggagactcgctctacagaggagagcgcctag

SEQ ID NO: 31841 - DNA, 6645 bp, Artificial Sequence
  Description of Artificial Sequence: Synthetic coding sequence
atggtagctaatttcttcaaaagtcttattctgccctacattcacaaattgtgtaagggaatgttcaccaaaaagctgggtaataccaataagaacaaagaatacagacaacaaaaaaaggatcaggactttccaacagccggtcaaactaagtcgcccaaattttcgtatacgtttaaaagtactgtcaagaaaattgctaagtgtagctctacacataacctgtcaaccgaagaagacgaagctagcaaggagttctctctctcccccaccttctcataccgagttgctattgctaacggactgcagaagaacgccaaggtgaccaattctgacaacgaggatttactccaggagctgtcgtcgattgaatcctcgtacagtgaaagtctgaatgagctgcggagctctacggagaaccaggcacagtctactcacaccatgcctgtgagacgtaaccgcaagtcaagctcctctctggcgccaagtgagggttcatctgatggggagaggacactgcatggcctgaagctgggcgctttgcgaaagctgcggaaatggaagaagtcccaagaatgcgtctcctcggatagcgaattgtctactatgaaaaagtcttgggggataaggtcaaagagcctggatagaaccgtacgcaatccgaaaacgaacgcccttgagcccggattctcctctagcggctgcatctcacagactcacgatgtgatggagatgatcttcaaagagttacaaggcatctcacaaatagagacagagctctccgaactacgagggcacgtcaacgcactgaagcactccatagatgaaatcagcagctcagtggaggtggtccagagcgaaatagagcaactgagaactgggttcgtgcagtctaggagggagacccgagatatccatgactatattaaacatctgggccatatggggtcaaaggcatcgctgaggttccttaacgtgacagaggaacgattcgagtatgtggagagcgtagtctatcaaattttgatagacaaaatgggtttttcagacgcccctaatgccataaaaatagaattcgctcagaggatcgggcaccagcgcgactgtcccaacgccaaacctcgcccaatactcgtgtactttgaaaccccacagcaacgtgatagtgtcctgaagaagagctataagttaaagggaaccggtatcggcattagtacagatatcttaacccacgatatccgcgaacgcaaggagaagggcatcccttcctctcaaacatacgagtcaatggcaattaaattgagtaccccagagccaaagataaagaagaataactggcagagccccgacgacagcgacgaggacctggaatctgacttaaaccgcaacagttacgcagtcctgtccaagagtgagctgctgacaaagggaagcactagtaagccgtcaagcaagtctcactcagccaggtctaaaaataagaccgctaacagctccagaataagcaacaagtccgattacgataagattagctcgcaacttcccgaaagtgacatcttggagaaacagacaacaacccactacgcagacgccactccactttggcactcccaatcagactttttcacggccaagttatctagatctgagtctgatttctctaaactgtgccaaagttatagcgaggatttttctgaaaatcagttctttacccggacgaacggaagttctcttctgagctcgtcggaccgggaactgtggcaaaggaagcaggagggcacagcaacgttgtatgatagtcccaaagatcagcacttgaacggaggggtgcaggggattcaagggcagacagagacagagaacactgagacggtggatagtggaatgtcaaatggtatggtgtgtgcttccggggacagatcccattactctgattctcagctgtcactacacgaagacctgtccccgtggaaggagtggaatcagggagcagacctgggcctagatagttcaacccaggaagggtttgactatgaaacaaacagcctctttgatcaacagctagacgtctacaataaagatctggagtatctaggcaaatgccatagtgacttgcaggacgatagcgagtcctatgacctgacccaggacgataactctagtccctgtccgggtctcgacaacgagccccaaggacagtgggtggggcagtatgacagctaccaaggtgccaatagtaatgaactctaccagaaccagaaccagctctccatgatgtacaggtctcagtcggagttacagtcagatgatagcgaagacgctcccccaaagtcatggcactcccgcctttcaattgacctctccgacaaaacctttagctttccaaagttcgggtcaaccctgcagagagctaaatctgccctagaagttgtgtggaacaagagtacgcagtctctttctggatatgaagacagcggatcaagcctgatggggcgcttccggacactttcacagtctacagccaatgagtcctccactactctggatagcgatgtatatactgaaccctactattacaaagcagaggatgaagaggactatacagaacccgtcgccgataacgagaccgactacgtggaggtgatggagcaggtgctagccaagctcgagaaccgtacgagtattactgagactgacgagcagatgcaggcatatgatcacctgtcctacgaaacaccttatgaaaccccgcaggacgaaggatacgacggtccagcagatgacatggtcagtgaggaagggctggagcctctgaatgaaacatctgctgaaatggaaattcgggaggacgaaaatcagaatattcccgagcaacctgtggagattactaaacccaagcgcattagacctagctttaaagaggcagccctacgcgcttacaaaaagcagatggctgaactcgaagagaaaatcctggctggcgtctcactcgacgtagatctggaggctcgcatcgtgtctggaaacgacctggacgctagcaagttctccgcccttcaggtgtgcggtggcgccgggggtggactttatggcatcgattctatgcctgacttgcggcggaagaaaaccttgcctattgttcgagacgtcctactaaccctggctgcccgaaagtctggattatcattggccatggtaattaggacttcactgaataacgaggagttaaaaatgcacgtgttcaagaaaacactgcaggcgctgatctaccctatgagctccaccataccgcataactttgaggtctggactgccaccacccccacgtactgctacgaatgcgaaggcctgctttggggcattgcccgccaaggaatgaagtgcttagaatgtggcgttaaatgccacgagaaatgtcaagacctgctgaatgcggattgtttgcagagagcagccgagaaaagttccaagcatggggcagaagataaaacacaaactatcataactgcaatgaaggagcgtatgaaaattcgggaaaagaaccgccccgaagtctttgaagtcattcaggagatgttccagataagcaaggaggattttgtgcagtttacgaaggccgctaaacagagtgtgctggacggtacctccaaatggtctgccaaaataacgatcacagtcgtctctgcgcagggcttgcaggcaaaagacaagacaggcagttccgacccatatgtcaccgtgcaggtaggtaagaataagcggcggacaaaaaccatctttggtaatctgaatcccgtgtgggatgagaaattctacttcgaatgtcataactcaaccgacagaatcaaagtcagggtgtgggacgaggacgacgacattaaaagcagagtcaaacagcacttcaagaaggaaagcgatgattttctcggtcagaccatcgtggaagttcggacactcagtggggagatggatgtgtggtacaacctcgagaagcggactgacaagtctgccgtcagtggtgcgatccggttgaagatcaacgtggagattaaaggagaggagaaggtagccccctatcatattcaatatacctgcctgcatgagaatcttttccattatctaacagaggtgaagagcaatggaggggttaaaattccagaggtgaagggggacgaggcctggaaggtgttcttcgacgacgcatcccaagaaatcgtcgacgagtttgccatgaggtatgggatagagtctatttatcaggcaatgacgcacttttcctgccttagcagtaaatacatgtgccccggcgtgcccgccgtcatgtcgaccttactcgcaaacattaatgcattttatgcacatactaccgtcagcactaatatccaggtcagcgcatctgatcgcttcgctgcaacaaactttggcagggagaagttcatcaaactcctggatcagctgcacaatagtctgaggattgatctttcgaaatacagggaaaactttcctgccagcaataccgagcgcctccaggatctgaagtccactgtggacttgttgacttccatcactttctttagaatgaaagttctggagctacagagccctcctaaggcctcgatggtggtgaaggactgtgttcgcgcgtgcctggattctacctataagtacatctttgacaactgccacgagctctacagtcagctgactgatccatccaagaagcaggacatcccacgagaggaccaaggaccaacaactaagaatttagacttttggccacaacttatcaccctgatggttacgatcattgacgaggataagacagcttacactccagtcctcaatcaattcccgcaggaattgaatatgggtaaaatatctgccgagattatgtggactctctttgcattagatatgaaatatgccctggaggaacatgagaaccagcggttatgcaagagcacagattacatgaacttgcatttcaaagtgaagtggttttacaacgagtatgtgagagagctgccagcatttaaagacgcagtcccggagtatagcctctggtttgagccattcgtgatgcagtggcttgacgagaatgaggatgtgtctatggagttcctgcacggagccctcggccgtgataagaaggatggatttcaacagacgtccgaacacgctctgttctcatgcagcgtggtggacgtgtttgcacagctgaaccagtcttttgaaattattaagaaactcgaatgtccaaaccccgaggccctgtctcatctaatgaggaggtttgcgaaaacgataaacaaggtgctcctgcaatacgccgccattgtatccagtgatttttcctctcactgcgataaagagaatgttccttgcatcttgatgaacaatatccaacagctgcgtgtgcagttggagaaaatgttcgagagtatgggtgggaaggagctggactcagaagccagcactatcctgaaggagctgcaggtcaaactcagcggagttctcgatgaattgagcgtgacctatggcgaatcctttcaggtgattattgaggagtgcataaagcagatgtcctttgaactgaatcaaatgcgcgccaacggcaatacaacaagcaataagaattccgccgcaatggatgccgagatcgtgctccggagcctcatggattttttagacaagacgttgtccctatccgctaagatctgcgagaagactgtgctgaaacgagtgctgaaggaactttggaagcttgtcctaaacaagatcgagaaacagatcgtcctgcctcctcttacggatcaaaccggacctcagatgattttcattgctgccaaagatctggggcaattaagcaaacttaaagagcatatgatcagggaagacgcacgcggcctaacaccaaggcagtgcgccatcatggaggtggtcctggcgaccattaagcagtattttcatgccggaggtaatggactaaaaaaaaattttctcgagaagtcccccgacttgcaaagtctaaggtacgccctgtccttgtatacccaaacgaccgatgccctcatcaagaagtttatcgatacccagacttcccaatcacggagcagcaaagatgcagttggccaaattagcgtgcacgttgacataactgctactcctggaaccggagatcataaggtgaccgtcaaggtcatcgccatcaacgacctcaactggcagaccacagccatgttcagaccattcgtggaagtgtgcatcttgggcccaaaccttggggataagaagaggaagcagggtacgaaaacgaaaagtaatacctggtcaccaaaatataacgagacattccagttcatcctaggaaaagaaaaccgtcccggcgcctacgagttgcatcttagtgtaaaggattactgcttcgcccgcgaagatcgcatcatcgggatgacagttatacagctgcagaacatagccgagaaaggatcctacggcgcctggtacccccttctgaaaaacatctccatggatgaaaccggacttacaattcttcggatactgagccagcggacttcagatgatgtggccaaggagttcgtgcgactgaagagtgaaactcggtctacagaagaaagtgcttag

SEQ ID NO: 31842 - DNA, 1557 bp, Artificial Sequence
  Description of Artificial Sequence: Synthetic coding sequence
atgtgtccacaggagtcttcatttcagccatcgcaatttcttctgctggtgggcgttccagtggcgagcgtgctgttgctagctcagtgcctccggtggcattgtccgcgccgactgctgggcgcgtgttggacactgaacggacaggaggagccagtttcacagcccacccctcagcttgagaatgaggtttctcgtcagcacctgcccgccactctaccagagatggtagctttctatcaggagctccacaccccgacccagggtcaaaccatggtcaggcagcttatgcacaagctactggtgttcagtgctagggaagtcgatcatcgcggcggatgccttatgcttcaggataccggaatttccttattgataccacctggcgccgttgccgtcggcagacaggaacgggtgagccttatcttagtctgggacctgtcagacgcccctagtctctcccaggcccagggtctagtgagtccggtggtggcgtgtggtcctcatggcgcttcctttttgaagccttgtaccctgacttttaagcactgcgccgaacagccgtcgcatgctcgtacctacagctccaacacaactctgctcgacgcaaaagtctggaggcccctcgggaggcccggggcccatgcctcacgcgacgaatgtaggatccacctctcacacttttcactctacacctgtgtccttgaggcacccgtggggagagaggcaaggaagtggctgcagctggctgtcttctgcagcccactcgtgcctgggcaaagccacctgcagctgcgaatttattttctcaacaataccccttgcgcattgcaatgggccctgaccaacgagcaaccacacggggggcggttgcgcggaccttgtcagctgttcgatttcaacggtgctcggggtgaccagtgccttaagctgacctacatcagtgaagggtgggagaacgtcgatgacagcagctgccaacttgtgccccatttgcacatctggcatggaaagtgtcccttccgttctttctgcttccggcgcaaggccgccgatgaaaacgaagattgtagcgcactcactaacgaaattatcgtcacgatgcacacattccaggacggcttggagaccaagtacatggagattctacgcttccaggcaagcgaggaggagagctgggcagcacctccgccggtgagccaacctccaccgtgtaaccggctacccccggagttgtttgaacagttaagaatgctattggaacctaattccatcactgggaatgattggcgcaggctagcgtcacacctggggctttgtgggatgaagattaggtttttgtcttgccagaggagtcccgccgctgctatcctggagttgtttgaagagcaaaacggttcactgcaggaactacattacttaatgaccgtgatggagcgtctggattgtgcttctgctattcaaaattacctctccgggactcatggcggcagtccgggacccgagcggggcggggcaagagacaaccagggccttgagctggacgagaaactctag

SEQ ID NO: 31843 - DNA, 1557 bp, Artificial Sequence
  Description of Artificial Sequence: Synthetic coding sequence
atgtgccctcaggagagttcttttcaacccagccagttccttctgctggttggagttcctgttgccagcgtgctgttgctggcacagtgcctcagatggcactgcccccgacgcctgttgggagcctgttggactttaaacgggcaggaggaaccggtgtctcagcccacccctcagcttgagaatgaagttagtaggcagcaccttcctgcaacccttccggagatggtggccttttaccaagaattgcacacgcccacccagggacagacaatggtccggcagttaatgcacaaattgctggttttttccgcaagggaggtcgatcatagaggcggctgcctgatgttacaagatacaggcatcagcttattgattccacccggagccgtggcggttggtcgccaagagcgggtcagcctcattcttgtctgggatctgtctgacgcaccgtcactgtcacaggctcagggactggtgtctccagtggtcgcatgtggcccccacggggccagtttcttaaagccatgtactctcacattcaagcactgtgctgagcagccctcgcacgcgcggacctactctagtaacacgaccctcctagatgccaaggtatggaggcctctgggacggcccggagcccacgccagtagggacgagtgtcggatccacttatcccattttagcctgtatacctgcgtcttggaggccccagtgggtagagaggcccgaaagtggttacagctagcagtgttttgttcacctcttgtcccaggccagtcccacctgcagctgcgaatatactttctgaataatactccctgtgccctccagtgggccctgacaaatgagcagcctcatggcgggcggcttcgaggtccttgccagctcttcgactttaacggtgccaggggcgaccagtgtttgaaacttacctacatcagtgaggggtgggagaacgtggatgattcttcttgtcagctagtcccacatttgcacatttggcacggtaagtgtcctttccgcagtttttgtttcagacgcaaggcagctgatgaaaacgaagactgcagtgcgcttacaaatgagattatcgtgacaatgcacacctttcaagatgggctggaaacgaagtatatggaaatcctgaggttccaagccagtgaagaggaatcttgggccgctccccccccagtatcacagcctccgccttgtaacaggctcccccccgagttgttcgaacagcttcgtatgctgttggaaccaaattccatcactggcaacgattggagaagattggcgtcccacttgggtctctgcggcatgaaaatcaggttcctgtcatgccaacggtctcctgcggccgcaatcctggaactgttcgaagaacaaaatggaagcctgcaagaattgcattatctgatgaccgtgatggagaggctggattgcgcaagcgcaatacaaaattatttatcgggcacccacggcgggtcccctgggcctgagagagggggggctcgggataaccagggcctggagctggatgaaaaactttag

SEQ ID NO: 31844 - DNA, 2862 bp, Artificial Sequence
  Description of Artificial Sequence: Synthetic coding sequence
atggggcgtgcagcagccaccgccggtggtggcggcggcgcgcggcggtggctcccgtggctaggcttgtgcttctgggccgccggtacagcagcagcccgcggtactgataatggagaagcactgccagagagcatcccttccgccccggggacactgccgcacttcatagaggagccagacgatgcatatattattaagtctaaccccatcgcgctgagatgcaaggcccgccccgcaatgcagatttttttcaaatgcaatggtgaatgggtgcatcagaatgagcatgtcagcgaagagactctggatgaatcaagtggtcttaaggtgagggaggtatttatcaatgttactaggcagcaggtcgaggattttcatggcccagaggattattggtgccagtgcgtggcttggtcacatcttggcacaagcaagtcgcggaaagctagcgtcaggattgcttacctcagaaagaattttgagcaggacccacaggggcgcgaggtccctattgaggggatgatcgtgctccattgccgaccgcctgagggcgtgccagccgcggaggtggagtggcttaagaatgaggagcctatagactccgaacaggacgaaaatattgacacccgggcagatcacaacctgatcatcaggcaagcccggctgtctgactctggtaactatacatgcatggcagccaatatagtcgctaagaggagatccctgtccgctaccgtggtggtctatgtgaacggcggttggagctcctggaccgagtggagcgcatgcaacgtgaggtgtggcagggggtggcagaaacgcagcagaacctgcacaaatcctgcacccttgaatgggggcgctttctgtgaaggtatgtccgtccagaaaatcacgtgcacgagtttatgtcccgttgacgggagttgggaagtgtggtccgaatggtctgtttgcagccccgaatgtgagcacttacgcatcagggaatgtaccgcgcctccaccacgtaatggcggtaagttttgtgagggtctgtcccaggagtcggaaaactgcactgatggtctgtgcattctagataagaaacctctgcatgaaatcaagccccaatcgattgagaacgcttcagacatcgcactgtactccggcctgggcgctgcggtggtggctgtggccgtgcttgtgattggggttacactgtatcgcagatctcaatccgactatggcgtggacgtaatcgacagctccgccctgacaggagggtttcagacttttaattttaagacagtccggcagggcaattcactgcttctgaattcagccatgcagccagacctgacggtgtctcggacatactctgggcctatatgtcttcaagacccccttgacaaggaacttatgacagaatcttctctatttaaccccctgtcggacattaaagttaaagtccagtccagttttatggtgtctcttggagtctccgagcgcgccgagtaccacggcaagaatcatagcagaacgttccctcatggaaataaccattctttctccaccatgcaccctcgtaacaagatgccatatattcagaacctcagcagtctacctactaggaccgaattgagaactactggcgtgtttggccacctgggaggaagactggtcatgccgaatacaggcgtctccttactgatcccacatggtgctatacccgaggagaactcctgggagatttacatgagcatcaaccagggcgaaccctccctccaatcagatgggtccgaggttctgctctctcctgaggtcacatgcgggcctcccgatatgatcgtaacaacaccctttgcactaaccataccgcattgtgcagacgtttcaagcgaacattggaacatccatctgaaaaagagaacccagcagggaaaatgggaagaggttatgtccgtggaggatgagtccacatcctgctactgccttttggatccttttgcctgccatgtgctgttagactctttcgggacatacgccctgaccggagaacccattacagactgcgccgtcaagcagttaaaggtggccgttttcgggtgtatgagctgtaatagtttggattacaacctgagggtctactgtgtcgacaacacaccctgtgctttccaggaggtggtaagtgatgaaagacatcaaggaggacaattgctggaggaacccaagctgctccactttaagggtaatacgttctcactgcagatttctgtcctggatattcccccgtttctctggaggatcaaaccattcactgcttgtcaggaggtgccattcagcagagtctggtgttcaaataggcagcccctccactgcgctttctctctggagaggtatacaccaaccacaacccagctctcttgtaagatttgcattaggcagcttaaaggccacgaacagattctccaggtccaaacttcgatccttgagtctgagcgggaaacaattacttttttcgcacaggaagatagcacttttcccgcccagaccggtcccaaggcatttaagataccttactccattcgccagcgcatctgtgccacatttgatacaccaaacgccaaagggaaggactggcagatgctggcccagaagaatagtatcaatcgcaatctttcatacttcgcaactcagtcctcaccgtcagccgttatcctgaacctgtgggaggcacggcaccaacatgacggggatctagattcgctcgcatgcgccctagaagagattggtcggactcacaccaaactgtccaatatctccgagtctcagttggacgaggctgatttcaattattcacgccagaatggcttgtag

SEQ ID NO: 31845 - DNA, 2847 bp, Artificial Sequence
  Description of Artificial Sequence: Synthetic coding sequence
atgatcctggtgttagtgaaagccttatctgatgtttgtgccggtacatcagggtttctgcttgatttctctagccagacttcccccgggactgataatggggaggccttgcccgagtcaattccttctgcacccggtacattgccccactttattgaggaaccagatgatgcctacattattaaaagtaaccccatcgctctgcgttgtaaggcccgcccggcaatgcagatcttctttaaatgcaatggcgagtgggtacaccagaatgagcacgtttcagaagaaacattagatgagtccagcgggctcaaggtgagggaagtgttcatcaatgtaacaaggcagcaggtggaggactttcatggacccgaagattactggtgtcagtgtgttgcgtggtcccacctgggcacatctaaatcccggaaagcatccgtccgcatagcttatctcagaaagaactttgaacaggatcctcagggccgggaagtcccaattgagggcatgattgttctgcattgtagacctccggagggggtcccagctgccgaagtagagtggctcaagaatgaggagccaatcgactccgaacaggatgagaatattgacactagagccgatcataatctgattattaggcaggccagactttccgattccggcaattatacctgcatggcggcaaatatcgtggctaaaaggaggagcttaagtgcaacggtcgtagtatatgtaaatggtggctggtcatcctggactgagtggagcgcatgcaacgtgagatgcggccggggatggcagaaacgaagcagaacctgtacgaacccagctccgctcaatgggggagccttctgcgaaggaatgtctgtacagaagattacatgcacgtccctgtgccctgtggacggttcttgggaggtgtggagcgagtggtccgtttgctctcctgagtgtgaacatctccggatcagagagtgcactgcccctcctccccgaaacggggggaagttttgtgagggactctcacaggagtccgagaactgtactgatggcttgtgcatactggataaaaaacctctccacgaaatcaagccccagagcatcgagaatgctagtgacatcgcgctgtacagcgggctgggagccgcagttgtggcagtggccgttctggtgatcggcgttacactgtatcgccgatcccaatccgattatggagtcgatgtgattgatagctcagccctgactggagggttccagacattcaacttcaagactgtgaggcaaggtaattcattgttgttaaactctgctatgcagcccgatctgacagtctcacgcacgtacagtggcccgatttgtctgcaggaccccttagacaaggaactgatgaccgaatcttccctgttcaatcctctctccgatataaaggtcaaggttcagtcctcttttatggtgagcctcggggtgagcgaacgcgccgaatatcacggcaaaaaccactcgagaacgttcccccacggtaataaccatagcttctcaacaatgcaccccagaaacaaaatgccgtatatccaaaacctctcatctctaccaacaagaactgaactgcgaaccacaggggtcttcggacatttaggcggtcgattagtgatgccgaacactggcgtttcgctgcttatcccacacggcgctatccccgaggagaacagctgggaaatatacatgtctatcaatcagggagagccgtcacttcagtctgacggatctgaagttttgctttctcccgaagtcacgtgcggcccgccagatatgattgtgacaaccccattcgcactcacaattcctcattgtgctgacgtgagctccgaacattggaatattcacttaaaaaagaggacccagcagggaaaatgggaagaagtgatgagcgttgaggatgaatcgaccagctgttactgtctgttggatccttttgcttgccatgtgctactggactcatttgggacctatgccttgactggggagcccatcacggactgcgctgtaaaacaacttaaagtggctgtgttcggttgcatgtcatgtaactccctggattacaacctgcgcgtctattgcgtggataacactccatgcgcatttcaggaggtagtttcagacgaacgccaccagggagggcaattgctcgaagagcccaaactgctccatttcaagggcaacacctttagcttacagatttcagtgctagatattcccccatttctgtggcggattaagcccttcacagcctgtcaggaggtgcccttcagccgggtgtggtgtagcaatcgtcagcccctgcactgtgccttcagtctggaacgatacacaccgacaaccacacagctttcctgtaagatttgcatccggcagcttaaagggcacgaacaaattttgcaagtgcaaacttctatactggaaagcgagagagagaccattacattctttgcccaagaggattcaactttccccgcgcaaacaggcccgaaggctttcaagattccttattctattagacagcgtatctgcgcaaccttcgacacccctaatgccaagggcaaggattggcagatgctggcccaaaaaaactccattaacaggaacctgtcctactttgcaacacagtcgagtccgagcgccgtgatcctcaatttgtgggaagcccgtcatcaacacgacggggatctcgacagcctcgcctgtgccttagaggagataggccgtacccacacgaagctaagtaatatctccgaaagccagctagacgaagctgatttcaactacagcaggcaaaatggcttgtag

SEQ ID NO: 31846 - DNA, 780 bp, Artificial Sequence
  Description of Artificial Sequence: Synthetic coding sequence
atgctgcccagtacaagcgtaaactcccttgttcaaggaaacggggtgctgaactccagggacgctgctcgtcacaccgcaggcgcgaaaaggtataaatacttgcgccggctctttagattccgccagatggattttgaatttgccgcgtggcaaatgctgtatttgttcacctcccctcaacgcgtgtacaggaacttccactacagaaagcagacaaaagatcagtgggccagagatgaccctgcattcttggttcttctgagtatatggctctgcgtgtcaacaatcggctttggatttgtactggatatgggcttctttgaaaccatcaagttgcttttatgggtggtgttaattgattgcgtgggcgtgggactgctcatagccaccctgatgtggttcatctcaaataaatacttggtgaaaagacaaagccgagactacgacgttgagtgggggtatgcttttgacgtacatcttaacgccttctaccctctcttggtgattttacattttatccagctgttttttatcaaccacgttatcctgacagacacgtttattggatatttagtgggcaatacgctctggctggttgctgttgggtactacatttatgtgacctttctgggctattcagccctgccatttctgaaaaacaccgtcatcctgttatatcccttcgcccccctaatcctgctctatggcctgagcctggccctgggttggaattttacacacacgctctgcagcttttataaatatcgagtgaaatag

SEQ ID NO: 31847 - DNA, 831 bp, Artificial Sequence
  Description of Artificial Sequence: Synthetic coding sequence
atgtttttgcagaacacttgtaagcggaatgtattcttaccatcccggaagatgctgcccagcacatccgttaatagtttagtgcagggaaacggagttctgaactcaagggacgccgccagacatacagccggcgctaagcggtacaaatatctgaggcgcctgttccgatttcgacagatggatttcgaattcgccgcttggcagatgctctacctgttcacaagtcctcagagagtgtatcgaaatttccactatagaaagcagaccaaggaccaatgggcaagggacgatccggcattcctggtgcttctgtcgatctggctgtgcgtttcaactatcggattcggctttgttttggatatgggcttctttgagacaatcaaactcctcctctgggtggttttgatagactgcgtgggggtgggcctgcttattgccacattgatgtggttcatctcaaacaaatatctggttaagaggcagtcccgagattacgatgtcgagtggggttatgcattcgatgtgcacctgaatgccttctaccccctgctggtgatcttgcattttatacagttgtttttcatcaatcatgtcattttaaccgatactttcataggctacctggtcggcaatactctctggttggttgcggtcgggtactacatttacgttacctttctcggttattccgccttaccgttcctgaaaaacacagtgattctgctgtatccgttcgctccactcattctcctatatgggttgtctctggctctcggatggaatttcacccatactttatgctcgttctacaagtatagggtcaaatag

SEQ ID NO: 31848 - DNA, 831 bp, Artificial Sequence
  Description of Artificial Sequence: Synthetic coding sequence
atgttccttcagaatacctgcaagaggaatgtgttccttccatccaggaaaatgctgccgtccacgtccgtcaatagcttggttcaggggaacggcgtcctgaactcccgggatgctgccaggcataccgccggggcgaaacggtacaagtacctgcgtcgtctcttcagattccgacagatggactttgagtttgccgcttggcagatgttgtatttattcaccagcccgcaacgcgtttaccgaaactttcattaccggaaacagacaaaagaccaatgggcccgcgatgaccctgccttccttgttctcttatcgatctggctgtgcgtgtccaccataggattcggcttcgtcctagatatgggtttttttgaaaccataaagttgctattgtgggtcgtgctgatcgattgcgtgggggtggggttattgatagctaccctgatgtggttcatcagcaataaatatcttgttaagagacagagtagggactatgacgtggagtggggctatgctttcgatgtgcacctgaacgcgttttacccactgctcgttatcctccactttatccagctgttctttatcaaccacgtgatcctgacagatacgtttattgggtacctggtaggcaataccctatggctggtcgcagtggggtactacatctacgtgaccttcttgggttacagtgcactgcctttcctgaaaaacaccgtaatcctgttgtacccctttgccccactgatcctgctctacggtctctctttagctctcggatggaatttcactcataccctatgtagcttctataaataccgcgtgaagtag

SEQ ID NO: 31849 - DNA, 3111 bp, Artificial Sequence
  Description of Artificial Sequence: Synthetic coding sequence
atggaggtggtgggcgattttgagtatagtaagcgagacctggtcggtcacggagcctttgccgtggtattccgggggcgtcatcggcagaaaaccgactgggaagtagcaatcaagagtatcaacaagaaaaatctctccaagagccaaatcttattggggaaggaaattaagatcctgaaagagcttcaacacgagaatattgtggcattatatgacgtccaggaactgccgaactcagtattcctggtcatggaatactgcaatggcggcgatctggccgactaccttcaggctaaggggacactgagtgaggacacgatcagagtgtttctgcatcagattgctgccgccatgagaattcttcacagtaaaggcattatccaccgcgatctgaagccccagaacatccttctgtcctacgctaaccgaaggaagtctagcgtgtcaggtatccgtattaagattgcagactttggtttcgcccgatacttacatagtaatatgatggccgcaacactctgcgggtctcctatgtatatggcccccgaagtgattatgagtcagcattacgatgccaaagccgatctttggtctatcgggacagtcatttatcaatgccttgtgggcaaaccgccatttcaggctaacagtccccaggacctgaggatgttttacgaaaaaaacagaagtttaatgccctcgatccctagggaaaccagcccttacttggctaacctgttgttgggcctcctgcagaggaatcaaaaggaccggatggattttgaagcctttttcagtcacccgtttttagaacagggacctgtgaagaaatcatgtccagttccagtccccatgtactccggatccgtgtcagggtcatcctgtggaagctctccaagctgtaggtttgccagcccgccctcactgccggacatgcagcatattcaggaggagaacttgagcagcccaccattaggcccccccaactaccttcaggtaagtaaagatagtgcttctacatcaagtaagaattctagctgtgacacagacgacttcgtgctcgtgccccacaacataagttccgaccattcttgtgatatgccagttggaaccgcagggcgcagagcatcaaacgagtttctggtgtgcggcggccagtgccagccaacggtgtcaccccattctgagactgccccaattcccgttccgacgcaaattcgaaactatcaacggattgaacagaatctgacgtctaccgctagcagtggaactaatgtacacggctcaccgagaagcgcagtcgtccgtcgctctaatacctctcccatgggctttctgagacccggctcttgtagccccgttcccgctgacaccgcccaaacagtgggccgccggcttagtacgggttcctcaagaccatactcaccctcaccactggtcgggaccataccagaacagttctctcagtgctgttgtggtcaccctcagggccacgactctcggtctcgcaatagttcaggctcacctgtaccccaggcccagagtccccaatccctgcttagcggggccaggctgcagagcgcaccgaccctgaccgacatttatcagaacaagcagaaactgcgaaagcagcactcagaccctgtgtgcccctcccatactggcgccggctattcctactccccgcagccatcacgcccaggaagtttaggaacaagccccacgaagcacctcggctcttcccccaggagttccgattggttcttcaagacgcccctgcctacaatcattggctctcccactaaaacaacagctcctttcaagatcccaaagacacaagctagctctaatcttctcgctctggtaacacggcatgggcctgccgaggaacaatccaaggatggaaatgaacctcgtgaatgcgcacactgcctacttgtacagggaagcgagcggcagagggctgagcagcaaagcaaggccgtgttcggaaggtcagtgtctacaggcaaactctcagatcagcagggcaaaaccccaatctgtcggcaccaggggagtacagattcactgaacactgaaagacccatggatatcgcccctgccggggcctgcgggggtgttctggctcccccggctgggactgctgcgagctctaaagcagtgctatttaccgtcgggtcccccccacacagtgccgcagcacccacttgtacccatatgtttctgcgtactcgcaccactagtgttggaccctcgaacagcggtgggtctctttgtgccatgagtgggcgtgtctgcgttgggagtccccctggaccaggtttcggttcctctccacccggggccgaggcggctccgtcactgagatatgtcccgtatggagccagtccaccatcccttgagggcttaataacattcgaagctcctgaactgccggaagagactctgatggagagggagcacactgacacacttcgtcatcttaatgtgatgctcatgttcactgagtgtgtgttggacctgacagctatgaggggcgggaaccctgaactttgcactagcgctgtttctctgtatcagattcaggagagcgtcgtagttgatcagattagtcagctctcaaaggattgggggagggttgaacagttggtgctgtatatgaaagccgcccaacttctggctgccagcttacaccttgccaaagctcagataaaaagcgggaagcttagcccgagcaccgcagtgaagcaggtggtgaaaaaccttaatgagcgctacaagttttgcataaccatgtgcaagaaactgacagaaaaacttaaccgctttttcagcgacaaacagcgtttcatcgacgagattaactcggtcaccgccgagaaactgatatataactgtgctgtagagatggtccagtccgccgccttggacgagatgttccaacaaaccgaggacatcgtgtacaggtaccacaaagcagccctgctactggagggcctgagtcgcatcctgcaggatcctgcagatatagaaaacgtgcacaaatacaagtgcagtatcgaacggcgtctctcagctctttgtcactccactgcgaccgtctag

SEQ ID NO: 31850 - DNA, 3111 bp, Artificial Sequence
  Description of Artificial Sequence: Synthetic coding sequence
atggaagtggtcggcgactttgaatattcaaagcgagacctggtgggccatggagcgttcgccgtcgtatttagaggcagacacaggcagaaaacagattgggaggttgccatcaaatcaattaataaaaagaatctttctaaatctcagattcttctgggaaaagaaatcaagattctgaaggagctccagcacgaaaacatagtggccctctatgatgtgcaggagctgccgaacagcgtcttcctggtaatggagtactgcaatggcggcgacttagccgattaccttcaggcgaaaggaacgctgtcagaggatacaattcgggttttcttgcatcaaattgccgcagccatgagaatcctacactccaaaggcatcattcaccgggacctgaaaccacaaaatatacttctcagttatgctaataggcggaaaagctccgtctccggcatcaggatcaagatcgccgactttggtttcgccagatatcttcactccaatatgatggccgccactctttgtggctcccccatgtacatggcccctgaggttatcatgtcacagcattatgacgccaaggccgacctgtggtctattgggactgtcatctaccaatgtctagttggtaagccgccgttccaggcaaactcgccacaggatcttagaatgttctatgaaaaaaaccgcagcctgatgccgtctatcccaagggagacttccccatacctggcaaacctgctcctggggttgctgcagcggaaccagaaggacagaatggactttgaagccttcttctctcatccctttctggaacagggccctgttaagaagtcctgtccagtaccagtgcccatgtatagcggaagtgtcagtgggtctagctgtggatccagtccatcttgtcgtttcgcttcaccgccgtccttgcctgacatgcagcatatccaggaggagaatctgtcctccccaccactgggtcccccaaactacttgcaagtgtcaaaggattctgctagcactagcagcaagaactcttcttgcgacaccgacgattttgttttagtgccccacaatatatcttctgatcactcctgcgatatgcccgtcggtacagctggacggagggcgtctaatgagttcctcgtgtgcggaggccagtgccagcctacagtttccccacattcagaaactgcccccataccagtgcccactcagatccgaaactatcagcgcatagagcagaatctgacctctaccgcttcctccggaacgaacgtccatggaagtccccgtagcgctgtggtgaggaggagcaatacctctcctatgggctttctgagacctggatcatgctctccagtacctgcggacacggcccaaacggtggggcgacggctgagtaccggatccagccggccctacagtccttcgcctctcgtaggtactatccccgaacagttctcacagtgttgctgcggccatccacagggacacgactcccggagccgcaatagcagcgggtctccggtcccgcaggcacagagtcctcagtccctattgagcggagcccgcctccagtcggccccgactctgaccgatatctatcaaaacaagcagaagctgcgcaagcagcactccgatcctgtgtgccccagtcacactggcgccgggtattcttacagcccgcagccctcacggcccggatcactcggtaccagccccaccaagcacttaggaagctccccacggagtagtgactggttctttaagacgcctctgcctaccatcattggatccccaacgaaaacaacagccccgtttaagatccccaaaacccaggccagcagcaatttgttagccctcgtgacacggcacgggcccgctgaggagcagagcaaggacgggaacgagcccagggaatgcgctcattgtctgcttgtgcagggttctgaacgtcagcgggccgagcagcagagtaaggccgtgtttggtaggagcgtgtctactggaaaattgagtgatcagcaaggcaagactcctatttgtcggcaccagggcagcactgattcactgaacaccgagagaccaatggatatcgcaccagcaggagcttgtgggggcgtgctggcgcccccggccggaactgctgcatccagtaaggctgttttattcactgttgggtcgccaccccactcagcagccgctccaacttgcacccacatgtttctcagaacccggaccacctctgtcggcccctctaatagcggggggagcctgtgcgctatgtcaggccgggtctgtgtggggtctcccccagggcctgggttcgggtcatcccccccaggcgcagaagcggcccctagtttgcgctacgtaccttatggagcttcacctccgagcctggaaggactgattacttttgaggcgcccgagcttcccgaagaaactcttatggaacgcgagcacaccgatactctgagacacctgaatgtgatgttgatgttcaccgaatgcgtcctagacttgacagccatgaggggaggaaatcccgaactatgtactagtgccgtgtccctctatcagattcaggagagcgtcgtcgttgatcagatctcccagctgagcaaggactgggggcgggtagagcagctcgttctttatatgaaagcagctcaattactcgcagcctcattgcaccttgcaaaagcacagattaagagcggcaagctgtcgcctagcacagcagtgaagcaagtggttaagaacctgaatgaaaggtataagttttgcattactatgtgcaagaagttgactgaaaaattgaacaggttcttttcggacaaacagaggttcatagatgaaataaactcagtgacggcagagaaacttatctacaactgcgccgtggaaatggtgcaatccgctgcactagatgagatgttccaacagacggaagacattgtttaccgttatcacaaagccgctcttctgctggagggattgtcccggatccttcaggatccggctgatatcgaaaatgtgcataagtataagtgcagtattgaaagaaggctaagtgccctatgtcacagcacagctactgtctag

SEQ ID NO: 31851 - DNA, 2532 bp, Artificial Sequence
  Description of Artificial Sequence: Synthetic coding sequence
atgcggctgcccgacctgagaccttggacctccctgctgctcgtagacgcggccttactctggctattgcaggggccactcggaaccctgctcccgcaggggttgcccggtctctggctggagggaacgcttagactgggtggactctggggattgcttaagctgaggggccttttgggcttcgtagggacactgctgctgcctttgtgcctggccacaccgctgacagtatccttacgtgccctagtcgctggggctagcagggctcctccagctcgggtagcgagcgccccctggagctggctgctcgtcggttacggagcagctggcctaagctggagtctgtgggctgtgctgtcgccccccggcgctcaagagaaggaacaggatcaggtgaacaataaggtcctgatgtggagactgttgaagctcagtcgtccagatctgccattactggtggctgctttcttctttctcgtgctcgccgtcctgggcgagacgctcataccccactacagtggaagagtgatcgatatcctgggaggggacttcgacccccacgctttcgcttctgcaatcttttttatgtgtctcttcagctttggttccagcctgtctgctggatgtcgcgggggatgctttacctacaccatgagcaggatcaacctcaggatccgtgagcaactgtttagttcactccttcggcaggacctaggcttctttcaagaaactaagaccggcgagctgaattcccggctgtccagcgacactacccttatgtcgaactggcttccactgaatgcgaacgtgcttctccggtcgctggtcaaggttgtcggactttatggattcatgttgtctatcagtccccgtctcacactgctgtccctacttcacatgccgtttactatcgccgccgagaaagtgtataatacccggcaccaggaggtccttcgcgaaatccaggatgctgtcgcaagagctggtcaagtggtgagggaggctgtggggggccttcaaacagtgagatcattcggggcagaagaacacgaagtctgccgatacaaggaggctctcgagcagtgtagacagctttattggcgcagggacctggaacgggcattgtacctattggttagaagggtgttacacttgggtgtgcagatgctgatgctgtcttgcgggctccagcagatgcaggatggggagctaacccagggctctttattgtcgtttatgatataccaagagtctgtgggctcgtacgtgcagacattggtttacatctacggcgacatgctgagcaacgtgggcgcagccgaaaaggtattttcttatatggatcggcaacccaacctgccaagccccgggactctggccccaactacgctgcagggggttgtgaagtttcaggatgtgtccttcgcataccctaaccgtccagaccggcccgtcttgaaagggctgacctttactctacgccccggtgaagtgactgccctggtgggacccaatggctcgggcaagtcaaccgtggctgcactgcttcaaaatctttaccagccaacagggggccaggtgctgttagatgaaaagcccatcagccagtacgagcactgctatcttcactcccaagtcgtgtctgtggggcaggaaccagtgctcttctctggcagtgttaggaataatatcgcatatggactccaatcctgtgaagacgacaaggttatggccgccgcgcaggccgcccacgctgacgatttcatacaggagatggagcatggtatatacaccgacgtgggggaaaaggggtcccaactggctgccggccaaaagcaacgattagcaattgctcgagccctggtgcgggatccccgcgtgctgatacttgatgaggccaccagcgctctggatgtgcagtgcgagcaggccaacggcttctgggtcgggcccctcggtgggggcagcgctagcgagtccgatcccactgggtttctccacgactcgcggcacaggctgagctccgacgtagggatgttcgtggccctcaccaagctcggccaacctgatgcggagcagtggaactcgcgtcttgatctcttagaacgatcccgccaggcagttgacggcgtgtgtcgccacaactatcgtctcggagccccattcactgtggggcggaaagtgcagcccgaagtcactgtttaccctgaaaggacccccttattgcaccagcataatctgctccattgctcagtgacaggcttctacccaggggacattaaaattaagtggtttcttaacggccaggaggagagagctggcgtcatgtctacagggcctattaggaatggggactggacctttcagaccgtggtgatgcttgagatgacacctgagctaggccatgtgtatacctgcctcgttgaccatagttctctccttagccccgtgagcgtggagtggcgggcgcagtctgaatatagctggcgtaagatgctatcaggcatcgccgcctttctcctagggctctag

SEQ ID NO: 31852 - DNA, 2247 bp, Artificial Sequence
  Description of Artificial Sequence: Synthetic coding sequence
atggaccagcaccaacatttgaataagaccgctgaatctgcctcatcggagaaaaagaaaacgaggaggtgtaacggtttcaagatgttcctggcagccctctcttttagttacattgccaaagcactcggcggcataatcatgaagatcagcatcacacagatcgagaggcgctttgacattagcagctccctagcaggtttaattgacggctccttcgagatcggaaaccttcttgtaattgttttcgtctcgtatttcggatctaagctgcacagacctaagcttatcggaatcggttgtcttctgatggggacaggatctattctaacatctctgcctcactttttcatgggatattatcgatatagtaaagaaactcacatcaacccctccgaaaacagcacatccagcttgtccacatgtctgatcaaccagacactttctttcaatggcacctcccccgagattgtggagaaagattgcgtgaaggaaagcggttctcatatgtggatctatgtctttatggggaacatgctgcggggaataggtgagacaccaattgttccactaggcatctcatacattgacgacttcgccaaagagggccatagttccctttacctcggatccctaaatgccatcggcatgatcggccctgtcataggctttgcgctgggtagtctattcgccaaaatgtacgtggatatcggatacgttgatctgtccacaatcaggatcacacctaaggattcacgatgggtgggggcctggtggctcggctttttggtgagtggcctgtttagcattattagcagcattcccttttttttcctgcctaagaatcccaataaaccgcagaaggagcgaaagattagcctcagcctccacgtgctaaagaccaatgatgatcggaaccagactgcaaacctgaccaatcaggggaaaaatgtgacaaaaaacgtgacaggctttttccagtcactgaagtcaattctgactaaccctttgtacgtgatctttctcctactaaccctgcttcaagtgagcagctttattggctcattcacttatgtgtttaagtacatggaacagcagtatggccaatccgcgtcacacgctaatttcttacttgggatcattactatacccaccgtagctacaggcatgttcctgggggggtttatcatcaaaaagtttaagctctcacttgtgggaatcgcgaagttcagctttctgacctccatgatctcgttcctcttccagctgctctatttccccctgatttgcgaaagcaaatcagttgcaggcctgactctgacttacgatgggaacaacagcgtcgcctcacacgtggacgtgcccctctcttactgtaacagtgaatgcaattgtgacgagtcccagtgggagccagtctgtggcaacaatgggatcacatacctgagtccttgcctggctggatgtaagtcatcttctgggattaagaagcatacagttttctacaattgcagctgcgtcgaagttactgggctacagaacaggaattactccgctcatctgggtgaatgtcctcgggataatacttgtacgcgcaaatttttcatctatgtggccattcaggtgatcaattctttattcagcgcaacaggagggacgacatttatcctcctgacggtcaagatagtgcaacccgagttaaaagcgctggccatgggtttccagagcatggttattcggactctaggcggaatcctcgcgcccatctactttggcgccctgatagacaagacatgcatgaaatggtctaccaattcttgcggggcacagggcgcctgtcgcatctataactcagtattttttgggattgttcagcctgagctgaaagctctggcaatcgggttccatagtatgattatgaggtcattaggtggaattttggtacccatctacttcggggcccttatcgataccacctgtatgaaatggtccacaaatagctgtggggccaggggagcttgtaggatctataacagcacctacctcgggcgggccttcttcggtcttaaagttgcactcatatttcccgtcctggtcctcctgactgtgttcatttttgtagttcgaaagaagtcacacggcaaggacaccaaggtgctcgaaaatgaacggcaggtaatggatgaagccaatctggagttccttaatgacagcgagcactttgtgccatctgctgaagaacagtag

SEQ ID NO: 31853 - DNA, 582 bp, Artificial Sequence
  Description of Artificial Sequence: Synthetic coding sequence
atgtcaccctgcggcggggaggacatcgtcgctgatcatgtcgcctcctatggcgtcaacctgtaccagtcgtacggcccttcagggcagtacactcatgagttcgacggggacgagcagttttatgtggaccttggccgaaaggagactgtgtggtgtttgcccgtgctcagacagttccgcttcgacccacagtttgcactgaccaatattgccgtgctgaagcacaatctgaattcattaatcaaaaggagcaacagcaccgctgctaccaacgaggtgccagaagtgaccgtcttttccaagagtcctgttaccctcggacagcccaacatccttatatgcctggttgacaatattttcccccctgtagtgaatataacctggctctccaacggacacagcgtcacagagggagtgtccgagacctcattccttagtaagagtgaccactcattttttaagattagctatctaaccttactgcctagcgccgaggagtcttacgattgtaaagtcgaacattgggggctagacaagcccttactcaagcactgggtgcacggatttttgagcttttag

SEQ ID NO: 31854 - DNA, 762 bp, Artificial Sequence
  Description of Artificial Sequence: Synthetic coding sequence
gggtgtctggggaaacgcatgatacttaacaaggctttaatgctcggcgctcttgctttaacaaccgttatgagtccctgcggcggggaggatattgtcgccgatcatgtggcttcatatggggtgaacctgtaccaaagctacggccctagcggacagtacacacatgagtttgatggcgacgaacagttctacgtggatctgggtaggaaggagactgtttggtgtcttccagttctccgccaattccgtttcgacccacagtttgccttaacaaacatcgccgtgctgaaacataacttgaactcccttatcaagcgctccaacagtaccgcggcaacaaacgaggtgcctgaggtgacggtgttcagtaaaagtccagtgacccttgggcagcctaacattctcatttgcctggtggacaacatatttcctcctgtcgtcaatataacttggttaagtaatggtcactccgtgacagaaggtgtgagtgaaacatcgttcctgagtaagagtgaccactcgttcttcaagatctcctaccttaccctgctgcctagcgccgaagagtcatatgattgcaaggtcgaacattggggtttggacaaaccactccttaagcactggggaaaagatgaatttcatcacttcctgatgcttagctgcctgtcaagctctgagctccccgctttttactcctatatacctaaactcgtgttccacacctcctgggtgtctttcttcttgattttcttcttctag

SEQ ID NO: 31855 - DNA, 441 bp, Artificial Sequence
  Description of Artificial Sequence: Synthetic coding sequence
atgatcctcaacaaagccctcatgttaggagccctggcactaaccaccgtgatgagtccttgtggcggcgaggatatagtggcggatcatgtggcttcctatggagtcaacctgtaccagtcatacggaccttcggggcagtatacccacgaattcgatggagatgagcagttctatgtggacctgggacgcaaagagactgtgtggtgcttgcctgtattacggcagtttcgcttcgatcctcaattcgctcttaccaacatgtgtattgccatatacagatccagaagggttgatctgcttcacgatctagcactgttcagcgggccaatttaccatattcccttcctgcttcagatgtttcttttgagcccgttgttatgggacctaaattgttacatctgcagcgaacttacgaacgcatttgaactgttcccatag

SEQ ID NO: 31856 - DNA, 765 bp, Artificial Sequence
  Description of Artificial Sequence: Synthetic coding sequence
atgatcctgaataaggcgctgatgctcggtgctttggcccttaccaccgtgatgtctccatgtgggggtgaagacatcgtggctgatcacgtggcttcctacggcgttaacctataccagtcctatggaccctccggacagtacacacatgagtttgatggggatgagcagttctacgtggacctcggacgtaaggaaaccgtgtggtgcctgcccgtcctacgccagttcaggttcgatcctcagtttgcgttgaccaacatagcggttctgaaacacaacctcaatagcttgatcaagcggagtaactccacagccgctaccaatgaagtgcccgaggtaacggtcttttctaaaagtcccgtcaccctgggtcagccaaacattctgatctgcctagtggacaatatattcccaccggtggttaacatcacttggctcagtaacgggcactcggtgactgaaggtgtttccgaaactagttttctgtctaaatctgaccacagcttctttaaaatttcttacttgactttactgccttccgccgaggagtcctatgactgcaaagtggagcactggggcttagacaagcccttgctgaagcactgggagcccgagatacccgctccaatgagcgagctaaccgaaacagtggtgtgcgccctcggtctcagcgttggactggtgggaattgttgtcggaactgtattcatcattcgtgggctcagatctgtgggagccagccgccaccaggggcctctttag

SEQ ID NO: 31857 - DNA, 498 bp, Artificial Sequence
  Description of Artificial Sequence: Synthetic coding sequence
atgacacggctctgcctgccgagacctgaagcaagggaggacccaatcccagtgccgccccgtggcctcggagcaggggagggatctggcagcccggtgagaccaccagtgtctacctggggtccgtcttgggctcaactcctggattctgtcctgtggctgggggccctcggactgacaatccaggctgtattttccacaacgggcccggcattactcctgcttctagtttctttcctgaccttcgacttattgcatcggcctgcaggccatacacttcctcagagaaagctgctgacaagggggcagagccagggagcaggcgaaggacctggtcaacaagaggcgctcctgttacagatgggtaccgtcagcggccagctaagcttgcaggacgcattgctactgcttttaatgggcctcggtcccctgctgcgagcatgcgggatgcctctcactctcttgggactcgcattctgtttacatccctgggcctag

SEQ ID NO: 31858 - DNA, 513 bp, Artificial Sequence
  Description of Artificial Sequence: Synthetic coding sequence
atggtgacagtgctggatcagatgaaagctggcacatataagcttactttcgataccgaggggtattggagaaaaagaggccaggagtcattctaccctcatgtggaggtggtccttactatcacgtcaaaagcacagaagtttcatgtgcctctggtgttacaccatctccccagggagctggaaaggcgactggctgcgggagggtgcctgccagtgcccgcacgatggctgcacccccctagccctcagcagtcgggcttgtgtgctcaccagggagctttggcccatcactttttgggcaaatccaggccacctggcgagagtcattgggccgccgtgacacaggtcagcatgaaactggtgcccgcacccgctaagctatccatcaggtgggacaattcaggcgctaaaacgggatccaccgccagacattgtccaaatccacaggtgtccgctggacattccgagaaggtgcctcctacagtggtgggcggggaaacgagagagtag

SEQ ID NO: 31859 - DNA, 780 bp, Artificial Sequence
  Description of Artificial Sequence: Synthetic coding sequence
atggctgcctctcgcctggaactgaacctggtcaggctcctgagtcggtgtgaagccatggctgccgaaaagcgtgatcctgacgagtggcgattagaaaagtacgtaggcgctctggaggacatgctgcaagccctaaaagtacatgcatcaaagccggctagcgaagttattaatgagtactcctggaaggtggactttttgaagggcatgctgcaggccgagaagctgaccagcagctcggaaaaggcgctggccaaccaattcttggcccctggccgcgtccccactactgctcgtgaacgcgtccccgctacaaagactgtgcatctccaaagtcgtgcccgctatacatcagagatgcgatcagaactcctggggactgactccgccgagcctgaaatggatgttcggaaacggaccggggttgcggggtctcagcctgttagcgaaaagcaactcgcagcggaattagaccttgtattacagcgacaccagaacctccaggaaaaactggcggaagagatgttaggcctagctcgctccctgaagactaacaccctcgcagcacagtctgtgatcaaaaaggataatcagactctcagccactccttaaaaatggctgaccaaaatctagagaagctgaaaaccgagtccgaacggctggaacaacacacccagaaatccgtcaactggctcctctgggccatgttgatcatagtgtgctttatttttatcagtatgattctgttcattcggatcatgcctaagctcaagtag

SEQ ID NO: 31860 - DNA, 177 bp, Artificial Sequence
  Description of Artificial Sequence: Synthetic coding sequence
atggcaggtcctgagtcagacgctcaataccagtttacaggcatcaagaagtatttcaacagttacaccttgaccggccggatgaactgtgtgctagctacatatggttctattgcgctgattgtgctctacttcaagttaaggtctaagaagacaccagcagtgaaagcaacgtag

SEQ ID NO: 31861 - DNA, 177 bp, Artificial Sequence
  Description of Artificial Sequence: Synthetic coding sequence
atggcaggccctgagtcagatgcacagtaccagttcactggcataaagaagtatttcaacagctatactctgaccggcaggatgaattgcgtccttgcaacctatggcagtatcgccctcatcgtcttatattttaagcttagatccaaaaaaacccctgcggtgaaagcaacttag

SEQ ID NO: 31862 - DNA, 177 bp, Artificial Sequence
  Description of Artificial Sequence: Synthetic coding sequence
atggccggacccgagtcagatgcacagtaccagttcaccgggataaaaaagtacttcaacagctatacactcaccggacggatgaactgtgtgctcgcgacctatggtagcatcgctctgatcgtgctttactttaaactgagaagtaaaaaaaccccagccgtgaaggccacatag

SEQ ID NO: 31863 - DNA, 177 bp, Artificial Sequence
  Description of Artificial Sequence: Synthetic coding sequence
atggctgggcctgagagtgacgcccagtatcagtttactgggatcaagaagtacttcaacagctacactttgacaggtcggatgaattgtgtgctagcaacctatgggagcatagctttaattgtgctgtattttaagctgcgatccaagaagacccccgcagtgaaggccacatag

SEQ ID NO: 31864 - DNA, 177 bp, Artificial Sequence
  Description of Artificial Sequence: Synthetic coding sequence
atggccgggccagagtccgacgcacagtatcagtttacaggaattaaaaagtactttaactcttacacgctgacaggccgcatgaactgtgtattggctacctacggctcaattgctctcatcgtattgtacttcaaactaaggagcaaaaagactccggccgtcaaggcaacctag

SEQ ID NO: 31865 - DNA, 792 bp, Artificial Sequence
  Description of Artificial Sequence: Synthetic coding sequence
atggataactcatggcggctgggcccagccatcggactgtctgctgggcagagccagctcctcgtgtccctgcttctgctgttgacaagagtacagccagggacagatgtcgctgcccctgagcacatatcatacgtgccccagttatcaaacgacacactggccggccgtttgaccctatctacattcacccttgagcagcctctgggccagttctccagccataacataagcgatttggataccatctggctcgtggtggctctatcaaatgcaactcagtcctttactgctcctcgtactaatcaagatattccagcccctgcaaattttagtcaaagggggtattacctgaccctccgggcaaatagagttctgtatcagaccagaggtcaactgcatgtcctccgcgtaggcaacgatacacattgccagcctaccaagatcgggtgtaatcatccccttccaggtccaggcccctacagagtgaagtttctagtgatgaacgatgagggtccagttgcagagactaaatggtcatccgacaccaggcttcagcaggcacaagcactccgggctgtgcccggtccacagtctcctggaactgttgttatcattgcgatactatcgattttactggcggttctcctgaccgtgctgcttgcagtgttgatttatacatgttttaatagctgtaggagtacctctcttagcggacccgaggaggccggcagtgtgcgtcggtacactactcaccttgcattcagtacccccgccgaaggcgcgtcctag

SEQ ID NO: 31866 - DNA, 1170 bp, Artificial Sequence
  Description of Artificial Sequence: Synthetic coding sequence
atggccctgacaccggaatcccccagctcctttccaggactagctgcaactggctcttcagttccggagccacctggcgggccaaatgccacactgaattctagctgggcctctccaaccgaacccagtagcctcgaggatctcgtggctactgggacgatagggacactgctaagcgccatgggagtcgttggtgtcgtcggaaacgcgtacacgctggtagtcacatgtcgtagcttgagagccgtggcatcaatgtatgtctacgtagtgaacctggccttggcagacctgctgtacctgctcagtatccccttcatcgtcgccacctatgtgacaaaggaatggcactttggggatgtgggctgtcgtgtcttattcggccttgactttcttacgatgcatgccagcatcttcaccctgaccgtgatgtccagcgagaggtatgccgctgtgctgcggccattggatactgttcagaggcctaagggttacaggaagctgctcgctctgggcacatggttgcttgcccttctcctgactctccccgtgatgctggcgatgaggctggtgaggaggggtccaaagtctctgtgcttgcctgcctgggggccaagggcccaccgcgcttacctgactcttctgtttgccactagcatcgccggacctggcctcttgattggcctgctctatgctagactggcccgcgcctataggcgttctcagagggcctcctttaaacgggctagaagacctggagcaagagctttgcgcctggtgttgggtattgtgctgttgttctgggcctgcttcctgcccttctggctttggcaattactcgcccagtaccaccaggcccccctcgccccccggactgcccgcattgtcaattacctcacaacctgcttgacatatggaaactcatgcgccaaccccttcctgtataccttgctcacccggaactaccgcgatcatctacggggcagagtccgcggccccggatctggaggcggccgcggccctgtgccatccctccagcctagagccagatttcaacggtgttctggaaggtctttgagttcttgcagcccgcagccaactgatagcttggtcctggcccccgcggctccagcaaggcccgctccggagggacctcgggcccccgcttag

SEQ ID NO: 31867 - DNA, 1578 bp, Artificial Sequence
  Description of Artificial Sequence: Synthetic coding sequence
atgatgccttggttgtggaccgcaccacaccagaaagagtctcagaaagccgacgaatatctcagagagattcaagagcttggccagctgactcaggctgtgcagcaatgtattgaagccgctggacatgaacatcaacctgatatgcaaaagagcctcctccgtgtgggtctcgacggtcgggcaggtgagggtggggcaggacgaggttgggatgggcaacagggcagcagccttctgtctccaagcggatcaagtcaagccgcctccttcggaaagtgcttcctggatagattccctccagatagcttcgtgcacatgtgtcaagatctgcgcgtgttgaacgctgttcgcgattaccacatcggcattcctctcacctattctcagtacaagcaacttactatccaagtcctccttgatcgtctggtgcttcggaggctgtatcccctggccatacagatctgcgaatacttgagactgccagaggtgcagggggtctcccggattttggcccactgggcatgctataaggttcagcaaaaggatgtcagcgatgaagacgtagccagggcaatcaatcagaagttgggggatacaccaggagtgagctactccgatatagctgcacgcgcctatggttgtgggagaacggagctggccatcaaattactggaatatgagcctcggagcggtgaacaggtccctttgctcctgaagatgaaaaggagtaaattagcattatccaaagccatcgaatccggcgacaccgatcttgtgtttacggtacttctgcacctcaagaatgagctgaaccggggggacttttttatgacactcaggaaccaacccatggccttgtcactttatcggcagttctgcaagcatcaggagctggaaacactgaaagatctgtataaccaagatgacaaccatcaagagctcgggtctttccacatccgcgcatcatacgctgccgaagaaagaatcgaggggcgggtcgccgctttgcagacagctgcagatgcattctataaggctaaaaacgagttcgcagcaaaggcgaccgaggaccagatgaggctgttaagactgcaaaggaggctggaggatgagctgggtggccagtttctggacctctctcttcacgacacagtgacaacgctgatcctgggaggccacaacaagcgggcggaacaactggccagagacttccgtattcctgacaagcgactgtggtggcttaagctaacagcactggcagacctggaggactgggaggagttagaaaaattcagcaaatctaagaaaagtcccattggctatctgccattcgtcgagatttgtatgaaacaacacaataagtacgaggctaaaaaatacgcctctcgggtaggtcccgagcaaaaggtgaaggctttgcttttagtcggagacgttgcccaagcagcagatgtcgcaattgagcatagaaatgaagccgaactgtctttggtgctgagtcattgtacaggtgcaacggacggagcaacagccgataaaatacagagggcccgggcccaggcccagaaaaagtag

SEQ ID NO: 31868 - DNA, 2520 bp, Artificial Sequence
  Description of Artificial Sequence: Synthetic coding sequence
atggactgttatacggccaattggaatcccctcggcgacagtgccttctatcggaaatacgagctgtattccatggactgggaccttaaagaggaactgcgcgattgtttggtggctgcagccccctacggcggacccattgcacttctgcggaatccctggcggaaagagaaggctgcatcagtgagacccgtgctggacatttatagcgcctctggcatgcctctagccagtctactctggaaatcgggcccagtcgtgagccttggttggagcgcagaagaggaattgttgtgtgtccaggaggatggcgcagttttagtgtacgggcttcacggggacttccgcaggcacttttcaatggggaatgaagttctccagaacagagtgctagacgcaagaatatttcacaccgagtttggctctggggtggccatcctcacgggtgcccatcgattcaccttgtccgctaacgtgggtgatttaaaactcaggcggatgccggaggtgcctggtctccagtctgcaccatcttgctggacagtgctgtgtcaggatagggtggcccatattctgctggcggtcggccccgatttgtaccttctggatcacgcagcgtgttcagctgtgacccctccaggactagcccccggagtcagctcctttttgcagatggcggtcagttttacctacagacatctggccctatttactgacacaggatacatctggatgggcactgcatctctcaaggagaaattgtgcgagtttaactgcaacataagagcacctcctaaacagatggtctggtgctccaggcccagaagcaaagagagggctgtggtggtcgcctgggagcgccgccttatggtcgtgggcgatgcaccggaatctattcaatttgtactggacgaggatagctatcttgtccccgagctcgacggtgtgcgtatattctctcggagcacccatgaattcctgcacgaagttcctgctgcatcagaagaaatatttaaaattgccagtatggctcctggagctcttcttctggaggctcagaaggaatacgaaaaagagagtcaaaaagctgacgagtatcttcgtgagatccaggagcttgggcagctgacacaggccgttcaacagtgtatagaagctgccgggcacgaacaccaacccgacatgcaaaaatccctacttagagccgctagcttcggaaaatgctttttagaccggtttcctcctgacagttttgtccacatgtgccaggaccttcgcgtcctgaacgcagtacgagactaccatattggaatcccattaacatacagtcaatataagcagctcaccatccaagtgttactagatcgcctggtgctgaggagactctatcctctggccatacaaatatgcgagtacctaaggcttccggaagtgcagggagtttctagaatcctggctcactgggcatgttataaggtgcaacagaaggacgtgtctgacgaggacgtggccagggctatcaatcaaaagctgggggacacacccggggtctcatacagtgacattgctgcccgagcttatggatgcgggcggaccgagctagcaattaagcttctggagtacgagcctaggtcaggggaacaggttcctctcctgctgaagatgaagcggtcaaagctggccctgtcaaaggcaattgaatccggggacacagatctagtgttcaccgtgctcttgcatctgaaaaacgagctgaatcggggtgatttctttatgaccttaagaaatcaaccaatggccctgtccctgtatagacagttttgcaaacaccaggaactcgagaccttaaaggatctatacaaccaggatgacaatcatcaggaactggggtcttttcacatccgcgcgtcctacgccgccgaagaacgaattgaggggagagtcgcagcattacagaccgccgccgacgctttttataaagcgaaaaatgagttcgccgccaaggcaacagaggatcagatgcggttactgcgtctgcagcgcaggctcgaggatgagctcggaggccaatttcttgatctcagtcttcatgacactgttaccactctgatcctgggcggccataataagcgcgcggagcagttggcccgagattttcgtatccctgataagagactgtggtggttgaagttgacagcactggccgatctcgaggactgggaggagctggaaaaattctccaagagcaaaaaaagtcccatcgggtacctcccattcgtggaaatctgtatgaagcagcataacaagtatgaagccaagaagtatgcgagcagggtgggacctgaacagaaagtaaaggctctcctgttggtgggcgatgtggcacaagccgcggatgtggccatcgaacataggaacgaagccgagctcagtcttgtgctcagccactgcacaggagcgaccgacggcgcaacagcggataagatccagcgggcacgcgcccaggctcagaagaagtag

SEQ ID NO: 31869 - DNA, 2088 bp, Artificial Sequence
  Description of Artificial Sequence: Synthetic coding sequence
atggattgttacacagcaaactggaatcctctgggcgactcagccttctaccgcaaatacgaattatacagtatggattgggacttaaaggaggagctaagagactgcctggtggcagctgccccttacggaggtccgatcgccctcctgcgcaacccttggagaaaggagaaggctgcctccgttagacctgtgttggatatctacagtgcttccgggatgccactcgccagcctcctgtggaaaagcggtcccgtggtgagcctgggctggagcgccgaagaggagctgttgtgtgtgcaagaggatggcgccgtgctcgtgtatgggttacatggcgatttcaggcggcattttagcatgggcaacgaggtgctgcaaaatagggttctggacgccaggatcttccacaccgaatttgggtcaggtgtcgctatcctgactggagcacacaggttcaccctgtccgccaacgtgggtgatctgaagctacgcaggatgcccgaagttcctggactccaaagtgcaccgtcatgttggaccgttctatgccaggatagggttgcccatatcctgttagcggtcgggccagacctgtacctattggaccatgctgcctgcagtgctgtgaccccgccagggttagcccccggggtctcgtcctttctgcagatggcggtgtccttcacctatagacacctggccttattcaccgacaccggatatatttggatgggaacggcctcactcaaagaaaaactgtgcgagtttaactgtaacattcgcgcccctcccaaacagatggtctggtgcagccggcctcgaagtaaggaaagagcggtggttgtcgcctgggagagacgtctgatggtcgttggagacgcgcctgagagtatccagtataagcaactcaccattcaggtgttgctcgaccgcctcgtgctcaggcggctatatcctttagctatccagatctgtgagtatcttcgcctcccggaagtacagggcgtgtccagaatcctggcgcactgggcctgttataaagtgcagcagaaggatgtgtcagacgaagatgtggcacgagccatcaaccagaaattgggggatacgcctggcgtctcctattccgacatcgctgcccgggcatacggctgtggtaggaccgaactcgccatcaaattactggaatatgaacccaggtcaggtgaacaggtccccctgctgttgaagatgaagaggtccaaactggcgctatccaaagctatcgagagtggcgatacagacctggtcttcaccgtgctgctccatttgaagaacgaactgaatcgcggtgatttttttatgaccctgcgcaaccaacccatggccttatccttataccgacagttttgtaaacaccaagagctcgagactttgaaggacctttataaccaggatgataaccatcaggaattgggctcttttcacatccgcgcatcctatgctgcagaagagagaattgagggaagggtcgcagccctgcagacagctgccgacgctttctacaaagctaagaatgaattcgctgccaaggctacagaagaccagatgcgattactgcgactgcaacgccggctcgaggatgagctgggaggccagttcctcgacctgtcactccatgatactgtgactactctcatcctgggaggccataataagagagccgagcaattagcaagagacttccgtattcccgataagcggctatggtggctgaaactgacagcacttgcagacctcgaggattgggaagagttggagaagttctctaagtcaaagaagtctccaatcggctatctgcctttcgttgagatctgcatgaagcagcataacaagtacgaggcaaaaaagtatgcttcccgggtgggcccagagcagaaagtcaaggccctgctgctggtcggcgacgtcgcccaggcagcggatgtcgccatagagcatagaaacgaggccgaactctccttggtcctttctcactgcacaggtgctacagatggcgcaaccgcagataagattcaaagagccagagcccaggcccagaaaaaatag

SEQ ID NO: 31870 - DNA, 684 bp, Artificial Sequence
  Description of Artificial Sequence: Synthetic coding sequence
atgggagctcccctagaagtgctgcagaatcgcgtgctcgatgcccggatttttcacaccgaattcgggtccggagtggccattctaactggtgctcacaggttcaccttatctgccaacgtgggagacttaaagctgaggagaatgcctgaggtccctggactgcagagtgcaccttcgtgttggacggtgctgtgccaagacagggtggcgcacatcctgctggccgtgggccccgacttatacctattggaccacgctgcctgctcagcagtcactcctcctgggctggccccgggcgtgagctcattccttcagatggctgtctctttcacttatcgtcacttggcactgtttaccgacacgggatatatatggatggggacagcatccctgaaagaaaagctatgcgaattcaattgtaatatccgggccccaccaaagcaaatggtgtggtgctcgcgcccaaggagtaaagagagggccgtcgtggtggcctgggaaaggcggctcatggtggtcggtgatgcgcctgaaagcatccagtttgtgcttgatgaggactcgtacctcgtcccagagctggatggggtccgcattttcagcagaagtacacacgaattccttcacgaagtccccgctgcaagcgaggagattttcaaaatcgccagcatggcgccctag

SEQ ID NO: 31871 - DNA, 825 bp, Artificial Sequence
  Description of Artificial Sequence: Synthetic coding sequence
atgggcgctcctctggaagtcttgcagaatcgggtactcgatgcaagaatatttcataccgaattcggctcaggagtggccatcctgaccggcgctcatcgtttcacactcagcgctaatgttggcgacttaaaactaaggcggatgccggaggtccccggacttcagtcagcaccctcatgctggaccgtgttatgtcaggatagagtcgcacatattttattagcagtcggcccagatctgtatctgctggatcacgccgcctgctccgccgttacccccccaggactggcccccggtgtttcctccttccttcagatggcggtgagtttcacctacaggcaccttgctctgttcaccgacactggatacatttggatggggacggcatcacttaaggagaagctctgtgaattcaactgcaacataagggccccaccaaagcaaatggtctggtgtagccgccctcgaagcaaagagagagcagtcgttgtcgcctgggagcggaggttaatggtggtgggcgatgccccagagagtatccaatacaaacagctgacaatccaagttcttctggatcggttagtgctccgcaggctatacccactagccatacagatctgtgagtatctgagactgcccgaggtgcagggggtgtctaggatattagcacattgggcttgctacaaggtgcagcagaaagatgtgtccgatgaggacgtggcccgggctatcaaccaaaagctgggagataccccaggcgtgtcatatagtgatatcgcagcccgcgcctacggctgcggtcgaacagaattggcaatatag

SEQ ID NO: 31872 - DNA, 711 bp, Artificial Sequence
  Description of Artificial Sequence: Synthetic coding sequence
atgcctccaagggaactgtccgaggctgaacccccaccactgcgggcccctacccctcctccgcgccgaagatctgcacctccagaacttggaatcaagtgcgttctggtcggtgacggcgctgtggggaagagttctctgattgtctcctatacctgcaacggttatccagctcggtatcgaccaaccgctcttgacaccttctctgtacaggtcctcgtcgatggcgccccggtgagaatcgaactttgggacacagccggccaggaggacttcgataggctcaggagtctgtgttatcccgatacagatgtgtttctcgcctgcttttccgtagttcagccttcatcttttcagaatatcacagaaaagtggctcccagaaatcaggactcataatccccaggcccctgtcctcctggtaggaacacaagctgacctgcgagacgacgtgaatgtcttgatccagctggaccagggcggtagggagggccctgttcctcaaccccaggcccaggggctagccgagaagatacgggcatgttgctacttggagtgcagcgccttaacacaaaagaacttgaaagaggtcttcgatagtgctattctaagtgccatcgagcataaggcccgactcgagaagaaactgaacgccaaaggggtgagaaccctaagtcgatgccgctggaaaaaattcttctgttttgtatag

SEQ ID NO: 31873 - DNA, 561 bp, Artificial Sequence
  Description of Artificial Sequence: Synthetic coding sequence
atggcaggccacaggcttgttctggtcctcggggatctgcatattccccaccggtgtaacagtctgcccgcaaaattcaagaagctgttggtacccggtaaaattcaacatattctgtgcactggaaatttgtgcacaaaggagtcttatgactatctgaagaccctggctggagatgtgcatattgtaagaggcgattttgacgaaaatctcaactatccagagcagaaggtcgttaccgtgggacaatttaaaattggactaattcatggccaccaggttattccgtggggggatatggcctcactagccttgctccagaggcagtttgacgtagacatccttattagcggccatacccacaagttcgaagccttcgagcatgagaataagttttacataaaccccggtagtgcaactggcgcgtataatgccctggagacgaacatcatcccctcttttgtcctcatggacattcaggcaagtactgtcgtgacatatgtatatcaattgatcggagacgacgttaaggtcgaacgcatcgaatataagaagccatag

SEQ ID NO: 31874 - DNA, 264 bp, Artificial Sequence
  Description of Artificial Sequence: Synthetic coding sequence
atggcctctctagcactcttacaacgtcagtttgatgtagacatactaatctcagggcatacccataaattcgaggcgtttgaacatgaaaacaagttttatatcaaccccggtagcgccacgggggcatacaacgccttggagacgaacatcatcccaagttttgtcctgatggatatccaagccagtacagtcgtcacatatgtttatcagctgattggagacgatgtaaaagtggagaggatcgagtacaagaagccctag

SEQ ID NO: 31875 - DNA, 549 bp, Artificial Sequence
  Description of Artificial Sequence: Synthetic coding sequence
atgcttgttctggtgctgggcgacctgcatatcccccatcggtgcaactcattaccagcaaagttcaagaaactccttgttcctggaaaaattcagcacattctgtgcactggcaacctctgcaccaaagagagttacgactatcttaaaaccctagctggcgatgtgcacatcgttcgtggggactttgatgagaatctgaattacccggaacagaaggtggtcacagtgggccagtttaagatcggcctgatccacggccatcaggtgataccctggggcgacatggcttccctcgcccttctccagagacagttcgatgttgacattcttatatccggacacactcacaaatttgaagcattcgaacatgagaacaaattttatattaaccccggatctgccacaggagcatataacgctttggaaaccaatatcattccatcttttgtgctgatggatatacaggctagcactgttgtaacctatgtctatcagctcattggagacgatgttaaagttgagcgtattgaatacaaaaagccctag

SEQ ID NO: 31876 - DNA, 2172 bp, Artificial Sequence
  Description of Artificial Sequence: Synthetic coding sequence
atggctgccgccgccacgatggcagcagcagccagggaactggttttgcgggctggtacaagtgatatggaagaggaggagggacctttagccgggggacccggtttgcaggagccactgcagctgggggaactcgatatcacatcggacgaattcatcctcgatgaggttgacgtgcatattcaagccaacttagaggacgagctggtgaaggaagcactgaagactggcgtggatctgcgccattattccaagcaggtcgagttagagctccagcagattgagcagaaatccatacgtgattacattcaggagtctgaaaatattgccagtctgcacaatcaaattactgcctgtgacgctgttctggagcgtatggaacaaatgctgggagcctttcagagcgatctgtcctccatttctagcgaaatcagaactctgcaggaacaaagcggagccatgaacatacgattacggaatcgacaggccgttaggggaaaactcggggaacttgtcgacggcctggtggtcccatccgcactggtgactgccattctggaggcccctgtcacagagcccaggttcctcgagcagctgcaggagttggatgccaaagcggctgctgttcgcgagcaagaggcccggggcacagccgcctgcgccgacgtgcggggagtactcgatcgactaagggtgaaagctgtgaccaagataagagaattcatcctacaaaagatctattcgttcagaaagcctatgacaaattaccagattcctcagacagccctcttaaaatatcgatttttctatcagtttctgttgggcaacgaacgggccactgccaaggagatcagggacgagtacgttgaaaccttgtctaaaatttatctcagctattaccgctcctacctagggcggctgatgaaagtgcagtacgaagaggtggccgagaaggacgatctgatgggagtcgaagatacagctaaaaagggctttttctcgaagcctagcctacgtagccgtaacaccatttttacattgggcacccgagggtctgtgataagccccacagaacttgaagccccaattctcgtgcctcataccgcacagaggggggagcaacggtacccattcgaggcactatttcggagtcagcactacgctctattagataacagctgtcgggagtacctgttcatctgtgagttcttcgtcgtcagtgggcccgccgcccatgacctttttcacgccgtcatggggagaacactgagcatgaccctgaaacatttagacagctatctcgccgattgctatgacgcaattgccgtctttctctgtatccatatcgtcctccgatttcggaacattgccgcaaagcgcgatgtacctgctctggacaggtattgggaacaggtgctggcactgctctggcccaggtttgagcttatccttgagatgaatgtgcagagtgtgcgtagcaccgacccacagcggcttggtgggctggacacccggccacattacatcacacgccggtacgccgagttttctagtgcactggtttcaatcaatcagacgattcctaatgagcggacaatgcagctccttggccagctgcaggtagaagttgaaaactttgtattgagggtggcggcagagtttagtagtaggaaggaacagttggtgttcctgatcaacaattacgacatgatgctaggagtcctgatggagcgagcggctgatgacagcaaagaggtcgaatcgtttcagcagttgctgaacgcgagaactcaggagtttatcgaggagcttctgtcccccccgttcggtggtctggtcgcctttgtcaaggaggccgaggcactgatagagagggggcaggccgaaaggctgcgaggtgaggaagctagagtcactcagctgatcaggggtttcggtagcagttggaagagcagcgtagagtctctgtcacaggatgttatgagatccttcacaaacttccggaatgggacttccattatccaaggcgccctaactcaactgattcagctctaccataggtttcatagagtcctgtcacaacctcaacttcgcgcactcccagcgcgcgcagagctcattaatatacaccacctgatggtggagctcaaaaaacataaaccaaacttctag

SEQ ID NO: 31877 - DNA, 2106 bp, Artificial Sequence
  Description of Artificial Sequence: Synthetic coding sequence
atggaggaagaggagggaccattggcagggggtccaggcttgcaggagccactgcagctgggcgagctggacattacatctgacgaatttatactggacgaggttgatgttcacatacaggccaatctggaggatgaactagtcaaggaagcactcaagaccggcgtggatttaaggcattatagcaaacaggtggaactggagcttcagcagattgagcagaagagcatccgcgactatatacaggagtccgaaaacatcgctagtctacataatcagatcacagcttgcgatgctgttttagagcgcatggagcaaatgctgggagctttccagagtgacttgtcctctatttcatcagaaattcgcactcttcaagagcagagcggggctatgaacatcagactgcggaacaggcaggccgtgaggggcaagctgggagaactggtcgacggtttggtggtgccttccgctctcgttaccgctatcctcgaagcccctgtcactgaacccagattcctggagcaactgcaggagctagacgcgaaggcagctgccgttcgagaacaggaagcccgggggactgctgcttgcgcagatgtgagaggcgtgctggacaggctcagagttaaggctgtgaccaaaattcgggagtttatacttcagaaaatctattccttcaggaagccgatgacgaactatcagatcccacaaaccgctttgctcaagtatcggttcttttaccagtttctgcttggtaatgagcgtgccactgcgaaggagatcagagatgagtacgtggagaccctgtctaagatctacctgtcatactatcggtcatacctgggaaggctgatgaaggttcagtacgaggaagttgcagagaaggacgatctgatgggcgtcgaagacacagccaagaagggctttttttctaagccaagtctcaggtctcggaatactatattcacacttggcactagaggaagtgtgatttcccctacagagctggaggctcctatcctggtgcctcacaccgctcaaaggggtgagcaaagatatccattcgaggcattatttcgcagccaacactacgcactcctagacaactcttgtcgcgaatatctgttcatttgtgagttctttgtagtcagtggcccagctgctcacgacttatttcatgcagtgatgggtaggacgctaagcatgacattgaagcacctggactcatatctggctgattgttatgatgctatagccgtctttctgtgcattcacatcgtgttacggttccgcaatattgccgccaagcgcgacgtgcctgctctggataggtactgggaacaggtcctggccctcctgtggcccagattcgagttgatcttagagatgaatgtacagtccgtacgtagcactgatccacagagactgggtggcctcgatactaggcctcactacatcacacggcgctatgcggaattttcctcagccctggttagcatcaaccagacaatcccaaacgaaaggacaatgcagctgctcggccagctccaggtcgaagtagagaactttgtgctccgcgtggctgcagaattcagcagccggaaggagcagctcgtattcctgatcaacaactacgacatgatgcttggtgttctcatggagagagccgctgatgattcaaaagaagtagaatctttccagcaactcctgaacgcccgtacccaggagttcattgaggagcttctctccccaccttttggtgggttagtagcctttgttaaagaggcggaggccctcatagagaggggccaggctgagaggcttcgaggcgaggaagcccgtgttacgcagcttattagggggtttggttcaagttggaaaagctctgtggaatcactctctcaggacgtcatgcgctctttcactaatttcagaaatggaacaagcattattcaaggcgctctgacccagcttatccagctttaccaccggtttcaccgcgtgctatctcagccacagttgcgcgcgctgcccgcccgggccgagttaatcaacattcaccatctgatggtggagctcaaaaagcataaacctaacttttag

SEQ ID NO: 31878 - DNA, 2172 bp, Artificial Sequence
  Description of Artificial Sequence: Synthetic coding sequence
atggctgccgccgcaacaatggcggctgccgccagagagctggtgcttcgcgcaggtacatccgatatggaggaagaggagggaccgcttgccggcggtcctggcctgcaagagcctctgcagctaggggagctggatattaccagcgatgaattcattctggacgaggtggacgtgcatattcaggccaatctcgaagatgaacttgtgaaggaagctttgaagaccggcgtcgatctgcgccactacagcaagcaggtcgagctggaactgcagcagatcgagcagaagagcatacgggactacattcaggagtcagaaaatatcgctagcctccacaaccaaattactgcctgcgacgctgttctggagcggatggaacagatgctgggagcctttcagtcagatttgagcagcatctcctcggaaatcagaacgctccaggagcaaagtggtgcaatgaacatccgtcttcgcaatcggcaggctgttaggggaaagctgggcgagctggtcgatggcctggtcgtgccatctgctttggtcacagctatcttggaagccccagtgactgagccaaggttccttgagcagctccaggaacttgacgccaaagccgctgcagtgagagaacaggaggctaggggcaccgctgcctgtgctgatgtgcgcggcgtgctcgacaggctgagagttaaggcggtgaccaaaatccgtgaattcattctccagaaaatttattcctttcggaaacctatgacgaattaccagatacctcaaaccgccctccttaaatatagatttttctatcagtttttgcttggaaatgaaagagccacagcaaaggaaattagagacgaatacgtggaaaccctgtccaaaatctacttgtcttactataggagttatctgggcagactcatgaaggttcagtatgaggaggttgccgagaaggacgacctgatgggtgtcgaagacaccgctaagaagggcttctttagtaaaccatctctccgatccaggaacacgatttttactctcggcaccagaggttccgtgatttcacccaccgagctggaggctccaattctggtacctcataccgcccagaggggagaacagagatatcccttcgaggccctttttcgaagtcagcactacgccctgctcgacaactcctgtcgggagtatctgtttatctgcgaattcttcgtggtttcagggccagccgcccatgatctgttccacgctgttatgggtaggacgctcagcatgactctgaaacacctcgattcatacctggcagattgctatgatgccatcgccgtcttcctctgcatccacattgtgcttcgattccgaaacatagccgcaaagcgggacgtgccagcactcgataggtattgggaacaggtactggcactcttatggccccgctttgagctgatcctggagatgaacgtgcagagtgtgcgatcgactgacccccagcgcctgggcggcctggacacccgcccacactacatcactcgacggtacgccgagttctctagtgctcttgtgagtataaatcaaactatacccaacgagagaactatgcagctcttagggcagttgcaggttgaagtcgaaaactttgtcctccgagtggcggccgagttctcttcacgcaaggagcagctggtcttcttgatcaacaactatgatatgatgctcggcgttctgatggaacgggccgccgatgatagcaaggaggttgagagcttccaacagctgctaaacgcccgaacacaagagtttatagaggaattactctctcctcctttcggcggcctggtggccttcgtgaaggaggcagaggctctgattgagcggggacaggcagagcgccttcgcggcgaagaagcgcgggtgacacagctaatcaggggtttcggtagttcctggaagtccagcgtcgagtctctgagccaggacgtgatgagatcctttacaaatttccgcaacggcacctccattatacagggcgcccttactcagctaatacagttgtaccatcgctttcatcgtgttctttcccagccccagctcagggcccttcctgccagagcagaactcataaatatccaccatttgatggtggagttaaaaaaacataagcccaatttctag

SEQ ID NO: 31879 - DNA, 1797 bp, Artificial Sequence
  Description of Artificial Sequence: Synthetic coding sequence
atggagcaaatgcttggcgctttccagagcgatctttccagcatctctagtgaaatccggaccctgcaagaacagtccggcgctatgaatatccgtttgagaaatcggcaggccgttaggggcaagttaggcgagctggtggatggcttagttgttcctagcgctctggtcacggcgattcttgaggcccctgtaacagaaccccggtttctggagcagttgcaggagctggacgcgaaagccgccgcagtcagagagcaggaggcacgaggcactgcagcttgcgccgacgtgagaggcgtgctggaccggttacgggttaaggcagtcaccaagataagggaattcatcttgcagaaaatttacagcttccggaagccgatgactaattaccaaattccccagacagctctcttaaaatataggtttttttaccagtttctgctgggaaacgagcgggcaacggccaaggaaatacgggatgaatatgtggagacactgtctaagatttatctgagctactatcggtcgtacctcgggaggttgatgaaggtgcagtacgaggaagtcgcagagaaggacgatcttatgggagtggaagatactgccaagaaaggatttttttcaaagccctctctgcgcagcagaaacaccatcttcactctcggtacacgcggctcagtgatctcgcccacagagttagaggcacccattcttgtgcctcacaccgcccagcgcggagagcagcggtatccattcgaagcattgttccggtcgcagcattatgcacttctggataactcctgcagggagtacctgttcatctgcgaattctttgttgtcagtggacctgcggcacacgacctgtttcatgcagtaatggggagaactctttcaatgactctcaagcacctagactcttatttggcagactgttatgatgccatcgccgtgtttctgtgcatccacatcgtgctacgcttcagaaacatcgccgcaaagcgggatgtgccagcactcgatcggtattgggagcaggtcttagcattgctttggccaaggtttgagcttatcctggagatgaatgtgcagagcgtgcgatccaccgacccccagcgcctgggaggtctggatacgcgaccccattacatcacacgtagatacgcagagttctcatccgctctggtctctatcaaccaaaccatccccaatgagaggaccatgcaattgctgggacagctgcaggtggaagtcgaaaatttcgttctgagggtagccgcggaattcagcagccgaaaggagcagctggtttttcttatcaataattacgatatgatgctgggcgtcctaatggagagagcagccgacgacagcaaggaggtcgagtcttttcagcagcttctcaacgcccggacacaggagtttatagaggagctcctctctcctccattcggaggcttggtggcatttgtgaaagaggcagaggctctcatagagagaggccaagccgagaggctgcgcggagaagaggcgagggtcacccagcttattaggggctttggaagttcatggaagtctagcgttgaatcactcagccaggacgtaatgcggagttttactaacttcaggaacggaacctctattatccagggagccctgacacagctgatacagctctaccatcgctttcaccgcgtgctctcccagcctcagctcagagccctgccagcccgtgccgaattgataaacatccatcatctgatggtcgagttgaaaaagcacaagccaaacttttag

SEQ ID NO: 31880 - DNA, 2172 bp, Artificial Sequence
  Description of Artificial Sequence: Synthetic coding sequence
atggccgctgcagctaccatggctgccgccgcccgggaactggtcttgcgggccggtacttctgatatggaggaagaagagggtcccctcgccggtgggcccgggttgcaggagcctctgcaactcggtgaacttgacattacgagtgacgagtttattttggacgaggtggatgtccatatccaggcgaatctggaagacgaactcgtcaaggaggcactgaagaccggggtcgacctgcgccactattctaagcaggtcgaattggagttacagcaaatcgaacagaagtccatccgagattacatccaggagagcgaaaacatagccagtctgcataatcagattacagcatgtgatgctgtgctggaacgaatggaacagatgctgggggccttccagtccgacctctcaagcatttcctctgaaattcgaacattacaagagcaaagtggggcaatgaacatccgacttcgcaaccgccaggcggtgcgtggaaaactgggggaactggttgacggtctggtggtgccatcggcactggtgacagccatcctcgaggctccagtaacagaacctcgttttctcgaacaattacaggaattggacgctaaggccgccgcagtgcgggaacaggaggctagaggcaccgcagcctgtgccgacgtcaggggggttcttgatcgtttgagagtcaaggcagtgaccaagattcgagagtttatcctacagaaaatctactcattccggaagcctatgacaaattaccaaatccctcagaccgcccttctcaagtaccgcttcttttaccagttcttactcggaaacgaaagggccacagccaaagaaattcgcgatgagtatgtggaaactttaagcaagatctacttgagctactacaggtcttatttgggccgcctgatgaaggttcagtacgaggaggtcgcggagaaggatgaccttatgggggtggaagacaccgccaagaagggcttctttagcaagccgtcactaaggagtcgaaatactatttttacactgggcacccgcggctctgttatatcgccaacagagttggaagctcctatcttagtcccacacaccgcacaacggggcgagcagcggtaccctttcgaagcgttattccggagtcaacactatgctttgctggacaactcatgtagagaatatttgttcatatgcgaatttttcgttgtgtctggacctgccgcccatgatctctttcatgctgttatgggacggacactgtccatgaccctcaagcatttggactcgtacctggccgattgctacgatgccatcgccgtctttctatgcatacacatcgtgttaaggtttcgcaacatcgccgcaaagcgggatgtccctgcactggaccgatactgggagcaggtgctggctctgctgtggcccagatttgagcttatcctggagatgaatgtccaatcagtgaggagtactgacccccagagactagggggcctggatacaaggcctcattatatcacgagacggtacgctgagtttagctccgcactggtgagcatcaaccagactattcccaacgagcggaccatgcagctcctggggcaactgcaagttgaggtggagaacttcgtgctcagagtggctgcagagttcagctcaagaaaagagcagctggtcttcctgattaataattatgacatgatgttgggtgtactgatggagagagctgccgatgactccaaagaggtagagtctttccaacaactgcttaatgcccgcacccaagagttcatcgaggagctcctgagcccaccctttgggggactggtagcctttgtgaaagaggcagaggcactaatagagaggggccaagccgaacgtctgcgtggagaagaggctcgggtgacacagcttatcagaggcttcggaagtagctggaaatccagcgtggagtctctttctcaggacgttatgcgaagctttacgaatttcagaaatggcacctcaattatccagggggcactcacccagctgatccagttgtaccatagatttcacagggtgcttagccaacctcagttacgtgccctgccggcaagagctgaactgattaacatccatcatcttatggtcgaactgaaaaagcacaaacccaatttttag

SEQ ID NO: 31881 - DNA, 2172 bp, Artificial Sequence
  Description of Artificial Sequence: Synthetic coding sequence
atggctgccgcggctactatggcggccgcagcccgggagcttgtgttgcgcgcaggcacaagcgatatggaggaggaggaggggccactggcagggggcccaggcttacaggagccccttcagctgggcgaactggacattacttcagacgagttcatcctcgacgaggtggacgttcacattcaggccaacttggaagatgaattagtgaaagaagccttgaagaccggagttgatttgcggcattacagcaagcaggttgaactcgaattgcagcaaattgagcagaaatccatacgagactacatacaggaatccgagaacatcgctagtctgcataatcagataaccgcatgcgatgcagtactggaacgtatggaacagatgctgggagccttccagtcagatctgagctccatctcctcagagattaggaccttgcaagagcaatctggtgctatgaatattcggctccggaatcggcaggccgtgcgcgggaaactgggagagcttgtcgacggcctcgtcgtcccctctgctctcgtgaccgccattctggaggcaccagtgacagagccgcggtttctagagcagctgcaggaattagacgccaaggcagccgccgtgcgggagcaggaagctcggggcacagctgcctgcgctgatgtgaggggcgtgctcgatcggcttcgtgtgaaggcagtgactaagattagagaattcatcctccagaagatctactcgtttcgcaagccaatgacaaactaccagattccgcagaccgctcttttgaaatatagatttttctaccagtttctgctcggaaatgaaagagcaaccgccaaagagataagagacgaatacgtggagaccttgtcaaaaatatacctgtcttattaccggtcctatctgggaagactgatgaaagtgcagtacgaggaggtggccgagaaggacgatctgatgggcgtggaggatactgctaagaaaggttttttttctaaacctagcttacgaagtcgaaacacaattttcacgctcgggaccagggggtccgtcatttctcctacagagctggaggcccccatactcgtcccccatacagctcaacggggagagcagagatacccattcgaggctctctttcgctcccagcactatgccctgctcgacaattcctgcagagaatacttgtttatttgtgagtttttcgttgtaagcggcccggccgcccatgatctgtttcatgcagtgatggggcgcaccctgagcatgacattaaaacacctggatagctatttagcagattgttatgacgcaattgctgtctttctttgcattcacattgtgctgagattccgcaacattgccgctaagcgcgacgtgcccgctttggaccgatattgggagcaggtgctggcattactgtggcctcggtttgagcttattctggagatgaacgttcaaagcgtgcggagtacagacccgcaaagactgggagggttggacacccgcccccactacatcacccggaggtacgcagaattctctagtgccctggtgagcatcaaccagacgatccccaatgaaaggactatgcaacttcttggccaattacaggtcgaggttgagaattttgttctccgcgtcgccgccgagttcagctcccgcaaggagcagctggtgttcttaatcaacaactacgatatgatgctgggggtcctgatggaacgtgccgcagatgattcaaaggaggtggagtcgttccagcagctgctaaacgctaggacacaagagtttattgaggagctccttagtccaccatttggaggattggtggcgttcgttaaggaagctgaggccttaatcgagagagggcaggccgagaggctgagaggggaagaggctcgggtgacccaactgatacgcgggtttggtagtagctggaaatcatccgtggaatctttatctcaagacgtcatgagatcttttaccaactttagaaatggtacatccattattcaaggggcacttacgcagctcatccaactttaccatcgattccaccgcgtgctgagtcagccacagctacgggccctccctgcacgggccgagcttataaatattcaccacctgatggtggaactcaaaaagcataagccgaacttttag

SEQ ID NO: 31882 - DNA, 2172 bp, Artificial Sequence
  Description of Artificial Sequence: Synthetic coding sequence
atggctgcggccgctactatggctgcagccgcacgagaattggtgctgcgagccgggacatccgatatggaggaggaggaaggaccattggcaggcggaccaggccttcaggaacccctccagcttggtgagctggatattacgagtgatgaattcatcttagacgaggttgacgtccatatacaagctaacctggaggatgagctggttaaggaagccctgaaaacgggcgtcgaccttcggcactacagtaagcaggtggagctcgaactgcagcaaatcgaacaaaaatccatccgggactatatccaggaatctgagaacatcgccagtttacacaaccagatcacagcctgcgatgcagtgttggaacgaatggagcagatgctgggagctttccaatctgatctgtcctctatttctagcgagatcagaacattgcaggaacagtctggcgctatgaatattcgattaaggaatagacaggcagtgaggggaaagctgggtgaattagtggacgggctggtggttccaagcgcgcttgtcacggctatccttgaagccccggtgaccgagccccgctttttggagcagcttcaggagctggatgctaaggctgctgcggtgcgtgaacaggaggcccgcggcacagccgcatgcgcagacgtaagaggagtgctggaccggcttagagtaaaggccgttacgaaaatccgggaattcattcttcagaaaatctactcttttcggaaacccatgaccaactatcagataccacagactgcactgctgaagtacaggttcttttaccaatttctgttaggcaatgagagggcaacagcaaaagagattagagacgaatatgttgagaccctttctaagatatacctgtcctactaccggagttatctagggcggctgatgaaggtgcagtacgaggaggtcgcggagaaggatgacctgatgggcgttgaagacacagctaaaaagggatttttctctaaaccctctttgagaagtagaaacaccatttttacattaggtacccgggggtccgtgatcagccctactgaactggaggcccccattctggtcccgcacacagctcaacggggtgagcagaggtacccgttcgaagccctgtttaggagccagcactacgctctcctggataattcttgtcgagaatatttgtttatttgcgagttttttgtcgtgtccggaccagcggctcacgatttgtttcatgcagtaatggggcgtacactctccatgacccttaagcacctcgatagctacctcgcagattgctatgacgctattgccgtcttcctgtgtatccacattgttctacggtttagaaacatagccgctaagcgcgacgtccctgccctcgataggtattgggaacaggttttggccctgttgtggccacgctttgaactgattctcgagatgaatgttcagtctgtcagatcgacggaccctcagcgtctgggcggtctggacacccgcccccactacattacgcggagatacgctgagttcagcagcgccctggtgtcaatcaaccaaaccatcccaaacgaacgtaccatgcagctcctgggccaattgcaagtggaggttgagaacttcgtgctgagggttgccgcggagtttagtagcagaaaagaacaattggtctttctgattaataactacgacatgatgctgggagttctgatggaaagggccgctgacgatagtaaagaggtggagagttttcagcaactgctgaatgcccggacgcaggagttcatcgaagagctgcttagccccccctttggcggcctggtcgcctttgtcaaggaagcggaagctttgatagagcgaggacaagccgagcggctacggggcgaagaggcacgcgtaacacagctaataaggggattcggctcctcctggaaaagcagcgtggagagcctatctcaggatgtgatgcggtcctttaccaactttagaaatggaacttcaattatacagggcgcgctgacccagctgattcaattatatcatcggttccaccgcgtgctgtcccagccacagttgcgggctctcccagctcgggctgagctgatcaacatccaccacctgatggtcgagcttaagaaacacaaaccaaatttctag

SEQ ID NO: 31883 - DNA, 2172 bp, Artificial Sequence
  Description of Artificial Sequence: Synthetic coding sequence
atggcagccgcggcgacaatggccgccgccgcccgagaactggttttgcgagctggcacgtctgatatggaagaggaagagggacctcttgccggggggcccggcttgcaggaacctctacagctcggggaactggacatcacctctgacgaatttattctggacgaggttgacgtgcatatccaggccaacctcgaagacgagctcgtaaaggaagcgcttaagacgggggtggacctgcgtcactattccaaacaggtggaattagagctacagcagatcgaacaaaaatcaataagagattatatccaagagagcgaaaatatcgcatccctgcacaaccaaattacagcttgcgacgccgtgttggagcggatggaacaaatgctaggagcctttcagtctgatctctccagtatcagtagtgaaatacgcacattgcaggaacagtccggcgcaatgaacattaggctccgaaacagacaggccgtccgaggaaaactcggggagctggtggatggactggtcgtgccttccgccctggtgaccgctattctggaagcaccagtgactgagcctaggtttctcgaacagctacaagagctggatgccaaggcagctgctgtccgcgaacaagaagcccgcggcacagcggcttgcgcagatgttcgaggagtcctagaccggctgcgggtcaaagccgtcacaaagattcgtgaatttatactgcaaaaaatatactccttccggaaacccatgaccaattatcaaataccccagacggctctcctaaagtaccgttttttttatcaattcctgcttgggaacgagagagcaactgcaaaggagatccgcgatgagtatgtcgagacgctcagcaaaatctacctgagctactatcggtcttacctcggccgccttatgaaggttcagtacgaggaggtggctgagaaggacgacctaatgggggtcgaagacactgcaaaaaagggcttcttctccaagccaagtttgcggtcacgtaacaccatcttcaccctcggcacacggggaagcgtaatcagcccaacggagctggaggctccaatcctggtaccccataccgcccaacgcggagagcagagatacccgtttgaagccctgttccggtcccaacattatgccttgctggacaactcctgcagagaatacctcttcatctgtgaattttttgtagtcagcggacctgccgcccacgatctattccacgccgtgatgggccgaactctcagtatgactctgaaacacctcgactcttatctcgccgactgctatgacgccattgccgtttttctatgcatccatatcgtactgagattcaggaacatcgctgctaaacgggacgtgcccgctctggaccgttactgggagcaggtcttggccttgctgtggccccgtttcgagctgatcctggagatgaacgtgcagagcgtgcggagtacagatccgcaacgtctggggggcctggacacgagaccccactatatcacccggcgttacgcagaatttagctcagctctcgtgtctatcaaccagactatacccaacgaacgcactatgcagctgctaggacagctgcaggttgaagtcgaaaacttcgtcttgagagtggccgccgaatttagttcccggaaagaacaactggtgttccttattaacaattacgacatgatgctcggggtcctgatggagagggcagccgacgacagtaaagaagtagagtccttccagcaacttctgaacgcacgcacccaagagtttatcgaggaactactgagccctcctttcggcggactggtggcgtttgtgaaagaggcggaagctctgattgagaggggtcaggcagagcgtttaaggggggaggaagctagggtgacacagctgataagaggctttggcagctcctggaaaagttccgtagaatcactgtcccaggacgtgatgagaagctttacgaatttcagaaacggaacatcaatcatccagggcgctttaactcaattgatacagctgtaccatcggtttcatcgagtgctctcccagccccaactgcgcgctcttcctgctcgtgccgagctgatcaatattcaccacttgatggtcgaactcaagaaacacaagcccaacttttag

SEQ ID NO: 31884 - DNA, 2106 bp, Artificial Sequence
  Description of Artificial Sequence: Synthetic coding sequence
atggaagaagaagaggggcctcttgctggagggcccggcctgcaggaacctctgcagttgggggagctggatatcacaagcgacgagtttatccttgacgaggtggacgtgcacatccaggccaatctcgaggacgagctggtcaaagaggccctgaaaaccggcgtcgacctgcggcactatagcaagcaagtggaactagaattgcagcagatcgaacagaaaagtattcgcgactacatccaggaatcagagaatattgcttctttgcacaaccagatcacagcgtgcgacgccgtgctggagagaatggaacagatgctgggcgcctttcagagcgatctgtcaagcatttcctccgagatacgaacactgcaggagcaatcaggggcgatgaatattcgcctacgcaaccggcaggccgtaagaggcaagctgggggaactggtggatgggttagtcgtgccctcggccctggtgacagctattctggaagctcccgtaactgaaccaagatttctcgaacaactacaggagctggatgccaaagcagccgcagtgcgggagcaggaggctaggggcaccgccgcttgcgcggatgtgcgcggtgtcctcgatcgcttgagggttaaggcggtgactaaaattcgtgaattcattctccagaagatatattcctttagaaaaccaatgacaaattatcagatcccacagaccgcgctcctgaagtatcgattcttttaccagtttctgttgggcaacgagcgcgccactgcaaaggagatacgcgacgagtacgtggagactctcagcaaaatctacctcagttactatcgttcctacctgggtcgcctgatgaaagtccagtatgaagaagtggctgaaaaagacgatctgatgggagttgaagatactgccaagaagggtttcttttctaaaccttcattgcgcagccgcaatacgatttttactctcgggactagaggctcagtgataagccccactgagctggaagcacctattctggtgccccatacagcccagagaggggagcagaggtacccatttgaagccctctttagatcccagcattacgcactactggataatagctgccgagagtatctgttcatctgcgaattcttcgtagtgagcggccccgcagcccacgacctttttcacgcagtgatgggcagaacccttagcatgacactgaaacaccttgactcatatcttgccgattgctacgatgcgattgcagtgttcctgtgcattcatatagtgctgagatttagaaatatagccgctaaacgagatgtaccagctctggacagatactgggaacaagttctggcactcctttggccgcgcttcgagcttatactcgagatgaacgtgcagagcgtgcgctctactgacccacaacgtttggggggcctggacacaagaccccattacataactcgcagatatgcagagttctcatcagcactcgtgtccattaatcagaccattcccaacgaacgcacaatgcagctgctgggtcagcttcaagtcgaggtggaaaattttgtgcttagagtggccgctgagttttccagtcgcaaggaacagctcgtgttcctcataaataattatgatatgatgctcggagtgctgatggagagagccgcagatgactccaaggaagtggaatcctttcaacagttgctgaacgcccggacgcaggagttcatcgaagaactcctgtccccgccctttggcggtctcgtggccttcgtgaaagaagcagaagctctgattgagcgagggcaggcagagcgcttgaggggagaagaggcgcgtgtgacccagctgattcgcggattcgggagctcttggaaaagtagtgtggaaagcctgtctcaggatgtgatgaggtcatttaccaacttccgcaacggcacgagcattatccagggggccctgactcagctgatacagttatatcacagattccacagggtgctttcccaacctcaactgcgcgccctccctgctagagccgagctaataaacattcatcacctcatggtagagttgaagaagcacaaaccgaatttctag

SEQ ID NO: 31885 - DNA, 2106 bp, Artificial Sequence
  Description of Artificial Sequence: Synthetic coding sequence
atggaggaggaggaaggacccttagcagggggcccaggattgcaagaacccctgcagctaggagagctggacatcaccagtgatgaatttattctggatgaggtggatgtgcatatacaagcgaatttggaagatgagctggtcaaggaggcattgaaaactggggtcgatctgcgccactatagtaagcaggtggagctggagttgcaacagattgaacaaaaatctatcagggattacatccaggagagcgagaatatcgcatctctgcacaatcaaattacagcttgtgatgctgtactcgagcgtatggaacaaatgctgggggcattccagtccgacctgtcttctatctctagcgaaattagaactctgcaggaacagtctggagccatgaacattagacttagaaatagacaggctgtgcggggaaagctgggtgagctggttgacggtctggttgttccgagtgccctggtcaccgctatcctggaagctcccgtcacggagccgaggttcctggagcagctgcaggagcttgacgccaaggcagcagcagtgagagaacaggaggctcgaggcacggccgcctgcgcggacgtaagaggcgttctagatcgactgcgagtgaaagctgtgactaaaatccgtgagttcatcctgcagaaaatttactccttcagaaaaccaatgacgaactaccaaattcctcagaccgccttgctgaagtatagattcttctaccagttcctactggggaacgagagggctacggcaaaggagatccgtgatgaatacgtggaaacactgagcaagatatacctttcgtactaccgctcctatctgggccgtctgatgaaggtgcagtatgaagaggtagccgagaaagacgatttgatgggggtggaggacacagccaagaaaggctttttctctaagccttccctccggtcacggaatacaatctttacattgggcactcgtggaagtgtcatttccccaacagagctggaagcgccgattcttgtgccccacaccgcccaacgcggggagcagcgttatcccttcgaagccctcttccggagccagcattacgccctcttggacaatagctgccgcgagtacctctttatctgcgagttctttgttgtgagcgggccagccgctcacgatctgttccatgctgtcatggggcgcactctgagtatgaccttgaagcacctcgactcttatctcgccgactgctatgacgctatagccgtgtttctctgcattcacatcgttttgcggtttcgtaacatcgctgccaagagagacgtgcccgcactggatcgctattgggagcaggtcctagcactcctctggcccaggtttgagttgatattggagatgaatgtgcagtcagtcaggtcaaccgaccctcaaagactgggagggctggacacacgcccgcattatatcactcgacggtacgctgagttctcctccgctctggttagcatcaaccagacaatccccaatgagaggaccatgcagcttctcggacagctgcaagtagaggtggagaacttcgtgctcagagtcgctgccgaatttagcagccgtaaggaacagcttgttttcctcatcaacaactacgatatgatgctcggggtccttatggagagggctgccgacgatagtaaagaagtagaatcctttcagcagttactaaacgctcgcacacaagaattcattgaggagctcctgtctccccccttcggggggttagttgcttttgtgaaggaagccgaagcattgattgagaggggacaggcagagcgcctcaggggagaggaggcacgggtgactcagttgatcaggggttttggatcatcctggaaatctagcgtggaatccctgtcacaggacgtgatgagatcatttactaattttcggaacgggacctcaattatacaaggagccctgacccagctcattcagctgtatcaccggttccatagagtgctaagccagccacaactccgagccttgcccgcaagagccgaactgattaatatacatcatctcatggtggagctcaagaaacacaaacctaacttttag

SEQ ID NO: 31886 - DNA, 1797 bp, Artificial Sequence
  Description of Artificial Sequence: Synthetic coding sequence
atggagcaaatgctgggcgcttttcagtccgacctatcttcaatttcctctgagattcgaacgcttcaggagcaatccggcgcgatgaatatcaggctgagaaatcggcaggccgtacgcggtaagttgggtgaactggtggatggactggtcgtgcccagtgccctggttaccgccattctggaggccccggtgacagaaccaagatttctcgaacagctgcaagaactggacgcaaaggccgcagcggtaagggagcaggaagcacgcggtaccgccgcctgcgccgatgtgcgtggagtcctggaccgactgagagtaaaagctgtgactaaaatcagagagttcatcctccagaagatttattcctttcgcaagcccatgactaactaccagatcccgcaaaccgcactgctgaaatataggtttttctaccagtttctcctggggaacgaacgagccaccgcaaaggaaattagagacgagtacgtagagactctctccaagatctacttgtcctactacaggtcctaccttggccgactgatgaaagtgcagtacgaagaggtcgcagagaaggacgacctgatgggcgttgaggacacagccaagaagggttttttcagcaagccctctttgaggagtaggaatacaatctttacgcttggaaccagaggatccgtcatttcaccaaccgagcttgaagcgcccatcctggttcctcacactgcacagcggggagaacagcggtacccattcgaggctctctttcggtcacagcactacgccctgctcgataacagctgtcgcgagtatcttttcatatgtgagtttttcgtggtgtctggccctgcggctcatgatctgttccatgcggtcatgggcaggacacttagtatgactctcaaacatcttgacagttatctggccgactgctacgatgctatcgccgtcttcctgtgcattcatattgtcctgaggttccgcaatatcgccgccaaaagggatgtacccgccctcgacaggtactgggaacaggtgctggccctcttgtggccgaggttcgaactgatcttggagatgaatgttcagtccgtcaggagtacggacccgcaacgccttggcggactggatactagaccccactatatcacaagaagatacgctgagtttagttcagccctggtgagtatcaatcaaacaatcccaaatgagagaacaatgcaactgctggggcaactacaggtggaagttgagaattttgtgctgagggtcgctgctgaattttcttctagaaaagaacagctggtttttctgataaacaattacgatatgatgcttggcgttttaatggagagagccgccgacgactcaaaggaggttgaatcctttcagcagcttcttaatgcacgaacacaagagtttatagaggagctcctatcacccccatttggcggtctggtggcgttcgtcaaggaggccgaagctctcatcgaaagaggccaagcggaacgcttgaggggcgaagaggcccgtgtgacacaactgattaggggctttgggagttcatggaagagctctgtggagtctctcagccaagatgttatgagatcatttaccaacttcagaaatgggacaagcatcatacagggcgccttaacacagctcatacagttgtatcataggtttcatcgagtgttatctcagccacagctcagagcccttccggcaagagccgagctgatcaatatccaccatctgatggttgaactgaagaaacacaagccgaacttttag

SEQ ID NO: 31887 - DNA, 1797 bp, Artificial Sequence
  Description of Artificial Sequence: Synthetic coding sequence
atggaacaaatgctgggcgcgttccagagcgatctgtcctccataagttcagaaattagaacgttacaggagcagtcaggcgccatgaacatcaggctgaggaaccgccaggctgtgagaggtaagctgggcgaactggtggatggcctagtcgttcccagcgcattagtgaccgccattctcgaggcccctgtgaccgagccccgatttttagaacaactgcaggaacttgacgcgaaagccgctgcagtcagagagcaggaggcgaggggtaccgcggcctgtgccgacgtaagaggcgtgttagatcgcctgcgggtgaaagccgtgacaaagatccgagagtttatccttcagaagatctacagctttagaaaaccgatgaccaactaccagataccccagacagcactgttgaagtatcgattcttttaccaatttctgcttgggaacgaaagggccacggcaaaggaaatcagggacgagtatgtcgagaccctgagcaagatctacctcagttattatagatcttacctggggaggctcatgaaagtacagtacgaggaagtcgcggaaaaggatgatctcatgggtgtggaggacacggctaaaaagggttttttcagtaagcctagtctcaggagccgtaatactatcttcacactcggtacacgcggctccgttataagtcctaccgagctggaggcgcctattctagtgcctcacacggctcagcggggcgaacagaggtatcctttcgaggcactattccggagtcagcactacgctctgctggataatagttgtcgggagtacctgttcatatgcgagtttttcgtcgtatctggaccagcagcacacgacctgttccatgctgtaatggggcggacactaagcatgaccctgaaacacctggacagctacctggccgattgttatgacgccatcgctgtgtttttgtgcatccacatagtgctcaggttcaggaatatagctgcaaagcgggacgtgcctgcccttgatcgatactgggagcaggtgctcgctctcttgtggccccgattcgagctgattctggaaatgaacgttcagagtgttagatctaccgatcctcaaaggctcggtggtttggacacccggccacattatattacaaggcgttacgccgagttttcctccgccctcgtgtctattaaccagacgataccaaacgaacgcaccatgcaactcctcgggcagctccaagtcgaggtggagaacttcgtactaagagtagccgctgaattttctagccggaaggagcaactcgtctttctaatcaataactatgatatgatgctgggggtgctcatggaacgcgcggccgatgacagcaaggaggttgaatcctttcaacagcttttaaatgctcgcacccaagagttcatcgaagagctgctgtctccgccatttggcggtctcgttgcatttgtgaaggaggctgaagccctcatcgaaaggggacaagcggagcggctgcgcggagaggaggcaagagtaacacagctcattcgaggctttggaagtagctggaagtcaagcgtggaaagcctctcacaggacgtgatgcgtagtttcacgaatttccgcaatgggacctcaattatccaaggcgccttgacccagctgattcaactctatcaccgctttcaccgcgttttaagccaaccccagctgagggccttgccagcacgagccgaattgataaatatacaccacttaatggtggaactgaaaaaacacaaacccaacttttag

SEQ ID NO: 31888 - DNA, 1443 bp, Artificial Sequence
  Description of Artificial Sequence: Synthetic coding sequence
atgtctgacgtcgcgatcgtgaaggagggctggctgcacaagcggggggagtacataaaaacatggcgtccgagatatttcctgttaaaaaatgacggaacattcatcggatataaagaaagacctcaggatgtcgatcaacgcgaggcgccactgaacaacttcagcgtggcgcagtgtcaattgatgaagaccgaaagacctcgccctaatacctttataatacgctgcctgcagtggaccaccgtgatcgagcgcacctttcatgttgaaactccagaggagcgtgaggaatggaccactgccatccagaccgtggccgacgggcttaagaagcaggaggaggaagagatggacttcaggtccggtagcccgtccgataacagcggggccgaagaaatggaggtctccttagctaaacctaagcaccgcgttacgatgaatgaattcgagtatctgaaactgctcggcaagggcacattcggcaaagtgattctggtgaaagaaaaagctacaggccgatattacgcgatgaagattcttaaaaaagaagtgatcgtcgcaaaggacgaagtagcccacacactaaccgaaaacagagtccttcagaacagccggcacccctttctgacggctttgaagtactccttccaaacacatgacaggctgtgcttcgtcatggaatacgcaaacggcggcgaactttttttccacctgagccgggagcgggtgttttcagaggacagagcgaggttctatggggcagagattgtctcagctttggactacctccatagtgagaaaaacgtggtgtatcgcgatctcaagctggaaaatctaatgctagataaggacggccacattaagatcaccgattttggactgtgcaaggaggggattaaagacggagctaccatgaaaacattttgcgggacaccggagtatctggctcccgaagtattggaggataatgattacggcagggccgtggactggtgggggctcggtgtggtgatgtatgagatgatgtgcggccgcctgcctttctacaatcaggatcacgagaaacttttcgagctgatacttatggaggagataagatttcctaggacgctcggaccagaggcaaagagcctgttgtctggcctgttaaaaaaagacccaaagcagcggctaggtggcgggtccgaggacgccaaggagattatgcagcacaggtttttcgctgggattgtctggcaacatgtgtacgaaaagaagttatcccctccattcaaaccccaagtgacctccgaaacggacacccggtattttgacgaggagttcaccgcccaaatgattacaatcaccccacccgaccaggacgactccatggagtgcgtggactccgaacgccgaccacatttcccacagtttagttactccgcttctggcaccgcttag

SEQ ID NO: 31889 - DNA, 3192 bp, Artificial Sequence
  Description of Artificial Sequence: Synthetic coding sequence
atgccacacttgcccctggcttcatttcggccacccttttggggccttagacactctcggggattgcctcgctttcacagcgtgagcacccaatcggagccgcatggcagcccaatttccagacgcaatcgagaggctaagcagaaacggcttcgagagaagcaggcaacactggaggccgagattgcgggcgaatcaaagtccccagctgagtcaatcaaggcctggcgacccaaagagctggtcctttacgagatccctactaaacccggcgagaaaaaggacgtgtccggcccactgccaccagcgtattccccccgctacgtggaagccgcatggtacccctggtgggtacgcgagggattctttaaaccggaataccaggccagactccctcaagccaccggcgaaactttttctatgtgtatccctcctccaaacgtcaccggcagcctccacataggccatgctttaaccgttgctattcaggatgctttggtccgatggcatagaatgagaggcgaccaggtactgtgggtacctggctcggatcacgctggtattgcaacgcaggcagtggtggaaaaacagttgtggaaggagagaggggtaagacgccacgaattgtccagagaggcctttctcagggaagtgtggcagtggaaagaggctaagggaggggagatctgtgaacaacttcgcgccctgggagccagcctcgattgggacagagaatgtttcaccatggacgtcggaagctctgtggcagtgaccgaggcttttgttcgcctgtataaggcgggattgctctatagaaaccatcagcttgtaaactggagctgcgctttacgctcagccattagcgatattgaggttgaaaaccgcccacttccaggccacactcagctccggcttccagggtgccctactccggttagcttcggcctgctgttctcggtggcttttcccgttgatggtgagcccgacgccgaggtggtggtgggaaccactcgccccgagacccttccaggcgatgtggctgtggctgtgcaccctgacgattcaagatacactcacctgcacgggcgccagctcaggcaccccctgatgggtcagcctttacctctcatcacagactacgctgtgcagcctcacgtcggaactggagcagttaaagtcactccagctcactctcccgctgacgccgaaatgggggccagacatgggctgagtcctttgaatgtgatcgctgaggatggaaccatgacttccctgtgcggcgactggttacagggtctgcaccgattcgtggcgcgtgaaaagatcatgtcagtgctgagcgagtggggactgtttaggggcctccagaaccaccctatggtcctgcccatctgtagccgcagcggagacgtgattgagtatctactgaagaatcagtggttcgtacggtgccaggagatgggggctcgagctgcaaaggcagtggaatcaggtgcactggagctgagcccttcatttcatcagaagaactggcagcactggttttcacacattggggactggtgtgtctccagacagctttggtggggtcatcagatacccgcctacctggtggtcgaggaccatgcacagggggaggaggattgttgggttgtgggaagaagcgaggctgaggcgcgcgaggtagcagctgagctgacaggaaggcccggagccgaactgacactggagagggatccagatgtattggacacgtggttcagttctgcgcttttccctttctctgctttgggttggccccaggagacgcctgatttagcccgattttatcccctatcgctgctggaaactggaagcgatctcttattattctgggtcggtagaatggtaatgctgggcacacagctgaccggccagctcccgttctccaaggtcctgctgcatccgatggtcagggatcgacaaggaaggaagatgagtaaaagcctcggaaatgtcctcgatccacgcgacatcatctctggggtcgagatgcaggtgctgcaagagaagctccggtcagggaacctggacccggccgaacttgctatcgtggcggctgcgcagaaaaaagattttccccatggcatacccgagtgcggtaccgacgccttgaggttcactctttgttctcatggcgttcaagccggagatctccatctatcagtcagcgaagtccagagctgcagacatttctgtaacaaaatttggaatgccttaaggtttatactcaatgcattgggcgaaaagttcgtacctcagccagcggaggagctcagcccgagctcccccatggacgcctggatcctgtcacggcttgcactggctgctcaggagtgcgagagagggtttttaacacgcgagctgtccttggtgacccacgctctgcatcacttttggctacacaatctgtgcgacgtgtatctggaagcagttaaaccagtcctatggcactcgcctaggcccctgggtccgccacaagtgttgttttcgtgcgctgacctggggcttagactccttgcaccactgatgccgttcctggccgaagaactttggcaaagattacctcctcggcccggctgcccacctgctcctagtatcagcgtggctccctatccctctgcgtgctccctcgaacactggcgccagccagagctggaacggagattctcaagagtgcaggaggtggtacaggtgctgcgggctcttagagcaacataccagctgacgaaggctcgcccccgcgtgctactccagtcatcggagcccggagaccaaggtctgttcgaggcgtttttggaacctctgggtactctgggatactgtggggccgttggactgctgcccccaggggcggctgctccctccgggtgggcccaagcccccctttctgacacagcacaggtctatatggagcttcagggactggttgatccccaaatccagttgccccttctcgctgctcgaagatacaaactccagaagcagctggactccctcaccgcacgaacaccctccgagggagaggccggcacacagcgacagcagaaactgagcagcctccagctggagctgtctaaactggacaaagcagctagtcacctgcagcagctcatggatgaacctccagcccctgggtccccagaactgtag

SEQ ID NO: 31890 - DNA, 348 bp, Artificial Sequence
  Description of Artificial Sequence: Synthetic coding sequence
atgccccacctgcctctcgcatcattccggccccctttctgggggctcagacattctcggggtctgcctcgcttccattctgtgtccacacagtccgagccgcatggatcccccatatcacgacggaaccgcgaagccaagcaaaagagactgcgggaaaagcaggctactttagaagctgaaatcgcaggtgagtccaaatctcccgccgaatccatcaaggcctggagacctaaagagctcgtgctgtatgagattccgactaagcccggagaaaaaaaggatgtgtcgggcccactccccccggcttacagccccagatacgtggaagccgcgtggtacccatag

SEQ ID NO: 31891 - DNA, 981 bp, Artificial Sequence
  Description of Artificial Sequence: Synthetic coding sequence
atgcctcacctcccactggcctccttccgccctcccttttgggggttgcgccattccagaggactgcctcggtttcactctgtcagcactcaatctgagccacacggcagtcctatttcccgtaggaaccgcgaagctaagcagaagcggttacgcgagaagcaggccacattggaagccgagatcgcgggcgagtccaagtctcccgccgaaagcataaaagcctggcgccctaaggagttagtgctttacgaaatccccactaagccgggggaaaagaaggacgttagcggcccactgccgccggcttacagcccgaggtacgtggaggcagcctggtatccctggtgggtcagggagggcttctttaagcctgagtaccaagctcgcctcccccaggcaacaggcgagacattttccatgtgtatccctccccccaacgtcacgggatcattgcacatcgggcacgccttgaccgtggctattcaggacgcgctagtaagatggcatcgcatgagaggcgatcaagtgctgtgggtccccggctctgaccatgcaggaattgcaacacaggcagtagtcgagaaacagctgtggaaggagcgcggcgttcgtagacatgagttatctcgtgaagcctttttgcgggaagtgtggcagtggaaagaagccaaggggggtgagatctgtgaacagttaagagccctgggagcatccctggactgggacagggagtgttttactatggacgtagggtcgagcgtcgccgtcacagaggcatttgttcgcctgtataaggcaggcttgctgtaccgcaatcatcagctggtgaattggagttgcgccctacgaagcgcaataagtgacattgaagtggagaacagacccctaccaggccacacccagttgcgcctccctggatgccccacaccagtgtccttcgggctccttttttcagtggctttccctgttgatggctag

SEQ ID NO: 31892 - DNA, 774 bp, Artificial Sequence
  Description of Artificial Sequence: Synthetic coding sequence
atgccgcacctgcctttggcctcatttaggcccccattttggggcttgcggcattcacgcggcctccctcgattccattctgtgagcacacagtcagaacctcacgggagtccgattagcagaaggaatcgagaggcgaagcagaagcggctgagggagaaacaagcaaccctcgaagcagagatcgcgggggaatctaaaagtcctgccgaatctattaaggcttggcgtcccaaggagctagtgctttatgagattccaacaaaaccgggagaaaaaaaggacgtatccggcccactgccccctgcctactcccccagatatgtcgaagcagcctggtatccatggtgggtgcgcgaggggtttttcaaaccagagtaccaggccaggttacctcaggccactggggagacattttctatgtgtattccacccccaaacgtcaccggctcgctccatattggccacgcacttaccgtcgctatccaggatgctctggttcggtggcaccgaatgagaggggatcaagtgctctgggtccccgggtccgatcatgcaggtattgctacacaggccgtggtggaaaagcagctctggaaggaaagaggtgtccgtaggcatgagcttagtagagaagcctttctcagagaggtgtggcagtggaaggaggcaaagggtggtgaaatttgtgaacagctcagggctctaggcgcttcactggactgggacagagtgttttaccatggctgttggctgttgagcggttgcgactag

SEQ ID NO: 31893 - DNA, 2772 bp, Artificial Sequence
  Description of Artificial Sequence: Synthetic coding sequence
atgtgtatcccacctcccaacgtgacagggtccttacatattggccacgcgcttaccgtggccattcaggatgcactcgttagatggcatcggatgcgcggtgaccaagtgctgtgggtgccgggctcagaccatgctggcatcgctactcaggccgtggtagagaagcaactttggaaagagaggggagttagacgccatgagctcagtcgggaagccttcttgagagaagtgtggcagtggaaagaagcgaaaggcggcgagatatgcgagcagttacgtgctctcggagccagcttagactgggaccgtgagtgctttactatggatgtgggaagtagtgtggccgtcaccgaggcctttgtacgcttatataaagctggtttgctgtaccggaaccatcagctggtcaattggagttgtgcactccgcagtgctataagcgatatagaagtagaaaaccggcccctgcctgggcatacccagctccgcctccccgggtgtcccacccccgtgtcttttggtctgcttttcagtgtcgcatttcccgtggacggtgaaccggacgcggaggtggtggtgggaaccacacgccctgaaacactcccgggagacgttgccgtggcagtgcatccagatgatagcagatacacccaccttcatggtcgccagcttcgccacccactgatggggcaacccctccccctcataactgactatgctgtgcaaccccacgttgggacgggcgcagtgaaagtgacacccgcacattctcctgcagacgcagaaatgggagctcgacatggcctgtccccattaaacgtgattgctgaggacggcacaatgacctccctgtgcggcgactggttgcaggggttacatcgtttcgtggcccgcgaaaagattatgagcgtactcagcgagtggggtctcttccgcggtctccaaaaccaccccatggtgctgccaatttgctcaagaagtggcgatgtcatcgaatacctgctgaagaaccagtggtttgtgaggtgtcaggagatgggcgccagggcagcaaaggccgtggaaagtggagccctagagctgtctccaagctttcaccagaagaattggcagcactggttctcccatattggagactggtgtgtctctcgacagctctggtggggccaccagattcccgcatacctggtggtcgaggaccacgctcagggggaagaggattgttgggtggtgggccggagtgaagcagaggcacgtgaggtggcagccgaacttacaggccgacccggcgctgagctgacactcgaacgagaccctgacgtgctggacacttggtttagctcagccctgttccctttctctgctctcggctggccccaggaaacccccgacctggctaggttctaccctctctccctcttggaaactgggtcagacttgttgctgttctgggtcggcagaatggtaatgttgggcacccaactcaccgggcaactcccgttttccaaggtgctactgcatcctatggtgcgcgacagacagggccggaaaatgagtaaaagtcttgggaacgtccttgatcctcgggacataatctccggtgtggagatgcaggtgttacaggaaaaattgcggagtggcaatctagatccagccgagttggcaattgtagcggcggctcaaaaaaaggattttccacatgggatcccagagtgtggtacagatgcactgcgtttcacactgtgctctcacggcgtgcaggctggagacctccatctgagtgtttcagaagtccaaagctgccgccatttttgtaacaaaatctggaatgcacttcggtttatccttaacgcgctaggagaaaaattcgtgcctcaaccggccgaggagctttctccctcttctccgatggacgcttggattctaagtcggctcgctctcgccgcgcaggagtgtgagcgtggctttttaacgagagagctgagcttagttacccacgctctgcaccacttttggctgcacaatctgtgtgatgtctatctggaagctgtgaaaccggtgctgtggcactctccacgccccttggggccgccacaggttttgttttcgtgtgccgatctagggctgcggcttctggcccctctgatgccgtttctagccgaagagctttggcagcgcctgccgccccgtcctggctgcccgcctgcacctagcatctccgtggccccctaccccagtgcctgcagcctggagcactggcgccagcctgagttggaacggagatttagccgggtacaagaggtggttcaggtgctcagagctttgcgcgctacttaccagcttacaaaggcccgccctagagtcctgctccagtctagcgagcctggcgaccaaggactgtttgaagcgtttctcgaacctttgggcaccctgggatactgtggggccgtgggacttctgcctcctggagccgctgctccatctggctgggctcaggccccgcttagcgatacggcccaggtgtacatggaacttcaggggctggtcgacccacagatacagctgccactgcttgccgccagacgctacaagttacagaagcagcttgactccctcacagcccggacaccttcagaaggcgaggctggaacacagaggcagcaaaaattatcttccctgcaactcgagctgtcgaagctcgacaaagctgccagtcacctgcagcagctgatggacgagccccctgcccccggtagtccagaactttag

SEQ ID NO: 31894 - DNA, 3282 bp, Artificial Sequence
  Description of Artificial Sequence: Synthetic coding sequence
atgggcggcaaggcatggcccaggcgggccgtgggcaccgccggaggtccctgcgcagagcagatctctgctccctttcagacactgctgatgccccatctgccccttgcaagcttccgcccacctttttggggcctgagacatagtaggggcctgcctaggtttcactcggtatccacacaaagtgaaccacatggttcgccgatttctcggcgcaatcgggaagcaaagcagaaaaggctgcgagagaagcaggctacactggaagccgagattgccggggagtccaaatccccggctgaatctattaaggcttggcggcctaaagaactggtactgtacgaaattcccactaaaccaggggaaaagaaagacgtgtccgggcccctccctccggcctactctccccggtacgtagaagccgcatggtatccctggtgggtgagagaaggttttttcaagcctgagtatcaggcccggctcccacaggctactggggagaccttctccatgtgcattcctccccctaacgtgacgggtagccttcacattgggcacgctttgaccgtggcgattcaggacgccctggttcgatggcaccgcatgcggggcgaccaagtgctatgggtgcctggtagcgatcacgccggtatcgcaacccaagccgtggtcgagaagcaactgtggaaagagaggggtgttaggcgccacgagttgagccgcgaagcgtttttgcgcgaagtgtggcagtggaaggaggcaaaggggggtgagatctgcgagcagctgcgcgcactgggagctagcctggactgggacagggaatgtttcactatggatgttggaagctctgtggcagtcacagaagcttttgtgagactctataaggcaggcctgctgtatcggaaccaccagctggttaattggagctgcgctctgcgttctgcaataagtgacatagaggtggaaaaccgcccactcccagggcacacacagctgagattacccggctgccctacccctgtctcatttggactgctgttttccgtagccttccctgtggatggggagcccgacgccgaagttgtggtgggtaccacaagacccgaaaccttgcccggcgacgtggctgtcgcagtacatcccgatgatagtcgatatactcacctgcacggacgacagctccgacacccgctgatgggtcagcccttacctctcatcaccgactatgctgtacagcctcatgtcggcacaggcgccgtgaaagtcacacctgctcactccccagccgatgcggagatgggcgcaagacatggactgtcccctctgaatgtgatcgcagaggatgggactatgaccagcctatgtggcgattggttgcagggactgcaccggttcgtcgccagagaaaaaatcatgtctgtgttgagcgagtggggattgtttaggggactccagaaccatcccatggtactccccatctgctcccgcagtggcgatgtgatcgagtatctgttgaagaaccagtggtttgtgagatgtcaggagatgggtgcaagagcagccaaagcggtggaatccggcgccctggaactgtcccccagcttccatcaaaaaaactggcaacattggttctcacatattggcgattggtgcgtgtcccggcagctgtggtggggccaccaaatccccgcttatctagtggtggaagatcacgcgcagggtgaagaggattgttgggttgtgggccggtccgaggctgaagctcgggaggtggctgcggaacttactggacggcctggcgctgaactgacgctagaaagggatcctgatgttctggatacctggttcagctctgccctctttccgttcagcgctctcggatggccacaagagactcctgatctggctaggttttatcccctttctcttctcgaaactgggtctgacttgcttctgttctgggttggccggatggtgatgttggggactcagctgacgggccagctgccattttcgaaggttctgttacatccgatggtccgggatcgccaaggccgtaaaatgtctaagtctcttgggaacgtgttggatcctcgcgacatcatttcgggtgtggagatgcaagtcctgcaagaaaagttgcgatcagggaacttggatccggcggagctagctatcgttgcggctgctcaaaaaaaggatttcccccacggcatccccgagtgcggcactgatgccctcaggtttaccctctgtagccatggggtccaggccggagacttgcacttgagtgtctctgaggttcagagttgcagacatttctgtaacaagatctggaacgcactccggtttattttgaacgccctgggcgagaagttcgtacctcagcccgccgaagaactgtcaccctcatctcctatggatgcttggatcttatctaggctggccctggctgctcaagaatgcgaacgaggttttctcactcgggaattgagtctggtgactcatgccttacaccatttctggctgcacaatctctgcgacgtatacctggaagccgtgaagccggtgctgtggcatagcccaagaccgctaggcccgccacaagtgctctttagctgtgcagatctgggcctcaggctgcttgcaccattaatgccatttctggcggaggaactgtggcagcggttaccccccaggcccggttgtcctccagccccctccatcagtgtagcaccctacccaagcgcatgttccctggagcattggcgccagcctgaactcgagcgcagattcagccgagtgcaggaagtggtccaggtgctgcgggcgctccgcgccacttatcaattgactaaagcgagacccagagtgctgttacaatcctccgaaccaggagaccagggtcttttcgaagccttcctagagcctcttggcacactgggttactgcggcgcggtgggactgttaccacccggggctgccgcccctagtggatgggcccaggcgccactgagcgacacagctcaggtgtatatggagctgcaggggctggtagatccacagattcagctgcctctgcttgccgccagacggtataaactccaaaaacaactcgattctctgacagcccgaactccaagtgagggagaggccggcacccaaaggcagcaaaaattatcatctcttcagcttgaactgtccaagctggacaaggctgccagtcacctgcaacagctgatggatgaacccccggcgcctggatctccagaactgtag

SEQ ID NO: 31895 - DNA, 699 bp, Artificial Sequence
  Description of Artificial Sequence: Synthetic coding sequence
atggccagcagcgctgctagctctgagcacttcgagaagcttcatgagatcttccggggtctgcacgaagacctgcagggagttcccgagaggctgcttggtaccgcgggcactgaggagaaaaaaaaactaatccgggacttcgatgagaagcagcaagaggccaatgagaccctggccgagatggaggaggagctgcggtacgcgccgctgtcgttcagaaatcctatgatgagtaagcttaggaactataggaaagacctggctaagctgcaccgcgaagttcgatcaacgcctctcacggccacccctggcggcaggggggatatgaagtacgggatctatgccgttgagaacgaacatatgaaccggcttcagtcccaacgcgcaatgttattacaaggtactgaatcgctgaatcgagccacccagagcatagagcgcagtcatcggatagcgacagagacggaccagatcggctctgaaatcatcgaggaactgggagaacagagggaccagttagaaaggacaaagtctagactggttaatacttcagaaaaccttagtaagtcacggaagatccttcggtcaatgtctcgtaaggttaccactaataaactcctcctttcaatcattattctcctcgagcttgcaattttaggcggcctggtctattacaaattcttccggagccattag

SEQ ID NO: 31896 - DNA, 426 bp, Artificial Sequence
  Description of Artificial Sequence: Synthetic coding sequence
atgcctccgaaatttaagaggcatctcaatgacgatgacgtcactggaagcgtgaaaagcgagcggaggaacctcctcgaagacgatagtgatgaggaagaggattttttcctgagaggcccatccggccccagatttggcccacggaatgacaaaatcaaacacgtccagaatcaggtcgacgaagtgatagacgtgatgcaggaaaatatcacaaaagtgatcgagagaggagagagactggacgaactccaggataagtctgaaagcctctctgacaatgcaacagcctttagcaacaggtccaaacagttacgtcggcagatgtggtggagggggtgcaagatcaaagccatcatggcactggtggccgctattctgctgctggtcataatcatactaattgtcatgaaatacaggacctag

SEQ ID NO: 31897 - DNA, 423 bp, Artificial Sequence
  Description of Artificial Sequence: Synthetic coding sequence
atgccacctaagtttaaaaggcatctgaacgacgacgatgtgacaggcagcgtgaaatcagagaggcggaacctgctcgaagacgattccgacgaggaagaagacttcttcttgggaccaagcggtccacgctttggcccccgcaatgacaaaatcaagcacgttcagaaccaggtagacgaggtgattgacgtcatgcaggaaaacatcacaaaagtcattgaacggggcgaaaggctagatgaactccaggacaaatccgagagcctctccgataatgccacggcttttagcaacagaagtaagcagctgagacgccagatgtggtggcgtggttgcaaaatcaaggcaatcatggctctcgttgctgccatcttacttctggtcatcataatcctgatcgtcatgaaatacagaacttag

SEQ ID NO: 31898 - DNA, 423 bp, Artificial Sequence
  Description of Artificial Sequence: Synthetic coding sequence
atgccccctaagtttaagagacatcttaatgacgacgacgtgacaggctcagtgaaaagtgaacgaagaaatctgctggaagatgacagtgatgaggaggaagatttcttcctcgggcctagtggtcctagatttgggcctcgcaatgataagattaagcacgttcagaatcaagtggacgaagtgatcgatgtgatgcaggaaaatatcactaaggtgatagagcgcggcgaacggctcgatgaacttcaagataagtctgaatccctgagcgacaacgccaccgccttttccaaccggtccaagcaactaaggcgccagatgtggtggcggggatgtaagatcaaggccataatggccctagtcgctgcgattttgctactcgtgatcattattctgatcgtgatgaagtaccggacgtag

SEQ ID NO: 31899 - DNA, 426 bp, Artificial Sequence
  Description of Artificial Sequence: Synthetic coding sequence
atgcctcctaagttcaaacgacaccttaatgatgacgatgtgactggatccgtgaaaagcgagagaagaaacctactggaagatgattccgacgaagaggaggacttcttcctgcggggacctagcggcccccgatttggacccagaaacgataaaataaaacatgtgcaaaaccaggtggacgaagttatcgacgtgatgcaggaaaacatcacaaaggtgattgagcgcggggaaaggctcgacgagctccaagataagagcgaatcactgtcagacaatgcaacggctttctcaaatcgctccaaacaactcagaagacagatgtggtggcgtgggtgcaaaataaaagcgataatggccttggtggccgccatactgctattggtgattattatcctaatcgtgatgaaatatcggacctag

SEQ ID NO: 31900 - DNA, 519 bp, Artificial Sequence
  Description of Artificial Sequence: Synthetic coding sequence
atgaggcggcaacccgctaaggtggctgctctcctgctgggcctcctgctggaatgtaccgaggctaaaaagcattgctggtactttgagggtctctaccccacttactacatctgcaggtcatacgaggattgctgcgggtcccgctgctgtgtgagggctctttctatccaacggctctggtatttttggttcttgctgatgatgggggttctgttctgttgcggagctggattcttcataagaagaagaatgtaccctccaccccttatcgaagagccagctttcaatgtttcctacactaggcagccccccaaccctgggcctggagcacagcaacccgggcccccctactatacagatcccggtggccccggaatgaacccggtgggtaatagtatggctatggcctttcaggtccctcccaactcgcctcagggctctgtggcttgccctccaccacctgcatactgcaacacacccccccctccttacgagcaggtggtgaaggcaaagtag

SEQ ID NO: 31901 - DNA, 510 bp, Artificial Sequence
  Description of Artificial Sequence: Synthetic coding sequence
atgctgagtgagacactcggttacctttcctcagtgctgctgcagtgtactgaagctaagaaacactgctggtattttgaaggattatatcctacctattatatctgccgatcctacgaggactgctgtggctcaagatgttgtgtgcgggcactgagcatacagcggctgtggtatttctggtttctgttgatgatgggggtgctgttctgctgcggcgctggctttttcattaggagaagaatgtatccacctcctctcatcgaagagcctgcctttaatgtctcatatacaaggcaacctccgaacccaggcccgggggcacagcagccaggtccaccatactataccgatcccggggggccaggtatgaatcccgttgggaattccatggctatggcttttcaggtgccccccaacagcccacagggtagcgtagcgtgcccacctccgcccgcctactgcaacacccctccaccaccttatgagcaggtagtgaaggcaaaatag

SEQ ID NO: 31902 - DNA, 2196 bp, Artificial Sequence
  Description of Artificial Sequence: Synthetic coding sequence
atgctgaaggagtgggccatcaagcagggcatcctgttaaaagtggctgagacaatcaagtcctggattttcttttcgcaatgtaataaaaaggacgacctactgcataaactagatatcggtttcaggttagactctctgcatacaatccttcagcaagaggtgcttttgcaggaagacgtggaactgatcgagcttctggacccctcgattttgtccgccggccagagccagcaacaggagaatggacatttgcccacactgtgctctctggcgacaccgaatatatgggacctgtcgatgctgttcgccttcatctctctgctcgtgatgctacccacgtggtggattgttagctcttggctggtgtggggagtgatactattcgtgtatctcgtgattcgagcactccgactgtggagaactgctaagctacaagtgaccctgaagaagtacagtgtgcacctggaggacatggctacaaattcccgagccttcacgaatttagtgcgcaaagcgctcaggctgattcaggaaactgaagtgatcagccggggcttcacattggtgtctgccgcatgtcccttcaataaagctggccagcacccaagtcaacacctgatagggctgagaaaagcagtgtataggacactcagagcgaatttccaggctgcccgtctggccactctgtacatgcttaaaaattacccacttaacagcgagtctgataatgtcaccaactacatctgcgtggtccccttcaaggagttggggctgggcctgagtgaagaacagattagtgaggaagaggctcataactttactgacggtttctcgctgcccgcacttaaagtgttgtttcaactatgggttgcccagtcctcagaattttttcggcgactagcgctgttactctccacagccaattcgccccctgggcccttactcaccccagccctactgccacatcggattctgtctgacgttacccaggggttaccccatgcgcactcagcatgtctggaggaacttaagcggagctacgaattttataggtacttcgagacacagcaccagagcgtgccacagtgtctgtcaaagacccagcagaagtccagggaactcaacaatgtccacaccgcagtccgatcactacagctgcacctaaaggcacttctaaacgaggtgattatactggaggatgaactagagaagttggtctgcactaaggagacacaggaattggtctccgaggcatatcctatcctcgagcagaaattgaaactgattcagcctcacgtgcaggcaagcaacaactgttgggaagaggccatatctcaagtggacaaactgctgcgccggaatacagacaagaaaggaaagcctgagatagcttgcgaaaaccctcattgtacagttgtgcctctcaaacagcccactctccacatcgccgataaggacccaatccccgaggagcaggaactagaagcttatgtggacgatatcgacattgacagcgactttaggaaggacgatttctactacctgtctcaggaagataaggagcggcaaaaacgagagcacgaggagagcaaaagagttcttcaagagttgaaatctgttctggggttcaaagcctctgaggccgaacgccagaaatggaaacaactgctgtttagtgaccatgccgtgctgaagtctttatcgccagtcgatccagtcgagccgatctcgaactcagagccatcgatgaacagcgatatgggcaaagtgagtaagaacgacacggaggaagaaagcaacaagtccgccacaacggataacgagatttcacgcacagaatacctgtgcgagaactccctggaggggaaaaataaagataattcaagtaacgaagttttcccacagggcgctgaagagcgtatgtgttaccagtgtgagagtgaggatgagccgcaggctgatggcagcgggttgaccacagctcctcccacccctcgggactcactccagccttccattaaacagcgattagcccggttgcagctctctccagattttactttcactgccggcctggcagctgaagtggcggcccgatctctatctttcactacaatgcaggagcagacattcggaggcgaagaagaagaacaaataatcgaagaaaacaaaaatgagatcgaggagaaatag

SEQ ID NO: 31903 - DNA, 2340 bp, Artificial Sequence
  Description of Artificial Sequence: Synthetic coding sequence
atgctgccggatatggaggacgtgcacctattccaaaattccccgttgtatcaatatttgcaggatttgggccatacagattttgaaatttgctccagtctgagtcccaagactgagaaatgtactaccgagggacaacagaaacccccaacaagggttctgccaaaacaaggcattctgctgaaagtcgccgagaccatcaaaagctggatctttttcagccaatgtaataagaaagacgatctactccacaaattagacataggattccgactggacagcctccacacaattttacaacaagaggtcctgctgcaggaagatgtggagctcatcgagctgctggacccctcaatcctgagcgctggccaatcccagcagcaggagaatgggcacttacccaccttgtgctcactcgcaacgcccaatatctgggatctctcgatgctgtttgcctttatctccctgcttgtcatgctacctacttggtggatagttagcagttggctggtgtggggagtcatactgtttgtttatctggtgattcgagccctgcggctgtggaggactgccaagcttcaggtcacgttgaagaagtactcagtgcatttagaagacatggctactaactctagggccttcaccaacttggtccggaaggcactgcgccttattcaagagaccgaggtgatctctcgggggttcactctcgtgagcgccgcttgtccctttaacaaggccgggcaacacccctcacagcaccttatcggcctgcgcaaggcagtttatagaacattgcgggcaaactttcaggctgctagactggcaaccctgtatatgcttaagaactaccccctaaactctgagtcagacaacgtgactaattacatatgcgtggtccctttcaaggagcttggactaggactctctgaagagcagatctcggaggaagaggctcacaactttaccgacggcttttctctccccgcactgaaggttcttttccagctttgggtcgcacaatcatctgaattttttcgaaggctagccctgctgctcagcacagctaactcccctcctggtccactgctcaccccggcactgctgccgcaccgtatcctttcagacgtgactcagggcctgcctcacgcacactctgcctgtcttgaggagttaaaaagatcttacgaattctaccggtattttgaaacccagcaccaatccgtgccccagtgcctctccaagacccagcagaagtccagggagctcaataatgtgcacactgccgtgcggtctttacagctgcatctcaaagcattgctaaatgaggtgattatcctggaagacgagctggaaaaattggtctgcaccaaggagacccaggagttggtctccgaagcctatcctattcttgagcagaagctcaagctgatccagccacatgtgcaggctagcaacaactgttgggaagaagcaatcagtcaggtcgataagctcctgagacggaacacagacaagaaggggaaaccagaaatagcctgcgagaatccccattgtactgtggtccctctcaagcaacccacactgcacatcgctgacaaagaccctattcctgaagagcaagagcttgaggcatacgttgacgatatcgacatcgactccgacttcaggaaggatgatttttactacttgtctcaggaagacaaggaaagacagaagcgcgaacacgaggaatcaaaaagggtgcttcaggaattgaaaagcgtgcttggcttcaaggcctcagaagctgaacgccagaagtggaaacagctgttattttccgatcacgcagtcctgaagagcttaagtccagtagacccagtcgagccgatttcaaattccgaaccatctatgaatagtgatatggggaaggtgagtaaaaatgatacggaggaagaatctaataaatcagccacgactgacaacgagatcagcaggacagagtacctgtgcgaaaacagcctggagggcaagaacaaagataactccagcaacgaggttttcccacagggtgccgaagaacgcatgtgctaccagtgtgagtctgaggacgagcctcaggcagacggcagcggcctcaccaccgctcctcctacccctcgagactcccttcagccatccattaagcagagactcgcccggttgcagctcagccctgacttcacttttaccgcaggcctcgccgcagaagtggcagcacggagcctgtcattcactaccatgcaagaacagacattcggtggcgaggaggaggagcagatcatcgaggaaaacaaaaacgagatcgaggaaaagtag

SEQ ID NO: 31904 - DNA, 2340 bp, Artificial Sequence
  Description of Artificial Sequence: Synthetic coding sequence
atgacgccagagtttgacgaggaggtcgtgttcgagaattcccccctgtatcaatatctgcaggatttggggcacactgattttgagatttgttcctctttgtctccaaagactgaaaaatgcactacggaaggacagcaaaagccaccgacaagggtgctgccgaagcaggggatcctccttaaagttgccgagacaattaaatcatggatctttttttcacaatgcaataagaaggatgacctgctccacaagttagacatcggtttcaggttagacagtctgcacactatactccagcaggaagtgctgcttcaagaggacgtggagctgattgagttgctggatccttccattctctcagccgggcagagccaacaacaggagaacggacatcttcctactctgtgtagccttgctacacctaacatttgggatctctccatgctctttgccttcatttccctcctggtgatgctgcccacgtggtggatcgttagttcatggctggtttggggggtaatcctatttgtctatctcgtgatccgggccctgcggttatggcgaacggccaagctgcaggtgactctgaaaaaatacagcgtccacctagaggacatggccactaatagccgagctttcaccaatctcgtgagaaaggcacttagacttattcaggagacagaggtgataagcagaggttttacacttgtgagcgccgcttgtccgttcaataaggctggtcagcatccctcccagcacctcatcggtttgcggaaagcggtgtatagaacgctgagagccaatttccaggccgctaggctcgcgactctctatatgttaaagaactatccactgaatagtgaatccgataacgtcaccaactatatttgcgttgtcccattcaaggaacttggcttggggctgtctgaagagcaaatctccgaggaagaggcccataactttaccgatggcttctccttaccagccttaaaagtgctgtttcaactgtgggtggcacaatccagtgagttcttcaggcggctggcgctgcttttaagtactgcaaattccccccccggcccgctgctgacgccagctctgttaccccaccgaattctgagtgatgtcacccagggcctgccacacgcgcacagcgcgtgcctggaggagcttaagcgctcttatgaattctaccgttacttcgagacacagcaccagtccgttccccagtgtctgagcaagacccaacagaaaagtcgagagttgaataatgtacatacagctgttcggtctttgcagctgcatctgaaagccctcctcaatgaggtgattatactggaggatgagctggaaaagttggtgtgcactaaggagactcaggagcttgtctccgaggcttaccccatactggagcaaaaattgaaactcatccagcctcatgtgcaggctagcaacaactgttgggaggaggctattagtcaggttgacaagctgctgcggcggaacaccgataaaaagggtaaacctgagattgcttgcgaaaacccacattgcactgtcgtgccactgaaacagccaactttgcatattgctgacaaggatcctatccccgaggaacaggagctggaggcctatgtcgatgacattgatatcgactccgatttcagaaaagacgacttctactacctttcccaggaagataaagagcggcagaagcgggaacacgaggaatccaaacgcgtgttgcaggaacttaaatccgtgctaggattcaaggcgagtgaggcggaacggcagaagtggaaacagttactcttttcagatcatgctgtattgaagagcctgtcacctgtcgaccctgtggaacccatctcaaattccgagcctagcatgaacagcgacatgggaaaggtgtctaagaatgacactgaagaggagtctaacaaatccgctacaactgacaacgagattagtcgcacagaatacctgtgcgagaactccttagaagggaagaacaaggacaactccagcaacgaagtgttccctcagggagccgaagagagaatgtgctaccaatgtgagtcagaagacgagccccaagctgacggctctggactgacaacggctccacctacaccacgcgactcgctccagcctagcattaagcagcgcctggcccgcctccagctgagccctgacttcacctttacagctggactcgctgcagaggtggccgcaaggagcctcagctttaccaccatgcaggaacagacattcgggggggaggaagaagaacagataatcgaagagaacaaaaatgaaatagaggaaaagtag

SEQ ID NO: 31905 - DNA, 531 bp, Artificial Sequence
  Description of Artificial Sequence: Synthetic coding sequence
atggcagctcctgtgttgctgagggtcagtgtgcctcggtgggagagggttgctcgttacgcagtgtgcgccgccggaatcctgctgtctatatacgcctaccacgtggagcgggagaaggagagagacccagagcaccgggctctctgtgatttgggcccatgggtcaaatgttctgccgcgctcgcttcgaggtggggaaggggctttggactgctaggttctatctttggaaaagacggcgtccttaaccagccaaattccgttttcggtcttattttttatattttgcagcttctcttgggcatgactgccagcgctgtagccgcattgattctgatgacctcatctataatgagtgtggtcgggtctttgtacttagcgtacatcttatactttgtgctcaaggagttctgtatcatctgtatcgtgacctacgtgctaaacttcttgctcttaattattaactacaaacgcctggtctatttaaatgaagcctggaagagacagctgcagcccaaacaggattag

SEQ ID NO: 31906 - DNA, 306 bp, Artificial Sequence
  Description of Artificial Sequence: Synthetic coding sequence
atggagcggcctgataaagcagcccttaacgccctgcagcctccagaattcaggaacgagagcagcctggcatccaccctgaaaacattactcttctttaccgcgttgatgatcactgtccccattggactatacttcacaaccaaaagttacatcttcgaaggggccttaggtatgtcaaacagagacagctatttttatgctgccatcgtagcagtggtggccgtgcacgtggtgttggctctttttgtgtacgtggcctggaacgagggttccagacaatggcgcgagggcaagcaggattag

SEQ ID NO: 31907 - DNA, 471 bp, Artificial Sequence
  Description of Artificial Sequence: Synthetic coding sequence
atgctgggatctccttgtgggcctcagctcagcgatcgagacgctgatgaggaccagtgctcacgcgaatttcgaggcagaagaagccgcagacctcccagacgaaccatgttgagaggaaagagccgactgaatgtggaatggctaggctacagccccggcctgctgttagagcatcgtccacttctggctgggagaaccccccggtctcatcggcggaatgaatccagcctagcttccaccctaaagacactgctgttcttcactgcactgatgatcacagttcctatcggattgtatttcaccactaagtcttacatttttgagggcgccttgggcatgtccaatcgggactcctatttctatgcagctattgtggccgtcgtggcggttcatgtggttctggcgctcttcgtctatgtcgcgtggaatgaaggctccaggcaatggagggagggcaagcaggattag

SEQ ID NO: 31908 - DNA, 1188 bp, Artificial Sequence
  Description of Artificial Sequence: Synthetic coding sequence
atgactcacaccctctatcctacccctttcgcattgtatcccattaacataagcgcagcttggcatttgggaccactgccagtctcctgcttcgtcagcaacaagtaccagtgttctctagcattcggcgctaccaccggtttgcgagtcctggttgtggtggtcccacagacgcagctgtctttcctgtctagcctatgcttagtgagtctgttcctccacagcctcgtctcagctcatggagaaaaaccaacgaagccggtcgggctggacccaacccttttccaggtggttgttgggatcctaggtaacttttccctcctgtactattacatgttcctttacttccgcggttataagcctagatcaaccgacctcatcctgcggcatctgactgttgccgactccctagtcattctgtccaagagaatccctgaaacaatggccaccttcggactgaagcacttcgacaattacttcgggtgcaaattcctattgtatgcccaccgcgtgggacggggcgtcagcatcggaagcacttgtttacttagtgtgttccaggtgatcactataaatccgaggaactctagatgggcagaaatgaaggtgaaggcaccaacctacatcggcttgagtaatattctgtgttgggcatttcacatgctggtaaacgccatcttccccatctacactaccggcaaatggagtaacaataatatcaccaagaagggcgatctaggatattgttcagcccccctaagcgacgaggtgactaagtccgtgtatgctgccctgactagcttccatgacgtcttatgcttggggttaatgctgtgggcctcgagtagtattgtgttggtactctacagacacaaacagcaggtacaacacatctgtagaaacaacctctatcccaactcctctccaggcaaccgggctatccagtcaatcttggccctcgtgagcactttcgccctctgttatgctctgtctttcataacttacgtgtaccttgcattatttgacaactccagctggtggttggttaataccgctgccctaatcattgcttgcttcccaaccattagcccctttgtgctcatgtgcagagatccctcccgctcaagactttgctccatatgttgtcgccggaatcgccgattctttcacgattttaggaagatgtag

SEQ ID NO: 31909 - DNA, 8487 bp, Artificial Sequence
  Description of Artificial Sequence: Synthetic coding sequence
atgcccaaacgggctcactggggagccctcagtgtcgtgctcattctcctctgggggcatcctcgcgtggccctggcatgcccacacccatgtgcctgttatgtgcctagtgaagttcattgtaccttcaggagtctcgccagtgtgccagccggcatcgcaaagcacgtcgaacgcattaatctgggatttaattccatccaggcgctatccgaaacaagtttcgccggcctcactaaactggagttactgatgatccacgggaacgaaatcccatcaatccctgacggcgccttgagggacctgagctccctgcaggtctttaagttctcttacaataaattacgcgtgatcacaggacagacgctgcagggcctctcgaatttaatgaggctacacatagatcacaacaagatcgagttcatccatcctcaagctttcaacggtctgacatccctgcgcctactccatctggaaggcaatcttctgcaccaactgcatccgtccacattttcaacttttactttcctcgattactttcgcctttccaccattcgccatctctatctggctgaaaacatggttcggactctcccagccagtatgcttcgtaatatgccgctgcttgagaatctttatctacagggaaatccttggacatgtgattgcgaaatgcgttggttcctggaatgggatgccaagtcccgggggatacttaagtgcaaaaaggacaaagcttacgaagggggacagttgtgtgccatgtgttttagtcctaagaagctctataaacatgagattcataaactgaaagatatgacgtgcctcaaacctagcatagagtcccctctgcgacagaaccgcagccgctccatcgaggaggagcaggaacaggaggaggacggggggtcacagctgatcctcgaaaaatttcagcttcctcagtggtccatctccctgaatatgaccgatgagcacggtaacatggtcaaccttgtatgcgatattaagaagcctatggacgtctacaagatccatctcaaccagacagatccaccggacatcgacatcaatgctacagtcgccctggactttgagtgcccaatgaccagggagaactatgagaagctctggaagctaattgcctactactcagaggtgccagtgaagttgcatcgggagctgatgctatcgaaggacccacgggtgtcataccaataccgccaggacgccgatgaggaagccctgtactacaccggcgtgcgcgcccagatcctggcagagcccgaatgggtcatgcagccctccatcgacattcagctcaatagacggcagtctaccgccaagaaggtgcttctaagttattatacacagtacagccagaccatttctaccaaggatacacggcaagcccgagggcgatcttgggtaatgatcgaaccctcgggcgcagtgcagcgggaccaaacagtgttagagggcggaccgtgccaactctcttgtaatgttaaggctagtgaatccccatccatcttttgggtactccctgacggctcaatcctgaaggctcctatggacgatccggattccaagttctccatcctctcgtccggttggctgcgcatcaaaagcatggaaccctctgactccggcctctatcagtgtatagcccaggttcgggacgaaatggacagaatggtgtaccgcgtgttggtacagagtcctagcacgcagccggcggagaaggacaccgtcaccatcgggaagaaccccggagaatccgtaacacttccgtgtaacgcgttggccatcccagaggcccacctctcatggattcttccaaacaggcgaatcatcaatgacctagctaacacaagccacgtgtacatgctaccaaacggtacactgagcatccctaaagtgcaggtaagcgacagcggttactaccggtgcgtggcagtcaatcagcagggcgctgatcactttacagtggggatcacagtgactaagaagggttccggcctccctagcaaacgtggacgccggccgggagctaaggctctcagccgggtgcgggaagatatcgtggaagatgagggtgggtcagggatgggagacgaagagaatacttctagacgcttgctccaccctaaggaccaggaagtgtttctgaaaactaaagatgacgctatcaacggagacaagaaagcgaagaaggggagacggaaactcaagctgtggaagcattcagagaaggaacctgagacaaatgtggcggagggccgccgcgtgtttgagagtcgccgcagaattaacatggcaaataagcaaatcaatcctgagcgatgggccgacatcctggccaaagtgcgaggcaagaaccttcccaaaggcacagaggtgcctcctctgattaagaccacgtctcctccatcgctgtcgttggaagtcacacctccgtttcctgccattagtcctcccagcgcatctccagtgcaaaccgtcacctcagctgaggaatctagtgcagacgttcctctgttgggggaagaagaacatgtgctgggcacaatttcctccgcctcgatggggttggagcacaaccacaacggtgtcatcctggtcgagccagaagtgacgtccacccctctggaggaagtggtggacgaccttagcgagaaaactgaggagatcacaagtacggagggcgaccttaaggggacggccgccccaaccctcatctcagagccctacgagccatctcccaccctgcacacattggacactgtgtatgagaagccgacccatgaagaaacagctaccgagggttggtctgccgccgacgtgggctctagccctgagcctacaagctccgaatacgaaccccctttagatgccgtttccctggccgagagtgagccgatgcaatattttgaccctgaccttgaaaccaaatctcagccagacgaagacaagatgaaagaggacaccttcgcacatctaacccccactcctactatatgggtcaacgattccagtacttctcagctctttgaagatagcacaattggggagccaggcgtacctggccaaagtcatcttcagggcttgaccgataacatccaccttgtgaagtcaagtctctctacacaagacacacttctcatcaagaaagggatgaaagaaatgagccagacattgcagggtggaaacatgcttgagggggaccccacccacagtcgctcgtctgagtctgagggtcaggaaagtaaatccatcaccctccctgattcgacgctgggcattatgagctcaatgtctcctgtgaaaaagcccgctgagacaaccgtgggaacactactagacaaggacacgacgaccgccaccaccaccccacgccaaaaagtggctcctagcagcaccatgagcacgcacccctctcggcggcgacccaacgggcgccgccggctgagaccaaataaatttaggcaccgtcacaagcagacacccccgaccacattcgccccttctgaaaccttctctacccagcctacccaggccccagatatcaaaatcagcagtcaggtcgagagtagccttgtgccaacagcctgggttgacaacaccgtgaatacacccaaacagctcgagatggaaaagaatgctgagcctacatccaaaggtactccccgcagaaaacacgggaagagaccaaataagcacagatacacacctagtaccgtgtctagcagggcgtcagggtcgaaacctagcccctcccccgagaataagcataggaatatagtgactcccagctcagagacaatcctgctgcctcgtacagtgtctctcaaaaccgagggcccctacgattcactggattacatgacaactaccagaaaaatctacagctcctacccgaaagtgcaagaaactcttcctgtcacttataagccaacctccgacggcaaagagatcaaggacgacgtggcgaccaatgtcgacaagcacaaatccgatatcctcgtgaccggagagagcatcaccaacgcaattccaacgtccaggtcgcttgtgagcacaatgggagaattcaaagaggaatcatcccccgtgggctttcccggtacgccaacttggaacccgtctcgcaccgcgcagcctggccggctgcagaccggcattcccgtgactacgagcggggaaaacctaaccgatccacctctgttgaaagaattagaagatgtagacttcacatcagagtttctatcaagtctgacagtgagtactccctttcaccaggaggaggcaggtagctctaccacactgtccagcattaaggtggaagtcgcatcttcacaggccgaaaccaccaccctggatcaggatcatctcgagacgacagttgctattctgttgtctgagacccgcccccaaaaccacaccccaacagcagcacggatgaaggagcctgcttctagctccccctccactattcttatgagtctggggcaaacaactacaaccaaaccagccctgccgagtccacgcatcagtcaggcaagtagggacagtaaggagaatgtttttctcaattatgtgggaaacccagagaccgaggcaacaccagtcaacaatgagggtactcaacatatgtcaggtccaaatgagctcagtacgcctagttccgaccaggacgcatttaacctcagcacaaagctagaactagaaaagcaagtgtttggctcgcggtccctcccccggggcccagactctcaacgccaggacgggagagtgcacgcctcacaccaactgactagggtgcccgcaaagcccattctcccaacggcgactgtcaggctgcccgagatgagcacacaaagtgcctcccgctactttgtcacctcccaatcgccccgtcattggaccaataagcctgaaattaccacgtacccctcaggcgctcttcccgaaaacaagcaattcaccacccctcgacttagcagcacaacgatccctctacctcttcacatgagcaaaccctcgataccatccaaattcacggacaggaggaccgatcagtttaatgggtattctaaggttttcgggaacaataatatacccgaggcacgtaaccctgttggtaaaccaccttcgcctcgcatccctcattactccaatgggagactgcccttcttcaccaacaagactctctcctttcctcagctcggagtcactcggcgtcctcagatccctacttctcccgcaccagtcatgagagaaaggaaggtgattccaggatcatacaatagaatccatagtcattcgacttttcacctggatttcggtccccccgcaccccctctgcttcacactcctcagactaccggcagtccttccacgaacttacagaatatcccaatggtgtcctcaacccagtcttcaatcagctttatcacatcctctgtccagtcatccggctcttttcatcaatctagctccaagttctttgcaggcgggcctcctgcaagcaagttctggagcctgggagaaaaaccacagatcctgacaaaaagcccccaaacggtgtccgtgactgccgaaactgatacggttttcccgtgcgaggccacagggaagcccaaaccctttgtgacttggacaaaagtgtctactggcgcccttatgacaccaaacactaggattcagcggtttgaggtcctcaaaaacggcaccctagtcattaggaaagtgcaggtgcaagaccggggacaatatatgtgcaccgcctctaatttgcatggccttgatcgcatggtggtattactttccgtgacggtacagcagcctcagattctcgcctcacattatcaggacgtgaccgtgtacttaggtgacactatcgccatggagtgcttggcaaaagggacccctgctcctcaaatttcttggatctttccagataggcgggtgtggcaaactgtatctcccgttgagggaagaataactctgcatgagaaccgaaccctttccataaaagaagcctccttctcagacagaggagtatacaaatgtgtagcatccaacgccgccggagctgattctctagctatacgtctacacgtggctgccctgccacccgttattcaccaagaaaagctcgagaatatatccttgccaccagggttaagcatccatattcactgcactgccaaggctgctccattgcccagtgtcagatgggtactgggcgacggtacgcagatcagaccatcacagttcctgcacggaaacttgttcgtgtttcccaatggcactttgtacatccgtaatctcgcgcctaaggattcaggcagatatgaatgcgttgctgccaatctcgtgggatccgctagacggactgtccagttaaatgtacagagagcggcagcaaatgcccgcattaccgggacgagtccacgcagaaccgatgtgcgatatggcggcaccttgaagctagactgttcagctagtggcgatccatggcctcgcatcttgtggagactcccatctaagcgcatgatagacgctttgtttagctttgacagcagaattaaggtgttcgcaaatggcaccctggtggtgaaaagcgtgactgacaaggacgccggagactatctctgtgttgcccgcaataaggtgggagatgactacgtcgtcctgaaggttgacgttgtgatgaaaccagctaaaatcgaacacaaggaggaaaatgatcacaaagtcttctatgggggcgatctgaaggtggactgtgtggccactgggctccccaaccctgaaataagctggagtctccctgacggatcattggtcaactcatttatgcaaagcgacgactctggcggtcgaactaaacggtatgtggtgttcaataatggtacactatacttcaatgaagtcggaatgagggaagagggtgattatacttgttttgcagagaaccaggtggggaaggatgagatgcgggtgagagtgaaagtggtcaccgcacctgccaccataaggaacaaaacatacctcgcagttcaggtgccttatggggacgtggttaccgtggcctgcgaggccaagggggagcccatgccaaaggtcacttggctgtcaccaacaaacaaagttatccctacttcttcagagaagtatcagatttatcaggacggtaccctgctcatccagaaggcccaacgctcggattcgggtaattatacttgtctggtcaggaacagtgccggagaggatcgaaaaacagtgtggatccacgtcaatgtgcagcccccaaagatcaacggcaacccaaatcccatcacaacagtgcgggagattgctgctggagggtctaggaaactgatcgactgtaaggccgaggggattccaacaccacgcgtactgtgggcgttcccagaaggggtcgtgctacccgctccgtactacggaaaccgcattaccgtgcatggaaatggatcacttgacatccgctcactccgtaaaagtgacagcgtacagttggtgtgcatggcacggaatgaaggaggcgaggccagactgatcttgcagctgactgtactagagcctatggaaaagcccatcttccatgacccaatcagcgagaaaatcactgcaatggctggacatacaatttccctgaactgcagcgccgctggtacccccaccccaagtttggtctgggttctgccaaacgggacagacctgcagagcggacaacagctgcagagattctaccacaaagccgacggcatgctgcatatctccggcctgtcctcagtggatgcgggggcgtaccgctgcgtcgcccgcaacgctgcaggccataccgaacgcttagtgtcgctcaaggtaggactaaaacctgaggccaacaagcagtaccataacctcgtgagcatcattaacggagaaacgttaaagctcccctgcacaccgcctggcgccggacagggtcggttttcttggacgctccctaacggcatgcatcttgaaggcccacagacactggggagggtctcgctgctggacaatggcaccctcacagttagggaagcctctgtgttcgatagaggtacttacgtttgccgaatggaaacggagtacggaccaagcgtgacctcaatcccagtcatcgtcattgcttacccacctcggataacaagcgaacccacccctgtaatctacactcgtcctggtaataccgtgaaattaaattgcatggcaatgggaatcccgaaggcagatattacatgggagctgcccgataaatctcacctgaaagcaggggtgcaggcgcggctgtacggcaaccgttttttacaccctcagggcagcctgactatccagcacgccacacagagggacgccggcttctacaagtgtatggccaagaatatcctcgggagtgattccaagacaacttatatccacgttttctag

SEQ ID NO: 31910 - DNA, 1272 bp, Artificial Sequence
  Description of Artificial Sequence: Synthetic coding sequence
atggtcttcgcattctggaaagtgtttctgatcctctcctgcctggcaggacaagtaagtgtggtgcaggtgactattcccgacggctttgtgaacgtgacagtcggtagcaatgttactctgatctgtatttacaccaccaccgtggcatctcgagagcagctgagcatccagtggtctttcttccataaaaaggagatggagccaatatctcacagtagctgtctgtctactgagggaatggaggagaaagctgtctcccagtgtttgaaaatgacacacgcaagggatgcaagaggacggtgctcttggacctccgagatctatttttctcagggcgggcaggctgttgcaattggccaatttaaggaccgcatcacaggcagtaacgaccccgggaatgcctccatcacaatttcccatatgcagccggccgattcgggcatctacatctgcgatgtcaataatccgcctgattttctgggacagaaccagggcatcctaaatgtgtccgtgctggttaaaccttccaagccactttgttctgtacagggacggcccgaaacgggccatactattagtcttagttgtttgagcgcgttggggactccatcacctgtatattactggcataaactcgaagggagggacatagtgccagttaaagaaaatttcaaccccacgactggcattcttgtgattggcaatttaacaaactttgagcaagggtattaccagtgcacggcgatcaaccggctcggcaattctagctgcgagatcgatctaacaagctcacaccccgaagttggtataattgtgggggcgctgattgggtcgctggtaggggctgccatcatcatttcggtggtgtgtttcgcgcgaaacaaagccaaggcgaaagctaaagaaaggaatagcaaaaccattgccgagctggagccaatgactaaaatcaaccctcggggcgagagcgaagctatgcctcgcgaggatgccacacagcttgaggtgactctaccatcatctattcatgaaacaggacccgataccatccaagaacctgattacgaacccaagccgactcaggagccagcacctgaaccagctcccggaagcgagcctatggccgtgcctgatctcgacatcgaactcgaactggagccggagacacaatcagagctggaacctgaaccggaacccgagccagaatccgaaccgggcgtggtggtagagcccttgtccgaggacgagaaaggtgtggtgaaggcgtag

SEQ ID NO: 31911 - DNA, 1623 bp, Artificial Sequence
  Description of Artificial Sequence: Synthetic coding sequence
atggcagctggcgggtccgcgcccgagcccagggtgctggtatgtttaggcgccctgctcgccgggtgggtagccgtcggactggaagcagttgttattggagaggtgcacgagaatgtgactctgcattgcggtaatatttctggtctgcgaggacaggtgacctggtaccgtaataattccgaacccgtgtttctgctgtccagtaactcttctttgcgtcccgctgagcctcgtttctctttagtggacgccacgtctctgcacattgagtctcttagccttggcgatgaagggatctacacttgccaggaaatcctaaatgtgacacaatggttccaagtttggctgcaggtggcgagcggtccttatcagatagaggtgcatattgtggcgaccggaaccctgcctaatggaactttatatgccgcacgaggctctcaggtggacttctcgtgtaactcttcatctcgtcctccaccagtggtggagtggtggtttcaggctctgaactcatcctcggagtccttcggtcacaaccttaccgtgaatttttttagcctcctgctcataagccccaacttacagggaaactatacctgcctcgctctgaatcaattgtctaagagacaccgtaaggtgactacagagcttctggtgtactatccgccaccttcagcccctcagtgctgggcccagatggcgtctggttcctttatgctgcaactgacatgccgttgggacggcggctaccctgatcctgacttcctctggatagaggagccgggcggtgtcatcgtaggtaaatctaagctgggggtggagatgctgagtgaaagccagttatcagacggtaagaaatttaaatgcgtcacgagccatatcgtgggcccagagtcgggagcgagctgtatggttcaaattcgcggacctagtctgctgtctgagccgatgaaaacatgcttcaccggcggaaacgtcactctgacatgtcaagtttcaggggcctacccccccgcaaagatcttatggttgcggaatctgacacaaccagaggtgataatccagcctagttcgcgccacctgatcacacaggatgggcagaatagcaccctgacaattcataactgttctcaggatcttgatgagggatactacatatgcagggccgactcccctgtgggtgtacgcgagatggagatttggctctcagtcaaagagccccttaacattggcggcatcgtcggaacgatcgtttccctgctgcttctgggacttgctattatcagcgggctgctcctccactactcccctgtgttttgctggaaagtcgggaacacctccaggggacagaatatggatgatgtaatggtgctggtcgattcagaagaggaagaggaggaggaggaggaagaagaagaggatgccgctgtgggggaacaagagggggctcgtgagcgtgaggagctccccaaggaaattcctaagcaggaccatattcacagggtgacggccctcgtgaacgggaacatagagcagatgggaaacgggtttcaggatctgcaggacgactcttcagaagaacagtcggacattgttcaggaggaagacaggcccgtatag

SEQ ID NO: 31912 - DNA, 2604 bp, Artificial Sequence
  Description of Artificial Sequence: Synthetic coding sequence
atggacaaccctcaggcactgccactgttcttactgctcgcttcccttgtgggtattctgaccttgcgtgcatcgagcggcttgcagcagacaaactttagcagcgctttctccagcgattccaagtctagctctcaggggttaggggtggaggtcccgagcatcaagcccccctcctggaaagttcctgaccaatttctggattcaaaggcctcagccggaatctcagacagcagctggttccccgaggccttgagctcaaacatgtctggatccttttggagtaacgtgtcggcagaggggcaggacttgtcacctgtgtcccccttctccgagacacccggctcagaggtgttccccgacatatcagatccgcaggtcccagccaaagaccccaaacctagcttcacagtcaagacgccagcttctaacattagcacccaggtgtctcataccaaactatctgtggaagcaccagactctaaatttagccccgacgatatggatctgaaactgtcagctcagagccctgaaagcaaattcagtgctgagacgcatagcgcagccagctttccacagcaggtcggtggacctcttgccgtactagtgggaacgacaattaggctgccgcttgtgcctatccctaaccccgggccgccaaccagcctagtggtgtggcggcgcggatctaaggtgctcgccgctggggggctggggcctggcgcaccactgatttcactagatccggctcacagggaccacctccgattcgatcaggccaggggcgtactggagttggcctccgctcagctggatgacgccggagtgtataccgcagaagtgataagggctggcgtgtcgcagcagactcatgaatttaccgtaggggtgtacgaacccctgccacaactatctgtgcagccaaaggctccggaaactgaggaaggcgccgcagagctcagattgaggtgcctgggttggggaccgggtcggggagaactcagttggagtcgcgatgggagggccttagaggccgctgaaagtgaaggagcagagactccacgcatgaggtccgagggcgaccagctgctcatagttagaccggttagatcagatcacgctcgttatacttgtagggtgaggagccccttcggacatcgggaagccgcggcagacgtttccgtgttctacggcccagacccccccactattactgtcagcagtgaccgtgacgccgcccctgcacggttcgtgacagcaggcagtaacgtgactctgcggtgtgctgccgcctctcgaccccctgccgatatcacttggtcactggcagaccctgcagaggcagccgtgcctgccggttcgcggttgctgctcccagccgttggacctggacatgccggcacatacgcctgcctggcagcgaaccctcgaacaggccgccgccgacgctcactgctcaacttgactgtcgccgaccttcctccgggggccccccagtgttctgtcgaggggggtccgggtgacaggagtcttcgcttccgttgctcatggccagggggcgcccccgctgctagtctgcagtttcagggcctccctgaagggattagggccggtcccgtgtcctctgtgctgttagctgctgttcccgctcatcccaggctctctggggtaccaatcacatgtctggcaagacatttggtcgccactcgcacttgtacagttacaccagaggcaccccgggaggtgcttctgcacccactggtcgcagaaacaagactgggagaagccgaagtggctctggaggccagcgggtgtccaccgcccagcagggcctcctgggcccgtgagggccgacctttagctccgggcgggggcagtagactccgcttgtcgcaggatggccggaagctccatattgggaatttttctctggactgggacctgggtaattattcagttttgtgttcgggggccctgggggccggcggagaccagataaccctgatcggcccttccatctctagctggcggcttcagagggctagggatgctgctgtcctcacttgggatgtggaacgaggggcactgatctcaagcttcgaaattcaggcttggccagacgggccagcactgggacgaacttctacttaccgagactgggtaagccttctgatcctcggtccacaggagagatccgcagttgttccacttcctcccaggaaccctgggacctggacctttcgtattctgcccatcctcggggggcagcccggcacgcctagccagagcagagtgtatagggctggcccgactctgtctcatggcgctattgctggaatcgttttaggctccctacttgggctggcattgcttgccgtgctgctgctcctgtgcatctgttgtctctgtcgctttcgcggcaaaacgcccgagaaaaaaaaacacccctcaactttggtgcccgtggtcaccccgtctgagaaaaagatgcattcagtgacccctgttgagatctcgtggccgctggacctaaaggtccccctggaggatcactcttcgactagagcctaccaggcacagacccctgttcagctctctctttag

SEQ ID NO: 31913 - DNA, 147 bp, Artificial Sequence
  Description of Artificial Sequence: Synthetic coding sequence
atggataacccgcaagcgttgccgctgttcctcctactggccagcctggtggggattctgactctgagggcttcttcaggattacaacagacgaacttctcatccgcgctgcatagagcgttttgggcaagaactagctatttttag

SEQ ID NO: 31914 - DNA, 1200 bp, Artificial Sequence
  Description of Artificial Sequence: Synthetic coding sequence
atgggcatactcctggggctcctgctgttgggccatctgaccgtggacacatacggaagaccaatcctggaggtaccagagtctgttactggcccttggaagggggacgtgaacctgccgtgtacctacgatccattgcagggctatactcaagtactggtgaagtggttagtgcagcgaggctccgatccagttaccatcttccttagggactcctccggtgatcatattcagcaggcaaagtatcagggcagactgcacgtatcgcacaaggtcccaggcgacgtgagcctccagctcagcactctggaaatggatgatcgaagccattatacttgcgaagtgacttggcaaacccccgatggcaaccaggtcgtcagagataaaatcaccgagttgcgggtgcagaagctttctgtctccaaacccacagtaacgactgggtccggatacggctttacagtccctcaaggcatgagaattagcctgcagtgccaggcccggggttccccccctatctcatatatttggtataaacagcagaccaacaaccaggaacctatcaaagttgctaccctgtccacactgctgttcaaaccagcggtaattgcagactctggtagctatttctgcacagctaaggggcaagtcggaagtgagcagcacagcgacatagtgaagttcgtcgtcaaagattcttctaagctgttgaagactaagactgaagccccaacgacaatgacataccccctgaaggcaacatctacggttaaacaaagttgggactggactacagacatggacgggtacctgggggagacaagtgctggaccggggaaaagtctccctgttttcgctatcattctgattatctctctatgctgtatggtcgtctttaccatggcttatattatgttgtgccgcaagacttctcaacaggaacatgtttatgaggctgctcgggcccacgcccgcgaagcaaacgactccggggaaactatgagagtcgctattttcgccagcggctgttccagcgatgagccgacttctcagaacctcggaaacaactacagtgatgagccttgtattggccaggaataccagattattgcgcagatcaatgggaattacgcaaggttactcgacaccgtccctctagattatgagtttttggctactgaaggcaagagcgtgtgttag

SEQ ID NO: 31915 - DNA, 918 bp, Artificial Sequence
  Description of Artificial Sequence: Synthetic coding sequence
atgggaatactccttggtctgcttctcttaggtcatttgacagttgacacgtatggcagaccgatcttggaggttcccgagtctgtcactggaccatggaagggggatgttaacctcccctgcacatacgaccccctccagggctatacacaagttctggttaaatggctggtgcagagaggcagtgaccccgtgaccatcttcctgagggacagcagcggcgatcacatacaacaggcgaaatatcaggggcgattgcacgtgtcccacaaagtgccaggagatgtcagtctccaactttccaccctggaaatggatgacaggtcccactatacttgcgaggttacctggcaaaccccagatggcaaccaggtggtaagggacaaaatcaccgagctgcgtgtgcagaagcacagttctaaactcctcaagacaaagaccgaagcacctaccactatgacttacccactgaaagcgacctcaaccgtaaagcagagttgggattggactaccgacatggacgggtacttaggagaaacctccgcaggcccggggaagagcctgcccgtcttcgctatcatcctcataatttcattatgttgtatggttgtgttcaccatggcgtatatcatgctgtgtagaaaaacatcacagcaggaacacgtctacgaagccgcccgcgctcatgccagggaggctaatgacagcggtgagaccatgagagtcgctatctttgctagcggttgttctagcgacgagccaaccagccaaaatttggggaataattatagcgacgagccgtgtatcgggcaggaataccagatcatcgcgcaaattaacggcaattatgcccgattgctggataccgtgccactcgattatgagtttctcgccaccgaggggaaatcagtgtgctag

SEQ ID NO: 31916 - DNA, 606 bp, Artificial Sequence
  Description of Artificial Sequence: Synthetic coding sequence
atgggcatcctcctaggcctccttctcctggggcacttgaccgttgatacctacggcaggcctattctcgaggtaccagagtccgtgaccggaccttggaaaggggatgtaaatttgccgtgcacttacgacccattgcagggctacacccaagtcctggtcaagtggctggtgcagaggggttccgacccagttacgaccgttaccactggctctggctacgggtttactgttcctcaaggaatgaggatatccctccagtgccaggcccggggctcgcctcctatctcttatatttggtacaaacagcagaccaataaccaggagcccatcaaggttgcaactctgtctactttgctgtttaaacccgccgtcatagcggactccgggagctatttttgcaccgcgaaaggtcaggtcggctccgagcaacattccgacatcgtgaagtttgttgtgaaggactcttctaagctgctgaagacgaagactgaggcccccaccacaatgacttaccctctcaaggcaacatccactgtgaagcagagttgggattggactacagatatggatggttatctgggtgagacatccgcaggaccttag

SEQ ID NO: 31917 - DNA, 825 bp, Artificial Sequence
  Description of Artificial Sequence: Synthetic coding sequence
taagatcacattcagcaggcaaaataccaagggcgcctgcacgtgtctcataaggtaccaggggatgtgtctctgcaattaagcacactcgaaatggacgacaggagccactacacgtgcgaggtgacatggcaaacaccagatggtaatcaggtcgtgcgggataaaatcaccgagctgagagtacaaaagctgtcggtgtccaagcccaccgtgacgacaggttccggctacgggtttactgtcccccaggggatgcgaatttcattgcaatgccaggccaggggatcccctcctattagttacatttggtacaagcagcagaccaataaccaggaacctattaaggtcgctactctatctactctcttgttcaaacccgcggtcatcgcagattccggctcctatttttgcacggccaaaggacaggttgggtcagagcagcactcagatatcgtgaagtttgtggtgaaggacagttcgaagctgttaaaaacgaaaaccgaggcccccactacaatgacatatccacttaaggctaccagtactgtcaagcagagctgggattggacaaccgatatggacgggtacctgggcgaaacatccgccggccctggtaagtcactacccgttttcgccatcattctcatcattagcctatgttgcatggtcgtgtttactatggcatacatcatgctctgtcggaaaaccagccagcaggagcacgtgtacgaggcagcatccccaaaatgccccccgactaacactggagccgctggatcgcactggctgtgcccgggcatatgccagatgcatttgaaatag

SEQ ID NO: 31918 - DNA, 966 bp, Artificial Sequence
  Description of Artificial Sequence: Synthetic coding sequence
atgggtattctccttggactgctgctgcttggacacctgaccgtagacacgtatggacgcccgatcctggaggttccagaaagtgtaactggtccctggaagggcgatgtcaatctgccctgtacctacgatccacttcagggctacacccaggtcctcgtaaagtggcttgtgcaacgcgggagcgaccccgtgactatcttcttgcgggactcttcgggagatcatattcagcaggcaaaatatcaggggcgccttcacgttagccataaggtgcccggtgacgtgtcattacagctctctaccctcgagatggatgaccgatcccattacacatgtgaagttacatggcaaactcctgacgggaatcaggtcgtccgtgacaagattacagagttgcgggtgcaaaagctgagcgttagcaagcctacagtgaccacggggagcggctacggtttcaccgttccgcagggcatgagaatatctctccagtgccaggcaaggggctctcctccaatttcctacatctggtataaacaacagactaacaaccaggagccaatcaaggtagctaccctgtcgaccctactgtttaagccagccgttatcgccgacagcggatcttatttttgcaccgccaaaggtcaggtaggatctgagcaacatagcgatatcgttaaattcgtcgtcaaggattcctcaaaactgctgaagacaaaaacagaggcacctacaactatgacctatcctctgaaggctacatctaccgtaaagcagtcttgggactggacaacggacatggacggttatttgggcgagacatccgccgggccggggaaatccctccccgtgtttgcaatcatcctcatcattagcttgtgctgcatggtggtgtttacaatggcttacattatgctctgcaggaagacttcgcagcaggaacacgtgtacgaggcggccagatag

SEQ ID NO: 31919 - DNA, 1245 bp, Artificial Sequence
  Description of Artificial Sequence: Synthetic coding sequence
atgcgcgtgggcggggcttttcatttattactggtctgcttaagtcctgctctactgagcgctgtgcgaatcaatggagatggacaagaggttctgtacctggctgaaggggataatgtgagattgggatgcccgtacgtgcttgatcccgaggattatgggccaaacggcctcgatattgagtggatgcaagtcaactccgaccctgcccatcatcgcgaaaacgtttttttgagttaccaggacaagagaattaatcatggctccctgccacatcttcagcaacgtgttcgtttcgccgcgagtgatccttcacagtacgacgcgtccattaacttaatgaaccttcaggtgtcggatacagccacatatgaatgtagagtcaagaaaacaactatggctacgaggaaggtcattgtcaccgtccaggctcgacccgcggtgcccatgtgttggaccgagggacatatgacctatggtaacgacgtggtcctgaagtgttacgcatctggagggtcacagccactcagctataaatgggctaagatcagcggtcaccactatccttatcgtgctggatcatacactagccagcactcctatcactcggagctctcttaccaggagtcttttcacagttcaattaatcaggggttaaataacggcgatctagtgctcaaggatatcagccgagccgatgatggcctttaccaatgcaccgtggcaaacaacgtcggatattcggtctgcgtggtggaggtcaaggtctctgactcacgtaggattggggttattattggtattgtgctgggatctctcttggctttgggttgcctcgcggtgggcatttggggcttggtctgttgttgttgtgggggctccggcgctggcggcgcacgcggagcctttggctatggaaacgggggaggtgtggggggcggtgcctgtggcgatcttgcgagtgaaatccgagaagatgccgtcgccccagggtgtaaggcgtccgggcggggatcgcgcgtaacacacctgctggggtacccgacacaaaacgtaagccgcagtcttcggcgaaagtatgcccctcccccctgcggcggtcctgaagatgtggctctggccccttgcacggccgccgccgcatgtgaggccggacccagccctgtctacgtgaaggtgaaaagtgccgaacctgcagactgcgctgagggaccggtgcaatgcaaaaatgggctcctggtttag

SEQ ID NO: 31920 - DNA, 576 bp, Artificial Sequence
  Description of Artificial Sequence: Synthetic coding sequence
atgcgactgttggcactggcagcagctgcattgctggccagggcccccgcccccgaggtttgtgccgccctgaacgtcaccgtctcccctggcccagtggtggattacctggagggtgagaatgcgactctgctgtgccacgtctctcagaagcgtcgtaaggactccctgctggcggtgagatggttttttgctcattcattcgactcgcaggaggccctcatggtcaaaatgaccaagctgcgagtggtgcagtattatgggaacttttcaaggtcagctaaacggaggaggctcagactgctggaagaacagaggggcgccctctataggctcagcgtgttgactctgcagccgtccgaccagggccactacgtgtgtagagtgcaggaaatttctcggcatagaaacaaatggaccgcttggagcaacgggtcaagtgcgaccgagatgcgtggtgtatcaagtcatcccgtagagcgaggcgcatttcttgggatctcccttgtgattctgccccatagcctgccattcacagctgatttaaccatggcgtcgtttcttcagtcctcctag

SEQ ID NO: 31921 - DNA, 963 bp, Artificial Sequence
  Description of Artificial Sequence: Synthetic coding sequence
atgagattactcgcactcgccgccgctgccctattagccagggcaccagcgcccgaggtctgcgctgcactgaacgtgaccgtgagcccgggtcccgtggtggactacctggagggtgaaaacgccacactgctgtgtcatgtgtcccaaaagcgcagaaaagattccttgctggccgtccgctggttcttcgcacattcctttgactctcaggaggctttaatggttaagatgacaaaattacgtgttgtgcagtactatggtaacttttctagaagcgcaaagagaagacgtctgcgtctcctggaggagcagaggggcgctctgtatcgcctctctgtcctcacactccaaccctctgatcagggacattacgtgtgtagagtgcaggagatttctcggcaccgtaacaagtggacagcatggagtaacgggagtagcgctaccgaaatgagggtcatctctcttaaggccagcgaggagtcaagttttgagaaaacaaaagaaacttgggctttctttgaggatctttacgtttacgccgtgcttgtatgctgtgtcggaatccttagtatcctactgttcatgctggtgattgtttggcagtcagtctttaataagcgtaaatccagagttagacactatctggtcaagtgcccacagaactcttcaggggaaacggtgacctctgtaactagcctggcccccctgcaacccaagaaaggaaagcgtcagaaagagaaacccgatatcccaccagccgtgccggcaaaggcccccatagccccaacgttccacaagccaaaactgctcaagccacagcggaaggttactctaccgaagatcgctgaggagaacctaacttatgccgagctggagctcatcaagcctcacagagccgctaagggtgccccgacatcaaccgtatatgcccagatcttgtttgaggagaacaagctgtag

SEQ ID NO: 31922 - DNA, 603 bp, Artificial Sequence
  Description of Artificial Sequence: Synthetic coding sequence
atgaggcccttgccgtccggacggcgcaagacgcgtggaatctcactgggtttatttgccttatgcctcgcagccgctaggtgccttcagtcccagggcgtcagcctctacattccacaggccaccatcaatgccaccgttaaggaagatatcctactgtccgtcgagtattcctgccacggagtccctactattgaatggacatattccagtaattggggcactcagaaaattgtagaatggaagcccggaacccaggctaacatctctcagtcacacaaggatcgcgtttgcacgtttgacaatgggagcatccagctctttagtgtgggcgtacgggatagcggctactacgtaatcacggtcacagagagactaggcagtagtcagttcgggactattgtgttgcacgtcagtgagatactctacgaggacctgcatttcgtagccgtgatcctggcattcttggccgccgtggccgccgtgctgatctccttgatgtgggtttgtaataagtgtgcttataaatttcagcgcaagcgcagacataagctcaaagaatccaccactgaagagattgaacttgaagatgtcgaatgttag

SEQ ID NO: 31923 - DNA, 501 bp, Artificial Sequence
  Description of Artificial Sequence: Synthetic coding sequence
atggcgagtttggggcagatactgttctggagtatcatttccatcatcatcatcttggcgggggctattgctctaataatcggattcggaatatccgcattcagtatgcccgaggtgaacgttgactataacgcttcctccgagacgctgcggtgcgaagccccaagatggttcccccaacctaccgttgtgtgggccagtcaagttgaccagggtgccaacttcagtgaagtctccaatacgagtttcgagctcaacagcgaaaacgtcacgatgaaggtggtgtccgtgctttataatgtgacaataaataacacctactcgtgcatgatcgagaatgacattgcaaaggctaccggcgatatcaaagtgactgagagtgagatcaaacgtaggtcacatctccaactgcttaactcgaaggcaagtttatgtgtctcaagttttttcgctatcagttgggccctgctgcccttatctccctacttaatgttaaaatag

SEQ ID NO: 31924 - DNA, 858 bp, Artificial Sequence
  Description of Artificial Sequence: Synthetic coding sequence
atggtgcttcttacgtcacggatgaaacccttgacctccaggattatctccatcattattatattagcaggtgcaatcgccttaattatcggcttcgggatctcgggtcgacacagtattacggtgacaaccgtcgcttctgctggtaatattggagaggatggcatactctcttgcacattcgaacctgatatcaaactttcagatattgtcatccagtggttgaaggaaggcgtgcttggcctagtgcatgagttcaaggaaggcaaagacgagctgtccgaacaggacgaaatgtttcgaggccgcactgctgtgttcgctgaccaggtcatcgtgggcaacgcttcactgcgactcaagaatgtgcaactgacggatgcaggtacatataagtgctatataataacgtccaaggggaaggggaatgccaatctcgagtataaaactggagccttctcaatgcctgaggtgaatgtggactataacgcatcatctgaaactttaagatgtgaggcaccaagatggttccctcagcccacagtcgtttgggcctcacaggtcgaccagggcgcaaatttctccgaggtgtctaatacgtctttcgaactcaatagcgaaaacgtgaccatgaaagtggtcagcgtgctctataatgtgaccatcaataacacctactcctgcatgattgagaatgacatcgccaaggctacaggagacatcaaagtgacagaaagcgagattaagcgcaggagtcatctccaattgctcaattctaaggccagtctctgcgtgtccagctttttcgccattagctgggcacttcttccactgtcaccttatctgatgctgaagtag

SEQ ID NO: 31925 - DNA, 258 bp, Artificial Sequence
  Description of Artificial Sequence: Synthetic coding sequence
gccaccctgcgcaacaagctgatgtggaacatcatcagcataatcataatccttgcaggggcgattgcccttattattggcttcggcatttccgaggtgagtgtctggttgtcggcaatgaaaggctgtcgctcttcaaaggctagcctttcaatcgatttatgtttccttaattgtagggagaccctgcaccattcccattattgcaggctcagttgggagcattggggagggtggaatcctgagctgcacttttag

SEQ ID NO: 31926 - DNA, 849 bp, Artificial Sequence
  Description of Artificial Sequence: Synthetic coding sequence
atggctagtttgggccagatccttttttggtccatcattagcatcatcattatcttagctggtgctattgcactgatcattggattcgggatctctggtcgccacagcatcaccgtaactacagtggctagtgccggcaatattggcgaggatggcatactttcctgtaccttcgaacccgatatcaaactgagcgatatagtgattcagtggctgaaggagggggtactggggctggtgcacgagtttaaagaagggaaggatgagctgtctgaacaagacgaaatgttcaggggccgaactgccgtcttcgctgaccaggtcattgtaggcaacgctagcctccggttaaagaacgtccagctcacggacgctggcacttacaagtgctatataataacatctaaaggcaagggtaatgccaatttggagtataaaaccggcgccttcagcatgcccgaagtcaacgtcgactacaatgcctcttcggagaccttaaggtgcgaagcacctagatggtttccccaaccaaccgtcgtttgggcgtcgcaggtggatcagggggccaatttttccgaggttagtaatactagtttcgagctcaactcagagaacgttaccatgaaggtggtttcggtactctacaacgtgaccattaacaatacatattcatgcatgatcgaaaatgatatcgcaaaggccactggtgatattaaagtaactgagagcgagatcaagcgaagatcccaccttcagctcctcaattcaaaagcctcattgtgcgtctccagttttttcgctatttcatgggcattgctgccccttagcccttacctaatgctgaagtag

SEQ ID NO: 31927 - DNA, 564 bp, Artificial Sequence
  Description of Artificial Sequence: Synthetic coding sequence
atgttccgaggccggactgcagtgtttgctgaccaggtaatcgtgggtaatgccagccttcgccttaaaaatgtgcagttgacagatgccggtacttacaagtgctatatcattaccagcaagggaaagggcaacgccaacctggagtacaagactggagcattctctatgcccgaggtgaatgtggattataatgcttccagcgaaactctacggtgcgaggctcctcgttggtttcctcagccaactgtggtgtgggcctctcaggttgatcagggagccaacttcagcgaagttagcaatacttcctttgagcttaacagcgaaaacgtgaccatgaaagtcgtgtccgtattgtataacgtgaccataaataacacttacagctgcatgattgagaacgacattgcaaaggccacaggggacatcaaggtgaccgagagcgagattaagagaagaagccacctccagttgctgaatagcaaggcttccctgtgcgtcagttccttctttgctatttcttgggctctcctgcccctgtccccctacttgatgctgaagtag

SEQ ID NO: 31928 - DNA, 1434 bp, Artificial Sequence
  Description of Artificial Sequence: Synthetic coding sequence
atgtcaggcgttatgtgtctgaaggcctctgacacctgggcaagcggcatccgatcacagccacagggctgtctggggaagtggcgtagtatgaggtgtaagcacacccggatgcacctcgcccacctgggaaactccaggcaattgatttctctgggacccccacggactagggaagacggatcaaggattagccagcaagtggagcaatcccgtagccaggtgcaagcgattggtgaaaaggtttccctcgctcaggctaagattgagaagatcaaaggctctaaaaaagcaatcaaagttttttctagcgcaaagtacccagcccccgaaagactccaggagtatggctctatcttcactgacgcacaggacccagggctgcagcgtcggccccggcatcgcatccagagtaagcagcggccattggacgaaagagccttgcaagaaaagctgaaggactttcctgtctgtgttagtactaaacccgaaccagaagacgatgctgaagaggggctcggaggactgccctcaaacatcagttccgtcagctctctgttgcttttcaacaccaccgaaaatctgtataagaaatacgtgtttctggacccactggcaggcgccgtgactaagacccacgtcatgctaggtgctgagacagaggagaagctattcgatgccccgctgtctatctccaaaagggagcagctggaacagcaagtcccagagaattatttttacgtgcccgacctggggcaggtacccgagatcgatgttccctcctaccttcccgatctgccaggaattgccaacgacctaatgtacatagccgatctgggacctggtatcgcaccatctgctccaggtacaattcctgagctgcccacattccataccgaggtcgcagaacctctcaaggtcgacttgcaggacggagtcctcacccctccccctccaccacctcccccgccccctgcaccggaagtgctggcctcagcaccaccactccctccttcgacagcagctcccgtcgggcagggggcccggcaggatgactcaagctctagtgcctccccatctgtccagggagcaccacgggaggtggtggaccctagtggaggttgggcgactctgctggagtccattcggcaggcaggtggaatcggtaaagctaagttacgctcaatgaaagaaaggaagctcgagaaacagcagcaaaaggagcaagaacaggtgcgagccacatctcagggtggccacctaatgtctgacctgttcaataaactcgtaatgagaagaaaaggcatttccggaaagggccccggagcgggcgatgggcccggcggggcctttgcccgggtttccgatagtatccccccactccctccgccacagcagccccaagccgaggacgaagacgactgggagtcttag

SEQ ID NO: 31929 - DNA, 510 bp, Artificial Sequence
  Description of Artificial Sequence: Synthetic coding sequence
atgtcaggagaaatggccttccatgaaatgcaggctcacaagaatgcgttgggaactagcggtgagcagcaggctgcagatatcactggaccaacgcctcaccagggcggttggaaacaagtggagcagagtcgcagtcaggttcaggccatcggcgagaaggtgtcactcgcgcaggctaagatagagaagatcaaaggatcaaaaaaggctatcaaggtgttcagctccgccaaatatccagcccccgagaggctgcaagaatatggcagtatttttactgatgctcaggatccaggactgcagcggagaccccgtcaccgtattcaaagcaagcagaggcccctggacgaacgggccctccaggaaaagctgaaggatttccctgtatgtgtttccacgaaaccagagcccgaagatgacgctgaggagggtctggggggcttgccttcaaacattagtagcgtttcctcacttctgctcttcaacactactgaaaacttatattag

SEQ ID NO: 31930 - DNA, 1344 bp, Artificial Sequence
  Description of Artificial Sequence: Synthetic coding sequence
atggcttttcatgagatgcaggcccataagaatgcgctgggcactagcggagaacagcaggccgcagacatcacaggacctacgccgcaccagggtggctggaagcaagtggagcagtcccgcagccaggttcaagctattggtgagaaagttagccttgcacaggcaaaaatcgagaaaattaagggcagtaaaaaggcaattaaagtgttttcatcggctaagtatccggcccccgagaggctgcaagaatatggatctatcttcaccggcgctcaggaccctggcctccagcgaaggccgcggcatcggatacagtcgaagcaccgccccctggacgaacgagcccttcaggagaaactgaaagactttcctgtgtgtgtctccaccaaacccgaacctgaggacgacgccgaagaagggcttggggggcttccaagcaatatttcttccgtctcttcactcctacttttcaacaccaccgagaacctgtacaagaagtatgtgtttttagatccactggccggggccgtgacaaaaacccacgtgatgcttggagccgagacggaagaaaagcttttcgatgcccctctgagcatcagtaagagggagcagctggagcagcaggttcctgaaaactacttttacgtaccggatctgggtcaggtcccggagatcgacgtcccctcatacctgcccgatctcccttcaattgctaacgacctaatgtatagtgccgaccttggcccaggcatcgcaccaagtgctcctgggacaatacctgagctgccaacattccacaccgaggtcgccgaaccactcaaggctgacctgcaggatggcgtgttgactccccctccccccccaccaccccccccacccgcccccgaggttcttgcttcagcacccccactgcctccttctacggcagcccccgtggggcagggtgctagacaggacgacggatccagctccgcctctccatcagttcagggggcccccagggaggtggttgacccgagtggcggctgggcaaccctgctcgagagtatcaggcaggcaggtgggatcggaaaggcaaagctgcggtctatgaaggaaaggaaactggagaagaagaagcagaaagaacaagagcaggttcgcgctacttcacaaggggggcatttgatgtcagacctcttcaacaaactggtcatgcggaggaagggcatcagtggaaaagggcctggcgccggcgagggccctggtggagctttcgcacgggttagcgactccatcccacctgtgcctccccctcagcagccacaggcagaggaagacgaagacgattgggagtcatag

SEQ ID NO: 31931 - DNA, 1437 bp, Artificial Sequence
  Description of Artificial Sequence: Synthetic coding sequence
atgagtggggtgatgtgcctcaaagcctctgacacctgggcctcaggtattcggagccagccccaagggtgtctgggcaaatggcgaagtatgagatgcaaacacaccagaatgcatctagcacatctcggcaacagtcggcagctcatctcccttggcccccccagaacacgggaggacggctcacgcataagccaacaggtggaacagagcaggagtcaggtacaggccatcggcgagaaagtctctctggctcaggcgaaaatcgaaaagattaagggtagtaaaaaggctattaaggttttttcatctgctaaatatcctgccccagagcggctgcaggagtatggatcaatttttaccggagcccaagaccccggattgcagaggagaccccgccatagaatccagtctaaacacagacctctggacgagcgcgcattacaggaaaagctgaaagatttccctgtctgtgtgtccactaaaccagagccagaagacgacgccgaagagggactcggcggtctaccaagcaatatctcatccgtgtcatccttgttactgtttaatactacagagaacttgtacaagaagtacgtatttctggaccccctagccggtgcggtgactaagacgcacgtgatgttgggagctgagactgaagagaaactttttgatgcaccactttccatcagcaagagggagcagttggaacagcaagttcctgagaactatttctacgtgccggatctggggcaagtccctgaaatcgacgtccctagctatctgcctgacctgccttcaatcgctaacgacctcatgtatagcgccgacctcggccccggcattgcgccctccgcaccaggtactattcccgagctgcccacctttcacacagaggttgcggaaccactgaaagccgacctccaggacggtgttctgaccccccccccgcccccaccaccccccccccctgcacctgaggtccttgccagcgcacccccattgcctccttcaacagccgcccctgtgggccaaggggcgcgccaagacgatggcagttcatcggccagtcccagcgtgcagggcgcccctcgcgaagttgtggaccctagcggaggttgggcgactctgttggaatcaatacggcaggccgggggaattggcaaagcgaagctgagatcaatgaaggaaagaaagctggagaagaagaagcagaaagaacaggagcaggtgagggctaccagccaaggcggccatctcatgagcgacctgttcaacaagctggttatgcggcgcaaggggatttcgggaaaggggcccggtgcaggcgagggtcccggcggcgcattcgccagggtctctgactcaatcccccccgtgccaccaccgcagcagccccaagccgaagaggacgaagacgattgggaaagctag

SEQ ID NO: 31932 - DNA, 10581 bp, Artificial Sequence
  Description of Artificial Sequence: Synthetic coding sequence
atgaacatggtcaagcggatcatgggcaggccgagacaggaggagtgttctccccaagacaatgcattgggcctcatgcatttgcgtcgcctgttcaccgagctctgccacccaccaaggcatatgacgcaaaaagaacaggaagagaaattatacatgatgcttcccgtgtttaatagagtcttcgggaacgcacccccaaatacgatgactgagaaatttagcgacctactccagtttactacccaggtctcccgccttatggtaacagagatacgtcggagagccagcaataaatctaccgaggctgcatccagagcaatagtccaatttctggagatcaaccagtccgaggaggcaagcagaggatggatgttgctgacaacaattaatcttcttgcttcatccgggcagaagacggttgattgcatgactaccatgagcgtgccgtccacattggtcaagtgcctctacctgttttttgacctgccacacgttccagaggcagtagggggagctcagaatgagctccctctcgctgagcgaaggggcctgctccaaaaagtgtttgttcaaattctcgtcaagctgtgcagcttcgtaagccccgcggaagaactcgctcagaaagacgacttacagctacttttttctgccataacgtcttggtgcccaccttacaaccttccttggcgaaagtctgctggcgaggtgctgatgaccatctcacggcacggcctgtctgtaaacgttgtcaagtacatccacgaaaaagagtgcctgtccacatgcgtgcagaacatgcagcagtccgatgacctgagcccactcgaaatagtagaaatgttcgcgggcctctcatgtttcctgaaagatagcagcgatgtatcccagacactgttagatgatttccggatatggcagggatacaattttctgtgtgacctgctgctgcgcctggaacaggccaaagaggctgagtccaaggatgccctgaaagatctcgtgaacctgataacatcactgactacatatggagtctccgagttgaaaccagccggcatcacaactggcgcccccttcttgttgcccgggtttgccgtccctcagcccgccgggaaagggcacagtgttcgtaatgttcaggcttttgcggtgctgcagaacgcgtttctcaaagccaagacatcgttcttagcgcagattatactagatgccattacgaacatctacatggccgacaatgcgaattactttatcctcgaatctcaacacactctgtcccaatttgcagagaagatctcaaagctgccagaagtgcaaaacaaatacttcgaaatgctggagtttgtcgtttttagccttaactacatcccctgcaaggagctgatctcagtgagtatcctcctgaaatcctcatcatcttatcactgctccattatcgccatgaagacactgctcaagttcacccggcacgactatatttttaaagacgtattcagagaagtcgggctgttagaggttatggtgaatctgcttcacaagtacgccgccctgcttaaagacccaacccaggccttgaatgaacagggtgattcacgcaataatagtagcgtcgaggatcagaagcatctggcgttgctggtcatggagacattgacggtcttgctgcagggatctaacacaaatgccggaatttttcgcgaattcggaggagcccggtgcgcacataacatagtgaagtacccacagtgtcgccaacatgcactgatgacgattcagcagctggtactgtctccaaacggcgatgacgatatgggtacactcttagggcttatgcacagcgctcctcctaccgaattacagttgaagaccgacattctccgtgctttgctctccgtcctacgggagtctcatagatcccggacagttttccgcaaggtgggtggatttgtgtacataacaagccttctcgtggcaatggagaggagtctcagttgcccccccaaaaacggttgggagaaggttaatcaaaatcaggtgttcgaactactgcacaccgttttttgtaccctgaccgccgccatgaggtatgaaccagctaactctcatttctttaagactgaaatccagtacgagaagctggctgacgcggtacgattcttggggtgcttctctgacctccgcaaaatcagcgcaatgaatgtctttccttcgaatacacaacccttccagcgcttgctcgaggaggatgtcatatctattgagtctgtttcccctacactgcgccactgttcaaagctgttcatttatttgtataaggtggctactgactcattcgactcccgcgctgagcaaattcctccttgcctgacatcagaatcctctctcccatctccgtggggcacccctgccctgtccagaaaacggcatgcctaccactctgtatcaacgccccccgtctaccctccgaagaacgtcgctgatcttaaactgcacgtaacaacgagcagcctacaatcgagcgacgccgtaattattcaccccggcgccatgctggccatgctcgacctgctggcatccgttgggagcgtaacacaacccgaacacgcactcgacctccagctggccgttgctaacatcctgcagagccttgttcacacagagcgaaatcagcaggtgatgtgtgaggccgggctccacgcacggttgctccagcggtgttcggcagccttagcagacgaggaccactctctgcacccgcccctgcagcgaatgttcgagcgcctagctagccaagccctggaaccaatggtgcttcgagaattccttcgactggcgtctccactgaattgcggcgcatgggataagaaactcctgaagcagtacagggtgcataagccatctagcttgagttacgaacccgagatgcgtagcagtatgataacatcgttggaggggctgggaaccgacaacgtcttcagcctccacgaggataaccattatagaatttcaaaatccttggtgaaatccgccgaaggcagcacagtgccgttaacccgggtcaagtgtctcgtgtctatgacaactccacacgatatcagactgcacggtagttccgttaccccggcattcgtggaattcgacactagcttagagggatttgggtgtctgttcctgccatccctggctccgcacaacgctcctacgaataatacggtcaccacaggtttgatagatggcgccgtggtttctggaatcggctctggggagcgcttctttccccctccttcaggcctatcttattcgtcctggttttgtattgagcacttcagcagtccccccaataaccaccccgtcaggctgctgacggtggtgcgccgcgccaatagcagtgagcaacattacgtttgcctggccattgtcctttcggcaaaagatagatcactcatcgttagcacaaaagaagaacttttacaaaactatgtggatgacttttcagaggagtcttctttttacgaaattctgccctgttgtgcccgctttcgctgcggcgaactcatcattgaaggccagtggcaccacttagtgctggtaatgagcaagggcatgctcaaaaatagcaccgccgcactctatatcgacgggcagctcgttaacacagtcaagctccactatgtccacagcactcctggcggctctggaagcgcaaacccccctgtggtgagcaccgtctacgcttatattgggacaccacccgcccagcgccagatcgcctccctggtctggcggctcggaccaactcatttcctagaggaagtgctcccttcttccaatgtgactaccatctatgagttgggccctaattatgttggaagctttcaagccgtttgtatgccatgtaaagatgcaaaaagtgaaggagtggttccctccccagttagtctggttcctgaagagaaagtcagttttggtctctatgccctgagtgtctccagcctgaccgtagctaggatcagaaaggtctataataaattagatagcaaagctatagccaagcagctagggatctcctcccatgagaatgcgactcctgtaaagttgatccataactctgctggtcatctgaacggctcagcccgaaccatcggtgctgcgcttataggatacctgggcgtgcgcacatttgttcccaaacccgtggcgacaaccttgcagtatgtaggcggggctgccgccatcctagggctcgtcgctatggcaagcgacgtggaagggctctacgctgccgtcaaagcgctggtatgcgtcgtgaagagcaatcccctagcttcaaaggaaatggagagaattaaaggttaccagctcctggctatgcttcttaaaaaaaaacggtctttacttaactcccatatcctccacctgacatttagcttggtgggcaccgttgattcggggcatgagacttctatcatccctaatagtacggcttttcaggatctcctttgcgatttcgaagtatggctgcatgctccttacgaactgcatctctccctgttcgagcattttatcgagctcttaacagagtcaagcgaggccagcaaaaatgcgaagttgatgagagaattccagctgattccaaagcttctacttaccttaagggacatgagcctatcacaaccgacaattgctgcaatctcgaatgtgctgagctttttgttacagggttttccatcctctaatgacctgctgcggttcgggcagtttatcagctccactcttccaacattcgcagtttgcgagaagtttgtggtgatggaaattaacaatgaagagaagttagatacggggaccgaggaagaatttggcggcctggtatctgctaatctgatacttctcagaaaccgcctgttggatatcctgctaaaactcatctacacttctaaggagaaaacctcgatcaatctacaggcttgtgaagagttggtgaagacactgggctttgattggattatgatgttcatggaagaacatttgcactccaccacggtgactgctgccatgcgtattctcgtggttctactctcaaatcagagcatcctgattaagtttaaggaggggctgtccgggggaggctggttggagcaaactgactctgtgcttacaaacaagataggaactgtgctcggattcaacgtgggccgctctgctggcggcaggtccacagtaagagaaatcaatagagacgcttgtcactttcccggatttcccgtgttacagtccttcctgcctaagcacaccaacgttcccgcattgtactttctgttgatggctctcttccttcagcagcctgtatcggaactccctgagaacctccaggtgagtgtacccgtgatttcctgtcggtccaaacaaggatgccagtttgatttagactcaatctggacttttatttttggtgtccctgcctcgtctggaacagttgtgtcttcaattcacaatgtatgtacagaggcagttttcctattgctgggtatgttacgatctatgctgacatcgccatggcagtccgaggaagagggctcgtggctccgcgagtaccctgtcaccctgatgcagttctttcgatatttatatcacaacgttccagaccttgcctccatgtggatgtctccggattttttatgcgctttggcagccactgtgttcccctttaacatccggccttacagtgagatggtcaccgatctcgatgatgaggtcggatcgccagcagaggaattcaaggcattcgcagcggatacaggtatgaaccgatcacaaagtgaatactgcaatgtgggaacaaagacttaccttaccaaccacccggcaaagaaattcgtattcgatttcatgagagtgcttataatagataacctatgtctaacacctgcaagcaagcagacccctctgatcgacctgctgttagaggcctctcctgaacgctctacaagaacacaacagaaggagtttcagacgtacatcctcgacagcgtgatggatcacctcctcgcagcagatgtcctgctgggagaggacgcgtcccttccaatcacttctgggggttcatatcaggttctggtgaacaatgtcttctacttcacacaacgagtagtggataagttgtggcagggaatgtttaacaaggagagcaaactcctgattgacttcatcatccaattgattgcacagagcaaaaggagaagccaaggcctgagcctcgacgccgtctatcattgcctaaaccgcacgatcctgtaccagtttagtcgggcacataaaactgtaccacagcaggtggccctcctggactcccttcgggtgctcaccgtcaaccgaaacctaatattgggtccagggaaccacgatcaagagtttattagttgtctggctcattgtttgataaatctgcacgtcggatcaaatgtcgatggattcggcctggaagccgaagctcggatgactacttggcacatcatgatccctagtgacatcgagcccgatggttcttacagccaggacattagcgaggggcgccagctcctgatcaaagcggttaaccgcgtgtggactgaactgattcacagcaagaaacaggtgctcgaagaactgttcaaggtaacactcccagtaaacgaacggggtcacgtcgacattgccacagctagaccactgatcgaagaggctgcgctcaagtgctggcaaaaccacctggcgcatgaaaaaaagtgtatctcccgaggggaggcgctggcccccactacccagagtaagcttagccgagtgtctagcgggttcgggctgtccaagctgacagggtcacgccgtaatagaaaagaatccggactgaataagcactcactctctacacaagagatttcacagtggatgtttacccatatcgctgtggtgagggacttggtggatacacagtacaaagagtatcaagagagacagcaaaacgctctgaaatacgtcaccgaagaatggtgccagatcgagtgtgagttacttcgggaacggggcctctggggaccacctatcggatcccacctagataagtggatgctggagatgacggaaggaccttgcagaatgaggaagaaaatggtcagaaatgacatgttctataatcattacccgtatgtgccagagactgagcaggagaccaatgtcgcctccgagatccctagcaaacagcccgaaacccctgacgatattccacagaagaagccagcccgataccgccgggccgtgtcctatgattcgaaagagtactacatgaggctcgcatctggaaacccagccattgttcaagacgctattgtggaatcttccgaaggcgaggctgcccaacaggaacctgagcacggggaagatacaatcgccaaggtaaagggtttggtcaagcctcccctcaagcgttctcgatcagctcccgacggaggggacgaggagaaccaggaacagctacaggaccagattgctgaggggtcttccattgaggaggaggagaagactgataatgcaacactcttacgcctgctagaggagggcgagaagatccagcacatgtacaggtgcgcacgggtgcagggtttagacacttctgaaggtctccttcttttcggaaaagagcatttttacgtcattgatggatttaccatgactgctacccgagagattcgggatatcgagactctgccgcccaacatgcacgagcctataataccccggggagcccggcaagggcccagtcagctcaagaggacttgttctatattcgcctacgaggacatcaaggaggtgcacaaaagacgctatctgctgcagcctatcgccgtggaagtattttctggggatggcaggaactacctgctagcgtttcagaaaggaatccgaaataaggtttaccagaggttcctcgcggttgtgccaagcctcacagactcatctgagtccgtgagtggccaacgccctaatacctcggtggaacagggctccgggctactgtcgacactcgtgggtgagaaatcagtgacccagcgctgggagcgtggagaaatatctaattttcagtacttaatgcacctaaataccttggccgggagaagctataacgatcttatgcagtatcccgtattcccctggatcctggccgactacgatagtgaagaagtcgatttgaccaatcccaagacattccgcaacctggccaagccaatgggcgcccagacagacgagcgccttgcgcagtataagaaacgatataaagattgggaagatcccaatggggaaaccccagcttaccactatggaacgcactactcttctgccatgattgtggccagctatctggtgaggatggagcctttcacacagatatttcttcggctgcagggaggacacttcgacttggcagatcggatgttccacagcgtcagggaagcttggtatagtgcctcgaagcataatatggccgacgtcaaggaactgatccccgaattcttttacctgccagaattcctgtttaatagtaacaactttgatttgggctgtaaacagaacgggactaagctgggggatgtgattctacccccatgggcgaagggagaccccagagagttcatccgcgttcacagagaggctctggaatgtgattacgtatcagcccacctccatgagtggatcgacctgattttcggctacaaacagcaaggtcctgccgcggttgaagccgtgaacgtgttccaccatctgttttatgagggccaggtcgacatttacaacataaatgaccccttgaaggagaccgccaccatcggtttcattaacaattttggccaaatacccaagcagctatttaaaaagccacatccccctaagagggttaggagccgcctcaacggagacaatgccggcatctcggtcctccctggttccacatcagacaagattttctttcatcatctcgataatctccggccgagcctcacacctgtgaaagaactgaaagagcccgttggacagatcgtctgtaccgataaaggtattctcgccgtggaacaaaacaaggtcctgatacctcctacctggaacaagacctttgcctgggggtatgccgacctttcctgccgactaggcacctatgaatccgacaaggcaatgacggtgtacgagtgccttagcgagtggggccagatcctttgcgcaatttgccctaacccaaaactggttattacaggagggacatctactgtggtttgcgtctgggagatgggcacctccaaggagaaggctaaaacagttaccctaaaacaagcactcctgggccacacggatacggttacctgtgcaaccgcatctctggcctaccatattattgtcagcgggagcagagatagaacctgcatcatctgggatctcaataaactttcttttctaacccaactgaggggacatcgtgctcctgttagcgctctatgtattaatgagctgactggcgacattgtgtcatgtgcaggaacctacatccacgtgtggagcatcaacggaaatcctattgtgtccgtgaacaccttcactggacggtcccagcagattatctgctgctgtatgagtgagatgaatgaatgggacacgcaaaacgtcatagtgaccgggcacagcgacggagtggtccggttttggcgcatggagttccttcaggttcccgaaactcccgcacctgaacctgccgaagtactggaaatgcaggaagattgtcccgaagcccaaatcgggcaggaggcccaagatgaggatagcagtgacagcgaggccgacgagcagtcgattagccaggaccctaaggacacaccctcacagccaagttcaacctcccaccggccaagagccgccagctgccgagccactgctgcttggtgtacagatagcggttccgatgactcccgtagatggagcgatcagctgtcactggacgagaaggatggcttcatcttcgtcaactactcagagggccaaacgagggcccaccttcagggacccctgtcccatccccacccaaatcccatagaagttcggaattactcacgtcttaagcctggttataggtgggagcgccagttggtgtttcgttccaaactcacgatgcatacagcgtttgatcgcaaggataatgcccacccagctgaggtgaccgcgttgggaatttctaaagaccacagccgaatcctagtcggagactctcgtggccgggtgttcagttggagcgtgtccgatcaacccgggcggtccgccgccgaccactgggtcaaagacgaaggcggagacagttgtagtggttgctccgtccgatttagccttaccgagcgtcggcatcattgccgcaattgtggacagctgttctgccaaaagtgtagcaggttccaaagcgagatcaaaaggctgaaaattagctctccagtgcgtgtgtgccaaaattgctactacaacctgcagcacgaacgcggatcagaagatggacctaggaattgttag

SEQ ID NO: 31933 - DNA, 10530 bp, Artificial Sequence
  Description of Artificial Sequence: Synthetic coding sequence
atgaatatggtaaaaagaatcatgggacgcccacggcaggaggaatgttctccacaggacaatgccttggggcttatgcacttgcgtcggttgttcacagagttatgccatccccctcgacacatgacccagaaagaacaggaggagaagctttatatgatgctgccagttttcaatagggtttttgggaacgcgcctccgaataccatgacagaaaaattctcagatctcctgcagtttacaacccaggtaagtcgtctcatggtgaccgaaattaggcgtcgagcttcaaacaagagcactgaggctgccagccgcgccatcgtccagtttctcgaaattaatcaaagtgaggaggcttcgcgagggtggatgctcctgacaacaatcaatctgctggcgtccagtggtcaaaaaacagtggactgcatgactacgatgtcagtacctagtacccttgtcaagtgtttgtatttgttttttgaccttcctcacgtcccggaggctgtcggcggagcccagaatgaactaccactcgccgagcgcaggggtctcctgcaaaaagtcttcgtacagatactggttaagctctgctcctttgtctcccctgccgaagagctggcgcagaaggatgacttgcagctattattcagtgcaatcactagttggtgtccaccatacaaccttccctggaggaagtccgccggagaggtcttaatgactattagcagacacggcctgtcagtcaacgtggtgaagtatattcacgaaaaagagtgcctgtctacgtgtgtccagaatatgcagcagagtgacgatctgtccccactggaaatcgtggagatgttcgctgggctttcttgcttccttaaggactcatctgacgtgtcccagactcttcttgatgatttccgaatttggcaggggtataactttctctgcgatctcctgcttagactagaacaggcgaaagaggcagaatcgaaagacgcccttaaagatctcgttaatttaatcacttcactgactacatatggggtcagcgagctcaagcccgccggcataactaccggggctccctttctgttaccagggttcgcagttcctcaacccgccggcaagggacactcagtacgaaatgttcaagcatttgccgtgttgcagaatgcttttctaaaagcgaaaacatcgtttctggcacagatcattctggacgccatcactaatatatacatggccgacaatgccaattacttcattcttgagagccagcataccttgtctcagttcgctgagaagatatctaagcttccggaagtgcagaataagtactttgagatgctggaatttgttgtgttcagcctgaactatataccctgcaaagagctcatatcagtgtcgatccttctaaaatcctccagctcataccactgcagcattatcgctatgaaaacattactgaagttcacacgccacgattacatcttcaaggacgtctttcgagaggtggggctgctggaggttatggtgaacctgctccataaatacgccgcactgctgaaggaccccactcaagcactgaacgagcagggtgatagtcggaataactcatccgtcgaggaccaaaagcaccttgccctgctggttatggagaccctcactgtgctattgcagggcagcaatacaaatgccggaatttttcgggaattcggaggagctagatgtgcccacaatatcgtcaaatacccacaatgtaggcagcacgctcttatgactattcagcagctggttctgagcccaaatggagatgatgacatgggtactctgctgggtttaatgcacagtgcgccccctacagaacttcagttgaaaaccgacattctgagggccttgttgtcggtactccgcgaaagccaccgcagtcgaacagtgttccgcaaagtcggaggattcgtttacattactagcctgctggtggcaatggaacgatccctctcctgccctcctaagaacggctgggagaaagtgaatcagaatcaggtatttgagctactgcacacagtgttctgcacactaacagcggccatgaggtatgaaccggccaactcccatttttttaagaccgagattcagtacgaaaagctagcggacgccgtgcggtttttgggctgttttagtgacttgaggaagatttcagccatgaacgtgtttccgtccaacacccagccttttcagaggttgttagaggaagacgtgatatctattgagtctgtgagcccaactctgagacattgcagcaaactctttatatacctatacaaggtggcaactgatagttttgactctagagctgaacagatccctccgtgcctgactagcgaaagctcactgccctctccctggggtactcccgccctcagccggaaacgacatgcctaccacagtgtgtccactcctccggtgtacccccccaaaaacgtggccgacctaaagcttcacgtgactacgtcatccttgcagtctagtgacgcggtgataatacatccgggggccatgctcgcaatgctggatctgcttgcttctgtgggatcagtgacacaaccagagcacgcattggacctccagctcgcagtagccaacatcctccaatctcttgtacataccgaaagaaaccagcaggtgatgtgcgaggctggccttcacgcacggctcctacagaggtgttccgctgccctggctgacgaagaccacagtcttcacccccccctgcaaaggatgtttgagcggttggcgtctcaggctctggagccaatggttctgagagagttcttgagacttgcctccccactcaattgcggcgcctgggataagaaattattgaagcagtacagggtgcacaaaccctcgtccttaagttatgagcccgaaatgagatcatctatgataacatccctggagggtttgggtactgataatgttttttcccttcacgaagacaatcattatcgaatctctaaatcactggtgaagagcgccgagggtagcacggttcctctgactagggtgaaatgtctggtatctatgacaacgccccacgatattcggcttcatggaagctcagtgacgccagcttttgtggaatttgatacctcccttgaaggattcgggtgcctctttttgcctagtctagccccacacaacgcccctactaataacactgtgaccaccgggttaattgacggtgcggtcgtgtccgggatagggtctggcgaacgctttttcccacccccatcagggctcagctatagtagctggttttgcatcgagcacttttcctctccgcccaataatcaccctgttaggttgctgaccgtcgtccgtcgagctaattcgagcgagcagcattatgtctgcttggccatcgtgctgtcagcaaaagatcgctccctgatcgtgagcactaaagaagaactgttacagaattacgtggatgatttcagcgaggagtcctctttttacgagattctgccttgttgcgctcggttccggtgcggtgagttgatcatcgaagggcagtggcaccacctcgtcctcgtaatgagtaaagggatgctcaagaattccacagcagccctatacattgatggccagctcgttaatactgtgaaactgcattacgtgcactctacgcccggaggtagcggctccgcaaacccccccgtggtgtcaactgtctacgcctatatcgggacccccccggcccagcgtcaaatagcctcgctcgtgtggaggttgggtcctacacacttcttggaggaggtgctgccgtcttccaacgtgacaaccatctacgaacttgggcctaattatgtggggtcgttccaggctgtttgtatgccctgcaaggatgctaagtccgagggcgtcgttccgagtcccgtgtcactggtccctgaagaaaaagtgtcttttgggctctacgcgctctccgtgtcatcgctgactgtggctaggatccggaaagtttataataaactggattctaaagctatcgcgaaacagctggggatttcgagtcacgagaacgccacccctgtgaagctgatccataatagtgctggacatctcaacggctccgccaggacaattggtgccgcccttatcggctacctgggcgtccgtaccttcgtgcctaagccggttgctaccacactccaatatgtcggcggagccgccgccattttgggacttgttgcaatggcgtctgacgtcgaaggtctgtatgctgcagttaaggctctcgtttgcgtcgtgaagtcgaaccctttagcctccaaggagatggagcggataaagggctaccaactgctggccatgctgctcaaaaagaagagaagcctgctaaactcccatatcctgcacctaaccttttcgctagtagggaccgtggatagcggacacgagacatccataatccctaactcgactgcctttcaggacctgttgtgtgacttcgaagtgtggctccacgccccttacgagctccacctgtcactattcgaacacttcattgagctgctaacagaaagcagcgaagccagcaagaatgcgaagctgatgcgtgagttccagctgatccccaaactgctacttaccctgagagacatgtctctgtcacaacccaccatcgctgcgatttctaacgtactgtctttcctcctgcaaggcttcccttcctctaacgatctactgcgtttcgggcagttcatttcctcaactcttcccactttcgctgtgtgtgaaaaattcgtggtgatggagattaacaatgaagagaagctggacacgggcacagaagaggagtttgggggccttgtctccgccaatctgatactcttaaggaatcgacttctggacatcctgctcaagctgatctacacgtcaaaggaaaaaaccagcattaaccttcaggcctgcgaggaattggtcaagactcttgggtttgactggatcatgatgtttatggaggaacacctccatagcacaactgtgacagcagctatgcgcatcctagttgtgctgctgagcaatcagagcatcttgatcaagtttaaggagggcctatccggcgggggatggctagaacagaccgattccgtgcttaccaacaagatcggaacggttttagggtttaacgtgggtcgtagcgctggggggagatccactgtaagagaaatcaaccgcgatgcttgccacttcccagggtttcccgtgctgcagtcttttttaccaaagcacacaaacgtgcctgcgctctactttctgttgatggctctattcctgcaacagccagtgtccgaactacccgaaaatctgcaggtttcagtccctgtgatatcttgccgcagcaagcagggctgtcagttcgatttggatagtatttggacctttatctttggcgtacccgcttcatcaggcaccgttgtctcatccatacacaacgtctgcacagaggccgtctttctgctactgggaatgcttcgcagcatgttgacctccccctggcagagcgaagaagagggatcttggctgagagaatatcctgtcaccctgatgcagttcttcaggtacctctaccacaacgtgcccgatttagcctctatgtggatgtccccagattttctgtgtgcgttggctgccacagtgttcccttttaatatccggccatattcagagatggtcactgaccttgacgacgaggttggatctcccgctgaagaattcaaagcattcgccgccgatacaggtatgaatcgctctcagtcagagtactgtaatgtgggcactaagacttatctgacaaatcacccagccaaaaaattcgtgttcgactttatgcgcgtattaatcatcgataatctgtgcctcacacctgccagtaaacagacacctctgatcgatctgctgctggaggcgagtcctgagaggagcacccgtactcagcagaaggaattccagacttacattttggatagcgtcatggaccatcttctggctgcagacgtgttactgggagaagatgcctccttgccaatcacatcgggcggatcttatcaggtactcgtcaacaatgtgttctactttactcaacgggtcgtcgacaagctctggcaggggatgtttaataaggagagcaagctgctcattgattttatcattcagctgattgcccagtcgaagcgtcgctcccagggcctttccctggatgccgtctatcactgtctaaatagaacgattctgtatcagttttcccgtgcccataaaaccgtcccccagcaagttgcactgcttgattctctgagagtgttaacagttaaccggaatctgatactgggccctggcaaccatgaccaggagtttatctcctgtctagcccattgcctgattaaccttcatgtagggagcaatgttgatggtttcgggcttgaagccgaggcccggatgacaacgtggcacatcatgatacccagtgatatagaaccggatggctcctatagtcaggacatcagcgaaggccgccaactgctgattaaagccgtgaatagggtatggactgagttgattcactcaaaaaagcaggttctggaagaattattcaaggtgaccttgcctgtgaacgaacggggtcacgttgatattgctactgctcgccctttgattgaagaggccgccctgaagtgctggcagaatcacctggctcacgagaaaaagtgtatcagccgcggagaggccctcgcccctaccacccagtctaagctcagccgagtcagcagtgggtttggattgagcaaactgacaggaagcaggcggaataggaaagaaagcggactcaacaaacattctctatcaactcaggagatatcccagtggatgtttactcatatcgccgttgtgcgcgacctggtggacacccagtacaaggaatatcaggaacgacagcaaaatgcgctcaagtacgttaccgaagaatggtgtcaaattgaatgcgagctgctgcgcgagcgtggactgtggggcccccccatagggagtcacctggacaagtggatgctggagatgaccgaaggcccttgtcggatgcggaagaagatggtacggaacgacatgttttataaccattatccatatgtgcctgagactgaacaggagacaaatgtggctaaacctgcccgctaccgacgagcagttagttacgactctaaggaatactatatgagactggcttccggaaacccagcgatcgtgcaggatgccatagtagagtcatcagagggagaggctgctcaacaggagcctgaacacggcgaagacacaattgctaaagttaaagggctggtaaagccccccttaaaaaggtcccggtccgctcctgatggcggagatgaggagaaccaagagcagttacaggaccagattgccgaaggcagctctattgaagaggaggagaaaactgacaacgcaacactgctgcggctgttagaggagggcgagaaaatccagcacatgtacagatgtgccagggtgcagggcttggacacctctgaagggttactcctgtttggaaaggagcatttttatgtgatcgacggattcactatgacagcgaccagggagattagagacattgagacccttccaccaaacatgcatgagccaatcatcccacgcggagcccggcagggtccaagccaattgaaacgaacctgctcgatctttgcatacgaggacatcaaggaggttcataaaagacgttatctgttgcagcccattgccgtcgaagtcttttctggagacgggcgtaattacttgctggctttccagaaagggatccgaaataaggtttatcaaagattcctggccgtagtccctagtctgacagacagtagcgagtctgtgtcaggtcaacggcccaatacatctgtcgagcagggtagtggtctgctaagcacactggtaggggaaaagagcgtgacacaacgttgggagcgaggggagatctccaactttcagtacctgatgcaccttaatacactggccggccgaagctacaatgacctaatgcagtaccccgtttttccgtggatcctcgctgattacgattccgaggaagttgacctgacaaatccaaagactttccgaaaccttgctaagccaatgggtgcccagactgacgagcggttggcccagtacaagaagaggtacaaagactgggaggaccctaacggagagactccggcttaccactacggcacccactatagctcagcaatgatcgtggctagctacctcgtccggatggaaccatttacacagattttccttagactacagggcggacacttcgacctggccgatagaatgtttcacagcgtgcgcgaggcctggtacagcgccagtaagcacaacatggccgatgtgaaagaactcattcccgaattcttctatctacccgaatttctttttaactcgaacaacttcgacctcggatgtaagcagaacggaactaaattaggagatgtgattctgcctccttgggcaaaaggcgaccctagggaatttatccgcgtacatcgggaagccctggagtgtgattacgtgtcagctcatttgcatgaatggatagacctgatattcggttacaaacaacagggccccgcagctgtggaggccgttaatgtctttcaccaccttttttacgagggacaggtcgacatttacaacatcaacgaccccctgaaagaaactgctacgattgggttcatcaataacttcggacagatacctaagcagttgttcaagaaaccccaccccccgaagagagtgcgcagtaggttgaacggcgacaacgcaggcatctccgtactgcccggaagcacaagtgataaaatattttttcatcacctcgacaacctgcgcccgtctcttactcctgttaaggagctaaaggaaccggtgggtcagatcgtttgcaccgataagggaatcctcgccgtggaacagaacaaagtgctgatcccgcccacctggaacaaaacttttgcctggggctatgctgatctatcctgccgcctagggacgtatgagagtgataaagcaatgaccgtgtatgagtgcctgtctgagtggggccagatcctatgtgcaatttgtcctaatccgaaactggtcatcactggaggaacgagcactgtggtgtgtgtttgggaaatggggacgtccaaagagaaagcaaagacggtcaccctcaagcaagctctgctgggacacacagatacagtcacctgcgccaccgcctccctggcataccatattatagttagcgggagcagggaccgtacttgtatcatctgggacctcaacaaactgtctttcctgactcaactgagaggccacagggcacctgttagcgctttgtgcatcaacgaacttactggggacatcgtatcatgcgcaggtacctatattcatgtctggtcaatcaacggcaacccaatcgtaagcgtgaatacttttaccggacgatcacagcagattatctgctgctgcatgagcgaaatgaatgaatgggatacccagaatgtgattgtcacaggacactcagacggcgtggtgcggttttggaggatggagttcctgcaggtgcccgaaactccagcacctgagcccgccgaggtgctcgagatgcaggaagactgccccgaggcccagatagggcaggaggctcaggacgaagactctagcgactccgaagccgatgagcagtcgatctcccaggacccaaaggataccccaagccagccgagcagtacatcccatcgcccacgggcagcctcctgcagagccactgctgcttggtgcacagacagtggcagcgacgactcaaggaggtggagtgatcaactgtcactggacgagaaggatggctttatttttgtgaattactccgagggccagacccgggcccacctccagggccctctatcacatccccaccccaacccaattgaggtgaggaattactcccgcctgaagcccggctataggtgggagcgtcagctggtcttccgctccaagttaaccatgcacactgcctttgacagaaaagataacgctcacccagcagaagtgactgcgctgggtatatcaaaagatcatagccgcatcctggtcggagattcacggggccgcgtgtttagctggagcgtgtcagaccagcctggccggagcgccgcggaccattgggtgaaagacgaagggggagatagctgctctggttgctctgtgcgattctctttaaccgaacggagacaccattgtagaaattgcggccaacttttttgtcagaagtgtagccggttccagtcagagatcaaacgtcttaagatctcctcacctgttagggtatgccagaactgctactacaatctgcaacatgagcggggttccgaggatgggccaaggaactgttag

SEQ ID NO: 31934 - DNA, 30 bp, Artificial Sequence
  Description of Artificial Sequence: Synthetic coding sequence
atgaacatggttaagcgcatcatggggtag

SEQ ID NO: 31935 - DNA, 183 bp, Artificial Sequence
  Description of Artificial Sequence: Synthetic coding sequence
atgaatatggtgaaacgcattatgggaaggccgaggcaggaagaatgtagtcctcaggacaacgctttagggcttatgcaccttcggaggctgtttaccgaattgtgtcatccacctcgtcacatgacacagaaagaacaggaggagaagctgtacatgatgctgccagtgtttaataggtag

SEQ ID NO: 31936 - DNA, 2241 bp, Artificial Sequence
  Description of Artificial Sequence: Synthetic coding sequence
atgcgacgggagttttgctgggacgcttattcaaaggccgcaggatcgcgggcctcaagtcctttacctaggcaggatcgggacagcttctgccaccagatgtccttttgtctgactgagctccacctttggagtctgaaaaatacgctgcacatcgccgaccgcgacattggtatctatcagtattacgataaaaaggacccccctgcaaccgaacatggaaatctggagaaaaagcaaaagcttgccgaaagccgcgactatccctggacccttaagaatcggcggccagaaaaactgcgggacagtcttaaagagctagaagagctcatgcagaactcgagatgtgtcctgtcaaaatggaagaataaatatgtttgtcaactgctctttggctctggtgtcctggtgtccctctccttgtccggcccacaactagagaaggtagttatcgatagatctcttgttggcaaacttatctccgacaccatatccgacgcacttctcactgactcattcattatcctatcttttcttgcgcagaataagctgtgctttattcagtttacaaagaaaatggaaagtagcgatgtgaacaagcgcctggaaaaactttccgcattggattacaagatcttttattacgagatcccgggcccgatcaacaaaaccaccgaaaggcaccttgccatcaattgcgttcatgatagagtagtctgttggtggccactagttaacgatgatgcttggccttgggccccgatctcttcagagaaggatcgcgccaatctcttactgctggggtacgcccaggggcgattagaagtacttagctccgtgaggacagagtgggaccctttggatgtccgatttggaaccaagcagccttaccaagttttcacagttgaacacagtgtctctgtggacaaggaacccatggccgacagctgcatatatgaatgtatccgtaacaaaattcaatgtgtctccgtgacgagaataccccttaagtcaaaggcaatatcctgctgccgcaatgtcacagaagataagctgatcctggggtgcgaggatagttctctcatcctgtacgaaactcacaggcgggtcactttactggcacaaacggaacttctcccatctctcattagctgtcacccttccggcgcaatcctgctggttggatcaaaccaaggtgagctccagatctttgacatggccctaagcccaataaatattcagctcctcgctgaagataggttgcctagggaaacactgcaattttccaaattatttgacgcctcctcatcactagtgcagatgcagtggatcgccccacaggtcgtctctcagaaaggagagggtagtgacatttatgatctgctcttcctgcgctttgaaagagggccgttgggtgtgctcctgttcaaactaggggtgttcacacgcgggcaactggggctcatagacattatcttccaatacatccattgtgatgagatctatgaagcaatcaatatcctttcatcaatgaattgggacacactgggccatcagtgttttatcagcatgagtgccattgttaatcacctactgcgacagaagcttactcctgagcgagaggcccaactcgaaacctccctgggaacattttacgcacccaccagacccctgttggattctaccatcctcgaataccgcgaccagatatccaaatatgcaagaagattctttcatcaccttctgaggtatcaacggttcgaaaaagccttcctcctcgccgtggacgtcggcgccagagacctgttcatggacatccattacttagccctagataaaggtgagctggcgctggcagaggttgctcggaagagggcatctgatatcgatgccgagtcgattacttctggagtcgagctgctcggtcctctagacagaggcgacatgttaaacgaggccttcattgggctgtctctggctccacaaggcgaggattcgttcccagacaatctgccaccctcctgccctacgcatcgtcacatactccagcaacgaatcttgaatggctcttctaatagacaaataattgaccggaggaatgaacttgaaaaagacatctgttcggggtttctaatgacgaatacctgcaacgcggaagacggagagttgagagaagatggtcgcgagcaagagattcgtgacggagggtctttgaagatgattcattttgggctggtgtag

SEQ ID NO: 31937 - DNA, 2742 bp, Artificial Sequence
  Description of Artificial Sequence: Synthetic coding sequence
atggcatcggagagcgacaccgaagaattttacgatgccccagaggatgtccatcttggggggggctatcctgtcggtagcccagggaaagtggggctgtcaacattcaaagagactgagaataccgcatacaaggtgggcaatgaaagtcccgtgcaggagcttaagcaggatgtgtccaagaaaatcatcgaatcgattattgaggagagtcaaaaggtgcttcagctggaagacgacagcttagactccaaggggaaagagctttccgaccaggcgacagcgtctcccatcgtcgcaaggacggacctctccaacatacctggattgctggcaattgaccaagtcctgccggaggagtcccagaaagcggaatcccagaacaccttcgaggagacagagctggaattgaaaaaatgctttccatctgatgagacatgcgaaaaaccagtggatgaaaccacaaaactgacacagacatcttccaccgaacagcttaatgtgcttgaaaccgaaaccgaggtgttgaataaagaggccgtcgaggtgaagggcgggggagatgttcttgaacccgtatcgagtgacagtcttagtacaaaggacttcgccgccgtcgaggaggtggctccagcgaaacccccgagacacctcactcctgaacccgacattgtcgccagcacgaaaaaacccgtccccgcccgcccgcctccaccaacgaattttcccccgcccaggccccccccgccctcacgtccagccccaccccctcggaaaaggaagagcgagctggaattcgagacactgaagacacccgatatcgatgtgccgaaggagaatattacctcagactctctgttaaccgcaagcatggcatcagagagcactgtgaaagatagtcagccttctcttgacctggcatcagccacttccggcgacaaaattgtgaccgcacaggaaaatgggaaagccccagacggccagacagttgcgggtgaagtcatggggccccagcgccctaggagcaatagcggacgtgagcttaccgacgaggagatccttgcgagcgtcatgataaaaaacctcgacactggagaagagatacccttgagtctcgctgaagagaagctgcctactggtatcaatcccttgactttacatattatgcgccgtactaaggagtacgtctccaacgacgctgcacagagtgatgacgaggagaagttacagagtcagccaactgacaccgatggcggacggctcaagcagaagacaacgcagctgaagaagtttctgggcaagtcagtgaaaagagccaagcaccttgctgaggaatatggagagagagcaatcaacaaagtgaagtcggtgcgtgacgaagtgtttcatacagatcaagacgatcctagttccagcgacgacgagggtatgccttacacacgccctgtgaagtttaaggcggcccatggcttcaagggcccatacgacttcgaccaaattaaggtcgttcaggatttatcgggggaacacatgggcgcggtgtggaccatgaagttctcccattgcgggcgcctccttgcgtctgcaggccaggataatgttgttcgaatttgggccctgaaaaatgcatttgactactttaataacatgcgtatgaaatacaacacagaggggagggtcagccccagtccctcccaagaaagtctgagctcaagcaaatctgataccgatacaggcgtttgctcagggaccgatgaggatcccgacgacaaaaacgctcctttccggcagcgaccattctgtaaatataaaggtcatactgccgacctgctggacctgtcttggtctaaaaattacttcctcctctccagctccatggacaagactgtgcgattatggcacatcagtaggagggagtgtctgtgctgctttcagcacatcgacttcgttactgcgatcgcattccaccccagagatgacagatacttcctaagcggttccctcgacggtaaactgcggctctggaacatcccagataaaaaggtggcactatggaacgaagttgatggtcagaccaagcttatcactgctgccaacttctgccagaacgggaagtacgcggtcattggcacgtacgatggtagatgtatattctatgacaccgagcacttaaagtatcacacccaaatccacgtacgaagcacacggggtaggaataaggtcggccgaaagattaccggtatcgagcctctgccaggggagaataaaatcctggtcacatccaatgatagtcgcatccggttatatgatctgagggacctgagtctcagcatgaagtataaaggctatgtaaattcaagctcccaaatcaaggcctctttctcacatgactttacttaccttgtgagtggatctgaggacaagtacgtgtacatctggtccacctatcacgatcttagcaagtttacctcagtccgccgagatagaaacgacttttgggaaggcatcaaagctcataacgctgtggtcacatccgctatctttgctcccaatcctagcctcatgcttagtctggacgtccagagtgagaaaagtgagggaaacgaaaagagcgaggatgccgaggtactcgatgctacgcctagtgggatcatgaagactgataatacagaagttttactgtcagctgactttacgggggctatcaaagtgtttgtgaataagaggaaaaatgttagttag

SEQ ID NO: 31938 - DNA, 867 bp, Artificial Sequence
  Description of Artificial Sequence: Synthetic coding sequence
tggggtaagaattactttctgctctcttcctctatggacaagaccgtccgcctgtggcacattagccggagggaatgcttatgctgcttccagcacattgactttgtgactgctattgccttccacccccgggacgacagatatttcctttccgggtctctggatggcaagcttaggctttggaatattcctgataaaaaagttgctctttggaacgaagtggatggtcaaaccaaactgatcacagcggccaacttttgccagaacggaaagtatgccgttataggcacatacgacggtcgctgcatcttctacgacactgagcaccttaagtaccacactcagatccacgtgcgatctaccagggggcggaataaggtggggcgcaaaatcactggcatcgaaccattacctggcgaaaataagattctggtgacctctaacgattccaggatcaggctgtatgaccttcgcgacctcagtctctcaatgaaatataaggggtatgtgaattcctcttcacagatcaaggccagtttttcgcatgactttacttacctggtgtccggaagcgaagacaagtatgtctacatctggagtacttaccatgatcttagtaagtttacatctgtgaggagggacagaaatgatttctgggagggcattaaagctcacaatgcagtggtgacatccgccattttcgcacctaatccctccctgatgctgagtctggacgtgcagtccgagaaatccgagggcaacgaaaaaagcgaggacgctgaggtgctcgacgcgaccccctctggtgccgtggcccacgcgtgtaatccttctactctaggggggcgcggcagaaggatcacgtag

SEQ ID NO: 31939 - DNA, 2475 bp, Artificial Sequence
  Description of Artificial Sequence: Synthetic coding sequence
atggctagcgagagtgataccgaggagttctacgatgccccagaggacgtgcacctcggagggggatatccagtcggatcacccggcaaggtgggcttgtcaactttcaagattattgagtccataattgaggaatcgcagaaagttctgcaacttgaggacgatagtctggattctaaaggtaaggaactctcagaccaagctactgcgagtcccatcgtagctcggacggatctgtccaatatcccaggtttgctggccattgatcaggtgctcccggaagagagccaaaaagctgaatcccagaacactttcgaagagactgagcttgaactcaaaaagtgttttccctccgatgagacttgtgagaaacctgttgacgagactaccaagcttactcagacctcatccaccgaacaactgaatgtactcgagactgagaccgaagtgctcaataaagaggcagtggaggtgaaggggggaggggacgtactcgaacccgtgtctagcgactccctgtccacaaaagacttcgctgcagtggaagaagttgcccccgccaagccacctcggcacctgacccctgagcccgatatagtggcttctaccaagaagccggtgcccgctagaccccctcctcctacaaactttccacccccaaggccacctcctccatccaggcccgcacctcctcctagaaagcgtaagtctgagctggaattcgagactctcaaaactccagacatagacgtcccgaaagaaaacattacatcagactcactgcttactgcttctatggcaagtgagtccacagtgaaggatagtcaacctagtctcgacctggctagtgcaacatcaggagacaaaatagtgaccgctcaagaaaacggtaaagccccagatggccagaccgtcgcaggcgaagtgatggggcctcagcgacctcgttctaactctggtcgggagttgacggacgaggagatcctcgccagcgtcatgatcaaaaatttggatactggagaagaaatccctctctcactggccgaagagaaactgccaacagggatcaatcctctgacacttcatattatgcgaagaaccaaagagtatgtgtctaacgacgctgctcagtcagatgacgaagagaagctgcaatctcagccaacagataccgatggaggcaggctgaagcagaagactacccagctcaagaagtttctgggtaaatctgtgaagagggccaagcacttagctgaggaatatggtgagcgcgccatcaataaagtaaagagtgtcagggatgaggtttttcataccgatcaggacgatccatcctcaagcgatgatgaaggcatgccctatactcgaccagtaaagtttaaggctgcgcatggttttaaagggccttatgacttcgaccagatcaaggtggtgcaggatctgagtggcgagcatatgggcgcagtctggacgatgaaattctcgcactgtggcagactcttggcatcggctggtcaggataatgttgtgaggatatgggcattgaagaacgccttcgattacttcaacaatatgcgaatgaagtacaatactgagggtcgagtgtcgcctagtcccagtcaggagtctttatcttcaagtaagagcgacactgatactggggtgtgcagcggtaccgacgaggaccctgacgataaaaacgcaccattccgacagagacctttttgtaagtacaagggacacacggcagacctgttagacctgtcctggagcaagaattatttcctgctgtcatcctcgatggacaaaacagtgcgactatggcacatcagcagacgggagtgcctatgttgcttccagcatatcgactttgtgaccgcaatcgccttccacccgagacacctgaaataccatacacagatccacgttcggtcgactcgcggtcgaaacaaagtgggccgtaagattactggcatagagcccttgcctggggagaacaagattctggttacgtcgaacgattctagaattaggctgtatgatctacgtgatctcagcctatcgatgaaatacaaagggtacgttaatagcagctcccagattaaggcctccttcagccacgactttacatatctggtgtctggttcagaggacaagtatgtgtacatctggagtacgtatcatgacctgtcaaaatttaccagcgtgcggcgggaccgaaatgacttctgggaaggcataaaggcgcacaacgcagtggtgaccagtgccatctttgctcccaacccctcgctcatgctgagtctggatgttcagtcagaaaagtccgaaggtaatgaaaagagcgaagatgccgaagtactggatgctaccccgtccggaattatgaaaacagacaatactgaagtcctcctttcagcagactttacaggggctatcaaggtgtttgtaaataagagaaaaaacgtatcatag

SEQ ID NO: 31940 - DNA, 2718 bp, Artificial Sequence
  Description of Artificial Sequence: Synthetic coding sequence
atggcgagcgaatcagataccgaggagttttacgatgcacctgaggatgtgcatctgggaggagggtaccccgtgggcagtcccgggaaggtaggactgtccacatttaaggagacggaaaataccgcctacaaggtaggcaatgagtccccagtccaggaactgaagcaggacgtgtctaaaaagattatcgaatccatcatcgaggagtctcagaaggtgctgcagttagaagatgattctcttgacagcaagggtaaagaactctctgatcaggctacagcctctcctatcgtagcacgcaccgatctgtcgaatatccccggcctgctggccatcgaccaagtattgcccgaagagtcacaaaaggctgagagtcagaacacttttgaggagaccgagttagagctcaaaaaatgcttcccaagcgacgagacctgcgaaaagcccgtggatgaaacgaccaagcttacccagacctccagcaccgaacagctgaacgtgttggagacggaaactgaagtgttaaacaaggaagccgttgaagtcaagggaggtggcgatgtccttgagccggtatcctcagattccctgagtactaaggacttcgctgctgtggaggaggtggccccagccaagccccccagacatcttacaccagagccggacattgtcgcgtcgactaaaaagcccgtccccgcaagacccccaccaccgaccaactttccacctcctcgtccaccccccccctctcgacctgcgcccccgccccgcaagcgcaagtccgagctcgaatttgagaccctgaaaacacccgacatcgacgtcccaaaagaaaacattaccagtgattctctgttaaccgctagcatggcctcagagtctaccgtaaaggattctcagccatccttggacttggcctccgccacctctggggataaaatagttaccgcacaagaaaacggtaaagccccagacggtcagacagtggcgggtgaagtgatgggacctcagcgtccgagaagcaactcaggaagagagctgaccgacgaagagattctggcatccgtgatgatcaaaaatctggacactggtgaggagataccgttgtctctggcagaggagaaacttccaaccggtatcaatcccttgacactacacattatgagacgcaccaaggagtacgtgtccaatgatgcggcacagtccgatgacgaagagaaattgcagtctcaacccaccgacactgacggcgggcggctgaaacagaagaccacccagttaaagaaatttctgggtaaatctgtaaagagggctaagcacctcgccgaagagtatggagaacgcgcaattaataaagtcaagagcgttcgggacgaggtttttcatacagaccaggacgatccctcaagcagcgacgacgaaggcatgccttatactaggcctgtgaagttcaaggcggcccatggctttaaaggcccatatgactttgatcagataaaagtggtgcaggacttgtctggggaacatatgggcgctgtttggactatgaaattttcccactgcggccgcctgcttgccagtgccggtcaggacaatgtagtaaggatctgggccttaaaaaacgcgttcgactattttaataatatgagaatgaagtacaacactgaaggcagggtctcacctagcccgtcccaggagtctctgagttcctctaaatcagataccgacactggtgtttgcagcggcaccgacgaagaccccgatgacaaaaacgctccgttccggcagcggcctttttgcaagtataaggggcacaccgccgatctcctggacctgtcgtggagcaagaattattttcttctttcgagcagcatggataaaacagttaggttatggcacattagccggagggagtgcctttgttgttttcagcacatagactttgtcactgctattgcttttcaccccagagatgaccggtactttctgtcgggttcattagatggaaagctccgactgtggaacatcccagacaagaaagtagcgctctggaatgaagtggacggacagaccaaactaatcacagcagctaatttttgccaaaatggtaaatacgctgtgatcgggacctacgacgggcggtgcatcttctacgataccgagcatcttaaataccacacacagatacatgtgagatcaacacggggacggaacaaggttggcaggaagataaccggtatagagccattacccggagaaaataagatactggtgaccagcaacgacagccggatccggctttacgacctgagagacctttcactgagcatgaaatataagggctatgtgaacagtagctcccagataaaggcctctttctccggaagcgaggataaatacgtgtacatctggtccacatatcacgacctctccaagttcacttcggtgaggcgtgaccgcaacgacttctgggagggcatcaaggcacacaatgccgtcgtgacgagcgctatttttgctcctaatcctagcctgatgctttccctagatgtccagtcagagaagtcagagggaaacgagaaatcagaggatgccgaagtgctggacgctaccccgagcggtataatgaagacagacaacacggaagtattgctgagcgctgactttacaggggcaatcaaagtttttgtgaataagaggaagaacgtgagctag

SEQ ID NO: 31941 - DNA, 2421 bp, Artificial Sequence
  Description of Artificial Sequence: Synthetic coding sequence
tgaactgatctctccaatatccctggtctcctagctatcgaccaggtgctgccagaggagtcacagaaggccgaaagccagaatactttcgaggaaactgaactggagctcaaaaagtgcttcccgtcagatgagacgtgtgagaaaccagtcgacgagactacaaaactgacccagacgtcctcgactgagcagctgaatgtcctcgagacagagaccgaggtcctgaacaaagaggcagtcgaggttaagggcggaggagacgtactcgagcccgtcagcagcgattctctgtctacgaaagatttcgccgccgtggaagaagtcgcccccgccaagccaccaaggcacctgactccagaaccagatattgtcgcaagtacgaagaaacccgtgcctgctcggcccccaccccctaccaactttccacctcctcgtcctccccctccctcgagacctgccccaccccctcgtaaacgaaagtctgagctggaatttgagacccttaaaaccccagacatcgatgtgcccaaggagaacattacttccgactccctcctgacagcaagtatggcctccgaaagcaccgttaaagactcccagccctccctcgatctggcctccgctacctctggcgataaaatagtcactgcacaggagaacggaaaagcccctgacggacagacagtggccggcgaagtaatgggtccacagagacctcgatccaactcaggcagagaactcaccgatgaagagatcctcgcttccgttatgatcaagaacttagataccggcgaagagattcccctaagccttgccgaggaaaaactacctaccggtataaatcccctcacactgcacataatgcggagaaccaaggaatatgtttccaatgatgcggcacaaagtgacgatgaggagaagctgcagagtcagcctactgacaccgatgggggcaggctcaagcagaaaacaacccagctaaagaaattcctgggcaagagcgtcaagcgggcaaagcacttggccgaggaatatggggagagggcaatcaataaagtgaagtccgtgagggacgaagtatttcatacggaccaggatgacccaagctcttccgacgacgagggcatgccttatactcgtccagttaaattcaaagccgcccatggattcaaggggccatatgactttgatcagattaaggtggtgcaggatctctccggggagcatatgggtgctgtgtggaccatgaaattcagccactgcgggaggctgctcgcctctgccggccaggataacgtggttagaatctgggcccttaagaatgcctttgattatttcaacaacatgaggatgaagtacaacacagaaggacgtgtgagtccaagcccatcacaagaaagcctgtccagtagtaagtctgacaccgatactggagtgtgttccgggacggatgaggatccagatgacaagaacgccccgtttcgacagcgacccttctgcaagtataagggccacacagccgacttgctggatctttcatggtccaagaattacttcttgctttcaagttccatggataagacagtgcggctgtggcacatcagcagacgcgaatgcctgtgctgcttccagcatatcgattttgtcacggcaatagccttccatcctcgggacgaccggtatttcctcagtggatcacttgacggaaagctgagactgtggaatattcccgataagaaagtggctctttggaatgaggtggatggccagaccaagctgatcaccgctgctaacttttgccaaaacgggaagtatgcagtgattgggacctacgatgggagatgcatcttctacgatactgaacacttaaagtaccacactcagattcacgtgcgatccactcgtgggaggaacaaagtgggccgaaagatcaccggtattgaacctctgcccggggagaataagatcttggtgactagtaacgacagccgcatccgtctctacgacctacgcgatctgtcactgtctatgaaatataagggttacgtaaatagttcgagtcagatcaaagccagctttagtcacgactttacctacttagtgtctggctcagaggacaagtatgtgtacatctggagcacctaccatgatctgagtaagttcactagtgtaagaagagaccgtaatgatttttgggagggtataaaagcccataacgctgtggttacaagcgcaatcttcgcccctaacccttccctgatgctgagtctcgatgtgcagtccgagaagtcagaagggaatgagaagtctgaagatgccgaggtgctggacgctacccctagcgccatgtccagccggtacgtcgctcaggccggactcgagctcctggcgtctaagcggtattacgaagaccgatag

SEQ ID NO: 31942 - DNA, 1116 bp, Artificial Sequence
  Description of Artificial Sequence: Synthetic coding sequence
atgacccagcagcctctgcgtggcgtgacatcactgcgcttcaatcaggaccaaagttgcttttgttgtgcaatggagacaggcgtcaggatctataatgtggaacctcttatggaaaaagggcacttggatcatgagcaggtgggatctatgggcctcgtcgagatgcttcaccgatccaacctgttggctttggtcgggggtggcagcagtccaaagttctctgaaatcagcgtgctaatttgggacgatgcacgggaaggcaaggacagcaaggagaagctggttctcgagttcactttcacaaaacctgtactgtctgtgcgcatgcgccatgataagatcgtgatcgtgttaaagaatcggatctatgtatactcgttccccgataaccccagaaaactgttcgaatttgacactcgcgacaacccaaaggccgcacaccccaccccccatctacatacattgggactgtgtgatctgtgcccttcactggagaagcagctcctcgtcttcccaggacataagtgcggaagcctgcaactggtcgatttggcgagcaccaagccgggcacctccagtgcacctttcactatcaacgcacaccaaagcgacatcgcatgcgtgagcctgaaccaacctgggaccgtggtagcttccgccagccaaaagggaacactcatcagactgttcgacacccaaagcaaggaaaaactggtcgagctgcgacgggggacggatccagctactctttactgtataaatttcagccacgatagcagcttcctctgtgcttcctctgataagggaacggttcatatattcgccttaaaagatacccggctgaaccggagaagcgcactggcaagggtgggcaaggtaggaccgatgattggacaatacgttgattcacagtggagtctagcaagctttaccgtgcccgccgaaagtgcctgtatttgtgccttcggccgaaatacttctaagaatgtcaactccgtcattgccatttgtgtggacggcacattccacaagtacgtcttcacacccgacggcaattgtaatcgggaagcctttgatgtgtatctcgatatttgtgatgatgacgatttttag

SEQ ID NO: 31943 - DNA, 1086 bp, Artificial Sequence
  Description of Artificial Sequence: Synthetic coding sequence
atgacccagcagcccctcaggggtgtgacctcacttagatttaaccaggaccaatcgtgtttttgttgtgcaatggaaaccggagtgcgcatctacaacgtcgagcctcttatggaaaagggacatctggaccatgaacaggtgggctccatgggattggtagagatgctccaccgctcaaatctcctggcgttggtaggtgggggctcgagcccgaaattctctgaaatcagtgcggtcttaatctgggatgacgctcgcgaagggaaggacagcaaggagaagttggtgctcgaatttacttttactaaacccgtactatcagtgcgcatgcggcacgataagatcgttatcgtcctgaagaaccgcatctatgtgtactcatttcctgacaatccaaggaaactcttcgaatttgatacccgcgacaaccctaagggcctttgcgacctgtgtccatcccttgagaagcaactgttggtcttcccagggcataaatgcgggagcctgcaactggtcgatttggcgtccactaagccagggacgagttcggcgccatttactattaacgcacatcagtcagatatcgcttgcgtgtcactgaatcaaccaggaacagtggtggccagcgccagccagaaagggacactaataagattgtttgatacacagtccaaggagaagttagtagaactgcgcagaggaaccgatcctgccaccttgtactgcattaacttttctcacgatagttctttcctgtgcgccagctctgataaggggactgtccacatatttgcactcaaagatacgcgtctgaatcgccgatcggctttggcccgggtgggaaaagtcggtccgatgattggccagtatgtcgattcccagtggagcttggcaagcttcacagtgcctgctgaaagtgcatgtatctgtgctttcggacggaatacatctaagaacgtgaactctgtgatagcaatttgcgtcgacggtacatttcacaagtacgtgtttacacctgacggcaactgtaatcgggaggcttttgatgtctatttggacatctgcgatgatgatgacttctag

SEQ ID NO: 31944 - DNA, 1086 bp, Artificial Sequence
  Description of Artificial Sequence: Synthetic coding sequence
atgactcagcagcccttgcgtggggtgacctcccttaggtttaaccaggaccaaagttgcttctgctgcgccatggaaaccggtgtcagaatctataatgtagagccactgatggagaaaggccacttggatcacgaacaggtaggcagtatgggtctcgtggaaatgctgcatagatctaacctgcttgctctagtaggagggggatcgtctccgaaattctcagaaatatctgcggtactgatctgggatgatgcccgtgagggaaaagactctaaagaaaaactggtgcttgagttcacatttactaaaccagtgctcagcgtccgcatgagacacgataagattgttatcgtgctcaaaaaccgcatttacgtatattccttccccgacaatccgcggaagttgtttgagtttgacacacgggataaccccaagggactgtgcgatctctgcccctctcttgaaaagcagctgttagtgtttccaggccacaagtgtggtagcttacagctcgttgaccttgccagtacaaaaccagggacatccagtgctccgtttacaatcaacgcacaccagagcgacatcgcctgcgtatcccttaaccagccaggaactgtggtcgccagtgcctctcagaaggggacactgatcagactgttcgatacgcagagcaaggagaaactggtcgaacttcgccgcgggacggaccccgcaactctttattgcataaacttctcacacgattcctccttcctttgtgcttcctctgacaagggaacagtccacatctttgccctcaaggataccaggctgaacaggcggtcggcgctagcccgtgtggggaaggtgggacccatgatcggtcaatacgtggacagtcagtggtcactggcgagctttaccgtacccgccgagagcgcatgcatctgtgctttcggcagaaatacctccaaaaacgtgaattccgttatcgccatctgtgtggatgggacatttcacaagtatgtgtttactccagatgggaactgcaaccgggaagcatttgacgtttacttggacatctgtgacgatgatgacttctag

SEQ ID NO: 31945 - DNA, 1083 bp, Artificial Sequence
  Description of Artificial Sequence: Synthetic coding sequence
atgactcagcagccccttcgaggagttaccagcttacggtttaaccaagatcagagttgcttctgctgcgccatggagaccggtgttcgcatatataacgtcgagcccttaatggagaaaggacatctagatcacgaacaggtcggatccatgggccttgttgagatgctccaccggagcaaccttctggcattagtggggggaggatcctctcccaagttctccgagatcagcgtgctcatatgggatgacgctcgggaaggcaaagattctaaagagaaactggttctcgagtttaccttcacaaagcctgtacttagcgtccggatgcgacacgataaaattgtcatagtgcttaagaataggatctacgtttactcattccccgataaccctcggaaactgtttgagttcgatacaagagataaccccaagggtttatgtgacctgtgcccttctctcgaaaagcagctcctggtgtttcccgggcacaaatgcggttctctgcagctagtcgatctggctagtaccaagcccggaacttccagcgctccctttaccattaatgcgcaccaatctgacatagcctgtgtgagtctgaaccaaccaggcacggtagtagcctctgcgtcccagaagggcacactaatcaggctatttgatactcagtcgaaagaaaagctggtggagctgcggaggggcacagatcccgcgacgctgtattgcatcaatttcagccacgactcttcctttctgtgtgcatcttctgacaagggaactgtgcatatattcgccctaaaggatactaggcttaaccgacggtccgccctggcccgggtaggcaaagttggtcctatgatcgggcagtatgtagactcacaatggagtttggccagttttactgtgcccgccgagagcgcatgtatctgcgcattcggtcggaatacatcaaagaatgtaaatagtgttatcgccatttgtgtagatgggactttccacaaatacgtgtttactcctgacggaaattgcaacagagaagccttcgacgtctatctcgatatctgcgatgacgacgatttttag

SEQ ID NO: 31946 - DNA, 168 bp, Artificial Sequence
  Description of Artificial Sequence: Synthetic coding sequence
atgacccaacagccccttagaggcgtcacctctcttcgattcaaccaggatcagtcttgcttttgttgtgctatggagactggcgttcggatctataacgtggagccactcatggagaagggccatcttgatcacgaacaggtcggctcaatgggcctcgtggagtag

SEQ ID NO: 31947 - DNA, 477 bp, Artificial Sequence
  Description of Artificial Sequence: Synthetic coding sequence
atgacacagcagcccctgcggggtgtgacgtccctcaggttcaatcaggatcagagttgtttctgctgcgctatggagacgggggtaaggatatataatgtggagcctctgatggagaaggggcatctggaccacgagcaggtcggatccatgggtttagtagagatgctgcaccgatcaaaccttttggccctcgtcggtgggggcagttcccccaagttctccgaaataagtgttcttatttgggatgatgcccgcgaaggcaaggactcaaaagagaaactagtgctggaattcacatttacaaaacctgttctatccgtaaggatgagacatgacaagatcgttatagtactcaagaacagaatttacgtatactcatttcctgataaccccaggaaactgttcgagttcgacacccgggataacccaaaggcagctcatcctactcctcatcttcacacgctcgggctctag

SEQ ID NO: 31948 - DNA, 879 bp, Artificial Sequence
  Description of Artificial Sequence: Synthetic coding sequence
atgacccagcagccacttcgcggggttacaagcctgaggttcaaccaagaccagtcttgtttctgctgtgctatggaaacaggagtgcgtatctacaacgtggaaccattgatggaaaagggacatcttggcctctgcgatctgtgtccctcactcgagaaacaattactcgtgttcccaggacataagtgtggcagcctccagttggttgatttggcctcaacaaaaccaggaaccagcagcgcccctttcaccatcaatgctcaccagagtgatattgcatgtgtgtctttgaatcagccaggcactgtggtcgcatcagccagtcagaagggtactcttatccgcctgttcgatacccaatccaaggagaaactggttgagctgaggagaggaaccgatcctgccactctttattgtattaacttcagtcacgattccagcttcctttgcgcttcttccgacaagggcaccgtccacatctttgccctcaaggatacccgcttaaatcgaagatcagcatacgtcagaccgcttcacactctactctctgctctggtggtggccgtggcgttgggcgtgttggtctgggcagcagaaacccgggctgctgtccggcgttgcagaaggagtcaccccgccgcgtgcttggccgcagtgcttgccgttggattgctcgtgctctgggtggcaggtggcgcgtgcacctttctcttctccatcgccgggcctgtccttcttatcctcgtgcacgctagtttgcggttgcgaaacctgaagaataaaattgagaacaagatagagagcataggcttgaaacgcaccccaatgggtcttttactggaagccctggggcaagagcaagaggcaggctcttag

SEQ ID NO: 31949 - DNA, 630 bp, Artificial Sequence
  Description of Artificial Sequence: Synthetic coding sequence
atggactcggatgagaccgggttcgaacatagcggcctctgggtaagtgtgctcgctggattgttactcggtgcctgccaagcacaccctattcctgactcttcaccactgcttcagtttgggggccaggtcagacagaggtatctctacaccgatgacgcgcagcagaccgaggctcacctggaaattagggaggatggaacggtcgggggtgctgccgatcaaagcccagagtctcttctccagttgaaagctttaaaacccggggtcatccagatcctgggagttaaaacatcaagattcttgtgtcaacggccggatggcgctctgtacgggagtctgcattttgaccccgaagcttgttccttcagagagctgctgttggaagatggatataacgtgtaccagtcagaggcccacggcctcccgttgcacctgcccggaaacaagtccccgcatcgtgacccggctccacggggtcctgcccgatttctgccactaccggggctgcctcccgcattgccagagcctcctggtatcctggccccacaaccacccgacgtcgggagctctgaccctctgtcaatggtcggccccagtcaaggcagaagcccttcctacgctagttag

SEQ ID NO: 31950 - DNA, 321 bp, Artificial Sequence
  Description of Artificial Sequence: Synthetic coding sequence
atgagcaccaataacatgtcggatccgcggagacctaacaaggtgctgcgttacaagccacccccctccgagtgcaacccagctctggatgatcctacaccagactacatgaatctattaggcatgattttctccatgtgtgggctgatgttaaagctaaagtggtgcgcatgggtcgccgtgtactgctcctttatttcttttgcgaactctcgctctagtgaagacacgaagcagatgatgtcatctttcatgttgtccatctctgcggtggtcatgtcctacctgcagaacccacagcccatgacaccaccgtggtag

SEQ ID NO: 31951 - DNA, 2061 bp, Artificial Sequence
  Description of Artificial Sequence: Synthetic coding sequence
atgtcctttcctagggggtcccagactcaaaagatcaagcatcctatcggcacaaggaagggccccctggaagtgccaccacccacagaaaaggattggcctaaagatgacgagcaggatcatgtcttagttgatccggacgaggagctagacagtttgcctcagccttaccggatgataaataagctggtgaacttactttttgatcagtcatgggagattatcgaagaacgaaacgcccttcgggaggctgaaagcagccaaatccagccgactgtatacccacccttaggggaaatccaactgaacaaaatgccaaactgcatggccgtcagtcaggattacgtgttcataggcggcgcaaagggtttctctatttataatctgtatagcgccaagcagatttatgcttgggaaaagcttaaggtagatgtgacaagcatttgggccacagatctgggaaatgaaatccttattgcgccggttgacgaaatgggcattataaggttgttttacttttataaggaaggcctatatctggtgaaggccatcaatgaggtcgatgacacatccaagcagactacctgtatcaaaatggagatatcacagggaggcgatttcgcagcgtttctccttcagggagccggcgatatttggctcgacgtgtataagctcccaaaggaaacatggctgaagaagctggagcacccacagcttactagcaatccaaaaaagaaggtccgccagccccaacttaattccttgggtccgataagtgcggatcccctggaaatggacgccaatgtgtcgtttaagggcgatattaagctctccttgcccgtttacatcatgaaaattaaaccccccaaacccgtgacgggaacgacttttaagagtcccttagaagtgttcgcaaaaatcaaggactgttatggtctgggttcaggtcaaaatcactttataaaggactcccaatgggaacagcaggcagagatctttaacgcctcctataagaagtaccttgatagggagtgggaggaggaacccctatcgacagcaactttctacttcttactgccatcctgcctgtttgccatgccaccggaggtcaaggggccctctggaatggcatgcgtgctgggaatacactggaccaggtcacacaattttttcctgtactctctaaaccgaacccttaaagacaaggctgatcccgagggtgtgtggccatgcgctgccccaatcgcagtaagccaattgtcgtgcagtagctcctacctggtactggcctgtgaagatggcgttctgaccctctgggatctggcaaaaggatttcccctgggagtcgcagctctgcctcagggctgtttctgtcaatctatccacttcctgaaatatttcagcgtacacaagggacagaacatgtacccagagggacaggtcaagagccagatgaaatgcgtcgtattgtgcacagatgctagcctgcatctggtcgaggccagcgggacccaggggccaacaatctctgttttggtagagagacccgtgaagcacctcgacaaaacaatttgcgcagtcgccccggtgcctgcacttcccgggatggtgttgatcttttctaaaaacggctcagtctgtctcatggatgtagctaagagggagatcatctgcgcctttgcccccccaggggctttccctcttgaggtgccatggaagccggtctttgccgtgtcaccagaccatccatgcttcttactccgaggggactactctcatgagacagctagcactgacgacgcaggaattcagtactctgtattctatttcaattttgaggcttgcccactcctcgaaaacatcagcaagaattgcaccatccctcagagagatctggataatatggcatttccccaggcactcccgctcgaaaagcgatgtgagagattcctgcaaaagtcatatagaaaattagaaaagaaccccgagaaggaagaggagcactgggcccgcttgcagaggtattccctgagcctgcagagagagaacttcaaaaagtag

SEQ ID NO: 31952 - DNA, 1977 bp, Artificial Sequence
  Description of Artificial Sequence: Synthetic coding sequence
atgagctttcccagggggtctcagacacagaaaatcaagcaccccataggaactcggaaaggtcccctggaggtgcccccgccaacagaaaaagattggccgaaggacgacgagcaggatcatgtcttggtggaccccgacgaggagctagactctttgccacagccttacagaatgattaataagctggtgaacctgctgtttgatcagagctgggagattattgaggagcggaacgccttgcgcgaagccgaaagctcgcagatccagcctactgtctacccccccctcggagagatccagctgaataagatgccaaattgtatggccgtgagccaggattatgtgttcatcggcggagctaagggcttctcaatttacaacttatattcagcaaaacagatttatgcgtgggagaagcttaaagtggatgtgacctccatctgggctacagatctgggaaacgaaattctgatagctcctgttgacgagatgggtataatccgcctattctacttctacaaggaagggctgtatctggtaaaagccatcaatgaggttgacgatacttccaagcagactacctgcattaaaatggaaatttcacagggaggtgactttgccgcatttctgctacagggcgcaggggatatctggttggatgtctacaagctgcccaaagaaacctggctgaaaaaactggagcatccacaactcacctctaaccctaagaaaaaagtacggcagccacaattaaactccctgggacccatctcagccgacccattggaaatggacgctaatgttagttttaagggtgatatcaaattgtcgctgccagtgtacatcatgaagatcaaaccacctaagcctgttaccggcactaccttcaagtctcctctggaggttttcgcaaagattaaggactgttacgggctcggcagtgggcagaatcactttattaaagacagtcagtgggagcagcaggccgagattttcaatgcatcgtacaaaaagtatctggaccgtgagtgggaagaagaacccctaagcacagctaccttctacttcttgctgccatcttgtctcttcgccatgcctcccgaagtcaagggccccagcggcatggcgtgtgtcttgggaattcattggacgaggtcccacaacttctttctctactcactcaaccgcacactgaaagataaagccgaccccgaaggagtttggccttgtgctgcacccatagctgtctcccaactctcctgcagctccagctatctggtcctggcatgtgaagatggcgtcctaaccctttgggacctggccaagggacaaaacatgtacccagaaggccaggtcaaatcacaaatgaagtgcgtagtgctgtgcacagatgcttccctgcatctggtggaggcatccggcacccagggaccaacaatctcagtgcttgtagaaagacccgtcaagcaccttgataaaaccatctgcgctgtggccccagtgccggctttgcccggaatggttctcatcttttcaaaaaatggatccgtctgtctgatggacgtcgcgaaacgagagatcatttgtgcctttgcgcccccaggtgcttttccactggaggtcccatggaagccagtgttcgccgtcagccctgatcacccctgttttctgctgagaggggactacagccacgagaccgccagcacggatgacgccgggatccagtatagtgtcttttatttcaattttgaggcgtgcccacttttggaaaacatttcgaaaaattgcacaattcctcagcgagatttggataacatggcgttcccgcaggcgttgccactggaaaagaggtgcgaaaggttcctgcagaaatcatacagaaaactggaaaagaatcccgagaaggaggaggagcattgggcccgcttgcagaggtattccctctctcttcagagggagaacttcaagaagtag

SEQ ID NO: 31953 - DNA, 1341 bp, Artificial Sequence
  Description of Artificial Sequence: Synthetic coding sequence
atggaggcggaggcagcggacgcgcctccggggggagtcgagtcagctctgagttgtttctcatttaatcaggactgtacatccctcgccactgggacgaaggctggctacaaattgttctctctgagttctgtggagcagctggaccaggttcatggcagcaacgaaatcccagatgtctacatagtggagagactgttttccagttcgctcgtcgtcgtggtatcacatactaaacctcgccaaatgaatgtctaccactttaagaagggaaccgaaatctgtaattatagttattcatccaatatcctgtcgatccgtctgaaccggcagcggctgttggtgtgtctcgaggaaagcatatatattcacaatattaaggacatgaagctgcttaagactctcctggacattccagctaatcccacagggctctgcgcacttagtattaaccactctaactcttacctagcctaccccggatccctgactagtggtgaaattgtgctgtatgatgggaattctctgaaaacagtctgcaccattgcagcccatgaaggcactctggccgccatcacgttcaacgcgagtggcagcaaactggcttctgcttcggaaaaagggacggtgatcagggttttttctgtccctgacggtcaaaagctttacgagttcagacgaggcatgaagcgatacgttactatctcttctctcgtgttctcgatggatagccaatttctttgcgcatcctctaacacagagactgttcatatttttaagttggagcaagtgactaacagtcggccagaggaaccaagcacgtggtccggttatatgggaaaaatgtttatggcggcaaccaactacctgcccacacaagtgtccgacatgatgcatcaggacagggcctttgctaccgctagactgaacttcagtgggcagcggaacatatgtacactctcaaccattcagaagctaccccggcttctcgtggcgtccagctcaggtcatctgtatatgtataacctggatccacaagatggcggtgaatgcgtactgatcaagacccatagcttgctggggtctggcactacagaggaaaacaaggaaaacgatctcagaccgtcattgccccagtcgtacgcggccactgttgcgagaccttcggcgtctagcgcctctacagtgccagggtacagtgaggatggaggagccctcagaggtgaagttatccctgaacacgagtttgcgaccggtccggtgtgccttgacgacgagaatgaatttccccctattatcctgtgtagggggaatcagaaaggaaagacaaagcagagttag

SEQ ID NO: 31954 - DNA, 1095 bp, Artificial Sequence
  Description of Artificial Sequence: Synthetic coding sequence
atgaacgtctaccatttcaagaaggggacggagatctgtaactattcatactctagtaacattctgtcaatcaggctaaatagacagcggctcctggtgtgcctggaggaaagcatctacatacataacatcaaagatatgaaactgcttaaaactttattggatataccagccaatccaacaggactctgcgccctttccataaaccattcaaactcttatctcgcatatccaggctctttgacctctggagagattgttttatatgacggaaattcactgaagacagtttgcacaattgccgctcatgagggcacgctggccgccattacctttaacgcatccggctctaagcttgcctctgcaagcgaaaagggcacggtgattagggtgtttagcgtacctgacggtcaaaagctctatgagttccggcgcggcatgaaacggtacgttactatatctagcctggtattctccatggatagtcagttcctgtgtgcttccagtaatacagagacggtgcacattttcaaacttgagcaggttacaaattcccggccagaggaacctagtacttggagtggctacatgggcaagatgttcatggctgcaacaaattatctgcccacccaggtgtcggatatgatgcaccaggacagggcatttgctaccgcgaggctgaatttttcagggcaacggaatatttgcaccttgagcaccatacagaagctcccccggttgctcgtggcttcatcttccgggcacttgtacatgtacaatctggaccctcaggacggcggggagtgtgtactgatcaaaacacactcactgttgggtagcggcacaactgaggaaaacaaggaaaacgatctgcgaccctccctgccgcagtcttatgcagccaccgttgccagaccgagcgctagctccgcctcgaccgtacctggctactcagaagacggcggtgctcttcggggggaagttatccccgagcatgaattcgctacagggcctgtgtgccttgacgatgaaaacgaatttccccccattatcttatgtcgtggcaaccaaaaaggcaaaactaaacaatcgtag

SEQ ID NO: 31955 - DNA, 1365 bp, Artificial Sequence
  Description of Artificial Sequence: Synthetic coding sequence
atgaacctcgcctctcagtctggtgaggcaggagccggtcaactcctctttgctaatttcaaccaggacaacacggaagtcaaaggcgccagtcgcgcggctggtcttggcagacgagctgtggtgtggagcttagcagttggctccaaatcaggctataaatttttcagcctgagttctgtggacaaactcgagcagatttatgaatgcacagacaccgaggacgtctgcatagtggaaagactgttctccagctccctggtagcaattgtctctttgaaggctccaagaaaattaaaggtgtgccacttcaaaaaaggtacagaaatttgtaattacagctacagtaacacaatccttgccgttaagctaaatcggcagcggctgatcgtctgcttggaggagtcactctatattcacaatataagggacatgaaggtgctgcatacgatccgggaaacccctcctaatcccgccgggctgtgtgccctgtccatcaacaacgacaattgttatctggcctatcccggctcagccacgataggagaagtacaggtctttgatactatcaatctacgcgcagcaaatatgatacccgcgcatgatagtcctctggccgctctggccttcgacgcatccggaacgaagttagctaccgcgagcgagaagggaaccgtgattagagtgttttccatcccagaaggacagaagctgtttgaattcagaagaggtgtcaaaagatgcgtatccatttgtagtctggcttttagcatggatggaatgttcctgtccgctagttcaaatacagaaacagtgcacatttttaaactagaaacagtgaaggagaaacctcctgaagagcccacaacgtggaccggctacttcggaaaggttctgatggctagtacctcctacctgccgtcacaagtcactgaaatgttcaatcagggccgtgcctttgctacagtacgcttgccattctgtggacacaagaatatctgttctctggctaccattcagaaaattcctaggctgttagtgggtgccgcggacggttatctctatatgtataatctcgatcctcaggaaggcggggagtgtgcgctgatgaaacagcacaggcttgatggctcactagagactacaaatgaaattctggattccgcttcccacgattgccctttggtgacccagacctatggagccgccgccggtaaaggtacgtacgtaccttcttcacccaccagattagcatacaccgatgatttgggcgctgtcggaggggcctgcctggaggacgaagccagcgcccttaggctggatgaagatagtgagcatcctcccatgattttgcgaaccgactag

SEQ ID NO: 31956 - DNA, 1314 bp, Artificial Sequence
  Description of Artificial Sequence: Synthetic coding sequence
atgctgctacgtctgcagcggattaagacgctgcgaccacccggctgtccgcaccccatgaccacctgctcagcgggcactctttccgctgtgccgtgtgtgtctcctagacaggtttttgtctttgagagaagattctgtctgtggagccacgtggagatgtttacccatgtgctaccttttgtgatcagcgccgacacagaggacgtgtgtatcgtggagcgtctgttcagtagctcgctggtagccatcgtgagtctgaaggcgcctaggaaactcaaagtgtgtcactttaagaaaggcaccgagatttgtaattactcgtattccaatacgattcttgcagtaaagctgaatcgtcagcggctcattgtgtgtttggaggagtctctctatattcataacatcagggatatgaaggtattgcatactattcgcgagactccgcctaacccggctggactctgcgccctctccatcaacaacgacaattgttacttggcctacccaggcagcgccacaattggcgaggtccaagtgtttgatacaatcaatttgcgtgccgcaaacatgataccagctcatgatagccctctcgcagccttggcattcgatgcgtcaggcactaagttggccacggctagcgagaaaggtacagtgattcgcgtgttttctattcccgagggtcagaaactgtttgaattccgccgtggggtcaagcgttgcgtgagcatctgcagcctcgcgttttccatggacggtatgttcctctcagcctcctctaatactgagacggtgcatatttttaagctggaaaccgtcaaggagaaaccgcccgaagagcccacaacatggacaggatattttggaaaagtgctgatggcatcgacatcttatctcccatcgcaggtcaccgaaatgtttaatcaaggaagagctttcgccactgtcaggcttcccttttgcgggcacaagaacatttgctcactggcgaccatccagaagatccctaggctgctggtgggtgcagcagacgggtatctctacatgtataacctggaccctcaggaagggggtgaatgtgctctgatgaagcagcacagactggacggctccttagagactactaacgaaatcttggatagcgcctcacacgactgtcccctggtgacccagacgtacggcgctgcagccgggaaagcttataccgacgaccttggcgccgtcggtggagcttgccttgaagacgaggcaagcgctcttagactggacgaggattcagagcatccccctatgatcctgcgcactgattag

SEQ ID NO: 31957 - DNA, 1278 bp, Artificial Sequence
  Description of Artificial Sequence: Synthetic coding sequence
atgaacctggcctctcagtcaggcgaagctggcgccggacaattactctttgctaacttcaatcaggacaatacatccctggccgtggggtctaaatcaggttataagttcttcagcctgtcctcggttgataaacttgaacagatttacgagtgcacggacaccgaggatgtgtgtattgtggagcgcctatttagttcaagtctggtggccatcgtgagcctgaaggcacccagaaagcttaaagtctgccactttaaaaaaggtactgaaatatgtaactattcttatagtaataccattctggcagtgaaactcaataggcagcgccttattgtctgtttagaagagtctctctatatacataacattcgtgatatgaaggttctgcatactattcgcgagacacctcccaatcccgcagggctctgcgcgctcagtatcaataacgataactgctatttggcttacccaggatctgcaactattggcgaagtgcaggtgttcgacacgattaatctgcgggctgccaacatgattccagctcacgatagccctctggccgcactggcgtttgacgcttctggaaccaaacttgcgactgcaagtgaaaaagggaccgtgattcgggtgtttagcatacctgaaggccaaaagctctttgaattccggaggggcgtcaagcgctgcgtgtcaatttgttctctggcctttagtatggacggcatgtttctttcagccagtagcaatacagaaactgtgcacatttttaagctggagacagtgaaagagaagccgccagaggaacccacaacatggacagggtatttcggcaaggtgctgatggcctccacctcataccttcctagtcaggttactgagatgttcaatcagggtcgcgcctttgccacagtgcggctacctttttgcggtcataagaacatctgctcactggcaaccatacaaaagatcccccgcctcctcgttggcgctgctgatggatatctctacatgtacaacctggacccacaggagggaggagagtgcgccttaatgaagcaacacaggcttgatggatccctcgagactacaaatgaaattcttgatagcgctagtcatgactgcccactcgtgacccagacctatggggccgcagctgggaaggcttatacggatgacctaggagcagtaggcggggcttgcttagaggatgaggcatctgcgttgcggctggatgaggactccgagcatccccctatgatcctgaggactgattag

SEQ ID NO: 31958 - DNA, 1311 bp, Artificial Sequence
  Description of Artificial Sequence: Synthetic coding sequence
atgaacctggcaagccagagtggggaggccggagccggacagctcctattcgccaatttcaatcaggacaatacctcactggctgtgggtagcaagtcaggttataagttcttcagtttatcttccgttgataagctggagcagatttatgagtgcaccgataccgaagatgtctgtattgttgagcgcctgttctcaagctctctggtggccatcgtgagcctaaaggctccccgcaagctgaaggtatgccacttcaagaagggcactgagatctgcaactattcctacagtaatacaattctggccgtgaaattaaatcgccagagactgatcgtttgtcttgaggaaagcctatatattcataacatccgcgatatgaaagttttgcatacaatccgggaaaccccacccaaccccgcgggcctttgcgcgctctcaatcaataatgacaactgttacctggcgtatcctggtagcgccaccattggcgaggtgcaggttttcgacacaatcaaccttcgcgcagccaatatgataccggcacacgattcccccctcgctgcacttgcctttgacgcctcgggtaccaagttagccactgcatccgagaaaggcacagtgatccgcgtgtttagcatacccgagggccaaaagttgtttgagttcaggcggggtgtaaagagatgtgtatcgatttgcagcctggctttttctatggatggaatgtttctttcagcaagctccaacaccgagaccgtgcatatattcaaactggaaacagtcaaagagaaacccccagaagagcctacaacctggaccggatatttcggaaaagtgcttatggccagcacctcatatctgccttctcaagttaccgagatgtttaatcaaggacgcgcatttgctaccgtaagactccctttctgtggtcacaaaaacatctgcagcttggctaccatccagaagatccctagactgctcgtgggcgcggccgacggatacctgtacatgtataatctggacccccaggaaggcggggagtgcgccttaatgaagcaacacagactcgatggtagtctagaaacaactaacgagatactcgactcggcttctcacgattgccctctcgttactcagacgtatggcgccgctgccggcaagggcacctacgttccatcctcacccacaagactcgcttatacagacgatctgggcgcggtgggcggggcttgtctggaggatgaggcatccgccctgcgtctggacgaggatagcgaacaccctccgatgatcctgcgcaccgattag

SEQ ID NO: 31959 - DNA, 1332 bp, Artificial Sequence
  Description of Artificial Sequence: Synthetic coding sequence
atgaacctggctagccagagtggcgaggccggggcagggcaactgctgtttgctaacttcaaccaggacaacactgaagtgaagggggcttcacgtgccgccgggctgggtcggcgggccgtcgtgtggagccttgctgtgggctctaagtcaggttataagttcttcagcttgtcaagcgtagacaagcttgagcaaatttacgagtgtacggataccgaggatgtgtgcattgtagaaaggcttttctcctctagtctggtggctatagtgagtctgaaagcgcctagaaaattgaaggtgtgccattttaaaaagggcaccgaaatatgtaactatagttacagcaacaccatactcgccgtgaagctgaaccgccaacgtttgattgtttgtttggaagagtcactttatatccacaacataagagatatgaaggttctccacacaattagggagacccccccaaatcctgccggcttgtgcgctttatccattaataatgataactgttacctcgcctatccagggtctgccactataggcgaggtgcaggttttcgacaccattaacctgcgtgctgctaatatgattccggctcacgacagtccgctcgctgctttagccttcgatgcatcagggacgaaactggcaacggcttcggagaagggcactgtcatccgggtctttagtatcccagaaggccagaagctgtttgagttcaggagaggggttaagaggtgtgtgtctatctgttcattagcattttccatggatggaatgtttctctccgcgtcatccaacaccgaaacagtgcacattttcaaacttgaaacagtcaaggaaaaaccgcccgaagaacctactacctggactggatacttcgggaaagtgcttatggcctcaaccagctatcttcccagccaggtgacagaaatgttcaaccaggggcgcgccttcgcgactgttaggctgccattctgcggacataaaaatatttgttcgctcgctacaatccagaagatacctcgtctgttggtgggcgctgccgacggctatctttatatgtacaatctcgatcctcaggaagggggagaatgtgctctgatgaaacagcacaggctggatggctccctcgagacaaccaatgaaatcctggacagcgcttcgcatgattgccctctcgtaacccagacgtacggtgctgccgctggcaaagcgtacactgatgatctgggtgccgtgggcggcgcttgtctggaggatgaagctagcgctcttcgtttggatgaggacagtgagcatcctcccatgattctaaggaccgactag

SEQ ID NO: 31960 - DNA, 1155 bp, Artificial Sequence
  Description of Artificial Sequence: Synthetic coding sequence
atgtttactcatgtgttaccattcgtcatttccgccgacactgaggacgtatgtattgttgagcggttgttcagcagctctctggttgctatcgtgagccttaaggcacctaggaagctgaaagtatgccacttcaaaaaaggcacagagatatgcaattactcctacagcaataccatactagcggttaagcttaataggcagaggcttatcgtgtgtctagaggagagtctgtacatccataatattagagacatgaaggtgctgcataccatcagagaaaccccccccaatccagccggactgtgcgccctctctatcaacaacgacaattgttatttggcataccctggctcggcgactatcggagaagtccaggtgttcgataccatcaatctcagagccgccaatatgatcccagcccacgactcccctctcgctgccttagcctttgatgccagtgggaccaagttagccaccgcctccgaaaaggggactgtgatccgcgtgttctcgatccccgaaggacagaagctctttgagttcagaaggggcgtgaaacgatgtgtgtccatttgctcactggccttttctatggacgggatgttcttgagcgcctcttccaatacagaaaccgtgcatattttcaagctggaaacagtcaaagagaagcctcccgaagagccaactacgtggactggctacttcggcaaggtgctgatggcaagcacttcatacctgccatcccaggttactgaaatgtttaatcaaggtcgcgcatttgctactgtgcggttacctttttgtggtcacaagaacatttgtagcctcgccaccatacaaaaaatcccgagacttctggttggagctgcagatggatatctttatatgtataacttggaccctcaagaagggggggagtgcgccctcatgaagcagcatcgactggatggttccctggagaccactaatgaaatcctggattcagcaagtcacgattgtccgctggtcacccaaacatacggggccgccgccgggaaggcatacactgacgaccttggggccgttggcggagcttgtctggaggacgaggccagtgcgcttcgcctagacgaagactccgaacatcccccaatgattctcaggacagattag

SEQ ID NO: 31961 - DNA, 1035 bp, Artificial Sequence
  Description of Artificial Sequence: Synthetic coding sequence
atgaatctgctcccatgtaatcctcacggtaacgggctgttatatgccggatttaatcaggaccacggatgctttgcgtgcggtatggagaatggcttccgagtttataatactgaccctctgaaggaaaaggagaaacaggaattcctagaaggaggagtagggcacgtggagatgctgtttcgatgcaactatctcgctctggtgggtggcggcaaaaagccaaaatacccccccaacaaggtcatgatctgggacgatctcaaaaagaagacagtcatcgagattgaattcagcaccgaagtcaaggccgtcaagctgcgacgggaccgcatcgtggtggtacttgatagcatgataaaggtcttcactttcacacacaacccccatcaattacacgtctttgagacttgctataatccaaaaggactctgcgtgctttgccccaatagtaacaatagtctgttggcctttccaggcactcacacagggcacgttcagctggtagatctagcaagtacagaaaagcctcctgtcgacattcccgcacacgaaggtgtcctgtcctgcatcgctctcaatcttcagggcacacgtatcgctactgcttcagaaaagggaactctcatcaggatcttcgatacatcctctggtcacctcatccaagagctaaggcgtggatcacaggctgcaaatatatactgcatcaactttaatcaggatgcctcactgatatgtgttagttctgaccacggcaccgtgcacattttcgccgccgaggacccgaaacgtaataaacagtcgagcctggcatccgccagctttctccctaagtatttctcttctaaatggtcgttttcaaagtttcaagtaccttctggaagcccatgtatctgcgcatttggaaccgagcctaacgccgtgatcgccatctgcgccgatggttcttactacaagttcttgttcaatccgaaaggagagtgcatcagagacgtctatgcacagtttcttgagatgactgacgacaagctttag

SEQ ID NO: 31962 - DNA, 951 bp, Artificial Sequence
  Description of Artificial Sequence: Synthetic coding sequence
atggaaaacggtttccgcgtctataacaccgatcctctgaaggaaaaggagaagcaagagtttctcgaaggcggggtcggccacgtggagatgctgttcagatgcaactacctggccctcgttggaggaggcaaaaaacctaagtatccccccaacaaagttatgatctgggacgaccttaagaaaaaaaccgtgatagaaatcgagttttccacagaggtgaaagccgtaaagttgcgacgagaccgtattgtggtggtgcttgattccatgattaaagtttttacatttacccacaacccgcaccaactgcacgtgtttgagacatgctacaatcccaaggggctgtgcgtcctctgtcccaatagcaacaattccctcctggcattcccagggacccacacgggccacgttcagctcgtcgatttagcatcaacagaaaaaccacccgttgacattcccgcccacgagggggtgctctcgtgtattgctctgaatctgcagggaactcggatagccacagcttccgaaaagggtaccctaattcgtattttcgacacctcatccggacaccttatccaagagttgagaaggggctcccaggccgcaaatatttattgtatcaatttcaaccaggacgcgagccttatctgtgtgtcatcagaccatggtacagtgcacatcttcgccgctgaggacccaaagagaaataagcagtccagcttagcaagcgccagcttcttgcctaaatacttctctagtaaatggtcttttagtaagtttcaggtgccctcaggatcaccctgcatctgcgccttcggcactgaacccaacgcggttattgcgatctgcgccgatggctcgtattacaagtttctgttcaatccaaaaggggaatgcattagagatgtgtacgctcagtttctggagatgacagatgacaagctgtag

SEQ ID NO: 31963 - DNA, 1395 bp, Artificial Sequence
  Description of Artificial Sequence: Synthetic coding sequence
atggccttggtggcccttgttgcaggagcacgccttggccgtaggctgtcaggcccaggcttagggcgtggccattggacagctgcccgtaggtcaaggagccgccgcgaagccgccgaagctgaagccgaagtgcctgtcgtgcaatacgtgggggaaagggccgcacgcgcggaccgggtgttcgtatggggtttctcctttagcggagcacttggtgttccttccttcgtggtgccgagtagtgggccaggtcctcgggcaggcgcccgtcccaggaggcgcattcagcccgttccctataggctggaactggaccagaaaatctcctccgccgcctgtggctatggcttcaccctacttagttcaaagacagcggatgtgactaaagtctggggaatgggcttgaataaggatagccagttgggcttccacagatctcgcaaagacaagacaaggggctacgaatacgttctggaaccaagcccggttagcctgccattagaccggccacaggagacccgagttctccaggtcagctgtggaagggcgcattctctggtgttgacagatcgcgaaggagtgttttcaatgggcaacaacagctacggtcaatgtgggcgtaaagtcgtcgaaaacgagatctacagcgaaagtcatagggtccacagaatgcaggacttcgatggtcaggtcgtgcaggttgcctgcggtcaggatcattccttatttctcactgacaagggggaggtgtatagctgcggctggggagcagacgggcagacagggctggggcattataatataacttcttctccaaccaagctgggcggtgatttagcaggcgttaacgtaatccaggtggcaacgtacggcgactgttgcctggctgtttctgcggacgggggactgttcgggtggggaaactctgagtaccttcagctggcctccgtcacggactctacacaggtcaacgtgccgaggtgtctgcacttttccggggtggggaaagttagacaggctgcttgcggtggaaccggctgcgccgtgttaaacggggaggggcatgtgttcgtatggggatatggcatactggggaaaggtccaaatcttgtagagtccgccgtccccgaaatgatcccacccacactgttcggcctcactgaatttaacccggaaatccaggtttcaagaatcagatgcggtctttcccatttcgctgcgctgacaaacaaaggcgaattgttcgtgtgggggaaaaatatacgtgggtgcctgggcattggtcgcctggaagatcagtacttcccctggagagtcaccatgcctggggagccggtggacgttgcctgcggcgtggatcatatggtcactcttgccaagtcattcatctag

SEQ ID NO: 31964 - DNA, 1365 bp, Artificial Sequence
  Description of Artificial Sequence: Synthetic coding sequence
atggctctggtggctttggtggccggggcccggctgggacgcaggctgagcggcccaggattgggtaggggccactggacggccgcaaggcgtagccggagccgaagagaggctgccgaagctgaagctgaggtgcccgttgtccagtacgttggcgaaagggcagcgcgggccgatagggtcttcgtttgggggttttcgttctctggagccttgggggtgcctagtttcgttgtgcccagtagcggccctgggccacgagcaggggcacggcccagacgacgtatccaacccgtcccttacagactcgaattggaccaaaagatcagctccgcggcatgtggctacggctttactcttctgtcgtctaaaactgccgacgtgactaaggtgtggggtatgggtcttaacaaagatagccagctgggcttccatcgatctcgcaaggacaagacccgaggctacgagtacgtgctagagcctagcccagtatcacttcccctggacagacctcaggaaacgagagtgctccaggtgtcttgtggcagagctcactcgttggtcctaacagatagagagggcgtgttttccatgggcaataattcatacgggcagtgtggacggaaagtggtggagaatgagatctattctgaatcgcacagagtgcatagaatgcaagactttgacggacaggtggtgcaggtcgcttgtggtcaagatcattctctgttcttaacagacaaaggtgaggtgtactcatgcgggtggggggccgacggacagactggtctgggccactacaatataacaagtagtccaaccaagcttgggggagatctagccggcgtcaatgtcatacaggtggcgacatatggtgactgctgtctggccgtcagtgcagatggtggcctgttcgggtggggaaattccgaatatttgcagctggcctccgtgacagactctacccaagtcaacgtgcctaggtgcctgcatttctctggagtcggcaaggtacggcaggctgcctgcggggggaccggctgcgcggtcttgaatggcgaagggcatgtttttgtttgggggtacggcattctggggaaaggcccaaacctggtggagagcgcggtgcccgaaatgattccgcctacgctcttcggacttactgaatttaatcctgagattcaggtatctagaattagatgcggattgtctcacttcgctgcattgactaacaagggggaactcttcgtatggggcaaaaacatacggggatgtcttggaataggccgactggaagaccaatattttccctggcgcgcaccagccccgtccgccagcgccaagaccactggacccctcttgtag

SEQ ID NO: 31965 - DNA, 1077 bp, Artificial Sequence
  Description of Artificial Sequence: Synthetic coding sequence
atggctcttgtagccttggtggcgggggcccgcctcggtcgacggctgtctggacctggcttgggccgaggccactggacagccgcccgacgctcccgatcacggagggaagcagctgaggccgaggcagaggtgccagtcgtgcaatacgttggcgaacgcgccgcccgtgccgacagagtctttgtgtggggcttctcattctctggggcattaggcgttcctagttttgtggtcccctcctcgggacccggccccagagcgggggcccgcccacgtcggagaatccagcctgtgccatatcgcctcgagctggatcagaagatctcatctgctgcatgtggatatggtttcacgctcctctctagcaagaccgcagacgttaccaaggtatggggtatggggttgaacaaggactcacagcttggttttcaccgctccaggaaggacaagacacggggttacgagtacgtgttggagcctagccccgtgtccctacccctggatcgcccccaggaaacaagggtgctccaggtgtcctgcggacgggctcattctcttgtgttgacagatagagaaggcgtgtttagcatgggcaacaactcttacggacagtgtggccgaaaagtggtggagaacgagatatactcagagtcccatcgggtacataggatgcaggactttgacggacaggtggtccaggtagcgtgtggtcaggaccactccctatttctgacagacaaaggtgaggtgtattcatgcggttggggggcagatgggcagacaggactaggacactataatatcacatccagccctactaagttaggtggcgacttagccggggtaaacgtgattcaggtagccacttatggcgactgttgcctagcagtcagtgccgacggaggccttttcggctggggtaacagcgagtacctccagctcgcctctgtgaccgactctacccaggtgaacgttccgcgctgcctccacttctcaggagtgggaaaagtgcgacaggccgcttgcggaggaaccggttgcgccgtgctgaatgacacttggccacagtcttag

SEQ ID NO: 31966 - DNA, 1797 bp, Artificial Sequence
  Description of Artificial Sequence: Synthetic coding sequence
atggcctccctgcggagggtaaaagtgctgctggttttgaatctcatagccgtcgcaggcttcgtgctattcctcgccaagtgtcgccccattgccgtgaggagcggggacgcattccacgagataaggccacgggccgaagtcgcaaacctgtccgcccactcagcaagcccgatacaggacgcagtgcttaaacgcctatcgctcctcgaggacatcgtatacagacagctgaacggcctgtcaaagtccctgggattaattgagggctacggagggcgcgggaaaggggggctgccagcaaccctgtcccctgccgaggaagagaaggctaaaggaccgcatgagaagtacggttacaacagttatctctccgaaaagatctccttagaccggtccatccccgattatcgccctaccaagtgcaaggaactgaagtacagtaaagacctcccacaaattagcatcatatttatcttcgtcaatgaggcattatccgtgatcctcaggagtgtccacagtgctgtgaaccatacacctacccatctccttaaagagatcatcctggtggatgacaactcggacgaggaggaattaaaggtgcctctggaagagtacgtgcataaaaggtaccccggccttgtcaaagtggtgaggaaccagaaacgcgagggtctgatcagagcccgcattgagggctggaaagtggctaccgggcaggtgaccggcttcttcgacgcccacgttgagtttacagctggatgggcagagcctgtacttagcaggatccaagagaaccgtaagagagtcatcctccctagtatagataatatcaagcaagacaatttcgaggtccagagatatgaaaacagcgcacatggctactcatgggaactatggtgcatgtatatttcccccccgaaagattggtgggacgcgggagacccttctctgcccatcagaaccccagcgatgataggctgttcctttgtagtaaataggaagttcttcggagagatcgggctcctggatcctggtatggacgtttatggaggggagaacattgagttgggtattaaggtgtggctgtgcgggggctcgatggaagttcttccctgtagcagggttgcccacatagagcgaaagaaaaaaccctacaactccaacatcggcttctacaccaaacgaaatgccctcagggtggctgaagtctggatggacgactacaaaagtcatgtctacattgcgtggaacctgcctttggagaatccaggcatcgacattggagatgtgagtgagcggcgcgcccttcgcaagagtctgaagtgtaaaaactttcagtggtacctcgaccacgtgtacccggaaatgcgaagatataataacacagtagcttacggagaacttaggaacaataaggcaaaggacgtgtgtctggatcagggcccattagagaaccacactgcaatattgtatccctgtcacggctgggggccacaactcgcccgatataccaaagagggctttctgcatcttggagcactggggacaactactctgctaccagatactcgctgcttggttgacaactccaaatcacgcctgccccagttgttggactgcgataaggtgaagtcatcactgtacaaacggtggaactttatccagaatggagcaatcatgaataaggggactggtcgttgcctggaagtggagaaccgcggactggcgggcattgacttgatcctcagatcttgcacaggacagaggtggacaatcaagaatagtatcaaatag

SEQ ID NO: 31967 - DNA, 1728 bp, Artificial Sequence
  Description of Artificial Sequence: Synthetic coding sequence
atggctaaacctttttttcgcctccagaagttcctcaggagaacacagttcctgcttttttttctgactgctgcgtatcttatgacagggtccctgctgctgttgcagagggtgagggtggcgctccctcaaggccctcgcgcgcctggaccgctccaaactctgccagtcgcggccgtagccctcggtgtgggtctgcttgattctagggccctgcatgacccccgggtcagccccgagctgttattaggcgttgacatgctgcagagccccctcactcgcccgaggcccggtcctcgctggctccggtccaggaactcagaactgcgccagctgcgcaggcgatggttccatcatttcatgtcagacagccaggggcctccggcgctgggtcccgaagccgcccgccccgctatccacagtaggggaacttacatcggctgtttcagcgacgacggtcacgagcggactctgaaaggtgcagtgttttacgatctgagaaaaatgacagtctcccactgccaagacgcctgtgccgagcgttcttatgtgtatgccggactcgaagcgggtgcagagtgctattgtggcaacagactgccagcagttagtgtgggtttagaggagtgtaaccacgagtgtaaaggcgaaaaaggcagcgtctgcggtgctgttgaccggttgagtgtgtatagggtcgacgaactgcagcctggtagcaggaaacgcagaacagccacctatcgggggtgttttcgactgccagagaacatcactcatgcattcccatcctctctgattcaggcgaatgtcactgtggggacttgtagcggattttgttctcagaaggagtttcccctagccatcctgcgcggctgggagtgttactgcgcgtatcctacacccaggttcaacctgagagatgccatggacagctccgtctgcggacaagatccagaagcccagaggctggcggagtattgtgaggtgtaccagaccccggtgcaggacacaaggtgcacggaccggcggttcctccctaataagtctaaggtgtttgtggccttgagcagcttccctggcgccggaaatacgtgggcgagacacctcattgagcatgccaccggtttttatacgggatcctattactttgacggcacgctctataacaagggcttcaagggcgagaaggatcattggcgatcacgacgcacaatctgtgtgaaaacacatgagtcaggccggagagagatcgaaatgttcgactcagccatcctattgatccgcaatccgtatagatctctagtcgctgaattcaataggaagtgtgccggccacctcggctacgcagctgatcggaactggaagtcgaaagagtggccggactttgtgaatagctacgcctcgtggtggtcaagtcatgtgctggactggttaaagtacggcaagcgcctcttggtcgtgcattatgaggaattgcgacgatctttggttcctactctcagggaaatggtcgcctttctgaatgttagtgtgtctgaggagcggctgctatgtgtggaaaacaataaggaagggtccttccgaaggcggggtcgtcgtagccatgacccagagccattcacccccgaaatgaaggatctgataaacggatacatcagaaccgtggaccaagcccttagagaccataattggacaggattaccaagggagtatgtccccaggtag

SEQ ID NO: 31968 - DNA, 1728 bp, Artificial Sequence
  Description of Artificial Sequence: Synthetic coding sequence
atggccaaaccgtttttcaggttgcagaagtttttacggcgcacacagttcctgctgttcttccttaccgccgcatacttgatgactggatctttgttgctactgcaaagagtgcgtgtggcgcttcctcagggaccaagagcccccgggccactccaaaccctaccggtcgcagccgtcgcactcggcgtaggcctacttgatagccgagctctccacgaccctcgggtctcgcctgagcttttattgggggtggatatgctgcagtctcccctgaccaggccgaggcccgggcccagatggctaaggagtagaaactcagagcttcggcagctacgtagacgctggtttcatcacttcatgtccgactcacagggcccacccgcactgggccccgaagccgcgagacccgctatccacagtaggggcacttacatcggatgcttttctgacgacggacatgagcggactctaaagggcgctgtgttctatgatctgaggaagatgaccgttagccattgccaagatgcatgtgcggagcgttcatatgtgtatgccggcctggaggctggagctgagtgctactgtgggaatcgccttcccgccgtctctgtaggcctggaagagtgtaaccacgagtgtaaaggcgagaaagggtcagtgtgcggcgcggtggacagactgagcgtttaccgagtcgatgagcttcagcccggatcccgcaagcgtcgaaccgctacttatcgtggatgtttccgacttccagagaacatcactcacgcgtttcctagctcactgatccaagctaatgtcaccgtaggaacttgctccggattctgctcccagaaggaatttccactggcaatattgaggggctgggaatgttattgcgcctaccccacaccgaggttcaaccttcgcgacgctatggatagctccgtttgcggacaggatccggaagcgcaaagactggcagagtactgcgaggtgtaccagacccctgttcaggacacaaggtgtacagacaggcgatttctgcctaataagtccaaggtcttcgtggccctcagcagcttcccaggcgctggcaatacgtgggccagacatctgattgagcacgctacaggcttttacactggcagttattactttgacggcacattgtacaacaaagggtttaaaggagaaaaggatcactggcgtagtcggcggaccatctgtgtcaagactcatgagagcggtcgccgcgaaatcgaaatgttcgacagtgcaatccttctgattcgtaacccttatcgaagcctggttgccgaattcaaccggaagtgtgcaggccacttaggttacgctgccgatcgaaattggaaatcgaaagaatggcccgattttgtaaactcttacgcatcttggtggtcttcccacgtgctcgactggctgaaatatggaaaacgcctcttagtggttcactatgaagagctgcgccgcagcctggtgcctacactcagggaaatggtcgcctttctgaacgtctctgtttctgaagagaggctgttgtgtgtggagaataataaagaagggtccttcagaagacgtggaagacgctctcacgatcctgaaccctttacacccgaaatgaaggacctgataaatggttatataaggactgtggatcaggcactgagagaccataactggacaggcctgccccgagagtacgtaccccggtag

SEQ ID NO: 31969 - DNA, 1758 bp, Artificial Sequence
  Description of Artificial Sequence: Synthetic coding sequence
atggcgaaactctggttcaagtttcagcgctacttccggagaaagccagtgcggttttttacttttctggcactctatctgacggcaggaagcctagtctttctacactcagggttcgtgggccagccggctgtgtcaggaaaccaggccaaccccgctgctgctggggggcccgctgagggtgccgaactgtcttttctgggtgatatgcacttggggcggggattccgggacaccggcgaggcaagcagcattgccagacggtacgggccctggttcaaaggcaaagacggtaacgagcgggcaaagctcggggactatggaggagcatggtctcgagcgctaaaaggacgagttgtgagggagaaggaagaggagagggctaaatacatcggctgttatctggatgacacccagagtcgagctctgcgcggggtgtcttttttcgattacaaaaagatgacaatatttcgttgccaggataactgcgccgagaggggatatctttacggtgggcttgaatttggggctgaatgctactgtgggcataagatccaagcaacaaacgtgagcgaggccgagtgcgacatggagtgcaagggtgagcgcggcagcgtctgcggcggagcgaacaggctgtccgtgtacagactccagttggcccaagaatctgctaggcgatacgggtctgctgtgttccgcgggtgtttccgaagaccggacaatctgagcctggctctcccagtgacagccgcgatgctgaacatgtcagtagataaatgcgtggatttctgtactgagaaagagtatccgcttgccgctctcgcaggtacggcttgccactgcggctttccaaccacccgctttccactacatgatcgagaggatgaacagttgtgcgctcagaaatgctccgcagaggagtttgagtcatgcgggaccccatcttacttcattgtgtatcaaacccaagtgcaagacaacagatgcatggaccgccggtttcttccaggcaaatccaagcaactgatcgcactggccagcttccctggtgcaggaaatacttgggcccgacatttgattgaattagcgactggcttttacactggctcttattattttgatggcagcctctataataaaggttttaagggcgaaagggatcactggcgctcaggacgaaccatatgtattaagacgcatgagtcagggcagaaggagatagaggcattcgatgctgctatacttctgatcaggaacccctacaaggcgctcatggcggaattcaaccgcaagtacggggggcacataggatttgccgcccacgcccactggaaggggaaaggtgcagtgcccggcagtctgcagatcctgttcagaagcatctgtacagcaagcgtgggggagtggcctgaattcgtccgtaattacgcaccttggtgggcaactcatacccttgactggcttaaattcggtaaaaaagtactggtggtgcatttcgaagacctgaagcaggatctgtttgtccaactgggccgcatggtgtctcttctgggtgtggcagtgcgggaggatcgacttttatgcgttgaaagccagaaagacgggaactttaagcggtctggcttgcgcaagctggaatacgatccttacaccgcagacatgcagaaaacaatttctgcttacatcaagatggtcgatgctgcgctgaaaggcaggaacctcacgggcgttcccgatgattattacccccgatag

SEQ ID NO: 31970 - DNA, 1698 bp, Artificial Sequence
  Description of Artificial Sequence: Synthetic coding sequence
atggcgaagctatggtttaaattccagcggtatttccggagaaaaccggtgagatttttcacattcctcgctctctatctgaccgccggctctctcgtattccttcacagtggattcgttggccagccagccgtctcaggtaatcaggccaaccccgccgcagcgggagggcccgcagaaggagccgaattgtccttcttgggggatatgcacctaggccgagggtttagggacaccggcgaggcttcttccattgcccggcggtatggcccgtggttcaaaggcaaggacggcaatgagcgtgccaaactcggcgactatggaggtgcttggagtcgagcactaaagggacgggtggttcgggaaaaggaagaagagagagccaaatatattggctgttacctcgatgatacgcaatccagagccctgcgaggtgttagtttctttgactataagaagatgactatttttagatgccaggataactgtgccgagcgaggctacttatatgggggcctggaatttggggccgagtgctattgtggccacaaaatccaagcaactaatgtgtccgaagccgaatgcgacatggaatgtaagggcgagagaggctctgtgtgcgggggagctaacagactgagcgtgtatcgcctccagttggcccaggagtccgcgcggagatacggtagtgctgtgttcagggggtgcttcaggcggcctgataatctgtcactcgcactgcccgtgaccgcagcaatgctcaacatgtcagttgacaaatgcgttgatttttgcacagaaaaggagtacccactggccgccctggccgggacagcatgccactgtggcttccctaccacacgctttccgctgcacgatcgagaggacgaacagctgtgcgcacagaaatgcagcgccgaagaattcgaatcttgcggtacaccctcatatttcatcgtctatcagacacaggtgcaggacaacagatgtatggataggagatttctgccagggaaaagcaagcagctaatcgcactggctagcttccctggagccggaaatacctgggcccgccatctaatcgagctggctaccggcttctataccggatcttattacttcgatggcagcctttataataaggggttcaaaggagaacgagatcattggcgtagtggcagaactatatgtatcaagacccatgagagcggccagaaagagatcgaggcctttgacgccgccattcttctgattcggaacccttacaaggccctgatggccgagttcaacaggaagtatggaggccacatcggatttgccgcccatgcacactggaagggtaaggagtggcctgagttcgtgagaaactacgccccctggtgggccactcatacacttgattggctgaaatttgggaagaaagtgcttgtggttcactttgaagacctgaagcaagatctcttcgtgcagctcggccgcatggtgagcctgctgggtgtggccgttcgggaagacagattactgtgcgtggagagtcaaaaagacggtaactttaaaaggtctggcttaagaaagctggaatacgatccttatacggcggatatgcagaagaccatctcagcctatataaagatggtggatgctgctctgaagggaaggaatctgactggcgtcccagatgattattatcctcgttag

SEQ ID NO: 31971 - DNA, 1698 bp, Artificial Sequence
  Description of Artificial Sequence: Synthetic coding sequence
atggcaaagttgtggttcaaattccagagatacttccgtcggaagcccgtacgattctttactttccttgcactctatctgaccgctggctccctggtgttcctgcactccggtttcgtgggtcagcctgccgtgtctggaaatcaggctaaccccgcagctgctggtggccccgctgagggggcggaactgtcttttctgggcgacatgcatctggggcgtggctttagagacacaggggaagcttcatcaattgcgaggcggtacggcccctggttcaagggaaaggacgggaacgagagagccaagcttggagattatggcggggcgtggagtagagccctgaaaggaagagttgtgcgtgaaaaggaggaagagcgggccaagtacatcggatgttacttagatgacacacagagtcgggcactcagaggcgtgtccttttttgactacaagaagatgaccattttccgatgtcaagacaattgcgctgaacgggggtacttatacggaggactggagtttggggcagagtgctattgcggacataagatccaagctactaatgtttccgaagcagaatgcgacatggagtgcaaaggggagcgcggatccgtctgcggcggtgccaatcgactgagtgtataccggctgcagcttgcccaggagtcagcacgacgctatgggtccgccgtattccgaggctgctttcgccggccagacaacctgtccctcgcgctcccagtgaccgccgcgatgttaaatatgagcgtggacaagtgtgtggacttctgcactgaaaaggagtaccccctggctgctctggctggaacagcttgccactgcggattccctacgacccgtttccctctgcatgatagagaagacgaacagctctgtgctcaaaaatgtagtgcagaggaattcgagtcatgcgggaccccatcatactttatcgtttatcagacccaggttcaggataatcgctgcatggacagaagatttctcccgggtaagtctaagcagcttatagccctggcttccttccccggtgccggtaacacctgggccagacatttaatcgagctagctaccggattctacacaggttcttactactttgatgggagcctgtacaacaagggtttcaaaggggaacgagatcactggcgctctggtagaaccatttgtatcaaaactcatgagagcggtcagaaagaaattgaagctttcgatgctgctatccttctcattagaaatccctataaagcactgatggcagaatttaaccgcaagtatggcgggcacatcggatttgccgctcacgctcactggaaagggaaggagtggccagagtttgtgaggaattacgcgccttggtgggctacccacacactggattggctcaaattcgggaagaaggttctcgtcgtccactttgaagacctgaaacaggacttattcgtgcagctgggtcgcatggtttcactcctcggagtggccgttagagaagaccgtctgttatgcgtggaatcgcagaaagatggcaattttaagcggagcgggctgaggaaactcgagtatgatccttatactgccgacatgcagaaaacaatctccgcttatatcaaaatggtggatgctgctttgaaaggaaggaacctcacaggcgtgcctgatgattactaccctaggtag

SEQ ID NO: 31972 - DNA, 1758 bp, Artificial Sequence
  Description of Artificial Sequence: Synthetic coding sequence
atggccaagttgtggttcaaatttcaacggtattttagaagaaagccagtgcggtttttcaccttcctggcgctgtatttgactgctggctctctcgtgttcttgcactctggttttgttgggcagcctgcagtgtctggcaatcaggccaatcccgctgccgcaggcggacccgctgagggcgcagagctgtccttccttggggacatgcatttggggagaggatttagggatacaggtgaggcctcctccatcgctaggagatacggcccatggttcaaaggaaaagacgggaatgagcgcgcaaaactcggcgactacggcggtgcctggtctagagcgctcaagggacgagtcgttcgggagaaggaggaagaacgcgccaaatatatcggctgctatctcgacgatactcaatcaagagcgctccggggggtcagtttctttgattacaagaaaatgactatattccggtgccaggataattgtgcagaaaggggctacttgtacggaggcctagaatttggggcggagtgctactgcgggcataagattcaggcaaccaatgtgtccgaggctgagtgcgatatggaatgtaaaggagaacgcggcagtgtgtgtggaggggcgaatcgactctccgtataccggctgcaactagcgcaggagagcgcacggaggtacggatccgcggtgtttaggggctgtttcagacgacccgacaacctgtccttggcactgcccgtgacagcagctatgctaaacatgagcgtcgacaaatgcgtcgacttttgcacagaaaaggaatatcctctggcagcgctcgcagggacagcttgtcactgcggattcccaaccactcggttccctctccacgatcgcgaagacgagcagctgtgtgctcagaagtgcagtgctgaagagttcgagagttgcggtacaccatcatattttatcgtctaccaaacccaggtccaggacaaccggtgtatggaccggcgctttctgccggggaagagtaagcagcttattgccctggcttcctttcccggtgctggaaacacctgggccagacatctcattgagctagccaccggtttctacaccggttcctactattttgatggctccctgtacaataagggatttaaaggcgaaagagatcattggcggtctggtagaactatttgtattaagacacacgagtctggacaaaaagagatagaggcctttgacgccgcaatcctactaatccgaaacccttataaagcacttatggcagagtttaaccgaaagtacggaggccatatcgggtttgcagctcacgcacactggaaggggaagggcgccgtccctgggtcgttgcagatcctatttaggagcatttgtaccgcgagcgtgggagagtggcccgaatttgtgcgcaactacgcgccctggtgggccacccacaccctggattggctcaaattcggtaaaaaggtgctggtggtgcactttgaggatctcaagcaggacctctttgtgcagttgggcaggatggtgtctctgctgggtgtcgccgtgcgtgaggatcgactcctgtgcgtggagagccagaaggatggaaattttaagcgatcaggattgaggaaactggaatacgatccctacactgccgatatgcagaaaactatatccgcatacatcaagatggtggatgcagctctcaagggccgcaatcttaccggcgtacctgacgactattaccctcggtag

SEQ ID NO: 31973 - DNA, 5532 bp, Artificial Sequence
  Description of Artificial Sequence: Synthetic coding sequence
atggccgatactcagacgcaagtggcacctacccccacaatgcggatggcaacagctgaggatctcccgctaccccccccgcctgcacttgaagatcttcctttgcctcctcccaaggagtcattcagcaagtttcaccagcagaggcaggcctctgaactccgaagactgtaccgacacatccaccccgagctgcgtaaaaacttagcagaagcggtagctgaggacctggccgaggtcctgggctccgaagagccaacagagggcgacgttcagtgcatgcggtggatcttcgaaaactggcgcctggacgcaatcggcgaacacgagagaccagccgctaaggagcctgttctgtgcggagacgtccaggccactagtagaaaatttgaggaaggatctttcgctaattccaccgatcaggaaccaactagaccccaacctggaggcggcgatgtgagagccgccagatggcttttcgaaaccaagcctctggacgagctgaccgggcaggccaaagagctcgaggcgactgtgcgcgaacccgccgcctctggggacgtccagggcacacgcatgcttttcgagacacgccccctcgaccggcttggttcacggccctcactgcaagaacagtcccctctggagttacggtcggaaattcaggaactcaagggagatgtcaaaaagacagtaaagctgttccagacagagcccctgtgcgccatccaggatgccgagggagccatccacgaggtgaaggcagcgtgcagagaggagattcagagtaacgcagtgaggagcgcccgatggctcttcgaaactaggccattggatgcaatcaaccaagacccaagtcaagtcagagtcatcagagggatctccctggaggaaggagcgagacctgatgtatccgccacccgctggatctttgagacacagccgctggatgcgatcagggagatattggtggacgaaaaggacttccagcctagcccagatttgatacctcccggtcctgacgttcagcagcagcaacatctgttcgagacaagagcgcttgacaccctgaaaggtgatgaggaggccggagcggaggcccctcccaaggaggaggttgtacctggggatgtccgcagtacgctttggctattcgaaacaaagccactggatgcattccgtgacaaagtgcaggtggggcacttgcagagggtagacccacaggacggggaggggcatcttagttccgactctagcagcgccctgcctttttcccaatctgccccacaacgcgacgagctcaaaggagatgtaaaaactttcaagaacctctttgagacactaccattggatagcatcggccagggtgaagtcctcgcccacggatcccctagcagggaagagggcaccgattccgccggacaggctcagggaattgggtccccagtctatgccatgcaggattcgaaaggaaggttgcatgcccttacttcagtatcccgcgaacagatagtcgggggggacgtccaggggtataggtggatgttcgagactcagcctctcgaccagctaggccgctctccaagcacgatcgacgtcgtacgcggtatcactcgccaagaggttgtggccggggacgtcggcaccgcccgatggctgttcgaaacacagccgttagaaatgatccatcaaagagagcagcaggaacggcagaaggaggaaggtaagtcacagggggatcctcagcccgaagctcctcccaagggggatgtgcagacaattagatggctgttcgagacttgtccaatgtctgaactggctgaaaaacagggctccgaagtgactgatcctaccgccaaggctgaggcgcagtcgtgcacctggatgtttaagccacagccggtcgatcgccccgttggatcgagagagcagcatttacaggtgtcacaggtccccgcaggggaaaggcagaccgataggcatgtcttcgagacagagcccctgcaagccagcgggaggccatgcggccgaagacccgtaagatactgcagtagggtcgagatcccatcaggccaagttagtcgacaaaaagaggtctttcaggccctggaggctggaaagaaggaagagcaggaacctcgcgtgattgccggatcaattcccgcaggatccgtgcataagttcacttggctgtttgaaaattgtccaatgggcagcctggcggccgaatcgatacaggggggtaacctacttgaggagcaaccgatgtcccctagtggcaacaggatgcaagaatctcaagagacagctgctgaaggcacccttaggacattgcatgctaccccagggatcttgcaccacggcggaatcttgatggaagcacgggggccaggcgagctgtgcctcgctaagtacgttttgtccggaacaggtcagggccacccttatatacgtaaggaggagctcgtatcaggagagctgccgagaatcatttgccaggtcttacgacggcccgatgtcgaccaacagggactgctcgttcaggaggacccaaccggacagctgcagctcaaacccctgcgcctgcctacacccggctccagcgggaatatcgaagatatggaccccgagcttcaacaactcctggcttgcgggctggggacgtccgtcgcaaggaccggcttggtgatgcaggagacagagcagggcctcgtggccctcacagcttacagtctacagccacggctgaccagcaaggcgagcgagaggtccagtgtgcagctgctggcctcttgtatcgataagggggacctctccgggctccattccctgcggtgggagcctccggctgaccccagcccggtacctgcctccgagggcgctcaatcactgcaccccaccgagtcaatcattcacgtgcctccactggatccctcaatgggcatgggtcacctaagggcatccggcgccaccccgtgtccaccacaagccattggaaaggctgttcctctggccggggaggccgccgcgcctgcgcagctgcagaacaccgaaaagcaagaagattcacactcaggtcaaaaaggcatggctgtcctgggaaagtccgagggtgcaacaacaacaccgccaggccctggcgcccctgacctgcttgcagccatgcaaagtctcagaatggctactgctgaagctcagtctctgcaccagcaggtcctcaacaagcataagcaggggcctactccaactgccactagtaacccgattcaggatggactacgtaaagctggcgctacccaatctaatattaggcccggaggtggcagtgatccaagaattcctgccgctcctcgaaaggtgtctagagaggagcaggctctgcctcgcggcctgcctgggggttgggtaaccattcaggacggaatttataccgctcatccggttcgtacgtttgaccccccaggaggcgtccagctgtcacagcgcgagcctcaatctcgacacagagaaactgccctgagcgtccaagcaccgaggccgttacaggggggtcccgggcagtccactggcccggggcgcgaagaacctggtggttgcacacagatggcctggggaccacctggtaaggctatggcagaggtttgtccagggggcttacaggcagccgaaactacattaaaaacagccccactgggaaggcacatcctggcctccggcccccaggccgctggcgccagtccacacccacataatgcattcgtgccgccaccccctaccctccccgccgctgtgacgggacctgacttcccagccggagctcatcgggccgaggattccatacagcaggcctcagagcctctgaaagatcctttgctgcactcacattcctcccccgcaggtcaaaggaccccaggtggatctcagaccaaaacaccaaaactcgatcccactatgccaccaaagaaaaagccccagctgccacctaaacctgcccatctgacacagtctcatccgcctcagcgactacctaaacctctgccgctgagcccatccttctcatctgaggtcggacagagagaacaccagcgaggcgagagggacactgccattccccagcctgccaaagttccaacgacggtggatcaagggcatattccactggcacgctgccccagcggtcacagtcagccctctttgcaacatggattgagtaccacagccccgaggccaaccaaaaatcaagcgactggttcaaacgcacagagctccgagccaccaaaactaaacgcactgaatcacgacccaaccagtccacaatggggacctggcccctccggcgagcaacctatggagggatcccatcaaggagctcccgaatccccagattcccttcaaagaaatcagaaggaactgcaaggactacttaatcaggtccaggctctggagaaggaagcagcctctagtgtcgatgtacaggcattgcggcgactgttcgaggctgtaccacagctgggcggcgcggccccacaggccccagcagcacaccagaagcctgaagccagtgttgaacaagcttttggtgagctgaccagggtctcaactgaagtcgcacagctcaaggagcaaaccctggccagactgctggatatagaagaagcagtccacaaagccctctccagtatgtcatcattacaacctgaagcttccgccagaggacatttccaaggcccccccaaggatcacagtgctcacaaaatttctgttactgtatcctcaagcgccaggccctccggttctggccaggaggttgggggccaaacagcagtcaagaatcaggccaaggtcgagtgtcacacagaagctcagagtcaggtcaagattcgtaatcacaccgaggctcgtgggcacaccgcctcaacagcccctagcaccaggcggcaggagacctcacgtgaatacctgtgcccacctcgcgtcctgccgagttcccgcgactcccctagctctccaaccttcatttccattcagtccgcgacacggaagccactcgagaccccgtcttttaaaggtaacccagacgtttccgtgaaatctacgcagctcgctcaggatatcggtcaggctctgctgcatcagaaaggagttcaggacaaaaccggcaaaaaggacatcacacagtgctctgtgcagccagagccagctccgccctccgccagcccactgcccagaggttggcaaaagagcgtgctcgaactgcagacaggaccaggcagctctcagcactatggagctatgaggacggtgactgagcaatatgaggaagtcgatcagttcggtaacactgtgttgatgagctctaccactgttactgaacaggcggaacctcccaggaatcccggttcacacctgggtctgcatgctagccctctgctgagacaattcctgcactcccccgccgggttctccagcgacctgacagaagcggaaacagtgcaagtatcctgtagctacagtcagcccgccgcccagtag

SEQ ID NO: 31974 - DNA, 3366 bp, Artificial Sequence
  Description of Artificial Sequence: Synthetic coding sequence
atggcagacacccagacccaggtcgcccctactccaacgatgcgcatggctaccgcagaagacctccctctcccgccacccccggcactagaagacttacctcttcctccacctaaagagagcttctccaagttccaccagcagaggcaggccagcgagttacgcaggctgtatcggcacatccaccccgagttacgcaagaatctggctgaggcggtcgccgaagatcttgccgaagtgttgggttccgaagagcccactgaaggtgatgttcagtgtatgaggtggatattcgaaaactggaggctggacgcaattggagagcacgaaaggcctgccgctaaggagccggtgctctgtggagacgttcaagccacatcacgtaagtttgaagagggctcctttgccaactctacggaccaggagcctacgaggccacagcccggggggggtgatgtcagggcagcccggtggttgtttgaaaccaagccccttgatgaactgaccggccaagcaaaggaactagaggcgacggtgagggagcccgctgccagtggggacgtacaggggacacgtatgttgttcgaaacccgccctctggaccgcttggggtctcgtccctctcttcaggagcagagcccattggagttacggagcgaaattcaagaactcaaaggggacgtgaaaaaaaccgtcaagctcttccagaccgagccactctgtgcaatacaggatgcggaaggggccatccacgaggtgaaggccgcatgccgggaggagatccaaagtaatgccgttaggtcagcccgctggctgtttgaaacgagacccctagacgccatcaaccaggacccatcccaggtgagagtgattcggggcatttccctcgaggaaggtgcacgccctgacgtgtccgcaacccgatggatcttcgagacccaacccctggatgccattagagagattctggtagacgagaaagatttccagccctctcctgatctgattccccccgggcctgatgtgcaacaacagcagcacctattcgaaacccgggcactggacaccctgaagggtgatgaggaggctggggccgaagctcccccgaaagaagaagtagtgcccggggatgtcagatccaccctctggctatttgagactaagccccttgacgcctttcgagacaaggtgcaagtcggtcatttacagcgcgtagatccacaagacggggagggccacctgtccagtgactccagctcggcgttgccgttctcccagtcagccccacagcgggatgagctcaagggcgatgtcaagactttcaagaacctctttgaaaccttgcccctagatagcataggacagggtgaggtgctggctcacggtagcccctctagggaggagggcactgactcagccgggcaggcgcagggcataggctctcctgtatacgctatgcaggactcaaagggacgcttacatgctttaacttcagtaagccgcgaacagatcgttgggggcgacgtgcaggggtacaggtggatgttcgaaacccagcctttagatcagctgggtagatctcccagcacaatcgacgtggtgaggggaatcacaaggcaggaggtggtagccggcgatgttggcaccgccaggtggctattcgagacccaacctctggaaatgattcaccagagggagcagcaggaacgacagaaggaggagggaaaaagtcagggagaccctcagccggaagctcccccaaaaggcgatgttcagactatcagatggctgtttgagacctgccctatgagcgagcttgctgagaaacaggggagtgaagttaccgatccgacagctaaagccgaggcccagtcttgtacctggatgtttaagcctcagcctgtggacaggcctgttggatctcgggaacagcacctccaagtatcacaggtcccagcaggagaaagacaaacagatcgacacgtgttcgagacagaaccgttgcaggccagtggcagaccctgtggaaggaggccagttaggtactgcagccgggttgagataccttccggacaggtgagtagacagaaagaggtatttcaagcactcgaagctgggaagaaggaagagcaggagcctagagtcatcgcagggtctattcccgccggcagtgttcataagttcacatggctattcgagaattgccctatgggaagcctggccgccgaaagcatccaggggggcaaccttctcgaggagcagccaatgagtcctagcggcaatcgtatgcaggagagccaggaaactgcagcagaagggacattaaggaccctgcatgcgacacccggaattctgcaccatggtggcatcttgatggaggctcgagggcctggagagctgtgcttggccaagtacgtcctgtcaggaactggccaagggcacccctacattcgcaaggaggaacttgtctcgggagagctgcctcgcatcatctgtcaagtgctgcggcgcccggatgtcgaccagcaaggcctactcgttcaggaggatcctactggtcagcttcagctgaagcccttgcgactgcctacacccggaagttcggggaacatcgaagatatggaccctgaactgcagcaactgctggcctgcggactgggaacaagcgtggcccgaaccggcctggtgatgcaagaaacagaacagggactagtggcattaaccgcctactctctgcagcctcgcctgacatctaaggcttctgagcgctcatctgtgcagctgcttgccagttgcatcgataaaggtgatctgagcggccttcattcgctgagatgggaaccgcccgcggacccctctccagtacctgcctcagagggggctcagtcactgcatcccactgagagcattatccatgttccgcctctagacccttccatgggtatgggacatcttagggcatcaggcgcaacaccttgtccacctcaggccatcgggaaggctgtgcccctggctggggaggcagccgcgcccgcccaactgcagaacaccgaaaaacaggaggactcccactctggccaaaagggtatggcagtgctcggaaagagcgagggtgcaacgactaccccacctggaccaggcgcaccagatctgctggcagcaatgcaaagcctaaggatggctacagcagaagctcaatcgcttcaccagcaggttctaaataagcataaacagggcccaaccccaactgccaccagcaatcccatccaggacggcctcaggaaggctggggctacacagtctaacatccgcccaggcggcgggagtgatccaaggatcccggctgccccgaggaaattgttatag

SEQ ID NO: 31975 - DNA, 1581 bp, Artificial Sequence
  Description of Artificial Sequence: Synthetic coding sequence
atgccacccaaaaagaagcctcagttaccacctaagccagcccacctgacccagtcccaccctccccagaggctgccaaagcctctgccactctccccctctttcagctcagaagtgggccagcgagagcaccagagaggcgagagagataccgcaatcccacagcccgccaaggtacctactactgtagatcagggtcatattcctctcgcccggtgcccttccgggcacagccagccctctttgcagcacggcctgagcacaaccgcccctcggcctacgaagaaccaggcaaccggaagcaatgcgcaatcaagtgagcctcctaagctgaatgcgctgaaccatgacccaacctcgcctcaatggggacccggcccatcaggagagcagccgatggaaggaagccatcagggggcccccgagagccctgacagccttcagcgaaaccagaaagagctgcagggactgttgaatcaagtgcaggcccttgagaaagaggctgccagttcggtggacgtgcaggctctcagaagactcttcgaggccgtcccacaactgggcggagccgcccctcaggctcctgccgcacaccaaaagcctgaagcctccgtcgaacaggcgttcggggagcttacccgcgtatctactgaggtggctcagttaaaagaacagacactggctaggctgctggatatcgaggaggccgttcataaagccttgtcttcaatgagcagcttacaacccgaagcaagcgctaggggccattttcaaggacccccaaaagaccactcagcccataagatttccgtgacagtgtcttcctccgcacggccatccgggtccgggcaggaagtgggcggacagacagcagttaaaaatcaggcgaaagtggagtgccacaccgaggcccagagtcaggtcaaaatacgtaatcatacagaggcccgtggacacacagcaagtactgccccttcaacccgacggcaggagacgtcacgggaatatctctgtccccctagagtgctgcccagcagccgggatagcccatcgagccctacttttatttcgattcagagtgccacgcggaagcctctggagacccctagttttaagggcaatcccgacgtgagtgttaagagtactcagctcgctcaggacatcggacaagctctgctgcaccagaaaggggtgcaggacaaaaccgggaagaaagacatcactcagtgttccgtccagcccgagcccgccccgcctagcgctagtccccttccaagaggttggcagaagtctgttctcgagttacaaaccggaccagggtcgtctcagcattatggggcaatgcggacagtcacggaacagtatgaggaggtcgaccaattcggtaataccgtgcttatgagcagcaccacagtcacggagcaggccgagccccccagaaatcccgggtcacacctggggcttcacgcctccccccttcttagacagttcttacattccccagctggattctcctccgatctaacggaagcagaaacagtccaggtatcatgctcttactctcagcccgccgcccaatag

SEQ ID NO: 31976 - DNA, 1953 bp, Artificial Sequence
  Description of Artificial Sequence: Synthetic coding sequence
atggctgccaagtctgacggacgtctgaagatgaagaagtctagcgacgtggcctttacacctctgcagaatagcgaccattcaggtagtgtgcagggcctggctcccggtcttccttcaggaagcggtgcagaggacgaggaggcagctgggggcggttgttgtccagacgggggaggatgttcccggtgctgctgttgctgtgctggctccggcgggagcgctggatccggtgggtcaggtggcgtcgcagggcccgggggaggaggcgccggctctgccgctttgtgcctgcggctaggccgcgaacagcgacgctacagcctctgggattgtctctggatcctcgcggcagtggcagtatattttgcggacgtcggcacagatgtgtggctcgctgtagactactatctgcggggtcaacggtggtggttcgggttgacactgttcttcgtcgtgctggggtcgctgtctgtgcaagtgttcagcttccgttggtttgtccacgatttctcgactgaggattccgctaccgccgcggcagcatctagctgtcctcagcccggcgcagactgcaaaaccgtcgtgggaggtggctccgctgcaggggagggcgaagccagacctagcacccctcagagacaggccagcaacgcctcaaagtccaacatcgcggccgctaattcaggcagtaattcgtcgggagcgactagagcttcaggtaagcatcggtcagccagttgttctttctgtatatggttgctgcagagcctgatccacattctgcagttgggtcagatctggagatactttcatactatctatttaggaatccgctcccggcaatctggagagaatgataggtggcgcttctattggaagatggtatatgaatacgctgatgtcagcatgctgcatctacttgcgaccttcttggaatccgcaccacagctggtattgcagctgtgtattatcgttcagacccattcgctgcaggcactgcaggggtttactgctgcggcctcccttgtgtctcttgcttgggcactcgcctcctaccagaaggccttaagagatagccgagacgacaaaaagccgatctcttatatggctgtgatcattcagttctgttggcatttcttcactatcgctgctcgggtgatcaccttcgcattgtttgcttccgtctttcagctttacttcggaatattcatcgtgctccactggtgcattatgacattttggatcgtacattgcgagaccgagttttgtatcaccaagtgggaagaaatcgtgtttgatatggtggttggcatcatatatatcttctcatggtttaatgtgaaagagggacggacccggtgtagacttttcatttactatttcgttatactcctggaaaatacagctctaagtgcactttggtacctttataaggcaccccagatcgccgacgcattcgcaatcccagccttgtgtgtcgtattctctagctttctgactggggttgtttttatgctgatgtactacgctttctttcacccaaacggacctcgtttcggccagtcccccagctgcgcttgtgaagatcctgccgccgctttcactctcccccctgatgtggccacatcaacccttcggtctattagcaacaacagaagcgtggtgtcagaccgggaccagaagttcgccgaacgcgacggctgtgtgcctgtctttcaagtccgacctactgccccctctacccccagttcaaggcccccccgcatcgaggagtccgtgatcaaaatcgatctgttcaggaaccgataccctgcatgggaacgccatgtcttagatcggagtctgcgcaaagctatactcgcgttcgagtgtagcccttcccctccgagactccagtataaagatgatgcgctgattcaggaaagactggaatatgagaccactctgtag

SEQ ID NO: 31977 - DNA, 1953 bp, Artificial Sequence
  Description of Artificial Sequence: Synthetic coding sequence
atggcggccaaatcggatggaaggctcaaaatgaaaaaatcctcagacgttgctttcacccccctacaaaactccgatcactccggtagcgtgcaggggctggcacctggcttaccctccggttccggcgcagaggacgaagaagccgctggcggagggtgctgccctgatggcggcggttgctcacgttgctgttgttgttgtgctggatcagggggtagcgcaggttcaggcggatccggtggtgtcgccgggcctgggggcgggggagccgggagcgcagccctctgcctcagacttggccgagaacagcgccggtatagtctctgggactgcctatggatcctggccgctgtcgccgtttacttcgctgacgtgggcactgatgtgtggctcgctgtagattactatctccgaggccagcgatggtggtttggcctcacgttgttttttgtggtgctcgggagcctctcagtccaggtgttttccttcagatggttcgtgcatgatttctctacagaagactccgctactgcagcagctgcctcgagctgtccacagccaggagcagactgtaagaccgtggtcggggggggctccgccgcaggggaaggtgaagctcgaccgtctactccacaacgtcaggcaagcaacgcatctaagtccaacatcgcagcggccaactccgggagcaatagttctggggcaactcgagcgtcagggaaacaccggtctgctagttgttctttttgtatatggcttttgcagagcttgatccacatcctgcagttaggtcagatttggagatactttcatactatttacctgggaattaggtcccgacagagcggcgagaacgacaggtggagattttattggaagatggtgtacgagtacgctgacgtctctatgctccacctccttgcaacttttctcgagtcagctccacagctggttttgcagttgtgcatcatagtccagacccacagcctccaggccctgcagggctttactgctgctgccagcctagtatctctagcttgggctcttgcttcatatcagaaggctctgagagattctagagatgataaaaagcccattagttatatggcggtaattatacaattttgttggcacttcttcaccattgctgcaagggtgataactttcgcgcttttcgcatccgtcttccaactgtacttcgggatctttatcgttctccactggtgcattatgactttttggattgtgcactgtgaaacagagttctgcatcacgaaatgggaggagatcgtgtttgatatggtggtgggaatcatttacatctttagctggtttaatgttaaggaaggcagaacccgatgccgactcttcatctactactttgtgatcctacttgaaaataccgctcttagtgcactctggtatctgtataaagcccctcagattgctgatgcttttgccatccctgctctctgtgtggtcttctcatcgtttctgacaggtgtggtattcatgctgatgtattatgcattcttccatccaaatggtccgcgcttcgggcagtctccgtcctgtgcttgcgaggaccccgctgctgcatttactctgccccccgatgtggcgacgagcacgctccggtctattagcaacaacagatccgtagtgtccgacagggaccagaaattcgctgaacgcgacggctgcgtcccagtttttcaagtgcgacctaccgccccttcaaccccttctagccggcctccacgaatcgaggagtccgtgattaaaatcgacttgtttagaaaccggtacccagcatgggaaagacatgtattggatcgatccctgcgcaaggctatattagcgtttgaatgtagcccctccccaccgcggcttcagtataaggacgacgcactcattcaagaaaggctggagtatgaaacaactctatag

SEQ ID NO: 31978 - DNA, 1089 bp, Artificial Sequence
  Description of Artificial Sequence: Synthetic coding sequence
atgatgtacgagtacgctgacgtgaatatgctgcgcctgctggagaccttcctagagagcgctccacagttggtgctccaactatacatcatgttacagaagaactccgcagaaacactgccttgcgtgagtagcgtaacatccctgatgtcccttgcgtgggtcctggcatcctaccacaagctgctacgagacagccgagatgataagaagtccatgtcatacagaggagccattatccaggttttttggagactttttacaatctcaagcagggtgatcagcttcgcgctgtttgcctcgatctttcaactgtattttgggatcttcgtggtggttcactggtgcgctatggccttctggattatccatggggggaccgacttctgtatgagcaagtgggaggagattttgttcaatatggtggtcggcattgtgtatattttttgttggttcaacgtcaaagaggggaggacacgctaccggatgttcgcctactacaccatcgttctcacagaaaatgccgccctaacatttctctggtatttttacagagaccccgagaccacagatagttatgccgtgccggccctgtgttgcgtcttcatcagcttcgtggccggaatcgccatgatgctgctttattatggcgtcttacatccaaccggaccccgggctaagatcctggctagtagttgctgtgccgagcttctgtggggaattccgttgccacccgatgtcgaaccaatggcgcccgaaattcccggttaccgaggaacccaggttacgcctacgagagccgttaccgaacaacaggaggacctgacggcggatacatgcctgccggtattccaggttcgaccaatgggtcctcctacacccctggggcgtccatacttacccgagggcccgctgataaaaatcgacatgccacgaaagcgctaccccgcatgggatgctcactttgtcgacagacggctacgtcgaactataaatatactccagtacgtgactccaaccgctgtgggaatacgctaccgcgatggacctttgctgtacgagctactgcaatatgagagcagcctgtag

SEQ ID NO: 31979 - DNA, 1926 bp, Artificial Sequence
  Description of Artificial Sequence: Synthetic coding sequence
atggccgctaaatctgacggcggtggagtgggagtgggatttgctcaactgcacaatctagacgaagccgtggggtccggcggcgaggaggatggtgagcccgggggaggagggtgtggtgggggcggtgacggatcagagcctggagagtcatcctccatgcacatctgtcactgctgcaataccagctcgtgctattgggggtgccggtccgcatgcctccgctccctgctcggtagaaagccacgtcggagcgccgctgcagatggcggggaccaacccttgcagcccccagccgcccccggagccggccgacagccccccacaccttcagccgcgaggcccgagccaccccccccacaggttgagcgcccctggctcgactgtctttggatcgtgcttgctctgcttgtgttttttggagacgttggcacagatctctggttggcactcgactactataggaagggtgattatgtgtactttgggctgaccctctttttcgtcctggttccaagccttctagtccaatctctgtcatttagatggttcgtgcaggactacaccggtggaggtctgggagcggtggaagggctaacatctcgggggccccctatgatgggcgccgggtatgtccacggggcagcccgcggtggccctggtgtcagggtgagtcccacgcctggcgcccaaagactctgtcgtctttcagtgtggatctggcagtccgtgattcacctgctgcagatggggcaggtgtggaggtacatccgtacgatgtatttgggcatccagtctcagcgacgaaaagaacatcagcggcggttttactgggcaatgatgtatgagtacgccgacgtgaacatgcttcgcctgctggagacttttctggaatccgcgccacaactcgtcctccagctgtatatcatgttgcagaaaaatagtgcagaaacactcccctgcgtttcctctgtaaccagtctcatgagtctagcttgggtgcttgcctcctatcacaaactccttagggattccagagacgataaaaagtctatgtcttacaggggcgcgataatacaggtcttctggcgcttgtttaccatatcgagcagggttatctcattcgcgctgttcgcgtcaatttttcagctgtatttcggaattttcgtggtcgtgcactggtgcgcaatggctttctggattatccatggcgggaccgatttctgcatgtccaagtgggaggaaattctatttaatatggtcgtgggcattgtctacatcttttgctggttcaacgttaaggaaggaaggactcgctataggatgttcgcctactatacaatcgtcctgacagaaaatgcggccctgactttcctgtggtacttctacagggacccagagacgacggactcttatgctgtgcctgctttatgttgcgtatttatctcctttgtcgcagggattgccatgatgttactgtattacggcgtgttgcacccaacggggccaagagctaaaatactggcaagttcttgttgcgctgaattgttgtggggaattcccctcccaccggacgtggagcctatggcccccgaaattcccggctataggggcacacaggtcacgccaacaagagcagtcactgaacagcaggaagacctgactgctgatacatgcctgcccgtctttcaggtgagacccatgggaccacctactcctctgggccgcccatacctcccagaggggcctctgatcaaaatcgacatgccacgaaaaaggtatccagcgtgggatgcccatttcgttgataggagactcagaagaaccatcaatatcctgcaatacgttaccccaactgccgtggggattcggtatcgggacggtcccttgctgtacgaattgctacaatacgaatcttctctttag

SEQ ID NO: 31980 - DNA, 2034 bp, Artificial Sequence
  Description of Artificial Sequence: Synthetic coding sequence
atgctgtcaagcaccgactttacctttgcgagctgggagctggttgtgagagtcgaccatcctaacgaagaacagcagaaggacgtgacccttcgcgttagcggggacctacacgtgggaggggtcatgctaaagttggtagagcagattaacatctcccaggattggtcagatttcgctctctggtgggagcagaagcattgttggcttctcaagacacactggacactagataaatacggcgtccaggccgatgcaaagcttctgtttacgccacagcataagatgcttagactgcgactgcccaatcttaagatggtgagacttagagtcagtttttctgcagtcgtcttcaaggctgtgtccgatatctgcaagatactcaacattcgaaggtcggaggagctatccttactgaagccttctggggactattttaagaaaaagaagaagaaggataagaacaacaaagaacctattatcgaggacattctcaatctggagtcatcacctacggccagcgggagctccgtgtctccaggactttactcgaagaccatgacgcccatttacgatcctattaacggaacccctgcgagcagcaccatgacctggtttagtgactcccccctgactgagcaaaactgttctatcctggcattcagtcagccaccacagtctccggaggcccttgctgatatgtatcagcccaggtccctcgtcgataaagcaaagctgaacgcaggctggctggactcttctcgctccctgatggaacaggggatccaggaggatgagcagctcctgctgagattcaaatactattctttctttgacctgaaccccaagtacgatgcggtccgtatcaaccaactgtacgaacaggctcgctgggcgattctgctcgaggaaatcgactgcacagaagaagagatgctgatttttgcagccctgcagtatcacatttcaaagcttagcctgagcgccgagacccaggatttcgccggggagtccgaggtcgatgagatcgaagctgctctaagcaatctggaggtgacactcgaggggggcaaagcggacagtctgctcgaggatatcacggatatcccaaaattagcagataacttgaagctgtttcgccctaagaagcttctgcccaaggcctttaaacagtactggttcatctttaaggacactagcatcgcctatttcaaaaataaagagctggagcagggggagccactggaaaagctgaaccttcgaggatgtgaagtggtacccgacgtgaatgtcgccggacggaagtttgggataaagttgctgattccagtggctgatggcatgaatgagatgtacctgagatgcgatcacgaaaaccaatatgcacaatggatggccgcctgtatgcttgcttctaaggggaaaacaatggcagactctagctaccaaccggaggtgctgaacatccttagcttcctccgtatgaagaacagaaatagcgcctctcaggtggctagcagcctggaaaacatggatatgaatcctgagtgtttcgtgtctcctagatgtgccaaacggcacaagagcaaacagttagcagccagaattcttgaagcccaccaaaatgtggcccagatgcctctcgtggaagctaaactgcggttcatccaagcatggcagtctttgccggaattcggactgacctattaccttgtgagatttaaagggagtaaaaaagacgacatccttggcgtgtcttacaataggttgataaaaatcgacgccgccacaggaattcctgtaactacttggcggtttaccaacattaagcagtggaacgtcaattgggagaccagacaggtcgtgattgagttcgaccagaatgtcttcactgcatttacctgtctctcggctgattgcaaaatcgtccacgaatatatcggaggttatatttttctgtctactcgctctaaggaccagaatgagaccctcgatgaggacttatttcacaagctcaccggcggacaggattag

SEQ ID NO: 31981 - DNA, 1188 bp, Artificial Sequence
  Description of Artificial Sequence: Synthetic coding sequence
atgccttggtcatctaggggagctctgctccgggatctcgtgctcggggtcctcggcacagcggcgttcctgctcgacctgggtactgacctgtgggcggctgtacagtatgctctcggtggcagatacctgtgggcagcactcgtgcttgctctcctgggcctcgcttcagtggccttacagctgttctcttggctgtggctgcgagcagaccccgcaggacttcacggctctcagccaccacgaagatgcctggctttgctccacctgttgcagctggggtacctgtaccgctgtgttcaggaattgcggcaaggcctactcgtttggcagcaggaagagccaagcgaattcgacctggcttatgccgactttttggccctcgatatctctatgctgcgactgtttgagacctttttggaaacagccccgcagctgaccctcgtcctggccatcatgctccagagcggccgcgccgagtactaccagtgggtcggcatttgcacaagtttccttggtatatcatgggcgctcttggactaccatagagccctgcggacttgtttgccatcaaagccattgttggggctgggcagctccgtgatctattttctgtggaatctccttctgctgtggccaagagttctggcggtcgctttgttcagtgccctctttccttcttacgttgccctccacttcctggggctgtggctggtgctgctgctgtgggtgtggttacaaggaacggacttcatgcccgaccctagttctgagtggctttacagggtgaccgtggctacgatcttatacttcagttggttcaacgtcgccgaaggcagaactcgtgggagggccattatccatttcgctttcctactctccgattcaatcctgttggtggctacgtgggtgactcattcctcttggcttccttctgggatacctttgcagctgtggttgcccgtgggctgcggctgcttcttcctgggcctcgcgctcaggctggtttactaccactggctccaccctagctgctgctggaaaccagatcctgaccaggtagacggcgcccggtcactgctcagtcccgaaggctatcagttgccacaaaatcggagaatgacacatctcgcccaaaaattctttccgaaggccaaggacgaggcagcaagccccgtcaagggctag

SEQ ID NO: 31982 - DNA, 1122 bp, Artificial Sequence
  Description of Artificial Sequence: Synthetic coding sequence
atgaagtatacaaaacagaactttatgatgagtgtgctgggcattattatctacgtgaccgacctcatagtcgacatttgggtctccgttcgattctttcacgaaggtcagtatgtgttttcagccctggccctcagtttcatgcttttcggcacccttgtcgctcaatgcttttcgtattcatggttcaaggccgatctcaagaaagctggccaggagagtcagcactgcttcctcctcttacactgcctccaaggcggcgtttttacacgttactggttcgctttaaagaggggctatcatgcagccttcaagtacgatagcaacacttccaactttgttgaggagcagatcgacctgcacaaggaggtgattgaccgcgtgacagatctctcaatgctccgcctcttcgaaacatatttggaagggtgtccacagctgattctgcagctgtatattctgctggaacacggacaggcgaacttttctcagtatgcggccattatggtgtcttgttgcgcgatctcatggtctacagttgactaccaggtggccctgcgaaagtccctacccgataagaaacttctgaacggtctctgccctaaaattacctatctgttttacaaacttttcacactgttatcttggatgctgagtgtggtgttacttctctttcttaatgtgaagatagcgctgttcctcctcctgtttctgtggctgctggggattatatgggccttcaagaataacactcaattttgtacctgcatatctatggagtttctgtatcgaatcgtcgtcggcttcattttgatcttcacctttttcaacattaagggacaaaatacaaaatgtccaatgtcatgctactatattgtccgggtactgggcacgctcggcattttaacagtgttctgggtttgtcctctgaccatattcaacccggactacttcattccaatttctattaccatcgtgttgacattattgctgggcatcctttttcttattgtgtactatggaagttttcatcctaatcgaagtgccgagactaagtgcgacgagatcgacggcaaacccgtacttagagaatgccggatgaggtattttctgatggagtag

SEQ ID NO: 31983 - DNA, 1122 bp, Artificial Sequence
  Description of Artificial Sequence: Synthetic coding sequence
atgaagtatacaaagcagaattttatgatgtcagtgcttggcatcatcatctatgtgaccgacctgattgtagatatctgggtgtcggtgcggttctttcatgagggacagtacgtgttttccgccctggccttgagctttatgctgttcggcactctggtagcccagtgtttcagctacagttggtttaaggcagatctgaagaaagcagggcaggagtctcagcactgttttttactgctgcactgcctgcagggaggcgtgttcacaaggtactggtttgctctcaaacgtggctaccacgctgcctttaaatatgattcaaacacttcaaactttgtggaagagcagatcgacttacataaggaagtgatagatagagttactgacttgagcatgctccgcttattcgagacgtacctggagggttgcccccaactgatcctgcagctctatattctccttgagcacgggcaggctaacttctcgcagtacgccgccatcatggtatcatgttgcgcgatctcttggtccaccgtggattatcaggtcgcactgaggaaatctttgcccgacaagaaattgctaaacgggctgtgccccaaaatcacatatctgttttacaagctgtttacgctgctaagctggatgctgtccgtcgtactgctcctgtttctgaatgtgaagattgcacttttcttgctgctgtttctctggctgctgggaatcatctgggcctttaagaataatacgcaattctgcacctgcatatccatggagttcctgtatagaattgtggtcgggtttattctgatcttcactttctttaacatcaagggtcagaacaccaagtgtccaatgtcttgttattacatcgtgagagttctgggcaccctcggaatcttgaccgtgttctgggtctgccccctgaccattttcaatccagactacttcattccgatttctattaccattgtgctgaccctgctactgggaatcctgttcctgattgtgtactacggttcttttcaccccaaccgctctgcagaaactaaatgtgacgaaatagacggcaaaccagtgctgagagaatgccggatgagatacttcttgatggaatag

SEQ ID NO: 31984 - DNA, 1182 bp, Artificial Sequence
  Description of Artificial Sequence: Synthetic coding sequence
atgggtctcctcagggggggtctgccatgtgcccgagcaatggctcgtctgggcgccgtgcgctctcattattgcgctctgctcttagcagctgccctggctgtttgcgctttctactacctaggtagtggccgggaaacattctcgtccgctacaaagagactgaaggaagctcgcgcgggagcgcctgctgcaccatccccacctgcactcgaactggctcggggctcagtggccccggcccccggtgcaaaggctaagtccctggagggcggcggggcagggcccgtggattaccacctcctcatgatgttcaccaaagccgaacacaacgctgcactgcaagccaaagcccgcgtggccttacgaagcttgctcaggctggctaaattcgaggcgcatgaggtcctcaacttgcacttcgtgtctgaggaggctagtcgcgaagtagctaaaggcctgcttagggagctcttgccaccagctgctgggtttaaatgcaaagtgatttttcacgacgtggccgttctcacggacaagttgtttccgatcgtggaagcaatgcagaagcatttctccgctggcctcggaacgtactactccgattcaatcttcttcttaagcgttgccatgcaccagattatgccaaaggaaattctccagattattcaactggacctcgatcttaaatttaagacgaacatcagagagctgtttgaggaatttgattcctttctcccaggagcgatcataggcatagcccgcgagatgcagccagtttaccgccacaccttttggcaattccgccacgagaacccccagacccgcgttggcggccctcctccagaggggttgcctggctttaattctggagtgatgcttcttaatctggaggccatgcgtcagtctccgctttattcccgcttgttagagccagcgcaagtgcagcagctggccgacaagtatcacttccgcggacacctgggagatcaagatttctttaccatgatcggtatggaacatccaaagctgtttcacgtcctcgactgtacctggaatagacagctgtgtacgtggtggcgtgaccacgggtactccgatgttttcgaagcctactttaggtgcgagggccatgtcaagatctatcatggcaactgtaacacacctataccagaggactag

SEQ ID NO: 31985 - DNA, 573 bp, Artificial Sequence
  Description of Artificial Sequence: Synthetic coding sequence
atgtggccccctcgttgcaaagaccccgggcggcagtccgctgaaatcctgcagattatccagctggacctcgaccttaagttcaagaccaacatcagggagctttttgaggaattcgattcgtttttacccggcgccatcatcggtatcgctagagaaatgcagcctgtatatcgccacaccttctggcagttccggcatgagaacccccagacccgggtaggcgggcccccacccgagggattacccgggtttaacagtggcgtgatgctactgaacttggaagctatgcgccagtccccactgtattccagattgctggagccggcacaagtgcaacagctggcagacaaataccacttccgaggccacttgggggaccaagacttcttcactatgatcggtatggaacacccaaagctgttccatgtgctcgattgtacctggaatcgacagctgtgcacatggtggagggaccacggatactctgacgtctttgaggcctatttccggtgcgaaggccacgtgaaaatataccacggaaattgcaatacccccattccagaggattag

SEQ ID NO: 31986 - DNA, 564 bp, Artificial Sequence
  Description of Artificial Sequence: Synthetic coding sequence
atgaatggtatgagcgtgttgatgaaagaaacactgaaatcatctgtcaccccttccccttatgaggaaaccggggagaggcagccaagtgtgaactgggctgtgtctccccatcagactcagaatcagtgggcaagatggagctggactagccagccactcgaacttcataccttttggcaattccggcatgagaacccacagacaagggttgggggcccaccccccgagggtttgccagggttcaactctggggtgatgctgctgaacctcgaagccatgaggcagagccctctctacagccggctgctagagccagcccaggtgcagcagttagccgataagtaccacttcagaggtcacctgggagatcaggacttctttacgatgatcgggatggaacatcctaagctgtttcacgtgctggattgcacatggaacagacagctgtgcacctggtggagagaccatggctactctgacgtctttgaggcctacttccgttgtgaaggccacgtgaaaatataccacggcaattgcaatacgccaattcctgaggactag

SEQ ID NO: 31987 - DNA, 573 bp, Artificial Sequence
  Description of Artificial Sequence: Synthetic coding sequence
atgtggccaccgagatgcaaggacccaggacggcagtcggccgagattcttcagatcatacaactggacctagatctgaagtttaaaacaaatattagagagctcttcgaggaatttgattcctttttgccaggagcaattattggaattgcacgggaaatgcagcccgtgtacagacacaccttctggcagttccgccacgaaaacccccagaccagggtcggtggcccccctcccgagggacttccaggatttaacagcggagtgatgcttctcaacctcgaagccatgaggcagtcaccattgtactctaggctcctcgagcccgctcaggtacagcagcttgccgacaaataccatttcaggggtcacttaggcgatcaggatttcttcaccatgataggcatggagcatcctaagctgtttcacgtactcgactgcacttggaaccgacagctgtgcacctggtggagagaccatggctattccgatgtgttcgaagcctatttcagatgcgaaggacacgtcaagatctaccacgggaactgcaacacgcctatcccagaagactag

SEQ ID NO: 31988 - DNA, 570 bp, Artificial Sequence
  Description of Artificial Sequence: Synthetic coding sequence
atggtccgctgcgtgccctctgcagttatcgtctgtttcctgcggccaccgcagcccggtaggactgtaatcttccatgacgtagcagtgctgaccgacaaactgttcccaatagtggaggccatgcagaaacactttagcgcagggcttgggacctactacagcgactcaatcttttttttgtcagtggctatgcatcaaattatgcccaaggaaatcctgcagataatccagttggatcttgaccttaagttcaagacaaatatcagagagttatttgaagaattcgactcctttctgcctggggccattattggtatcgcccgcgagatgcagcagctggccgataaataccacttcagaggacacctgggagatcaagattttttcacaatgatcggtatggagcatcccaagttattccacgttctcgactgtacatggaaccgccagctgtgtacctggtggagagatcacggctattctgatgtcttcgaggcatattttagatgtgaaggacatgtcaaaatttaccacggcaactgtaacacccccatcccagaggactag

SEQ ID NO: 31989 - DNA, 504 bp, Artificial Sequence
  Description of Artificial Sequence: Synthetic coding sequence
atgagcctcgtgatccgcaatctccagcgagtgatccctattagaagggctcccctccgatcaaagatcgaaatcgtacggaggatcctgggcgtgcagaagtttgatctgggtatcatttgtgtcgacaacaagaatattcaacatattaataggatctatagggacaggaacgtgcctacggatgtcctttctttcccctttcacgagcatctaaaagcaggtgagttccctcaacctgatttcccagacgactacaacctgggcgatatctttctaggggtggagtacatcttccaccagtgcaaagagaatgaagactacaacgacgttcttaccgtcacagcgacacacgggctctgtcaccttttaggcttcactcacgggacagaggccgaatggcaacagatgtttcaaaaagagaaggctgtgcttgacgagctcgggcggcggacggggactagactgcaacctctgacacgcggtctctttggtgggtcctag

SEQ ID NO: 31990 - DNA, 375 bp, Artificial Sequence
  Description of Artificial Sequence: Synthetic coding sequence
atgtcactcgtgattcggaatctacagcgtgtgataccaatcagacgcgcaccccttagaagcaagatcgagattgtccgacgcatactgggagtgcaaaagtttgatctcggaatcatctgcgtcgacaataaaaatatccagcatataaacagaatctatcgggatagaaatgtccctactgatgttctttctttccctttccatgaagtgacagccacgcacggcctgtgtcacctgctgggatttacgcatggcaccgaggctgaatggcagcaaatgttccagaaggaaaaagctgtcctagatgagctgggccggcgcactggaacgcgcttacaaccattaactagaggtttatttggcggcagctag

SEQ ID NO: 31991 - DNA, 504 bp, Artificial Sequence
  Description of Artificial Sequence: Synthetic coding sequence
atgagtctagtgattcgaaacctgcagcgggttatccccattcggagagcgcctttacgctcgaagattgagatcgtccggaggattcttggcgtgcaaaagtttgacttaggcatcatttgcgtcgacaacaaaaacattcaacatattaatcggatttatagagatagaaatgtaccgactgacgtgctgtcctttccatttcatgagcacctgaaggcaggcgagtttcctcagcctgatttcccagacgactataatcttggcgacatcttccttggcgtggaatatatcttccaccagtgtaaggagaacgaggattacaacgatgttctgactgtcaccgcaacccacggactgtgccaccttctaggctttacacatggaacagaggccgagtggcagcaaatgtttcagaaagagaaggctgtgcttgacgaactgggacgcaggaccggcacaaggttgcagccattgactcgcgggctgtttggaggatcttag

SEQ ID NO: 31992 - DNA, 240 bp, Artificial Sequence
  Description of Artificial Sequence: Synthetic coding sequence
atgtccctcgtgatcagaaacttacaacgggtaataccgatcagaagggccccacttaggtcgaagatcgaaatcgtgaccgctacccacggcctgtgccatcttttggggtttactcacggaaccgaggcagaatggcagcaaatgttccaaaaagagaaagcggtcctggacgagttaggccggcggaccggaacccggcttcagcccctcactagaggtctttttggaggttcctag

SEQ ID NO: 31993 - DNA, 369 bp, Artificial Sequence
  Description of Artificial Sequence: Synthetic coding sequence
atgtctttggtgattagaaacctacagagagtgatccctataaggagagctccactacgttctaagatcgaaatacatctcaaagccggcgagtttccgcaacctgactttcccgacgattataacttaggtgatatctttctgggagtggaatatatcttccatcagtgtaaggagaatgaagattataacgatgtgctgaccgtgacggctactcatgggctgtgccacctgcttggattcacccacggtaccgaggcagaatggcagcagatgtttcaaaaagagaaggctgtcctcgacgaactcggccggagaaccgggactcgactccagccccttactcgcggattgtttggagggtcttag

SEQ ID NO: 31994 - DNA, 504 bp, Artificial Sequence
  Description of Artificial Sequence: Synthetic coding sequence
atgtctctagtcattaggaacttgcagcgcgtgatacccatcaggagagctccactgcggtctaagatcgagattgtcagacggattctgggagtgcagaagtttgacctgggcatcatttgcgtggacaacaagaatatacagcatatcaacaggatctaccgcgatagaaacgtccctactgacgttctttcattccctttccacgaacacctaaaggccggcgaattcccacaacccgacttcccggatgattataatttaggggacatttttctgggggttgagtatatttttcatcaatgcaaggaaaatgaagactacaacgacgttctgactgtgactgcaactcacggcctgtgtcatttgctcggcttcacacacggaaccgaggccgagtggcagcagatgttccagaaagaaaaagccgtcctcgacgaactgggccggagaacaggtacccgcctgcagcctctcactcgcggcctgtttggcggctcctag

SEQ ID NO: 31995 - DNA, 921 bp, Artificial Sequence
  Description of Artificial Sequence: Synthetic coding sequence
atggccgccgtagatgatctccaatttgaagagttcggaaatgctgctacgtcacttaccgctaatccggatgcaaccactgtgaatatcgaagaccccggggaaacacccaagcatcagccaggctccccacgcggcagcggaagggaggaggatgatgaactcctgggcaatgacgactcagacaaaactgagctgcttgctggccagaaaaagagcagcccattctggaccttcgagtactaccagaccttctttgacgtggacacctaccaggtctttgaccgcataaagggcagcctcttacctatacctggtaaaaatttcgtccgcctttacataaggtctaaccctgatttatacgggcctttctggatctgcgctactctcgtctttgccatcgctatatctgggaacttgtcaaattttctaatacacctgggcgagaaaacatatcattacgtaccagagttcaggaaggtgagcatcgcggctaccattatttacgcctacgcttggctggttcccctcgccctgtggggcttcctgatgtggagaaattcaaaagtgatgaatattgttagctacagcttccttgagatcgtctgcgtttacggctacagcctgttcatttacattccaacggcaatcctgtggattatcccccaaaaggctgtgagatggatattggtgatgatcgcactcggcatttccggctccctgctcgctatgaccttttggcctgcagtgcgggaagataaccgtagagtcgccctggcaaccatcgtaactatagtcttgctgcatatgctgctgagtgtgggatgcttggcctacttctttgatgcaccagaaatggaccatctgcccacaaccaccgctacccctaaccagactgtggctgcagcaaagagcagctag

SEQ ID NO: 31996 - DNA, 372 bp, Artificial Sequence
  Description of Artificial Sequence: Synthetic coding sequence
atgtggcgaaatagcaaagtcatgaacatagtaagctattctttcttggaaattgtctgtgtgtacgggtattccttattcatctacatacctacagccattttgtggatcattccacagaaggcagtgcgctggatcttggttatgatcgcgttgggcatttccggttcgctgctagcgatgacattctggccagccgtgagagaggacaatcgacgcgtcgcactggcgactatcgtaaccatcgtattgcttcatatgttgctgtcagtcggatgcctggcctacttcttcgatgcaccagaaatggatcacctgccgactacgactgcgacaccaaaccagacggtggctgcggcaaagtcgtcatag

SEQ ID NO: 31997 - DNA, 654 bp, Artificial Sequence
  Description of Artificial Sequence: Synthetic coding sequence
atggcagccgtcgatgatttgcagttcgaagagttcggcaacgccgccactagcctgactgctaaccccgacgcaaccacagtgaatatcgaggaccccggtgagacccctaagcaccaaccagggtccccccgcggcagcggccgggaagaagatgacgagttgttaggtaatgacgactctgacaagacagagctgctggctggtcagaagaagtctagccctttttggacatttgagtattatcagacattttttgacgtggacacttaccaagtctttgaccgaattaagggctcactccttcctatacccgggaaaaattttgtgagactgtacattaggtctaacccagacctgtatggaccgttctggatttgcgctacactcgtgttcgcgattgctatcagtggcaatctgtctaatttccttatccatctaggagagaaaacctaccattatgtgccagagtttcgcaaagtgtcaattgcggccacaattatctacgcctatgcctggcttgtccctctggccctgtgggggtttctgatgtggaggaactcaaaggttatgaacattgtgtcttactctttcctggaaattgtctgtgtatatgggtatagcctattcatttacatccctactgccgtgtag

SEQ ID NO: 31998 - DNA, 921 bp, Artificial Sequence
  Description of Artificial Sequence: Synthetic coding sequence
atggccgctgtcgatgatcttcagttcgaggagtttggaaacgcagccaccagcctgaccgcaaaccctgacgcaacaaccgttaatatcgaggacccgggagaaacacccaagcatcagcctgggtcccctagaggatccggtagagaggaggatgacgagctgttgggcaatgatgactcagataagaccgaactgcttgccgggcagaagaagagttcccctttttggacattcgaatactaccagacattttttgacgtggatacttaccaggtctttgatcggataaagggctcccttcttcctatcccgggcaagaactttgtgcgattgtatatccgaagtaaccctgatctgtatggtcccttctggatctgtgcaaccctggtgtttgcaatagccatcagtgggaatctgtccaatttccttatccatctgggtgaaaagacgtaccattacgtgccagagtttcggaaggtgtctatagccgctactatcatctatgcctatgcatggcttgtccccctggccctttgggggttcctcatgtggcgaaattccaaggttatgaatattgtgagctattcatttctcgagattgtgtgtgtgtatggatattccctttttatttacattccaacagctatcctttggattattccgcagaaagccgtgagatggatccttgttatgatagctctgggcatcagcggttcactgttagccatgacattctggcctgcagtgcgcgaggacaataggcgcgtagctcttgcaacgatcgtgactatcgtgctattgcacatgctgctgagcgtgggctgtcttgcctatttctttgatgctcctgagatggaccacttacccacaaccactgcgaccccaaatcaaactgttgcggctgccaaatccagctag

SEQ ID NO: 31999 - DNA, 996 bp, Artificial Sequence
  Description of Artificial Sequence: Synthetic coding sequence
atgtctggcggggaaatatcaagccggactctgcagattttctttctcataatagggagaagactgaccgggcgaatggctgccgttgacgacctgcagttcgaagagtttgggaacgcagcaaccagtctgaccgcgaaccccgacgccactacagtgaacatagaagatccgggggagacacccaaacaccaacctggtagccctaggggatctggtagagaagaagatgacgagctgcttggcaacgacgactccgacaagactgagctgctagcgggtcaaaagaaatccagcccattctggacctttgagtattaccagacgttttttgacgtcgacacttatcaggtgtttgaccggattaagggatctttgctgcctattccggggaaaaactttgtgaggctgtacataaggtctaatcctgatctgtatggccctttctggatctgcgctaccctggtatttgcgatcgccatctccggcaatctttcaaactttcttatccacctgggagaaaaaacctatcattatgttccagagttcagaaaagtaagcatagcagctacaatcatctatgcttacgcgtggctcgtccctctggctctgtggggcttcttgatgtggagaaatagcaaggtgatgaatatcgtgagctacagcttcttagagatagtctgtgtgtacggctattcactcttcatttacatacccacagcaattctgtggatcattcctcagaaggcggtgcgatggatcctcgttatgatcgcgctcgggatctcaggaagcctgcttgccatgacattctggcccgcggtccgcgaggacaatcgacgggtggcactggcaacaatcgtgacaatcgtgctattacatatgctactctcagtgggatgtttagcctacttttttgacgcacccgaaatggaccacttgcctacgactacagcaactccgaaccaaaccgttgcagccgccaaaagctcctag

SEQ ID NO: 32000 - DNA, 951 bp, Artificial Sequence
  Description of Artificial Sequence: Synthetic coding sequence
atggcaagcgctgatgaattaacgttccatgagttcgaggaagctacaaatttgctagcagatacaccagatgctgcgacgactagccgctcagatcagctcaccccgcagggacacgtcgcggtcgcagttggcagcggcgggtcctatggggccgaggacgaggtcgaggaagaatccgacaaggcggccctgctgcaggaacagcaacagcagcagcagcccggtttctggacttttagctactaccagagcttcttcgacgtggacacaagtcaggtcctggatcgcattaaaggcagtctcctgccccggccgggtcacaatttcgtacggcatcacctgcggaaccgccctgacctgtacggtcccttctggatttgtgccacactggcctttgttctcgcagtgacaggcaacttgacactggtgctagcccagaggcgtgacccaagcatccattacagcccacagtttcataaagtgacagtggccggcatttctatttattgttatgcatggctggttccactggccttgtggggatttctacgttggcggaaaggggtgcaggaacgcatggggccatatacgttccttgagactgtgtgcatctacggttattctctgttcgttttcatcccgatggtcgtgctgtggctcatcccagttccatggctgcagtggcttttcggcgccctcgcgctcggactcagtgcagccgggcttgttttcacactctggccagttgtgcgcgaggatacacgactcgtagcgacggttctcttgtctgtggttgtgcttctgcatgcgctcctggcgatggggtgcaaactctacttcttccagagccttccacccgagaatgttgccccacctccacaaatcacgagtctcccaagcaacatcgcattatcccccaccctcccgcagtccctggcaccgtcttag

SEQ ID NO: 32001 - DNA, 735 bp, Artificial Sequence
  Description of Artificial Sequence: Synthetic coding sequence
atgcagccccctggacctcccccggcttatgctcccactaatggcgatttcacctttgtctcatcggctgatgctgaagatttgtccggttcaatcgcctctccagatgtgaaactcaacctgggcggtgattttattaaagagtcaacagctactacttttcttaggcagagaggatacggctggctcttggaagttgaggatgacgatccagaggacaacaagccactcctggaggaacttgatattgacctgaaggatatctactataagattcgctgcgtcctcatgccaatgccttcactgggcttcaaccggcaggtggtgcgcgataatccagatttttgggggcctttggcggtcgtgctgttcttctcaatgatttcgctgtatggtcagttccgggtggtctcctggatcattaccatctggatcttcggctcactcaccatttttctgttagcacgcgtgctgggtggcgaagtggcttacggccaagtgttaggcgtgatagggtattccctgctccctctcattgttattgccccggtgctgctcgtggtggggagtttcgaagtggtcagtacacttattaaactgtttggcgtattctgggccgcatactcggccgcatccctactggtgggcgaggagtttaagaccaagaaacctctgctcatctatcccatcttcctgctctatatttattttctgtccctttacaccggggtgtag

SEQ ID NO: 32002 - DNA, 582 bp, Artificial Sequence
  Description of Artificial Sequence: Synthetic coding sequence
atggccgaagccgaggaatctccaggggacccaggaacagcttccccaagaccactcatgagggacctgaaagccgtggggaagaagtttatgcacgtcctgtaccccaggaagtccaatacactgttacgcgactgggatctttggggacccctgatcctgtgcgtgacgttggctcttatgctccagcgagacagcgctgactctgagaaagacggcggaccccagtttgccgaggttttcgtgatcgtttggtttggggctgtgacaatcacactcaacagtaagctgttgggcggtaatattagttttttccagtcactgtgtgtgcttggctactgcattttacctctcaccgtggctatgcttatctgccgcctggtgctgctggccgaccctggacctgtgaattttatggtgcggctttttgtggtgatcgtcatgttcgcatggagcatcgtggccagtactgcatttctcgctgactcgcaacctccaaatcgacgggccctcgccgtataccctgtgtttctgttttactttgtgatctcctggatgattctgacatttaccccacagtag

SEQ ID NO: 32003 - DNA, 567 bp, Artificial Sequence
  Description of Artificial Sequence: Synthetic coding sequence
atggcagaggccgaagagtctccaggcgacccgggtacagcctccccgaggcccttaatgcgtgacctgaaggcagtcggaaaaaagtttatgcacgtactttacccgcgtaagtccaacaccctgctgcgcgactgggacctatggggaccactaattttatgcgtcaccctcgctctgatgctccaacgagatagcgccgactccgaaaaagatggaggcccgcagtttgccgaggtgttcgtcattgtctggtttggcgcagtgacgatcacactgaactcgaagctgctggggggcaatatttccttttttcagagtctctgcgtgttgggctactgcatactccccctaaccgttgctatgctgatttgtcgacttgtcttgctggcagacccaggccctgtgaactttatggtgagattgtttgtggtgattgtaatgttcgcctggagcattgtggcctcaactgcattcttggccgactctcagccccctaatcgtagggcccttgccgtgtatcccgttttcttattctacttcgttatttcctggatgattctgtag

SEQ ID NO: 32004 - DNA, 711 bp, Artificial Sequence
  Description of Artificial Sequence: Synthetic coding sequence
atggctgaggctgaggaatccccgggagatccaggtaccgcatccccccgacccctcttcgccgggcttagcgacatttccataagccaggatattcctgtggagggggagattacaatcccgatgagaagccgtataagggagttcgattcctcaacccttaatgaatccgtacggaatactatcatgcgtgacctaaaggccgtgggaaaaaaatttatgcacgtgttgtacccacggaagtccaatacgctactgagagattgggatctctggggtcctttgattctgtgtgtcacacttgctttgatgctccagcgtgacagcgcggactcggaaaaggacgggggccctcagtttgctgaggtttttgttatcgtctggttcggcgccgttaccatcaccctgaatagtaaacttctcggcgggaacatctctttcttccagagcttgtgcgtcctggggtactgtatcctgccgctaacagttgcgatgctcatttgtcgactggtcctgctggccgacccaggaccggttaacttcatggtccgccttttcgtggttattgttatgtttgcatggtcaatagtggcctctacggcgtttctggccgattcccaaccccccaacagaagggctctggccgtttatccggtgttcttgttctactttgtcataagttggatgatacttacgttcaccccccagtag

SEQ ID NO: 32005 - DNA, 843 bp, Artificial Sequence
  Description of Artificial Sequence: Synthetic coding sequence
atggatttacttaaaatctcccataccaagttgcacctcctcgaagacttaagcatcaaaaacaagcaaagaatgagcaatctggcgcagtttgacagcgacttttatcagtccaactttacaatcgacaatcaggaacagtcaggcaatgactctaatgcttacggaaatttgtacgggagccgcaaacagcaagctggcgaacagccacagcctgcttcgttcgttccttccgagatgttaatgagttcaggatacgccggccaattttttcagcctgcttctaattcagactactactcacagtctccctacattgactcttttgacgaggagcccccactgttagaggagttaggaattcacttcgaccacatttggcaaaagactttgacagtgctgaacccaatgaaaccagtcgatggaagcatcatgaatgagacggacctgacagggccaatacttttctgtgtagctttaggcgctaccctcctgctggcgggaaaggtgcagttcggctacgtctatggcatgtcggccattggttgccttgttattcacgcgctgctaaacctgatgtcgtcatctggcgtgtcttatggttgtgtggcatcagtgttaggatattgcttgttgcctatggtcatcctgtctggttgtgcaatgtttttttcactccagggtatctttggaattatgtcgagcctcgtgatcattggatggtgctctctttctgcctctaaaatatttatcgccgctctacacatggaggggcagcagctgctggtggcatacccgtgtgccattttgtacggactgtttgcactcctgaccatcttttag

SEQ ID NO: 32006 - DNA, 774 bp, Artificial Sequence
  Description of Artificial Sequence: Synthetic coding sequence
tagatgagcaatctggcccagttcgacagcgacttctaccagagtaacttcaccattgataatcaggaacagagcgggaatgactcaaatgcctacggcaatctgtacggctctcgcaaacagcaggcaggtgaacaacctcagcccgcatcctttgtcccgtccgagatgctgatgtcgtctggctatgcaggccaattcttccagcccgcgagcaactctgactactacagtcaaagcccatatatcgatagctttgatgaagaaccccctctgctggaagagcttggtatacactttgatcatatttggcaaaaaacactgactgttctgaaccctatgaagcctgtagatggcagcatcatgaacgaaaccgatttaaccggacctattctattctgtgtggcactgggcgctaccctgttacttgctggaaaggtgcaatttggatatgtgtatggcatgtctgctatcggttgtcttgtgattcacgctctgttgaatcttatgagctcttcaggcgtctcttacggttgtgtcgcttccgtgctggggtactgcttgctacctatggtgatattgagtggctgcgccatgtttttctccttacagggtattttcggcatcatgagctcactggttattatagggtggtgcagcctctccgcctccaagatcttcattgctgcgcttcacatggagggccagcagctgctggtcgcctacccgtgtgctattctgtacggactttttgccttgcttacaattttctag

SEQ ID NO: 32007 - DNA, 900 bp, Artificial Sequence
  Description of Artificial Sequence: Synthetic coding sequence
atgcctgggtcggccagcaagagacgcatcccagtcagccagccaggcatggcagatccgcatcaactcttcgatgatacatccagtgcccaaagccgagggtacggtgctcagagagcccccggcggcttatcttaccccgcagcatccccaaccccacatgctgccttcctggccgatcccgtcagcaacatggccatggcgtatggatcatcactagccgcgcaaggcaaggaactggttgacaaaaacatcgatcggttcatcccaatcacaaagctgaaatattacttcgcagtggatactatgtacgtgggccgtaaattgggattactcttcttcccatatctgcaccaggattgggaggtgcagtaccagcaagatacccctgtggcacctaggtttgacgtcaatgctccagacctgtacatccccgcaatggccttcataacctatgtgctcgtcgccggacttgcattaggcacacaggaccgcttctccccagacttactcgggctccaggctagctcagccttggcctggctgactctggaagtcctagcaatattactgagtctgtacctcgttaccgttaacacagatctgaccacaatagatctcgtggctttcctgggctataaatacgtcgggatgattggaggtgtcctgatggggctactgtttggcaagattggatactacctggtgcttgggtggtgttgcgtggcaatctttgtgttcatgatccgcactctgaggctgaagattcttgcagatgcagctgctgagggcgtgccagttaggggcgccagaaaccaacttcggatgtatctcactatggctgtcgcagcagcccagccaatgctaatgtactggttgaccttccacctagttaggtag

SEQ ID NO: 32008 - DNA, 876 bp, Artificial Sequence
  Description of Artificial Sequence: Synthetic coding sequence
atgcatccagcaggcttggcggctgctgccgccggaacacccagactgccatccaaacggcgtatcccagtttcgcagcctggcatggccgacccgcatcagctgtttgacgacacaagtagcgcccaaagtcggggctatggagcacagagggcgccaggagggctgagttacccagccgcctcaccaacgcctcacgccgcgttcttggccgatcccgtctcaaacatggccatggcatatgggagttccttggctgcgcagggcaaggaactagtggataaaaatatcgacagatttattcctatcacaaagctgaaatattacttcgcggtggatactatgtacgtcgggcggaagctgggcctgctattcttcccctacctgcaccaggactgggaggtgcagtatcagcaggacacgcctgtcgcccctaggttcgacgtaaacgctcccgacctttatatccctgccatggcttttataacatacgttctggttgctggtctggccctgggcacccaagaccgcttcagtcccgacctccttggtcttcaggcctcatccgccctggcatggctcactctagaagtgttggctatcctacttagcttatatctcgtgaccgtcaatactgacctgaccacaatagatcttgttgcgtttctgggttataaatacgtcggcatgatcgggggtgtgctcatggggcttctttttggcaagatcggctactacttagtactgggatggtgctgcgtggcgatcttcgtgttcatgtttccactgctgccaggcgccgtggcccacgcatgcaatccttcaaccctggggggacggggaggtaggatcacacgatcgggcaggtgtggctag

SEQ ID NO: 32009 - DNA, 945 bp, Artificial Sequence
  Description of Artificial Sequence: Synthetic coding sequence
atgcatcccgccggcctggccgccgctgctgcaggcactccgagactgcgtaagtggccttcaaagagaagaattcccgtgtctcagccgggcatggccgatcctcaccagctttttgacgacacgagcagcgcgcagagcagagggtatggcgcacagagggctcctgggggtctttcctatcccgcagcctctccaactcctcatgccgcgtttctcgccgaccccgtgtccaacatggcaatggcctatggtagcagtcttgctgcgcagggaaaagaacttgtggacaaaaacatcgatcgcttcataccaattaccaaactcaagtactactttgcagtggacaccatgtatgtgggccggaagctcggtctcctgttctttccctaccttcaccaagattgggaagtgcagtaccagcaggacacgcccgttgcccctaggtttgacgtgaatgcccccgacctgtatattcctgccatggcgttcattacatacgtcctggtcgccggtctggcgctgggcactcaggacaggttctcgccagatttactcgggctccaggcatccagcgctttggcttggttgactctggaggtattagctattctcctgtccctctacctcgtgactgtcaacactgatctgactaccatagatttggtggccttcttgggatacaaatacgtcggaatgattggcggagtcctgatgggcctccttttcggcaaaattggttattatctcgtccttggctggtgctgcgtggcgatctttgtattcatgatccgcactcttaggcttaaaatacttgcagatgctgcagcggaaggcgtgcctgttagaggggcgaggaatcaattaaggatgtatctgacaatggctgtagctgccgcccaacctatgctgatgtattggttaacttttcaccttgtgcgttag

SEQ ID NO: 32010 - DNA, 852 bp, Artificial Sequence
  Description of Artificial Sequence: Synthetic coding sequence
atggccgatcctcatcagctctttgacgacacaagctccgcccagagtaggggctacggtgcacaacgcgccccaggcgggctgagctacccagcagccagtccgacgccccacgccgcctttcttgctgatccagtatcgaatatggcgatggcttacggtagctcactggccgcccaaggaaaagaactggtagataaaaatatcgatagattcatccccatcacaaaactgaagtattattttgccgtcgataccatgtacgtcggcaggaagctcggtctgctgtttttcccatatctgcaccaggattgggaggtccagtatcagcaggacaccccggtcgcaccgcggtttgatgttaatgcccctgacctgtatattcctgctatggccttcatcacctatgttctggtcgcaggattggctctgggaactcaggacagattttctcccgatctgctgggtctgcaggcttcctccgccctcgcttggttaaccttagaagtgctcgccattctgctatcgctctatctcgtaacagtcaacacggaccttacaacaatcgacttagttgcttttctgggctataaatatgttgggatgatcgggggtgtgctgatgggcttgctgtttggtaaaatcggctattacttagtgctgggctggtgctgtgtggccattttcgtctttatgatccgcacactccggctcaagatcctcgctgatgccgctgctgagggcgtgcctgtgagaggggcacggaaccagctgagaatgtatcttaccatggctgttgcggcagcacaacccatgctgatgtattggctgacatttcatctggtgcgctag

SEQ ID NO: 32011 - DNA, 609 bp, Artificial Sequence
  Description of Artificial Sequence: Synthetic coding sequence
atgagcggacgttctgtacgggccgagacacgttcaagggccaaggacgacattaagaaagtgatggcggcaattgaaaaagtcagaaaatgggaaaagaagtgggttactgtgggcgatacaagcctcagaattttcaaatgggtgccagttaccgatagtaaagagaaggagaagtccaaatccaattccagcgctgcccgagaacccaatgggttccccagtgatgcctccgctaattcaagcttgctgctggaattccaggatgaaaacagtaaccaatcatcagtatccgacgtataccaactcaaagtagactctagcactaactcgtccccgtcaccgcaacagagcgaatctctgagcccagcccacacaagtgattttagaacagatgacagtcaaccgcccactcttgggcaggaaattctggaggagccctctctgcccagtagcgaagtagccgacgagccccccaccctgacaaaagaggaacctgtgccgctcgagacccaagtagtcgaggaggaggaggactccggggcaccgcccctcaagcgcttttgcgttgaccagccaactgtgccacagacagcctctgagagttag

SEQ ID NO: 32012 - DNA, 495 bp, Artificial Sequence
  Description of Artificial Sequence: Synthetic coding sequence
atgaaactctacagcctcagtgttctctacaaaggtgaggcaaaggtcgtcctcctcaaggcagcctatgatgtgagttcttttagcttttttcagcggtcttccgtacaggagtttatgacattcactagccagttgatcgtggaacgctctagtaagggcacacgggctagcgtaaaagaacaggattatctttgtcacgtgtacgtgcgaaacgacagccttgccggggtcgtgatcgctgataatgagtaccctagtcgtgtagcattcacacttcttgagaaggtgctagatgagttcagcaaacaagtggatcgcatcgattggcccgtgggatcacctgccaccatccattaccctgcacttgacgggcatctgtccaggtaccagaacccgcgcgaggccgacccaatgacgaaagtgcaggccgagctggacgagaccaagattatacttgctaggaagcaaaatagttgttgcgctataatgtag

SEQ ID NO: 32013 - DNA, 1119 bp, Artificial Sequence
  Description of Artificial Sequence: Synthetic coding sequence
atggcgagcaatgaggatttttcgattacccaggacctggagattcctgccgacattgttgagctccatgatatcaacgtggagccattgcccatggaagacattcccaccgaatccgtgcaatatgaggatgttgatggcaactggatttatggtggacacaaccatcctcccctgatggttcttcaaccactgtttaccaacaccggatacggtgaccacgaccaagagatgctgatgctccagacccaggaggaagtggtggggtactgcgactctgataaccagctgggaaatgacttggaagaccagctggctctgccagatagtattgaagatgagcatttccagatgaccctagcgtctctgagtgctagtgccgcctcgaccagcacgtccacccagtctagaagcaagaagcccagtaagaaaccctccgggaaatctgctacctccaccgaagcaaaccccgcgggatctagcagtagcctgggcactaggaagtgggagcaaaaacagatgcaggttaaaacacttgagggcgaattctctgttacaatgtggtctcccaatgataacaacgatcagggcgccgtgggggagggccaggcagaaaacccacctgactattctgaatacctcaaagggaagaaactgcctcctggtggcctccccgggattgacctgtcagaccccaaacagctggcagagttcaccaaggtgaaaccaaagaggtcgaaaggggaaccacctaaaacagtcccctgttcttatagtggctgcgagaagatgttcagggactacgctgctatgcgcaagcatttgcatattcatggcccccgcgtccatgtttgtgccgaatgtggtaaggccttcctcgaatcatcaaaactgagacgccatcagctagtgcacacaggggaaaaaccgttccaatgcaccttcgagggctgcggcaaacgcttcagtctggacttcaacttacgcacacacctcaggattcacaccggcgataagccatttgtttgcccattcgacgtgtgcaaccgcaaattcgcccagtccactaatttaaaaactcatatcctaactcatgtcaaaaccaaaaataacccttag

SEQ ID NO: 32014 - DNA, 2301 bp, Artificial Sequence
  Description of Artificial Sequence: Synthetic coding sequence
atggctagtgacacacccgaatccctaatggccctgtgtactgatttctgcttaagaaacttggacggtacactcgggtatctgctggacaaggagaccctgaggctgcacccagacatcttcctcccgtctgaaatctgcgaccgcctggtgaatgagtatgtggaactggtgaacgcggcatgtaattttgagccacatgaatccttcttttcactgttttcggaccctagatccactaggcttacacggattcacttgcgtgaagatttagtgcaggaccaggacctggaggcaatccggaaacaggatctggtcgagttatatctgactaactgtgagaagctgtcagctaaatcactgcagacgctgagaagcttttctcatactctcgtctccttaagtctgtttggctgtaccaacatcttctatgaggaagagaaccctgggggatgtgaggatgagtaccttgttaatcccacctgtcaagttttagtgaaggattttacgtttgagggtttctcacggctccgttttctcaatttgggacgcatgatcgattgggtgcccgtggaaagccttctaagacctctcaacagcctcgctgccctggacctgagcggtattcagacctcagatgccgcatttctgacacagtggaaggactccctggtatctcttgttctctataatatggatttgagtgatgatcatataagggtaattgtgcagttgcataaattgcgacatcttgacatctccagagataggctgtcgagttactacaaattcaagctgacccgggaggtgctgagtctgttcgtacagaaactgggcaatttgatgtccttggacattagtgggcacatgattcttgagaactgctccatcagcaaaatggaagaggaggccgggcagacctccatcgaaccgagtaagtcatctatcatacccttcagggctctgaaacggccgctacagttcctgggccttttcgagaactcactgtgcagactcacccacatccccgcatacaaggtaagtggagacaagaacgaggaacaggtcctgaatgcaattgaagcctacactgaacataggcccgagataaccagtcgagccatcaacttgctatttgacatcgcccggatcgagaggtgtaatcagcttttgcgagcgttgaagttggttatcaccgccctgaaatgtcacaagtatgatcggaacatccaagtgacagggagcgctgccttgttctatctcaccaattcagaatataggtctgaacagagtgttaagctgaggagacaggttatccaggtagtactgaacggcatggagtcataccaggaggtgacagttcagcggaactgctgtctaaccctgtgcaacttcagtatacctgaggaactggaattccaatacaggagagtgaatgagcttctgttgtcaatactaaacccgactcggcaggacgaatcaattcaaaggatcgccgtgcatctttgtaacgctctggtgtgtcaagtagacaatgatcacaaggaagcagtaggaaagatggggttcgtggtcactatgctgaagctgattcagaaaaaactcctggataaaacttgtgatcaggttatggagttctcctggtccgcactgtggaacattaccgatgagacacccgacaattgcgagatgttcctgaattttaatggcatgaagctgttcctcgattgtctaaaagagtttcctgagaagcaagagctacacagaaacatgctcgggctgcttggaaatgtggcagaggtgaaagaactgcgacctcaactgatgaccagtcaatttatttcggtgttctcaaaccttttggaaagtaaggccgacggtatagaagtgagttacaatgcctgcggcgtgctttcccacatcatgtttgatggccctgaggcctggggagtgtgcgagccacagagagaggaggtagaagagagaatgtgggcagctatacagtcctgggatatcaactcccgtagaaacatcaattatcgcagctttgaacccatcctgcgtcttctgcctcaaggcatctctcccgtgtcccagcattgggcaacatgggcactgtacaatctagtgtccgtgtaccctgataaatactgcccactgctcatcaaagagggaggaatgcccttgttgagggatatcatcaaaatggctacagcgcgacaggagactaaagagatggcccgtaaagtcatagaacactgtagtaattttaaggaagaaaacatggacaccagtcggtag

SEQ ID NO: 32015 - DNA, 498 bp, Artificial Sequence
  Description of Artificial Sequence: Synthetic coding sequence
atggcctctgatactcctgagtctcttatggccttgtgcactgacttctgtctgcggaacctagatggaacattgggctaccttcttgataaagaaacactgcggctccaccccgacatcttcctgcccagcgagatatgcgacagactcgtgaacgaatacgtggaactggtcaacgccgcatgcaatttcgaaccccacgaatccttcttctctctattttcagaccccaggagcactaggttgaccaggattcacctgagggaggacttggtacaggatcaggatcttgaggcgatcagaaagcaggacctcgttgaattatatctcaccaattgcgaaaaactcagcgccaaaagcctgcagactctgcggagcttctctcacacattggtaagtctgagcctattcgggtgcacgaatattttttacgaagaggaaaaccctggtggctgtgaggatgagtacctcgttaatccaacctgccaggtgctgtag

SEQ ID NO: 32016 - DNA, 306 bp, Artificial Sequence
  Description of Artificial Sequence: Synthetic coding sequence
atggccagtgacacccccgaatcccttatggctttgtgcacagatttttgtttgaggaacctggacgggaccctgggatatctgctggacaaggagacactccggctgcatcctgatattttcctgccctcagaaatatgcgatcgactggtgaatgaatacgtcgagctggtgaatgccgcatgtaactttgaacctcacgaatctttcttcagtctgttctccgaccccagatccacaaggctgactcgtatccacctgcgggaagaccttgtacaagaccaggatctggaggcaatcaggtag

SEQ ID NO: 32017 - DNA, 1239 bp, Artificial Sequence
  Description of Artificial Sequence: Synthetic coding sequence
atgatggctctctggtccctgctgcacctgacgttcttaggctttagcataacactgctgctggtgcatggccagggattccagggcaccgcagctatctggcctagtttgtttaatgttaatctgtctaagaaagtgcaggagagcatccagattccaaacaacgggtccgccccgctccttgtcgatgtacgtgtgtttgtctccaacgtcttcaacgtcgacattctgaggtatactatgtcttcaatgttgctgttgcgcttaagctggcttgataccaggctggcctggaatacatcggctcaccccaggcatgccattacgttaccctgggaatccctgtggacaccccgccttacgatcttagaggccctgtgggtcgactggcgcgaccagtctcctcaagctagagttgaccaggatggacatgtgaaactgaatttagcattagccacagagacaaattgcaacttcgaacttctgcactttcctcgagatcactccaactgcagcctgtctttttacgcactgagtaacaccgctatggaactggaattccaggctcacgttgtcaacgagatcgtcagcgtgaagcgcgaatatgtcgtctatgacttaaaaacccaggtcccacctcaacagctggtaccttgtttccaggttacactccggctcaagaacacggcgctgaaatccattattgccctgctggtgccggccgaggccctgctgctcgctgacgtgtgtggaggcctcctccccctacgcgctatcgagcgaatcggctacaaagttacacttctgctgtcctacctagtgttacattcctccctggtccaggctcttccatccagctctagctgtaatccactactgatatactattttacaatcctgctgctgcttctgtttctttctactattgagacagtattgttagccggattgctggcaaggggcaacctgggagctaaaagcggtcccagcccagcccctcgaggcgaacaaagggaacacggcaaccccggtccccaccccgctgaggaaccctcaagaggagtgaaaggctcacaacggtcatggcctgaaacggccgacagaattttttttcttgtttatgtggtgggagtgctgtgtacccagtttgtgtttgcaggcatctggatgtgggctgcttgtaaaagtgacgccgcacctggagaagccgccccccacggacgccggcctcggctttag

SEQ ID NO: 32018 - DNA, 381 bp, Artificial Sequence
  Description of Artificial Sequence: Synthetic coding sequence
atgatggccctctggagccttctccacctgaccttcttaggatttagtatcacgctgctcctcgtccatgggcagggatttcaaggtactgccgcaatctggcctagcttatttaacgtgaacttatcaaagaaggttcaggagtcaatacaaattcccaataatggatctgcgcctctcctcgtcgatgtgcgcgtattcgtgtctaacgtgtttaacgtgagttcagtgctccccagagcaactgctctacattcacatggcgactgtagcggcagtgctccctgcagtaaagcccgggggtccggctgtcacggactcacacctgggaaccacctgaaagtgcagcctccttgcattaacccatcaggggacatctag

SEQ ID NO: 32019 - DNA, 3393 bp, Artificial Sequence
  Description of Artificial Sequence: Synthetic coding sequence
atgtgcaagtgttgtaacctgttctcaccaaaccagtcagagctgttgtcacatgtctctgagaaacacatggaagaaggcgtgaatgtagatgaaatcatcattcctctgagaccacttagcactccagagccccccaacagttctaagacaggtgacgaatttctggtaatgaaaagaaaaagaggacggcccaaaggctctaccaaaaaatcctcgaccgaggaggagctagccgagaatatcgtgagtccgacggaagactctcctctcgcccccgaagaggggaacagtctgcctccttcaagcctggagtgcagtaagtgttgcagaaagttcagcaatacgcggcaattgcgcaaacacatttgtatcatagtacttaacctcggcgaagaagagggagaagcaggaaacgagagtgacctcgaactagagaaaaaatgcaaagaagatgatcgagagaaggcttcaaagcggccacgctcacaaaaaaccgagaaagtccagaagatttcgggaaaggaggctcggcagctgagcggtgccaaaaaaccaatcatttcagtggttctcacagcccacgaagccattcccggtgccaccaaaattgtgcctgttgaagctggccctccggagacaggggccactaactcagaaactaccagcgcggacctggtgccgaggagggggtaccaggaatacgccattcagcagaccccctacgagcagccaatgaagtcctcccgcctcggaccaacacagttgaaaatattcacatgtgagtactgcaacaaggtgttcaagtttaaacattctctgcaggcccacttgcgcattcatacgaacgagaaaccatacaagtgcccacaatgtagctacgctagtgcaattaaagccaacctgaatgtgcatcttcgaaaacacacaggagagaaatttgcctgtgattactgttccttcacctgtctgagcaagggacacttgaaagtgcacatcgagagggttcataaaaagataaagcagcactgccgcttctgcaagaagaaatatagtgatgtcaaaaatctgatcaagcatatccgggatgcccacgatccacaagataagaaggtgaaggaggcgttagatgagttgtgcctgatgacacgagagggcaagcgacagttactgtacgactgccacatctgtgagaggaaattcaaaaatgaactcgtcgaagaggaattcgctctgcagggtgtgaacgcactgaaagaggaagcttgtcccggcgatacccagcttgaagagggccgaaaggagccggaagctccaggcgagatgcccgcaccggccgttcaccttgcgagcccccaggctgagagcacagccctccctccctgtgaactcgagactacagtcgtcagttccagcgatttacattcacaggaagtggtgtccgacgactttctactcaagaacgatacctcctctgctgaagctcatgctgccccagagaagcctcctgacatgcagcatcggtctagtgtgcagactcagggtgaagtaattaccctcttgctgtcaaaagcccagtcagctggttcagatcaggagagccacggggcccaatctccgttgggcgaaggacagaacatggcagtactgtctgccggtgatcccgacccctcacgatgcctgcgctctaaccccgctgaggctagcgacctgttaccccctgtagcaggcggaggtgacacaatcacccaccagccagattcctgcaaggcagcccccgagcataggtctggcatcactgctttcatgaaggtactaaattctttacagaaaaaacaaatgaacacaagcctgtgcgaacggattagaaaagtttatggcgaccttgagtgtgaatattgtggcaagctcttttggtatcaggtgcattttgatatgcatgtccgcacgcacaccagagaacacctgtactactgttcacagtgtcattattcttcaattacaaagaactgtttaaaaaggcacgttatacaaaaacattccaacatcttgctgaaatgcccgactgatgggtgcgattacagcactccggacaagtataaactgcaggcacaccttaaagtgcacacagctctggacaagaggtcatactcatgccctgtttgcgagaagtctttttccgaggacagactgatcaagtctcatatcaaaacaaaccatcctgaggtgtccatgtcgacaatttccgaggtgcttggacgccgggtgcagcttaagggcctgattgggaagcgggcaatgaaatgtccttactgtgacttttactttatgaagaatggcagtgacctccagcgccacatctgggcccacgagggcgtgaaaccgttcaaatgcagcctttgcgagtacgccacccgcagtaaatcaaacttgaaagcgcatatgaaccgacactcaaccgaaaaaacacacctgtgcgacatgtgcggcaaaaaattcaaaagtaagggaacactcaaatcgcacaaactgctgcacacggcagacggcaaacagttcaagtgtacagtgtgcgactacacagctgcacagaaaccacagctcctaagacacatggaacaacacgtgagctttaagccctttcggtgcgcccactgtcattactcttgtaatataagtggcagcctgaaaagacactataatcggaaacatcccaatgaagagtatgcgaacgtggggacaggagaacttgcggctgaagtgctcatccagcaggggggcctgaaatgtcccgtgtgttcattcgtgtatgggacaaagtgggaatttaatcggcacttaaagaataaacacggactgaaggtcgtggaaattgacggtgatccaaagtgggaaaccgccacagaggctccggaggagccgtcaacacagtacctgcacatcacagaggccgaggaagatgttcagggaacacaggccgcagtggcagctttacaggacttgagatacacaagtgaaagcggcgatcggcttgatcccactgctgtcaatatcttgcagcagatcatagaactgggtgcagaaacccatgatgctactgctttggcttccgtagtggccatggcaccagggacggtgacggtcgtgaaacaagtcactgaagaagaaccctcatcaaaccatactgttatgatacaggaaaccgtgcagcaagcatccgtcgaactcgcagagcagcaccaccttgtggtgtctagtgacgacgtggaaggcatcgaaaccgtcacagtatatactcagggtggagaagcatccgaattcatagtctatgtccaggaggcgatgcagcccgtggaagagcaggccgtagaacagcctgcccaggagctttag

SEQ ID NO: 32020 - DNA, 3132 bp, Artificial Sequence
  Description of Artificial Sequence: Synthetic coding sequence
atggccatggccctggagctgcaggcgcaggctagccctcagccagagcctgaagagctcctgatcgtgaaactggaggaagactcctggggcagcgaatcaaaactttgggaaaaagatagaggttctgttagtggacctgaggcaagtcgacaacgattccgccagttccagtacagagatgcagcgggccctcatgaggctttctctcagctgtgggctctatgttgtcgctggctgaggcctgagattcgactgaaagagcagatcctcgagctgttggtgctggaacagttcctaacaattctgccacgagaagtccagacatgggtgcaggcacggcaccccgagtccggtgaggaggcggtggccctcgtagaagactggcaccgcgaaactcgcaccgcaggacagtccgggctcgagctgcatacagaagaaactcgcccactcaaaactggtgaggaggcccagagctttcagctgcagccggtggatccatggcctgagggtcagagtcaaaagaagggggttaagaatacctgtcccgatctgccgaatcacctcaatgctgaagttgccccacagcccctgaaagaatctgcagtactcactccgagggtgccaacccttcctaaaatgggaagtgtgggcgattgggaagtgacagctgaatcacaagaagctctaggcccaggcaaacatgcagagaaagagctgtgtaaggacccacccggggatgactgcggaaactctgtgtgtctgggggtccctgtgtctaaaccctcaaacacaagcgagaaggaacagggaccagagttctggggcttatcattaatcaatagcggtaagagatcgacagccgattacagtcttgacaacgagcctgcgcaggctctgacctggcgggattcacgtgcttgggaagaacagtaccaatgggacgtggaggacatgaaggtcagtggcgtgcattggggatacgaggaaactaaaaccttccttgccattctgtctgagtcccctttctcggagaaactccggacgtgtcaccagaaccggcaggtttacagagccatcgccgaacagcttagagcccgcggcttcctacggaccctcgagcagtgtaggtatcgggtcaagaaccttctccgcaattaccggaaagcgaaatcctctcacccccccggtacgtgtccattctatgaagagttggaggcactggtgagggctcggaccgctatccgcgcaactgatggtccgggagaagcagtcgctctgcccagactgggttactctgatgctgagatggacgagcaggaagaggggggctgggaccccgaagagatggctgaggattgtaatggggccggtcttgtcaacgtggagagtacacagggtcccagaatagcgggggctcccgcattattccagagccgcattgccggcgtccactggggatacgaggagaccaaggctttcctagcgattcttagtgaatctccgttttccgagaagctgcgcacctgccaccagaattcacaggtttacagagcgatcgcggagcggctttgtgccctcggctttctccggaccctggagcagtgcagatatcgattcaagaatctgctccgatcttacagaaaagcaaaatcctcccatccaccgggcacctgtcccttctacgaggaactcgattcacttatgcgggctagggcagccgttagggccatgggaaccgttcgagaagccgcgggcctcccccgttgtggccagtccagcgcagagacagacgcgcaggaagcctggggcgaggtggctaatgaagatgccgtgaaaccttctactttgtgtccaaaagcccctgacatgggattcgagatgcgtcatgaggacgaagaccaaatatctgagcaagacatctttgagggactgcctggtgctctgagcaaatgtccaacggaggctgtgtgtcagcccctcgattggggagaggacagcgagaatgagaatgaagatgaggggcagtggggcaacccatcacaggagcaatggcaggaaagttcatcagaagaagacctagagaagctgatcgaccatcagggcctctatcttgccgaaaaaccctacaaatgcgatacctgtatgaaaagtttctccaggagttcgcatttcatcgctcaccagaggatccacacaggtgaaaagccatataaatgtctggagtgtggcaaaaacttctccgacaggtcaaatctgaacacccaccaacggattcatacgggagagaagccctacaagtgcctggaatgcggtaagtcattctctgatcactctaacctgattacccatcagaggattcatacgggggagaagccctacaagtgtggcgaatgctggaaaagcttcaatcaatccagcaacctgctgaagcaccagaggattcacctggggggcaatcccgatcagtgcagcgaacccggcggaaattttgcccagtcacctagtttcagcgctcattggcggaacagtaccgaggagaccgcccccgaacagccccagtctattagcaaagacctgaactcaccaggaccccactcaaccaattccggggaaaaactgtacgagtgcagtgagtgcggacgatcattttctaaatcctcagctctgatttcccatcaacgcatccatactggggagaagccttatgagtgtgcagagtgcggaaaaagttttagcaaatcaagtaccttagctaaccaccagaggacgcacactggagagaaaccctataaatgcgtggattgcggcaagtgcttcagcgagagatccaagctgattacacatcaaagagtgcacacaggtgagaaaccttataagtgcctcgagtgcgggaaatttttccgcgacagatctaacctgattacccaccagcgaatccacacaggcgagaaaccctacaaatgtagggagtgtggcaaatgtttcaaccagtctagcagtttaataatacatcagagaatccacacaggcgaaaaaccatacaagtgcaccgagtgcggaaaggactttaataacagtagtcatttctctgcccacaggagaacccacgctggcggtaaggctagctag

SEQ ID NO: 32021 - DNA, 2934 bp, Artificial Sequence
  Description of Artificial Sequence: Synthetic coding sequence
atggccatggcgttagagctccaggcgcaggcgagtccacagcctgagcccgaggagctgttgattgttaagctggaattactggttctggagcaattcctgactattctccctcgggaagttcaaacctgggttcaggccagacaccctgagtccggggaggaggccgtagctctcgtggaggactggcacagggaaacacgtactgctggacagtccgggcttgaattgcatacagaggaaaccaggcctctcaaaacaggagaagaagctcagagttttcagctgcagcctgtggacccctggccagagggacagagccagaagaagggggtcaagaacacctgtcctgatctacccaaccatctcaatgcagaagtggccccgcagcctttgaaggaatccgccgtactgactccccgtgtgcccacactgccaaagatggggagtgtaggggactgggaagtcactgctgagtcgcaagaagccttaggacctggcaagcacgctgagaaggaattatgcaaggatcctccgggcgatgactgtggaaattcggtctgcctcggggtgccagtctcaaaaccctcaaatacgtccgagaaggaacagggccccgaattctggggtctgagtttaatcaacagcggcaaacgcagcactgcagactattcactggataacgaacctgcccaagctctgacatggagagacagcagagcctgggaagagcaatatcagtgggacgtcgaagatatgaaggtgagtggggtgcattggggttatgaagaaaccaagactttcctagcaatcctgagcgagagccccttcagtgagaaactgcgtacttgccaccagaataggcaggtgtacagggccattgccgagcaactgcgggcccgcggtttcctacgaacgctagagcaatgccggtatcgcgtgaagaatttactgagaaactacagaaaggcaaagtcctcccatccaccagggacatgtcctttctatgaggagttggaggccctagttcgtgctcgcacggctatccgtgcgacagatggacccggggaagcagtcgctctgccacgacttggttacagcgatgcagaaatggatgagcaggaagaagggggctgggatcccgaggaaatggccgaggactgtaacggggcaggactggtcaatgtggagtctacacaaggccctcgcattgcaggggcccccgctctgttccaatcaaggatcgccggcgttcactggggatacgaggagactaaagccttcctggcaatcttatctgaaagccctttctctgagaagcttcgtacctgccatcagaattcgcaggtttacagagctatcgcggaacggctttgcgctctaggattcctaaggactctggaacagtgtcgctaccggtttaagaacctgctgcgatcttaccggaaagccaaatccagtcatcctcctgggacgtgtccgttctatgaagagctggattctctgatgcgcgcacgggccgccgtgagggcaatgggaacagtacgggaggccgccggcttgccgcgatgcggccagagctcagcagaaaccgacgcccaggaagcctggggcgaagtcgcaaatgaggacgcagttaagcccagcactctctgtcctaaagcccccgacatgggcttcgagatgcgacacgaggacgaggaccagatctcagagcaggacatctttgaaggattgcccggagcactgagcaagtgtcccaccgaagcggtctgccaacccttggactggggagaggatagcgaaaacgaaaacgaagacgagggccaatgggggaatccgtctcaggagcaatggcaggaatctagcagtgaggaggatctggaaaagttgatcgaccaccaaggcctgtatctcgcagagaagccttataagtgcgatacatgcatgaagtcgttttctcgatcttcccactttatcgctcaccagagaatacatactggcgagaagccgtataaatgtctggagtgcggaaagaacttctccgacagaagcaatctgaatactcatcagagaattcacacgggcgaaaaaccgtataagtgtctcgaatgcggtaagtccttttcagaccattcaaatctcatcactcaccagaggattcataccggcgaaaaaccttataaatgtggcgaatgctggaaaagcttcaaccagtcttcaaacttattgaaacatcagcggatccatttgggtgggaaccctgaccagtgcagtgaacctggcgggaacttcgcgcagtctccctccttctcagcccactggaggaattcaacagaggaaacggctccagagcagccgcagtccatctctaaagatcttaacagtcctgggcctcattctaccaatagcggtgaaaagctgtatgaatgttcggagtgtggacgcagcttttctaagtcttcggctctcatttcccatcagcgtatccacactggagagaagccatacgagtgcgccgagtgtggcaaatctttcagcaagagctcaacacttgccaaccaccagagaacccacacaggggaaaagccatacaagtgcgtggactgtgggaaatgcttcagtgagagatccaagttaatcacacaccagagagtgcacaccggtgaaaaaccctataaatgcctcgagtgtggcaagttcttcagggaccgtagcaatttaataacgcatcagcgaatccacactggcgaaaagccctacaagtgccgcgagtgtggaaagtgttttaatcagtctagcagcctcatcatccaccagcgtatacacaccggggagaagccctataagtgtaccgaatgtggaaaggactttaacaacagtagtcacttttccgcccatagaagaacccacgctggtggtaaggcgtcttag

SEQ ID NO: 32022 - DNA, 1284 bp, Artificial Sequence
  Description of Artificial Sequence: Synthetic coding sequence
atggctatggccctggagttacaagcccaggcgtcacctcagcctgaaccagaggagcttcttattgtaaaacttgaagaagacagttggggcagcgagagcaaattatgggagaaggaccggggttctgtgtccggccccgaggcttcccggcagcgcttcaggcaattccaataccgtgatgccgcaggcccacacgaggcattttcccagctgtgggccctgtgctgtaggtggctgagacctgaaatcagactgaaggaacagattctggaactgttagttctggagcagttcctgaccattctcccgagagaagtacaaacgtgggttcaggcacggcaccccgagtcaggtgaggaggccgtagccctggtggaggattggcaccgggaaacccggactgctggccagtccgggctcgagctgcacaccgaggagaccagaccccttaagacgggagaggaggcccagtcgtttcagttgcagcctgtggatccatggcccgaggggcaatctcagaagaaaggggtcaagaatacctgccctgatttaccgaaccacctgaatgccgaggttgccccacaacccttgaaggagagcggtgtacccgtgagcaagccctcaaatacatcagaaaaagaacagggacccgaattttggggacttagtttaatcaactccggaaagaggtctacggcagactacagtctggacaacgagcccgctcaagcgctcacctggcgggatagtagagcatgggaggagcagtaccagtgggacgtggaagatatgaaggtctctggcgtgcattggggatacgaagagacaaagaccttcctggcaatcctgagtgaaagtccctttagcgagaaacttcgaacgtgccaccaaaaccgtcaggtgtatcgtgccattgccgaacagctgcgcgctcgggggttcctacggacgttggaacaatgcaggtatcgtgtgaagaacttgctgcggaactacaggaaagcaaaaagttcacatccacccggcacttgtccattctatgaagaactggaagctttggtgcgggcgagaaccgcaattagagccactgacggcccaggcgaagcagtcgctctgccccgccttggctactcagatgcagagatggacgagcaggaggagggcggctgggaccctgaagaaatggctgaggactgtaacggcgcgggcctggtaaatgtggagtctacacaggggccacgtattgccggagcaccagctctctttcaaagcagaatttag

SEQ ID NO: 32023 - DNA, 1302 bp, Artificial Sequence
  Description of Artificial Sequence: Synthetic coding sequence
atggctatggccctcgagcttcaagcccaagcttctccccagccagaaccagaagaattactgatcgtgaaactcgaggaggattcttggggctctgaaagtaagttgtgggaaaaggatcgaggctctgtctcgggccctgaggccagtagacagcgcttcaggcaatttcaatatcgggatgcagctggccctcatgaggctttctcacagctctgggcgctgtgttgccgctggctgcgacctgagatccggttaaaagaacagatcctggagttgctggtattggagcagtttcttaccattctacctcgcgaggtacagacctgggtgcaagctcggcatcccgaaagcggggaggaggctgtcgccctggtggaagactggcatcgggaaacccgtaccgcaggccaatcagggctcgaactgcacactgaggaaactcgtcctctgaagaccggtgaggaggcacagtccttccagctacaaccagtggacccttggccagaaggccaaagtcaaaagaaaggggtgaagaatacctgtcccgatctccctaaccatctgaatgcagaagtggcacctcagcccttgaaagaaagcggcgtcccagtgagcaaacccagcaataccagcgagaaagaacagggacccgagttttggggactctccctcatcaactctggcaagcgctcgactgcggactattcccttgataacgagcctgcgcaggcattgacttggagggacagccgggcttgggaggaacagtaccagtgggacgttgaggacatgaaagtttccggcgtgcactggggctacgaggagaccaagacttttctggccattctatctgagtcacctttctcggaaaagttgcgaacctgtcatcaaaaccgtcaagtgtaccgagctatagccgaacagctgcgggcccgtggattcctccgcactctggagcagtgccgctacagggtaaagaatctgttgagaaactatagaaaggctaaatcttcacatcctccaggaacttgcccattttacgaggaattggaggcgcttgtgagggctcggacggcgattagggccacggacggccctggagaagcagtcgcactgcctaggctgggatactccgacgccgaaatggatgagcaggaagaggggggttgggaccccgaagagatggcggaagactgtaacggcgctggtctggtcaatgtcgaatccacacagggcccaaggatcgcgggagctcctgcactgttccagtcacgcatcggcaaaaatatgggagtgtag

SEQ ID NO: 32024 - DNA, 2934 bp, Artificial Sequence
  Description of Artificial Sequence: Synthetic coding sequence
atggctatggcactggaactgcaggcccaggctagcccacaacccgagcccgaagaattgttaattgtgaagcttgagctactggtgctggaacagttcctgaccatcctgcccagggaagtccagacctgggtgcaggctcggcatcccgaatctggggaagaggcagttgctcttgtggaggactggcacagagagactaggacggcggggcagtcagggctggagcttcacactgaggaaactcggcccctgaagaccggagaagaggcacagtcgttccagttgcagcccgtcgatccatggcctgaaggccagtcacagaagaaaggggtgaaaaatacctgtcccgacctaccaaatcatttaaacgccgaagtcgccccccaaccactcaaggagtccgctgtactgacccccagggtccccacactcccgaagatgggctctgtcggtgactgggaagtgactgcggagagccaggaagcgctggggcccggcaagcatgccgagaaggagttgtgcaaggatcctcccggcgacgactgtggcaattccgtatgcctgggtgtacccgtctcaaagccaagcaatacctccgaaaaggagcaaggaccagaattttggggcctttccctgatcaactccggaaagcgctctactgccgattattcattggataatgagcccgctcaggctctgacctggcgggattcaagagcatgggaagagcaatatcaatgggatgtcgaagacatgaaagtctccggtgtacactggggctatgaagagaccaaaacctttctggcgattttaagcgagtcaccctttagcgagaagctgagaacctgccaccagaatcgccaagtctatcgggctattgcagagcagctaagggccagggggtttctccgcactctcgagcaatgtcggtatagagttaaaaacttactgagaaactatagaaaggcaaaatcttcacaccctccaggcacatgtcctttttacgaagaactcgaggcccttgtgcgagccaggaccgcaatcagagcaaccgacgggccaggtgaggcagtcgctctcccaagactggggtactccgatgctgagatggacgagcaggaagaaggtggatgggatcccgaggagatggccgaagattgcaatggtgctggactggtgaacgtggagtcaactcaaggaccaagaattgccggcgcaccagccctgttccagagccgcatcgccggagtccactggggctacgaagagacgaaggcctttctggcgattctgtctgaaagcccattttccgaaaagctcagaacatgtcaccagaacagccaggtataccgagctatagctgagcgcctttgtgccctgggctttcttcgcacccttgagcagtgtcggtaccgtttcaagaaccttttgaggagttatcgaaaagccaagagttcgcaccccccgggcacctgtcccttttacgaagagctggacagcctgatgcgtgcacgagccgctgtgcgggcgatgggaacagtgcgcgaagcagcgggcctacctagatgtggacagagcagcgcagagacggacgcacaggaggcttggggcgaggtggcaaacgaggatgccgttaagcctagcaccctctgtcccaaggcacctgatatgggatttgagatgagacacgaagacgaagaccagatttcagaacaggacatctttgaggggcttccgggagccctcagcaaatgcccaaccgaagccgtctgccagccactggattggggagaggactctgagaacgagaatgaggatgaggggcagtggggcaacccctcccaggaacagtggcaggagtcctcatccgaggaagacctggaaaagctcattgaccaccagggactgtaccttgctgagaaaccttataagtgtgacacttgtatgaagtcattttccagaagtagtcattttatcgcccatcagcgcattcacactggcgagaagccatacaagtgcctggagtgcgggaaaaatttttcggaccgctccaacctgaacacccaccagcgtatccacaccggcgagaagccttacaagtgcttggagtgtggaaaatctttctcagatcactctaatctgataactcatcagcggattcatactggggagaaaccatacaagtgcggcgagtgctggaaatctttcaatcaatcttccaacctgctcaagcatcaacgcattcatttaggggggaaccccgatcaatgttcagaaccaggaggaaattttgcgcagagtccttctttcagtgcccactggaggaattcaactgaggagacagcccctgagcaacctcaaagcatatccaaagacctcaatagtcctgggcctcacagtacaaacagtggggagaagctctacgagtgttcagaatgcgggagatcgttctccaagtctagtgcgctcattagccaccaaagaattcacacaggagagaaaccatacgagtgtgctgagtgtggaaaatcattttctaaaagcagcaccctcgccaatcaccaacgtactcataccggcgagaagccatataagtgcgttgattgcgggaagtgcttcagcgaaagaagcaaactaataacacatcagcgagtgcacaccggagaaaagccttacaagtgcctggagtgcggaaagttctttcgcgataggagcaacctcatcacccatcagcgcatccacactggggaaaaaccctacaaatgtcgcgaatgtggcaaatgcttcaatcagtcctcctctttaatcattcaccaacggatacacactggggaaaaaccttataaatgcaccgagtgcggtaaggatttcaacaacagctctcacttttccgcgcataggcgaacccacgcaggcggcaaagcgtcttag

SEQ ID NO: 32025 - DNA, 1800 bp, Artificial Sequence
  Description of Artificial Sequence: Synthetic coding sequence
atgagcggcccatgcggcgagaaacccgtgctggaggctagcccaacgatgagcttgtgggagtttgaggattcacactctcggcaagggactcctagaccagggcaggaactcgcagctgaggaggcctccgccttagaactgcagatgaaggtcgatttctttcgcaaacttggttatagctccaccgaaatccattccgtactccagaagttgggcgtgcaggctgatacgaacactgtccttggtgagctcgtcaagcacggtactgcaactgaacgggagaggcagacttctccagatccatgcccccagctgcctctggttccccgcggaggggggaccccaaaagcgcctaacctagagccacctttgcccgaggaagagaaggagggtagcgacctgcgtcctgtagtcatcgatggaagtaacgtggccatgagtcacggcaacaaggaagtgtttagctgccgcggcatcctcttggcagtcaactggtttctagagcggggccacaccgatataactgtatttgttccaagttggaggaaggaacagccacgccccgacgtgcccattaccgatcaacacatccttcgcgagctcgaaaagaagaagatactggttttcaccccgtctcgtagggtgggcggaaagagagtagtgtgctatgatgacaggttcatcgtgaagctcgcctacgagtctgatggcatcgtcgtgagcaatgatacttatcgggacctgcagggcgagcggcaggagtggaaacgcttcatcgaagaacgactactgatgtactccttcgttaacgacaaattcatgccccctgatgatcccttaggaaggcatgggccctccctcgataacttcttgagaaagaagcctctgacattggagcatagaaagcagccctgcccatatggacgaaagtgcacttacggcataaagtgtagattcttccatccggagagaccttcttgcccacagaggtcagttgccgacgaactcagggcaaatgctctgctttcccccccgcgcgctccgtcgaaggataaaaacggaagaagacccagcccatcgtcacagtcttccagcctgcttacagaaagcgagcagtgctctctcgatggaaagaaactgggcgcgcaagcatccccagggagccgtcaggaaggtctgactcagacttatgcaccttctgggcgctcactggcccctagtggcggttccggctcaagttttggccccaccgactggctacctcagactctggattcgctaccttacgtttctcaggattgtctggacagcgggattgggtcactggagtcccaaatgtctgagctctggggggtgaggggaggtgggcccggggaacctggcccccctcgggccccttacacgggttacagcccatatggaagcgagttgcctgcgactgcagccttctcggcattcggaagggctatgggggccggccactttagcgtgcctgccgactacccgcctgcccctcccgccttccctcctagggaatactggtctgagccctacccgttacctccacctacctccgtgctccaggaaccccccgtacagagccccggagctggcaggagcccctggggcagggcaggaagcctggcaaaagaacaagcctcagtgtataccaaattgtgtggcgtgtttccaccacatctggtggaagccgtgatgggacggtttcctcagttgctggacccccagcagctggccgccgagatattatcctacaaatcacaacacccatctgagtag

SEQ ID NO: 32026 - DNA, 1800 bp, Artificial Sequence
  Description of Artificial Sequence: Synthetic coding sequence
atgtcagggccctgtggtgagaagcctgtacttgaagcgagtcccaccatgtctctgtgggaatttgaagatagccattccaggcaggggaccccacgccccggccaagagctcgcagccgaggaggcttctgctctcgaattacagatgaaggtcgatttctttcggaagttgggctacagttccactgagatacactccgtgctgcaaaagctgggtgtgcaggcagacacgaacaccgtattaggcgagctggttaagcacggcactgccacggaacgcgagaggcagacctcccctgatccctgcccccagctgcctttagtgcccaggggaggagggacccctaaggctcccaatctggaacccccacttcctgaagaagagaaagaaggcagcgacctccgtcctgttgtcatagacggtagcaacgtggccatgtctcatggcaataaggaggtgtttagctgcaggggcatcctcctcgcagtgaattggtttttagaacgcggccacacagacattacagtattcgttccaagttggcgaaaagagcagccccgccccgatgtgccaataactgaccagcatatcttaagagagctggagaagaagaaaatattggtgttcacgccgtcaagaagggtcgggggcaaacgagtggtatgttatgacgatcggtttatcgttaagctcgcctacgagagcgatggaattgtcgtctcaaatgacacatacagagatctgcagggcgagcgacaggaatggaagaggttcatcgaagaacggctactcatgtatagctttgttaatgataagttcatgcctccggacgacccactggggcgacacggcccttcattagataacttcctgagaaaaaaacccctgacactcgagcacagaaaacagccatgcccatacggacggaagtgtacttacgggatcaaatgtagatttttccacccagagaggccttcttgcccgcagcgaagcgtcgcggatgagttaagagccaacgctctgctcagcccgccacgtgctccgtccaaagacaagaacggccgccggccgagtccaagcagccaatcttccagcctcctgaccgaatccgagcaatgttcactcgacggtaaaaagctgggagcacaggccagcccaggtagccgacaggaggggttgacacaaacatatgcccctagcggtagatccttggccccctctggtggctcaggttcctccttcggccccactgattggcttccccagactttagattccctaccttacgtgagccaagactgcctagatagtggcataggatcccttgagagccagatgagcgagttatggggtgtgcggggcggcggtccaggcgagcccggccctccacgagctccctatacaggatatagcccatacgggtcagagttgcctgcgaccgcggccttcagtgcctttggcagggccatgggagccggccacttttcagtcccggctgattatccgccagcacctccagccttccctccaagagagtattggagtgagccttatcctcttcccccacctacctccgtactccaggaaccccctgtgcaaagtccgggggctgggcggagtccatgggggcgggccggatctctagccaaggagcaggctagcgtctacacaaagctgtgtggcgtgttcccgcctcacctggtcgaagcagttatgggccggtttcctcagctgctagatccacagcagctggcagccgaaatccttagttataagagtcagcatccctccgaatag

SEQ ID NO: 32027 - DNA, 1281 bp, Artificial Sequence
  Description of Artificial Sequence: Synthetic coding sequence
atgccaccaaagaagcaagctcaggctggcggcagtaagaaggcagagcagaaaaagaaagaaaaaatcattgaagataagaccttcgggctcaagaacaagaagggtgctaaacaacagaagtttattaaagcggtgacgcatcaggtgaagttcggtcagcaaaacccccgtcaagtcgcccagagcgaggcggaaaagaagttaaaaaaagatgacaagaaaaaggaactgcaggagttgaacgagctattcaaacccgtggtggccgcacagaaaataagcaaaggcgcagatcctaaatcagtggtttgcgccttttttaagcagggccaatgcacaaaaggcgacaaatgcaaattttcgcacgacctgacacttgagcgtaagtgcgagaaacggtccgtttatattgacgcgcgcgacgaagagctcgaaaaagacacaatggacaactgggacgagaagaagcttgaagaagtagtaaataaaaagcatggcgaggccgagaagaagaagcccaaaacccagatagtatgtaaacatttcttagaagccattgagaataataagtatggatggttttgggtgtgcccgggtggtggagacatctgtatgtaccggcatgctttgccacctggattcgttctgaagaaggataagaaaaaggaagaaaaggaggacgagatctcacttgaagacctgatagaaagggaaagatccgccctgggacctaatgtgactaaaataacgctggagtctttcctagcctggaagaaaagaaagcggcaggagaagatcgataaactcgaacaggacatggaaaggaggaaggccgactttaaggcaggtaaagcactagtgatttccggcagggaggtgttcgagtttaggccagaactggtcaacgacgatgacgaggaagccgatgacaccaggtacactcagggcactggtggcgatgaggtggatgacagtgtgagcgtgaatgatattgatctctctttatatattcctcgggatgtggacgagactggtattacagtggcttctttagaacgcttcagcacttatacgtccgacaaagacgagaataaactgtcggaggcatccggaggtagagcggaaaacggggagagatcagatctggaagaggacaacgaacgggagggaacagagaatggggccattgatgcagtcccagtggatgaaaacctttttactggagaggatctcgatgagctggaggaagagctgaataccctggacctggaggaatag

SEQ ID NO: 32028 - DNA, 1179 bp, Artificial Sequence
  Description of Artificial Sequence: Synthetic coding sequence
atgccgcctaaaaaacaagcccaggccggcggttctaaaaaagcggaacagaagaagaaagaaaaaattatcgaagataaaacctttggcttgaaaaacaaaaagggagccaaacaacagaagttcatcaaggctgttactcatcaggtgaaatttggacagcaaaatccacgccaggtcgcccagtccgaagccgagaaaaagctcaaaaaagatgataagaagaaggaactgcaggaactgaacgagttgttcaagcccgttgtggcggcccagaagattagtaaaggagcagatcccaaatccgtcgtctgcgcctttttcaaacaagggcagtgtactaagggcgacaaatgcaaattttcgcacgacctcaccctggagcggaagtgtgagaaacgatcggtgtatatcgatgcccgcgatgaagagttagagaaggatacaatggataactgggatgaaaaaaaactcgaggaagtggtcaataaaaaacacggcgaggccgagaaaaaaaagcctaaaacccaaattgtctgcaaacattttcttgaggcaattgaaaacaataagtacggctggttttgggtctgtcctgggggtggtgacatatgtatgtaccggcatgccctgcctccaggattcgtgctcaagaaggacaagaaaaaagaagagaaggaggacgagatctccctagaggatttgatcgagcgcgagaggtctgcccttggtccgaacgttaccaagatcacgttggaaagtttcctagcgtggaaaaaacgcaaacggcaggagaaaattgacaaactggaacaagatatggaaagacgtaaggccgattttaaggccgggaaggcattagtcatcagcgggcgcgaagtgtttgagttcaggcctgagttagttaacgatgacgacgaggaagcggatgacacacgatacacgcagggcaccggaggagacgaggtcgacgatagcgtgtcagtcaatgacattgatctgtctctgtacattccaagagacgtcgacgagacaggtattactgttgcgagcctggagagattctcgacatacacttccgacaaagatgagaacaagctgtcagaagcttccggagggagagcagaaaatggagagagaagcgaccttgaggaggacaatgagcggcacgttctctag

SEQ ID NO: 32029 - DNA, 489 bp, Artificial Sequence
  Description of Artificial Sequence: Synthetic coding sequence
atgtacaggcacgccctgccacccggtttcgtactcaagaaagataagaaaaaggaagaaaaagaagacgaaataagtttagaagatctgatcgagagggaaaggagtgccctgggacctaacgtgacaaagataacgctggagtcattcttggcctggaagaagcgcaaacgtcaggaaaaaatcgacaagctggagcaggacatggaacggaggaaagccgacttcaaagccggtaaggctttggtgatatcaggccgggaagtgtttgaatttagacccgagctggtgaatgacgacgatgaagaggctgacgacacaagatatacccagggcactggtggcgacgaagtcagaggttcattcgttccccaccttctgatgttaatcgaacggaacaacagaaaataccacaatatggtgaagtctcatcaacatcagtcccattccgcctgggtgcagatactgactcctactatggggaattag

SEQ ID NO: 32030 - DNA, 1269 bp, Artificial Sequence
  Description of Artificial Sequence: Synthetic coding sequence
atgtttcaaacagcctggagacaggagcctgtaacctttgaggacgtggcagtgtacttcacccagaacgaatgggcctctctcgactcagtgcagagagcactgtaccgggaggtgatgctggaaaattacgcgaatgtcgcctctcttgcattcccatttaccacgcctgtcttggtgagccaactcgaacagggcgagctgccctggggcctggatccatgggaaccaatgggccgggaggccctcaggggcatctgcccaggtgacgaagcccggactgagaaggagggattgacccctaaggaccacgtgtctaaagaaactgagtctttcaggctaatggtgggggggctgcctggtaacgtctctcagcatctcgacttcggatccagtctcgaacagccccagggacactggataatcaagacaaaatcaaaacggcgtcacttcactgacacatctgctagacatcacgaagcctacgaggttaagaatggggagaagttcgagaagttggggaaaaatataagcgtttccacacaactcacaactaaccagaccaatccctccggccagatttcttacgagtgtggacagtgcggtaggtacttcattcagatggctgattttcaccggcatgaaaaatgtcataccggcgagaaaagcttcgaatgtaaggagtgcggcaaatatttccggtacaattcattactaattcgtcaccaaattatccacactgggaagaaaccattcaagtgcaaagagtgcgggaaggggctgagtagtgacacagcattgattcaacaccaaaggatccatacaggagaaaaaccctatgaatgcaaggagtgtggcaaggcctttagttcatccagcgtgtttcttcaacaccagaggttccacaccggtgagaagctgtacgaatgcaacgaatgctggaagacgttttcctgcagttcctccttcacagtccatcagcggatgcataccggtgaaaagccctatgaatgtaaggagtgcggaaagcgactgtcttccaacaccgctttgacacagcaccagaggattcatacgggcgagaaaccttttgagtgcaaggagtgcgggaaagccttcaatcagaagatcaccctgattcagcaccagcgagttcatactggcgagaagccatacgaatgcaaggtctgcggcaaaacattctcatggtgtggcaggttcatattacaccagaaattgcacactcagaaaactccagtgcaggcctag

SEQ ID NO: 32031 - DNA, 354 bp, Artificial Sequence
  Description of Artificial Sequence: Synthetic coding sequence
atgtttcagaccgcctggaggcaggaacctgtgaccttcgaggacgtggccgtgtatttcacacaaaacgagtgggcctccttggattcagtgcagcgagccttataccgggaagtgatgctggaaaactacgccaatgtggcctcgcttgcctttccatttacaacgcccgtcctggtttcacagctggaacagggggagttaccttgggggttagacccttgggaacctatgggccgcgaggcacttcggggcatttgccccggggatgaggccagaaccgagaaagagggcttgacaccgaaggaccatgtctccaaggaaaccgaaagtttcaggttaatggtaggctag

SEQ ID NO: 32032 - DNA, 933 bp, Artificial Sequence
  Description of Artificial Sequence: Synthetic coding sequence
atgggcctatgcaagtgtccaaagagaaaagtgaccaacttattctgctttgagcaccgagttaatgtatgtgagcattgcctggttgctaaccatgctaagtgcatcgtccagtcctacctgcagtggctgcaggacagcgactataaccccaattgtcggctgtgtaacatcccacttgcctccagagagaccacccggctggtttgttacgacttatttcattgggcttgcctgaacgaacgcgccgcccagctccctaggaacacagcccctgcaggatatcaatgtcccagctgtaatggaccaatttttcctcccaccaatctggcaggcccagttgcctccgctctgcgtgaaaaactggcaactgttaattgggctagagcaggcctgggccttccactgattgatgaagtggtgtcacccgaacccgaaccactgaacacaagcgacttctcagattggtcttccttcaacgcctccagcacgcccggccctgaggaggtggatagcgccagcgcagctcccgccttctacagtcaggccccacgacctccggctagtccaggcagacctgaacagcacacagtgatacatatggggaacccagagcccctgacgcacgcacctagaaaggtgtacgacaccagggacgacgacaggacacccgggctccacggggactgtgatgacgataagtaccgtaggaggccggcgttgggctggttagccagactactcaggtcaagagccgggtccagaaagcggcctctgactctcttgcagcgggccggcctgctcttgcttctgggcttactcggctttcttgccctgctagcactgatgtcacggctcggtagggccgccgctgactcagatcccaatttggatcctcttatgaacccacacattcgagtagggcccagctag

SEQ ID NO: 32033 - DNA, 567 bp, Artificial Sequence
  Description of Artificial Sequence: Synthetic coding sequence
atgggactatgtaaatgcccaaaaagaaaggtgacaaacttgttttgcttcgaacacagagttaatgtgtgcgagcactgccttgtagcaaaccacgctaagtgcattgttcagagttacttgcagtggctccaagatagtgactataaccctaactgccgcctgtgcaacattccgctcgcctctagagaaaccaccaggcttgtgtgttacgacttgtttcactgggcttgtcttaacgagcgcgctgcccaactgccccgcaacactgcacctgccggctaccaatgcccgtcctgtaatggcccgatttttccgccgaccaacttggccggaccagttgcctccgccttgcgcgagaagcttgcgaccgtcaactgggctcgggctgggcttggactgcctctgatcgacgaagtggtgagtcccgagcccgaacccttgaacactagcgacttcagcgattggagcagcttcaatgccagctctaccccagggccagaagaagtggactctgcctccgccgctcctgccttctattcccaagcacctcgccctccagcctag

SEQ ID NO: 32034 - DNA, 624 bp, Artificial Sequence
  Description of Artificial Sequence: Synthetic coding sequence
atgggcctatgtaaatgtcccaagcgaaaggtgaccaacttgttctgcttcgagcatcgcgtcaatgtgtgtgaacactgcctggtcgccaaccacgcaaagtgcatcgtgcaatcttacctccagtggttgcaggatagcgactataatccaaactgtaggctgtgtaatatcccactggctagcagggagacgacacgtctggtctgctatgatttgtttcactgggcctgcctaaatgagagagctgctcagctcccacgaaacaccgcccctgcaggctaccagtgtccaagctgtaacggccccatatttccaccaacaaacctggcagggccagtcgctagcgctcttcgagagaaacttgcaaccgtcaattgggcccgagccggactgggactcccactgattgacgaagtggtgtcaccagaacctgaacccctgaatactagtgattttagcgattggagttcttttaatgccagctccaccccaggtccagaagaggtcgattcagcttcagccgcccctgctttctactctcaggctccccggccgcccgcctcaccaggccgtcccgagcagcatacagtcatacacatgggaaatcccgagcccctatag

SEQ ID NO: 32035 - DNA, 1458 bp, Artificial Sequence
  Description of Artificial Sequence: Synthetic coding sequence
atgtacaaaatgaatatttgcaataagccctctaataagaccgctccagaaaagtcggtctggaccgcacctgcacagccaagcggcccatcccctgagctacaggggcagagatccaggagaaacggttggtcatggcccccccatcccctgcaaatcgtcgcctggttactgtacctgttctttgccgtgattggatttggcattctggtgcctctcttgcctcaccactgggttccagcgggctacgcctgtatgggcgctatcttcgccggtcatttggtagtacacctcacggccgtgtcaattgaccctgccgacgctaatgtccgggacaagagctatgccggacccctaccgattttcaacaggtctcagcatgcccacgtgatcgaggacctccactgcaatttatgcaacgttgacgtatctgccaggtcaaaacattgctcagcatgcaacaaatgcgtctgtgggttcgaccaccattgtaagtggctgaataactgtgtcggggaaaggaattaccggctcttcctccacagcgtggccagtgcgttgctgggcgtgctacttctcgtgctggtagctacttacgtattcgtcgaattcttcgttaacccaatgcggctgagaaccaataggcactttgaggtgctgaaaaaccacacggacgtgtggttcgtctttctccccgcagctcctgtcgagactcaggcaccagctatcctagcactggccgcattgcttatcctcctcggcttgttgagtactgccttgctggggcatctgctgtgtttccacatctaccttatgtggcacaagctgactacttacgaatacatcgttcagcaccggcctccccaggaagctaagggagtccaccgagagctcgagtcttgccccccgaagatgcgtccaatacaggaaatggagttctatatgaggacgtttcgccatatgagaccagagccacctgggcaggctggccccgcagccgtaaacgcaaagcacagtagaccggctagcccggaccccacccccgggcggagagattgcgctgggccacctgtgcaggtggaatgggataggaagaaacctctcccttggcggtctccactcctgctgttggctatgtggggtccacaggcgcctccatgcctgtgcaggaagaggggacggggagcatgcatcaaatgcgaacgattacgtcctagaatccggaggaggggactcggcccacctgctgccgccccagccagacgtcgcataccaaggacacccgccctgtgtacaccactggccctgcctgctccaactaccagaaggcggcagtccccttggaccaggttccagtggaggaggcgcgcgtgggcagcccccttgtggccaccgcgaggagctggggctgatagtcccagatggcgaggtcgccgggtgaggcctccattctcctag

SEQ ID NO: 32036 - DNA, 1239 bp, Artificial Sequence
  Description of Artificial Sequence: Synthetic coding sequence
atggatacgcggtctggctctcagtgctcagtgactcccgaggcaatcttgaacaacgagaagctggttctgccgccacgtatctccagggtgaacggctggagtctaccactgcactatttccaggtggtcacttgggctgtctttgtgggcttgtcctctgcaacttttggaattttcatcccatttttgccgcacgcctggaaatatattgcctacgtggtgactggtgggatattcagttttcatctcgtggtccacctgatcgcttcatgcatcgaccccgctgattctaatgtgcggttgatgaagaactactcccagcctatgccccttttcgatcggtcaaagcacgcacacgtgatccaaaaccagttttgccacttgtgcaaggtgactgtgaataagaaaacaaagcattgcatttcctgcaataagtgcgtgtcaggcttcgaccatcactgtaagtggatcaacaactgtgtgggttcccgcaactactggttcttctttagcactgtggcaagcgcgaccgcaggaatgctctgcctcatcgctatcctgttatatgtcttggtgcagtacctggtgaacccgggtgtcctgagaaccgacccccgctacgaggacgtgaagaatatgaatacctggctcttatttctccccctatttcctgtccaggtgcagaccctaatagttgtgatcattggaatgctggtgctgctgttagattttcttggactggttcatttgggacagttgcttatctttcatatatatttgaaagcaaagaagatgaccaccttcgagtatctgattaataaccggaaggaggagtcatcaaaacaccaggcagtgagaaaggatccttacgtgcagatggacaagggtgtgctgcagcagggggcgggcgctctggggtcctcagcccagggagtgaaggccaagtcttctcttcttatccataagcacctttgccacttctgcacgtctgttaatcaagacggggacagcacagccagagaaggggatgaggacccttgcccgtctgctctgggggccaaggcccgcaattcgcgcctgatttgcagaaggctgtgccaattcagcacccgagtgcaccccgatggtgggtctatggctcaagaggccgatgacgctcctagcattagtaccttgggtctgcagcaggagactacagaaccaatgaaaacggatagcgcggagtctgaggattag

SEQ ID NO: 32037 - DNA, 1239 bp, Artificial Sequence
  Description of Artificial Sequence: Synthetic coding sequence
atggatacccgcagtggttcacagtgttcagtgacccccgaggcaatcttaaataatgagaagctggtcctgcctccaaggatatcgagagtcaacgggtggtctttgccactgcattactttcaagtggtcacatgggcggtgttcgtcggcttgtccagtgccaccttcggcatttttattccttttctgccccacgcttggaaatatatcgcttatgtggtgaccggaggaatcttttcctttcacctagtggtgcacttaattgcaagttgtatagatcctgccgacagcaatgtcagactgatgaaaaactatagtcaaccgatgcctttgttcgataggtccaaacacgctcacgttattcagaaccagttttgtcacctgtgcaaagtgacagtgaataagaaaaccaagcactgcatctcttgcaacaaatgtgtatctggatttgaccaccattgcaaatggattaacaactgtgtcggttctaggaattactggttcttcttctccaccgtggcctcggcaaccgccggcatgctgtgtcttatcgctattttgctgtacgtcctggttcagtacctggtgaatccaggcgtgctccggactgacccgaggtacgaagacgtgaagaatatgaatacctggttactgttcctcccgctttttcccgtgcaggtgcaaacactgatcgtggtgattatcgggatgttggtgcttttgttggacttcttgggtttagttcatctcggccaactcctgatcttccacatatacctaaaggccaagaagatgaccacttttgaatacttgattaataaccggaaggaggagagttcaaaacaccaagctgtccgcaaggacccctatgtgcagatggacaagggagtcttgcagcagggggcaggggccttaggctctagcgcccagggagtcaaagcgaaatcaagtctgttgatccacaaacatctgtgtcacttttgtacttcagtgaatcaagacggggacagcaccgctagggaaggggatgaagatccctgcccctccgcactcggcgcaaaggcgcgaaattctaggctcatttgcagaaggctgtgccagttcagtacccgcgtgcaccccgacggcggaagcatggctcaggaggcagacgacgcccccagcatctctacattaggcctgcagcaggagacaaccgagccaatgaaaaccgactctgccgagtctgaggactag

SEQ ID NO: 32038 - DNA, 804 bp, Artificial Sequence
  Description of Artificial Sequence: Synthetic coding sequence
atggccccatgggctctgttgtcccctggagtgctcgtgcgcacagggcacacagtgctgacctgggggattactctagtgcttttcctgcatgatacagaactacgtcaatgggaggagcaaggtgagttgctactgcctcttacctttttactcctggtgcttggcagcctgctcttatatctggccgtatccctgatggacccaggttacgtgaatgtccaaccacagccacaggaggagctcaaggaggagcagaccgccatggtgccacccgctatccccctgcgaagatgcagatactgcctggtcctacagcccctgcgcgccaggcattgtcgggaatgtcgtagatgcgtgcgaaggtacgatcatcactgtccttggatggagaattgcgttggtgaaaggaatcacccattattcgtcgtgtacttggcactacagcttgtggtgctgctgtggggactgtatttggcgtggtctggtctgaggtttttccagccatgggggcagtggcttcgaagctcaggtctgctgtttgcaacattcctgttgctcagtctgtttagtcttgttgcctcactactgctggtatcacacctttacctggtggcttctaataccacaacttgggagttcatctcatctcacagaatcgcctacctgcggcagagacccagtaatccctttgacaggggcctgacacgcaacctcgctcactttttctgtggatggcctagtggttcctgggagactctgtgggccgaggaagaggaggaggggtcgagcccggccgtgtag

SEQ ID NO: 32039 - DNA, 648 bp, Artificial Sequence
  Description of Artificial Sequence: Synthetic coding sequence
atggctccctgggccctcctgtctccaggagtcttagtgcgtaccgggcacactgtgttaacctggggaatcacactggttttgttcttgcacgatacagaactgaggcagtgggaggagcagggtgaactgctactccctcttaccttcctgttactcgttctgggctcattgctgctgtacctcgccgttagccttatggatcctggatacgtgaacgtccagccgcagcctcaggaggaattgaaagaggaacagaccgcgatggttcctcccgccattccattacgacggtgccggtactgtttagtgcttcagcccttaagagctcggcactgcagggaatgcaggcggtgtgtgagacggtacgaccaccactgtccttggatggagaattgcgtcggtgaacggaaccaccctctttttgtggtctatctagccctgcagttggtggtactgctgtggggactgtacctggcatggagtgggctgagattcttccaaccgtggggacagtggctccgctcctctgggctgctgtttgcgacttttctcctactttctcacttcttttgtggatggccctcgggcagctgggaaactttgtgggctgaggaagaggaggaagggagctctccggctgtgtag

SEQ ID NO: 32040 - DNA, 846 bp, Artificial Sequence
  Description of Artificial Sequence: Synthetic coding sequence
atggcaccatgggctctgttatcccccggcgtcctcgtgcggactgggcacacggtcctgacttggggaatcaccctcgttcttttcctccatgacaccggtgagcccgatccagaaagaccccgcacgcatcctataccccagctgcgccagtgggaggagcaaggcgagttacttctccctttaaccttcctgttgttagtcctgggcagtctcctcctgtaccttgcggtatccttgatggatcctggttatgtcaacgtgcagcctcaaccccaggaagaacttaaggaggaacaaacagctatggtgcccccagccatccccttgcggaggtgcagatattgccttgtgctccagccactgcgggctaggcattgcagagagtgtcggcggtgtgttcgcaggtatgaccaccactgtccatggatggagaactgtgtcggggagagaaaccacccactgttcgttgtctacctggctctgcaactcgtggtgttgctttggggactgtaccttgcgtggagtggattgcgattttttcagccgtgggggcaatggttgagaagttccggcttgctcttcgcgactttcctcttgctatccctcttttcgctggttgcgagtctgctactggtgtcacacctctatctggtggcgtccaacacaacaacgtgggagttcatctcaagtcacagaattgcttacttgcgccagagaccctccaacccgttcgaccggggtctgactcgcaaccttgctcactttttctgcggctggccttcaggatcttgggaaactctctgggccgaagaagaggaggaggggagcagcccagctgtctag

SEQ ID NO: 32041 - DNA, 648 bp, Artificial Sequence
  Description of Artificial Sequence: Synthetic coding sequence
atggccccatgggcacttctgtcgcctggcgtactggtgagaaccggccacactgtcctgacctggggcattactctcgtcctttttctgcacgacacagagctgcgtcagtgggaagagcagggtgagcttctccttcctcttactttcttgctcctggtgcttggctcactgcttctgtacctcgccgtttctcttatggaccctggctacgtgaatgttcaaccgcagccacaggaagaactcaaagaggagcagacagccatggtaccaccggcgatccctctaagaagatgccgttactgtctcgtattgcagccacttcgggcgagacactgccgcgagtgccgacggtgtgtacggagatacgatcaccactgcccatggatggaaaattgtgttggggagcgcaaccatcccctctttgttgtttacctggccttgcagttagtggttcttctttggggcctatatctggcgtggtcaggtctccggttcttccagccctggggccagtggctgcggtctagcggactgctgtttgctacatttctcctactctctcatttcttctgcgggtggcctagcgggtcatgggaaaccctgtgggccgaggaggaggaggaaggaagctcacctgcagtgtag

SEQ ID NO: 32042 - DNA, 633 bp, Artificial Sequence
  Description of Artificial Sequence: Synthetic coding sequence
atggctccatgggcgcttctatctcccggagtcttagtgcgcactggtcacactgtgctgacctggggtatcacactagtgctttttctgcacgacacagacaagtccgccgacgagctcctcgcgactcactcccactcatggaatcagcatctgcaggcattcgcccagcccgggacacactttcccacatcgaactgtaccccgactccacccacaccggtgttacctggccctgccagcctgtgcagccccgctagcccagagctcagacagtgggaggagcagggcgagttactgttaccattgacattcttattgcttgtgttgggcagcttattgctgtacttagctgtgagcctgatggaccccggctatgtgaatgtccagccccagccacaagaagagctgaaagaggaacagaccgctatggttccaccagcgattccgcttcggcggtgtcgctattgtcttgtgctgcaacctctgagggcacgccactgtcgggagtgcagacggtgtgtcaggaggtatgatcatcattgtccttggatggaaaactgtgtaggcgaaagaaatcatccactgtttgtggtctacctcgccctccagctggtggtattgctctggtag

SEQ ID NO: 32043 - DNA, 618 bp, Artificial Sequence
  Description of Artificial Sequence: Synthetic coding sequence
atggctccatgggcattgctgtccccaggtgttttagtgcgaaccggacacaccgtccttacttggggcatcaccctcgtgctgttcttacacgataccgagctccgccaatgggaggagcagggcgagctgcttctgccactgacctttttgctgttggttctgggcagcctcctgctttacctggcagttagccttatggacccaggatacgtcaatgtgcaaccgcagccccaggaagagctcaaagaagaacagactgctatggttcccccggcgatccctctgaggcgttgtagatactgcttggtgctccaacctctgcgagcccggcattgtagagagtgtcggaggtgcgtgcgcagatacgaccatcattgcccctggatggaaaactgcgtgggggaacggaaccatcctctcttcgtggtttacctggcgctgcaactggtcgttctgctttggggactttaccttgcctgcactaggcctctttcacccgcaccgcaagtcagaccccccgtactcccagccctgggtagtgtggtcgcagtccagagggctcccgtaaggcacttgccagcagccgtccctttactggtgggaggccagccgtag

SEQ ID NO: 32044 - DNA, 1467 bp, Artificial Sequence
  Description of Artificial Sequence: Synthetic coding sequence
atgcctccgggaggcggcggccctatgaaagactgtgagtatagccagatatccacccactcttcaagtccgatggaaagccctcataaaaaaaaaaaaatcgccgctcgtcgcaagtgggaggtgttccccggaaggaacaaattcttctgcaacgggcgcatcatgatggcacgccagaccggcgtgttctatctgacattggtgcttatcctggtgacatctgggctcttcttcgcctttgactgtccttacctggccgtgaagattacgcccgcaattccggcggtggcaggtattcttttcttctttgttatgggaacgctgctgcgaacgtctttctctgatccaggcgtcctgccacgagcaacaccagatgaggccgcagatctcgaaagacagatagatatcgctaacggcaccagcagtgggggctataggccccctccaaggacaaaggaggtgattatcaacggtcagacggtcaagcttaagtactgcttcacgtgcaagatatttcggccaccaagagcttctcactgtagtctctgcgacaactgtgtggagagatttgaccaccactgtccttgggtgggtaattgtgtggggaagcggaactacaggtttttttacatgttcatcctctccctctcatttttaaccgtttttatctttgctttcgtgataacacatgtcattctacggtctcagcaaactggatttctaaatgccctgaaggacagtcccgcctcggtgttggaagctgtagtgtgcttcttcagtgtgtggtcgattgtgggactgagtggattccacacgtatcttattagtagcaatcagacaaccaatgaagacatcaaggggtcatggagtaacaaacggggtaaagaaaactacaatccatatagttatggtaatatcttcacaaactgctgtgtggccctctgtggaccaatctctccttcgctcatcgatcgacgcgggtatattcagcctgacactccccagccggcggctccctccaatgggatcacaatgtatggagctacacagagccaaagtgatatgtgtgatcaggatcagtgtatacagtctaccaaattcgtgctgcaggcagctgctactcccctgctgcagtccgaaccttcacttacctcagacgaattacatctgcccggcaagccaggattgggtacaccctgtgcctctctcacactgggacctcctacacctccagcaagtatgcctaatctggccgaggcgacgctcgccgacgtgatgccgcggaaagacgagcatatggggcaccagttcctgacacccgatgaggcgcccagcccgccaaggttactggcagccgggtcacctcttgcccatagtcggactatgcacgtgttaggactcgcatcccaggactccctgcacgaagatagcgtgcgcggacttgtgaagctaagctctgtatag

SEQ ID NO: 32045 - DNA, 1422 bp, Artificial Sequence
  Description of Artificial Sequence: Synthetic coding sequence
atgccccctggtggcgggggccctatgaaagattgcgagtacagccaaattagcacccattcttcatccccaatggagtctcctcacaagaaaaaaaaaatagcggcccgaagaaaatgggaggtcttccctggcagaaacaaatttttttgcaacggccgaattatgatggcacgacaaactggagtcttctacctgacactggttctgattctggtcacttccggcctatttttcgcctttgattgtccctatttggctgtgaagataactcccgcaatccccgccgtggccgggattctatttttcttcgtcatggggacgctactgagaacatcattctcggatcccggagtcctacctcgcgcgacccccgatgaagccgcagatctcgaaaggcagatcgatattgcgaacggtacaagttcaggaggctataggccaccacctcgaaccaaagaagttattattaacgggcagacagtgaaactgaagtattgctttacatgcaagatctttagacctccgcgagcttcacattgtagtctgtgcgataattgcgtagaaaggtttgaccatcactgtccttgggttggcaactgcgtggggaaacgtaactataggtttttctacatgttcatactctcgctcagctttctgacggtctttatttttgcctttgttataacccatgtcattctcaggtcccagcagactgggttcctgaatgctttaaaagactcacctgcatctgtgctcgaggccgttgtctgctttttctccgtgtggtctatcgttggtctatcgggctttcatacctacctgatcagctccaatcagacaacaaatgaagatatcaagggatcttggagtaacaagagaggcaaagaaaactacaatccctactcatatggcaacatattcaccaattgttgcgtcgcattgtgtggcccaatatcaccgtctcttattgatagacggggctacattcagccagacactcctcaacccgccgccccgtccaacggaattacaatgtatggagccacccagtcacagagtgacatggccgcagctacccctttactgcagagtgagccttctctgacgagcgatgagttacacctaccagggaagccaggactgggtacaccatgcgcttctcttacactagggccacccaccccccctgcttctatgcccaatctggccgaagccacacttgcggacgtgatgcccaggaaggacgagcacatgggtcaccagtttcttacgccggacgaagcgccctccccccctcggttactggccgccggttctcccctggcacacagccgcacaatgcacgtcctgggcttggcttcccaggactccctccacgaggatagtgtgagaggactggtcaagttatcctcagtatag

SEQ ID NO: 32046 - DNA, 1479 bp, Artificial Sequence
  Description of Artificial Sequence: Synthetic coding sequence
gaggtggcaccagaggaagcaggtggcggagggcctatgaaggactgcgagtatagccagatctccactcatagttcttcccctatggaatctccccacaagaagaagaaaatagccgcccgccgtaagtgggaggtctttccaggcagaaacaagttcttttgtaatggccgcattatgatggcgcgacaaacaggggtgttttatctgacactggtgttgatactcgtcaccagcggcctgttctttgccttcgactgcccctatctcgccgttaaaatcactccagctatccccgcagtcgccgggatcctttttttttttgttatggggacgttactacgaacgagtttttctgaccctggcgtgcttcccagagcgacccctgatgaagcagccgatctagaacggcaaatcgatatcgcgaacggtacatcgtccggtggctaccgaccccccccgcgcacaaaagaagtaatcataaacggccagacggtaaagcttaaatactgcttcacgtgtaagattttccgcccaccacgagcctcacattgttcgctgtgcgataattgtgtagagcgcttcgatcaccattgcccttgggtgggtaattgcgttggcaaaaggaactacagattcttctatatgtttattctctcattgtctttcctgaccgttttcatttttgcttttgttatcacccatgtgatccttaggtcacagcagacggggttcttgaacgctctgaaagacagccctgcttctgttctggaagccgtggtttgtttctttagcgtatggagtatcgtggggttgagtggctttcatacctatcttatttcttcaaatcagacaacaaacgaagatattaaaggatcttggtccaacaagcgcggcaaagagaattataacccttactcctacggcaatatctttacaaactgttgtgtcgctctgtgtggccccatctctccatcgcttatagaccgcagggggtatatccaacctgacacacctcagccagccgccccgtctaacgggattactatgtacggcgctacccagagccaaagtgacatgtgcgatcaggatcagtgtatccagtctacaaagtttgttctgcaagccgcggcaacccctctgcttcaaagcgagccctcgctcactagcgatgaactgcacctgccggggaagccagggctgggaaccccttgtgcttctctgacccttggccccccaacgccaccagcctcaatgcctaacctggccgaggccactttagccgatgtcatgccccgcaaagatgaacacatgggccatcaattcctgacccccgatgaggcaccctcacctccaaggctgctggccgccgggagcccattagcgcacagcaggactatgcacgtgcttggcttagcctcccaggatagcctgcatgaggacagcgtgcgtggccttgtgaaattatcgtctgtgtag

SEQ ID NO: 32047 - DNA, 891 bp, Artificial Sequence
  Description of Artificial Sequence: Synthetic coding sequence
atgcgaggccagcgtagccttctactcgggcccgcgagactctgcttgaggctgctgctattgctgggatataggcgtaggtgcccccctttgctgcgaggactggtgcagcgctggcggtacgggaaagtgtgtctgaggagtttgctgtataatagttttggggggagcgacacagccgtagatgccgctttcgagcccgtgtactggctggtggacaacgtgattcgctggttcggcgttggtcgcaatgacatagcaacggttagcatctgtaaaaaatgcatctatcccaaacccgctcggacgcaccactgttctatctgtaaccgctgtgtgctcaaaatggaccaccactgcccctggcttaacaactgcgtgggccattataatcatcggtacttcttttctttctgcttttttatgacgctcggctgtgtctactgttcatacgggtcctgggaccttttccgcgaggcttacgccgctatcgagacctaccaccagacaccgccgccaacattttcctttcgggagagaatgacacataaatcactggtgtatctgtggtttctttgtagttcagtcgctctagcactcggcgccctcacagtatggcacgccgtgttgattagtaggggggagacctccattgaaagacatataaacaaaaaggagcgaagaagactccaggcaaagggcagggtgtttagaaatccgtacaactacggctgtctggataactggaaagttttcctgggcgtagataccggaaggcattggctgacaagggtgctgttgccatcctctcacttaccacacggcaacgggatgagctgggaacccccaccctgggtgacagcccatagtgcctctgtgatggccgtctag

SEQ ID NO: 32048 - DNA, 1086 bp, Artificial Sequence
  Description of Artificial Sequence: Synthetic coding sequence
atgaggggccagagatcgctcctactgggtcctgcccggctgtgcttgcgactgctgttgctccttggttatcgccgccgctgccccccactgctccgaggattggtccagagatggagatatggaaaggtgtgtttgaggtcgctattgtacaactcattcgggggcagcgacactgccgtggatgctgcctttgagcccgtgtactggctagtggataatgtcatccgatggttcggcgttgtttttgtcgtcctcgtgatagtattgacaggatcaattgtggcgatcgcctacctgtgcgtacttccacttattttgagaacatactctgttccccgcctgtgttggcatttcttttattcccactggaatcttattcttattgtattccactattatcaggccataactactcctcctgggtaccccccacagggccggaacgatatagctacagtttcgatttgcaaaaagtgtatttatcctaagccagcccgcacacaccattgctctatatgtaaccgctgcgttctgaagatggaccaccattgcccatggcttaacaattgtgtggggcactataatcaccggtattttttttcattctgtttctttatgacactaggctgcgtgtactgctcttatggatcttgggacctatttagagaggcatatgcggctatagaaacttatcatcaaactcctccccccaccttcagcttcagagagcgcatgactcataagagtttggtttatctttggttcctctgcagttccgtggcactcgcactaggcgcccttaccgtgtggcacgccgtgcttatttcccgaggggagacctcgatcgagcgacacattaataaaaaagagaggaggcgacttcaggcgaaaggccgcgtgtttagaaacccttacaactacgggtgcttagacaactggaaggtgttccttggtgtggacacggggcgccattggttgacaagagtgctgctgccttcttcccatctgccgcatggcaacggaatgtcctgggaaccccccccgtgggtaaccgcccactccgcaagcgtcatggccgtgtag

SEQ ID NO: 32049 - DNA, 1017 bp, Artificial Sequence
  Description of Artificial Sequence: Synthetic coding sequence
atgcgaggtcagaggagcctcctgctgggccctgcacgcctatgcttgagattactgctcttactcggatacaggagacgttgtcccccccttctgaggggcctggtccagagatggagatacggaaaggtatgcctgcgctccctgctgtataactctttcgggggcagcgatactgccgtggacgccgcttttgagcccgtatactggttagttgataacgtgattcgatggtttggggttgtctttgtggtgttagtgatagtactgaccggatccattgttgccatagcttacctgtgcgtgttaccgctcatcctcagaacttattctgtgcccagactgtgctggcatttcttttacagccattggaatctcattcttattgtctttcactactatcaggcaatcactacaccgcctgggtatccgccacaagggagaaatgatattgcaaccgtgtccatttgcaagaaatgcatctaccccaagccagccaggactcaccattgctccatttgcaacagctacggtagttgggatctgttccgggaggcatacgcagcaattgagaagatgaagcagctggataaaaacaagctccaggctgtcgctaaccagacttaccaccagactccacctcctactttcagtttccgggaaagaatgacacacaagtctctcgtttacctgtggtttctgtgcagttcagtggccctagctttgggcgctctgacagtttggcatgccgtgctgatcagtcgcggcgagacttccattgagcggcacatcaataaaaaggaacgtcgccgactgcaggcgaagggcagggtgttcaggaacccttataactacggatgtttggacaattggaaggtctttttgggcgttgacactggtcgccattggttgactcgcgtccttttaccctccagtcacttaccccacggcaacggaatgtcctgggagccacctccatgggtcacagctcactcagcttcagtgatggcagtatag

SEQ ID NO: 32050 - DNA, 1086 bp, Artificial Sequence
  Description of Artificial Sequence: Synthetic coding sequence
atgaggggacagagaagcctgctactcggtccagcacgcctgtgcctccggctcttgctgctactggggtaccgccgcagatgtcctcctctgctgcggggcctcgtccagagatggcggtacggaaaagtgtgcctccggtctcttctatacaacagtttcggtgggtcagacactgctgtagacgctgcctttgaacctgtatattggcttgtggataacgtgattaggtggttcggcgttgtgttcgtggttctggtaattgtgctcacgggttcaattgttgccatcgcttatctctgtgtgctgcccctgatactgcgcacttactcggtgcctaggctgtgctggcattttttttattcccactggaatcttattctcattgtattccactactaccaggccatcacaactcctccaggctaccctccccagggcaggaatgatatagctacagtctccatctgcaagaagtgtatctaccctaaacccgcccgtacgcatcattgtagcatttgcaatagatgtgtcctgaagatggaccatcactgcccatggctgaataactgcgtcggccactataatcaccgctactttttttctttctgcttcttcatgacgctcgggtgtgtttattgcagctacgggtcctgggacctgttccgggaggcctacgcagcaatcgagacctaccatcagactcctccacccacctttagcttccgcgagagaatgacacacaagtctcttgtttacctttggttcttgtgctcctcagttgcccttgccctcggagcccttacggtgtggcatgccgtgctcatttcccggggtgagacttccattgaacggcacatcaataaaaaagaacggaggcgactgcaggccaagggccgagtgttccggaacccgtataattatggctgtctggacaattggaaagtttttctgggagtagataccggacggcactggctcaccagagtcctgttgccttcttctcatctgccgcatggcaacggaatgtcttgggagcctccaccttgggtgactgcccactcagccagcgtgatggcggtgtag

SEQ ID NO: 32051 - DNA, 924 bp, Artificial Sequence
  Description of Artificial Sequence: Synthetic coding sequence
atgagagggcaaaggtctctgctgttaggcccggctcgcctgtgcctccgactgttactgctcctgggctaccgacggaggtgccccccgctgctccgaggcttagtacaacggtggcgatatggcaaagtgtgcctgcgctccctgctgtataacagcttcggcgggtccgatactgctgtggatgcagcttttgagcccgtttattggcttgtcgacaacgtgattcgctggtttggcgtggtcttcgtggtgttggtgatcgtgctcactggttccatcgttgccattgcatatctgtgtgttttacctctgatcctgaggacatattcagtaccccgactttgttggcactttttttattctcattggaatttgatactgatcgttttccactactaccaagcaattaccaccccacctggctaccccccacagggacgtaatgacattgccaccgttagcatttgcaaaaagtgcatctatccaaagcctgccagaactcaccactgttctatttgtaacagatgcgtacttaagatggatcaccattgtcatatcttaccgccagcactatccaaactgcccacgagtctgcgacccagctttctgtcgtcagttgcccttgctctgggggccctaacagtttggcacgctgtcctaatttcccgaggggagacctccatagagcgccacattaacaaaaaagaaaggcgcaggttacaggccaagggccgagtgttcagaaatccttacaactatgggtgtctagacaactggaaagtgttcctaggggtggataccggccggcattggttgactagggtgctacttcccagttctcacctgccccacggcaacgggatgtcatgggaaccccccccatgggtaaccgctcacagtgccagtgtgatggctgtgtag

SEQ ID NO: 32052 - DNA, 1134 bp, Artificial Sequence
  Description of Artificial Sequence: Synthetic coding sequence
atgagaggtcagcgctctctactgcttggccccgctcggttatgcttaagacttctgctgttgcttggataccggcgacgttgcccaccactactaaggggtctggtgcaacgctggagatatggaaaagtatgtctgaggagtctactttataactccttcggtgggtccgacaccgccgtggacgccgcctttgagcctgtttactggctggttgataatgtaatcaggtggttcggagtcgtatttgtcgtcctggtgattgtcttgaccggcagcatcgtggcaattgcctacctgtgtgtgctgccacttatcctcagaacatacagcgttccgagactgtgttggcactttttttacagtcattggaaccttattcttattgtgttccattactaccaggctatcactacacccccagggtatcctcctcagggtcgtaacgacattgcgacagtctctatttgcaagaaatgcatctacccaaaacctgctaggacgcatcactgctccatctgcaatcgctgtgtgttgaagatggaccaccattgcccctggctgaacaattgcgtaggacactacaaccacagatacttcttctccttttgttttttcatgaccctgggctgcgtgtattgtagctacggttcttgggacctgttcagagaggcatacgctgctatagaaaagatgaagcagctggataagaataaactgcaagcagtggccaatcaaacttatcatcagacacccccaccaacattttcctttcgggagcgaatgacacacaagtcgttggtctatctctggttcctctgttcttctgtggccctcgctctaggcgcactgacagtctggcacgcggttcttatctctagaggggaaactagtattgagcgccacattaacaagaaagaaagacggcggctccaagcgaaaggaagagtcttccgaaatccatataactacgggtgcctggacaactggaaggttttcctaggagtggataccggccggcactggctgactcgcgttctgctcccaagcagtcatctcccacacgggaacggcatgagctgggaaccccccccctgggttacagcacacagcgctagtgtgatggcggtgtag

SEQ ID NO: 32053 - DNA, 1134 bp, Artificial Sequence
  Description of Artificial Sequence: Synthetic coding sequence
atgcgcggccaacgaagccttctcctaggccctgctaggctgtgcctcaggctgctcctgctgctgggatacagacgtcgatgtccccctctgctgcgcggacttgtgcagcggtggagatatggaaaagtgtgtctgaggtctttgctgtacaactcctttggaggatctgatactgccgtggacgcagctttcgaacctgtgtactggctcgtggacaatgtcatccgatggtttggcgttgtgtttgtggtgttggtaatcgtgctgaccgggagcatcgtggcgatagcatatctatgtgtcctgccactgatattgagaacttatagcgtcccccgactatgttggcatttcttttactcgcattggaaccttatactgatcgtgtttcattattatcaggccattaccacccctcccggctatccgccgcagggaaggaacgacatcgccacagtgtctatctgtaagaaatgcatctaccccaaaccagccaggacacatcactgctccatatgcaatcggtgcgtgcttaagatggaccaccactgtccctggttgaacaattgcgtcggccactacaaccataggtactttttctctttttgtttctttatgactcttggctgcgtgtactgttcctacgggagctgggatttgttcagagaggcctacgctgcgatcgaaaaaatgaagcaacttgacaagaacaagctgcaagccgtggctaaccagacataccaccaaacaccaccacctaccttttctttccgagaacgcatgacccacaagtccctggtctacctgtggttcttatgtagctctgtggctcttgccctgggagcattgacagtgtggcatgcagtcctgattagtagaggagaaaccagcatcgagcgtcatatcaacaaaaaagagaggaggagactgcaggcgaaaggtagagtgttccggaacccctataactatggatgtcttgataactggaaggtgtttctgggtgtggacaccggacgacattggctcaccagggtgttgctcccttcaagccacctgcctcatgggaatgggatgtcctgggaaccacctccctgggtcaccgcccactccgcctccgtcatggcggtctag

SEQ ID NO: 32054 - DNA, 642 bp, Artificial Sequence
  Description of Artificial Sequence: Synthetic coding sequence
atgagaggacagagatccctgttactggggccggccagactttgtttacgtctcctgcttctcctgggataccgcagacgttgcccgcctttgctcagaggcctggtgcagcggtggagatacggaaaagtgtgcctccggtcactactgtataacagctttgggggttccgacaccgcagtggacgccgcgtttgagcctgtgtattggctggtcgacaatgtgattcgatggttcggtgtggtcttcgtcgtgctagtcatagtcctgaccggcagtatcgtagccatagcatatctatgcgtattgccccttattctgcgcacatactccgtcccgagattgtgctggcatttcttctatagccattggaatctgatactcattgtctttcattactatcaggccatcacgactcctccggggtaccctccccagggaagaaacgacatcgccacagtctccatctgcaaaaaatgcatctatccgaagccggccagaacccatcattgcagtatttgcaatagatgcgtcctcaagatggatcatcactgtccctggttgaataactgcgtgggacactacaatcaccgatatttttttagtttctgttttttcatgaccctcggttgtgtgtactag

SEQ ID NO: 32055 - DNA, 906 bp, Artificial Sequence
  Description of Artificial Sequence: Synthetic coding sequence
tgagcagtcgacgcggcttttgaaccggtgtattggcttgtggataatgtcattcggtggtttggggttgtcttcgtggtcttagtgatcgtgctaaccggtagcattgtggccattgcctacctgtgcgtgctgccactgatcctccggacttatagtgtcccccggctttgttggcattttttctacagtcactggaatctcatattgattgtttttcactactaccaggcaataactactccccctggttacccacctcaggggagaaatgatattgcaacagtgagcatatgtaaaaagtgtatttacccaaagcccgctcgtacgcaccactgctccatttgcaataggtgcgttctaaagatggatcatcattgcccgtggctcaacaattgcgtcggccactataatcatcggtattttttcagcttctgctttttcatgacccttggctgtgtctactgctcgtacggtagctgggacctgtttcgggaagcctatgccgccattgagaaaatgaagcagcttgataaaaacaaactgcaggccgttgccaatcagacctatcaccagaccccaccgcctaccttcagttttcgggaacgaatgacacataagtctctggtctacttgtggttcctctgtagccgcggggagaccagtatcgaacgccatatcaacaagaaagagaggagacgcctgcaggccaagggcagggtgtttcgcaatccttataactacggctgtctggataattggaaggtcttcctcggggtagacacaggacgacactggctgacgcgcgtgctgctgccctcctcacaccttcctcacggcaatgggatgagttgggagccacccccgtgggtcactgctcactcagcaagtgtgatggctgtgtag

SEQ ID NO: 32056 - DNA, 960 bp, Artificial Sequence
  Description of Artificial Sequence: Synthetic coding sequence
tgaaggagatgcccacctctgttacgaggcctcgtgcaaaggtggcgctacgggaaagtctgtctcagatccctcctgtataatagttttggcgggagtgacacggctgtggatgcagcatttgaacctgtctactggttggtggacaatgtaatacgatggttcggcgtcgtctttgtagtgctagtgattgtcctgacagggtctatcgttgctattgcttacttgtgtgtgcttcctctcatactccggacttatagtgtgccccggctgtgctggcatttcttctacagccattggaaccttattttgattgtgtttcactattaccaagccattaccacccctcccggataccctcctcaaggccgcaacgacatcgccactgtgtctatatgcaaaaagtgcatctaccctaagcccgcccgcacacatcactgcagtatctgcaatagatgcgttttaaaaatggatcatcattgcccttggctgaacaactgtgtcggccactataatcatagatacttcttctcattttgctttttcatgacactgggatgcgtgtattgcagctatggaagctgggacctgtttagagaggcctatgccgccattgagacgtatcaccagacacccccacctacattttcattcagagagcggatgacccataagtcgcttgtgtatctctggttcctttgcagccggggcgagaccagcatcgagcgccatataaacaaaaaggagcgacgccgccttcaggccaaggggcgcgtgttcagaaatccatacaactacgggtgtctcgacaattggaaggtctttctgggggtagacaccggcaggcactggctgacacgcgtgctgctgccatcctcacatttgccccacggcaatgggatgagctgggagccacctccatgggtgactgcccactctgcctcagtgatggctgtgtag

SEQ ID NO: 32057 - DNA, 729 bp, Artificial Sequence
  Description of Artificial Sequence: Synthetic coding sequence
atgaggggccagaggagcctactgctgggtccagcccggctttgcctgaggctgcttctgctgttagggtacagaaggcggtgcccgcctctgctgcgagggcttgtccaacgttggcggtacggaaaggtttgtctaagatctctcctgtacaacagcttcggaggctcagacaccgccgttgatgccgcctttgagcctgtgtactggctggtagataacgtgatccgatggtttggagtcggccggaatgacatcgccaccgtgtcgatatgtaagaagtgcatataccctaagcctgcacgtacacaccactgttcaatttgcaatcggtgcgtgctgaagatggatcaccactgcccctggctgaacaactgcgtgggccactataatcatcgatactttttctcgttctgttttttcatgacgttagggtgtgtatactgttcctatggcagttgggatctctttcgggaggcttatgcggcaatcgagaagatgaagcagcttgacaaaaacaagctgcaagccgtcgcaaatcagacttatcaccagacaccgccacccacattctctttccgagagaggatgacacacaagtctctagtgtatctttggttcctttgttcctcagtcgctctggcattgggggcactgacggtctggcacgcagtgctcatctcccggggagagacaagcatcgaaaggcacattaataaaaaagagtag

SEQ ID NO: 32058 - DNA, 1167 bp, Artificial Sequence
  Description of Artificial Sequence: Synthetic coding sequence
atgaaggattgcgaatatcagcagataagtcctggagcagcgccgctacccgcttcacctggggctcgcagacccggaccagctgccagtcccaccccaggcccaggacctgcacctcccgcggcaccagcacccccccgatggagctctagtgggtccggtagtggctccgggtcgggctctttgggaaggcggcctaggcgcaagtgggaagtcttccctggtcggaatcgattttattgtggtggacgcctcatgctcgctggtcatggaggggttttcgccctgaccctgctcctgatcctgactacaaccggcctgttcttcgtctttgactgcccatacctggcccgtaaacttactctggctattcctattattgctgctattcttttctttttcgttatgtcctgtttactccagaccagctttacagatcccgggatcctgccacgcgctacagtatgcgaagctgccgctctagaaaagcagatcgacaatacaggcagctctacatacagacctcctccccgtaccagagaagtcctcatcaacgggcagatggtgaagctgaagtattgctttacctgcaaaatgttcaggccccctcggactagccactgttctgtgtgtgataactgtgtggagcgatttgatcatcattgcccttgggtggggaattgcgttggacgtcgaaactaccgattcttttacgcctttatcttgagcttatcctttcttacagcgttcatctttgcctgtgtggtcacacacctgacgttgcgggcccagggaagcaattttctctccactttgaaggagacaccagccagcgtgcttgagctggtcatctgtttcttcagtatatggagtatcctgggcctgagcgggttccacacctacctcgttgccagcaatctcacaacaaacgaagacatcaagggctcttggtccagtaagcgaggcggagaggcgtccgtcaatccctattctcacaagtccatcattacaaactgctgcgccgttctctgtgggcctttgcctccttccctgattgatcgtagaggcttcgtgcagtcagataccgtgctgccttctccaatccgaagcgacgagcctgcatgtcgcgccaaacctgatgcgtcgatggtgggcgggcacccgtag

SEQ ID NO: 32059 - DNA, 930 bp, Artificial Sequence
  Description of Artificial Sequence: Synthetic coding sequence
atgactttgctaactgacgccaccccacttgttaaggagcctcacccactgccattagtgccaaggccctggttcctgccctcactctttgccgcattcaatgtagtgttgctcgttttcttcagcggcttattcttcgccttcccctgtcgctggctcgcacagaatggcgaatgggcctttcccgtcataactggctcgctatttgtcctgactttcttctccctcgtgtctctgaacttttcggatccgggcatcctgcaccagggttcagcagagcaggggcccctgaccgtccatgtggtgtgggtgaaccacggtgcctttcgtttacagtggtgtccaaagtgttgctttcaccgaccccctagaacatatcattgtccctggtgcaacatctgtgttgaagattttgatcaccactgcaagtgggtgaataactgcataggccaccggaacttccggttcttcatgcttctggtgctgtccctgtgcctgtactccggtgctatgctggtgacatgcctgatattcctcgtgcgcaccacacatcttccatttagcacagacaaggccattgctatcgtggttgctgtgtcagccgccggtttactcgttccattgtccctgcttctgctcattcaggccctatcggttagttctgccgatcgcacctataagggaaagtgtcgccacctgcaagggtacaatcccttcgatcaggggtgcgcctctaattggtaccttactatttgtgccccgctgggccctaagtatatggccgaagcagttcagctgcaaagagtggtgggacccgattggacaagcatgcctaatttgcatccacccatgagcccatctgctttgaatccacctgcccctaccagtggttcactacagagtcgagagggcaccccaggcgcatggtag

SEQ ID NO: 32060 - DNA, 1104 bp, Artificial Sequence
  Description of Artificial Sequence: Synthetic coding sequence
atggccccgagcggcccaggcagctcggcgagaaggagatgtagaagggtgctgtattggatccctgtggtctttattacgcttctgcttggctggtcatattacgcatatgctatacaactttgcattgtgtcgatggaaaacacaggggagcaggtggtgtgtctgatggcttaccacctgctgtttgccatgttcgtgtggtcgtactggaagactatcttcaccctgccaatgaatccctctaaggaattccacctgtcatacgcggagaaggatctgttggaacgggagcctaggggagaggcccaccaggaagtgctaaggagggccgcgaaagacctgcccatatacaccaggaccatgagcggcgccatcagatattgtgatcgatgtcaactcatcaaaccggatagatgtcatcactgctccgtttgcgataaatgcatactgaagatggatcatcactgtccatgggtcaataattgcgtcggattttccaattacaaattcttcctgctgtttttagcctactctcttctgtactgcctgtttatcgccgcgacagacttgcaatatttcataaagttttggaccaacgggctgccagacacccaggctaaattccatattatgtttctgtttttcgcagccgccatgttctccgtgtcgctctctagcttgtttggctaccattgctggctagtttccaaaaacaagtccactctggaagccttcagatctccagtcttcaggcacggcacagacaaaaacggcttctctttgggcttctcaaagaatatgaggcaagtgttcggagatgagaagaaatattggttgcttcctatattttcttcactcggggatggctgttccttcccaacttgcctggttaatcaggacccggagcaggctagtactcccgccggtctgaactctaccgcgaagaatttggagaaccaccagtttccggctaagcctctacgagagtcccagtcccatcttctcaccgatagccagtcttggactgaatcctctatcaatcccggtaaatgtaaggcaggcatgtctaacccagctctgacaatggagaacgagacatag

SEQ ID NO: 32061 - DNA, 963 bp, Artificial Sequence
  Description of Artificial Sequence: Synthetic coding sequence
atggctccgtggactctttggcgatgttgccagcgagtggtgggatgggtgcctgtgctgttcataacattcgtggtcgtgtggtcttactacgcttacgtcgtggaattgtgcgtgttcacaatattcggtaacgaggaaaatggaaagacagtggtgtaccttgtggccttccatctttttttcgtgatgtttgtctggtcatactggatgacgatcttcacttctcctgcaagcccttccaaggagttttatctgtctaacagcgaaaaagagcgttatgagaaggagttctcacaggagaggcagcaggaaattttaagacgagctgctagagctttgccaatctatacgacctctgcttccaagactatacgttattgcgaaaagtgccagctgatcaaaccagatagagctcatcattgtagtgcttgcgactcctgcatccttaagatggaccaccactgcccatgggtaaacaactgcgtgggtttcagcaactacaagttcttcctcctgtttctactttactcccttctctattgcttgtttgtggctgctaccgtattagagtactttatcaagttctggaccaatgaactcacggacacgcgtgctaagttccacgtgctgtttctgtttttcgtttctgcaatgtttttcatctctgtgctgtcgctgttctcataccactgctggttggttgggaaaaatcggacaacaatagaatcattcagggctcccactttttcctatggccccgacggcaacggattctcattgggatgctcaaagaactggagacaggtgttcggagacgagaaaaaatattggcttctacctattttcagctccctgggcgacggatgttcattccctaccagactggtcggaatggatccggagcaggctagtgtcaccaaccagaacgaatatgctagacggagtaagctgcagagatag

SEQ ID NO: 32062 - DNA, 1065 bp, Artificial Sequence
  Description of Artificial Sequence: Synthetic coding sequence
atggcaccttggacgctgtggaggtgctgccagagggtggtcgggtgggtgcctgtgctgtttatcactttcgtagtggtctggtcttactacgcatacgttgtcgaattgtgtgtgttcaccatctttgggaacgaagagaatggtaagaccgttgtctacctggtcgcgtttcatctattcttcgtcatgttcgtttggagctattggatgactatctttacttccccagcttctccatctaaagagttctacctcagtaacagcgaaaaagaacgctatgagaaggaattcagtcaagagaggcagcaggagatcctgcgacgggcagctcgagcgttgcctatctatacgacctcagcaagcaaaactattagatattgtgaaaagtgccagctgataaaacccgaccgtgcccaccattgtagtgcgtgtgactcctgtatactgaagatggaccaccactgcccctgggtgaacaattgcgttgggttctctaattacaaattcttcctgctgttcctgttatactcccttctgtattgcttgttcgtcgcagctaccgtgctggagtattttattaagttctggactaacgagctgacagatacccgggcaaagtttcacgtcttgttcttgttcttcgtcagcgctatgtttttcatttctgtgttgagcctattctcttaccattgctggctcgtggggaaaaatcgaaccacaattgagtcctttcgggctcccaccttttcctacggcccggatggaaacggctttagcttaggctgcagtaaaaactggcgtcaggtattcggagatgaaaagaagtactggctactgcctatcttttcatcattgggagacggctgcagcttcccaacccgacttgtaggaatggatcccgagcaggcctccgtaactaaccagaacgagtatgcccggagcggatctaatcaaccttttccaatcaaaccgctgtccgagagtaagaataggctgctcgattccgagagtcagtggctcgaaaacggggctgaggaagggatcgtcaagtctggcgtctag

SEQ ID NO: 32063 - DNA, 1098 bp, Artificial Sequence
  Description of Artificial Sequence: Synthetic coding sequence
atggctccatggacactgtggcgatgttgtcaaagagtggtcgggtgggttccagtcttgttcattacctttgtcgtggtctggagttattatgcttacgtagtggagctgtgcgtttttactatcttcggcaatgaagaaaacggaaagacagtggtttatctggtagcttttcacctgttcttcgtcatgttcgtctggagctactggatgaccatcttcaccagcccggccagcccaagcaaggaattctacctgtcgaactcggagaaggagaggtatgagaaagaattttcacaggagcggcagcaggagatactccgacgggccgccagggctctgcctatctatacaactagcgccagcaaaacaataagatactgtgagaaatgtcagctcataaagcctgacagggcgcatcattgtagtgcgtgcgatagttgcattcttaagatggaccatcactgcccgtgggtgaataactgtgtgggattcagcaactacaagttcttccttctcttccttctatacagccttctgtactgcctttttgtggctgcaacagtgctggagtatttcatcaaattctggacaaacgagctgacggacactcgtgctaaatttcacgtgctcttcttatttttcgtctccgctatgttcttcatctctgtgctgagcctgttctcataccactgctggcttgtcggaaagaataggaccaccatcgagtccttccgggctcccactttttcgtacgggccagacggcaacggcttttctcttggctgttccaaaaattggcgtcaggtcttcggggatgaaaagaagtattggttgctccccatatttagtagcctaggcgatggttgttcattccccactcgcctcgttggcatggatcctgaacaggccagcgtcacgaaccaaaacgaatacgcacgcagctccggaagtaaccaaccctttccaatcaagcccctgtctgagtccaagaatcgcctgcttgacagtgagtctcagtggcttgagaacggcgcagaagaggggatcgtcaaatccggtacaaacaaccacgtgaccgtcgcaattgaaaactag

SEQ ID NO: 32064 - DNA, 1098 bp, Artificial Sequence
  Description of Artificial Sequence: Synthetic coding sequence
atggcaccctggactctgtggaggtgttgccagcgcgtggtcggctgggttccagtgctcttcattacttttgtcgtcgtatggagttattacgcttacgtggtggaactgtgtgtcttcacaatattcgggaacgaagaaaacgggaagactgtggtttatctggtagccttccatttattcttcgtcatgtttgtctggagctactggatgacgatcttcactagtcccgccagcccatccaaagagttttacctcagcaacagcgaaaaggaacgatatgagaaggaattctctcaagaaaggcagcaggaaatactgcgcagagcagcccgcgcacttccaatttacaccaccagtgcttcgaagacaatccggtactgcgagaagtgtcagctaatcaaacctgaccgggcgcaccattgttccgcctgtgattcatgcattttgaaaatggaccatcactgcccctgggtgaataattgcgtagggttttcgaactacaaattttttttgctgtttctcttgtatagcttactgtactgcctctttgtcgcagctacggtacttgaatatttcataaaattttggaccaatgaactaaccgacacccgcgccaagttccacgttctgttcctcttcttcgtgtcagcaatgttctttatctccgtgttgtcactgttcagctaccattgctggctggtcgggaaaaataggacaaccatcgaaagcttcagggcaccaacattttcttacggtccagacggcaacggcttcagtctggggtgcagtaagaattggcgacaagtgtttggagatgagaagaaatactggctcctgcctatattttcgagcttgggtgacggctgttcctttccgacccggctcgtcggtatggaccccgagcaggcgtccgtgacgaaccagaacgagtacgcgcgcagttcgggtagtaatcaaccttttcccattaaacctctctccgagtcaaagaataggctgctggatagtgagtcccagtggttggagaatggggctgaagaagggatagtgaagagcggtacaaacaaccacgtgaccgtcgccatcgagaattag

SEQ ID NO: 32065 - DNA, 393 bp, Artificial Sequence
  Description of Artificial Sequence: Synthetic coding sequence
atggctccgtggacactgtggcggtgctgccagcgagtggtaggctgggtacctgtcctttttattacgttcgtggtcgtctggagctattacgcctacgtggtggaattatgcgtgtttacaatctttggaaacgaggagaacggcaaaacagtcgtgtatctggtcgcctttcacctgttctttgtgatgtttgtttggagctattggatgaccatatttaccagtccagcaagtcccagcaaagagttctacttgtctaatagcgagaaggaaaggtacgaaaaggagtttagtcaagagcggcagcaagagatcttacgccgagccgcccgggccctccctatctatacaactagcgcaagtaagagcctaatgcagtccacaaaatag

SEQ ID NO: 32066 - DNA, 879 bp, Artificial Sequence
  Description of Artificial Sequence: Synthetic coding sequence
atgtttgtgtggagttattggatgactatttttacctctccagcctcacctagcaaagaattctatctgtccaatagcgaaaaagagaggtacgaaaaggagttctcacaagagcgacagcaagagatactgagaagggcggctagggcacttccaatttatacgacttctgcgagtaaaaccatacgctattgtgagaagtgccagctcattaagccagatagggcgcaccactgttcagcctgtgactcatgcatcctgaagatggatcaccactgtccctgggtcaacaattgtgttggattctcaaattataagtttttcctactcttcctactgtactccttgttgtactgcctgttcgtcgctgcaacagtcctagagtacttcatcaagttctggacgaacgaactcacagatacccgggctaaattccacgtgctctttttattctttgtgagtgctatgtttttcatatccgtgctatctctgttttcctatcactgctggctcgtggggaagaatcgcaccaccattgaaagcttccgagcccctaccttttcttacggaccagatgggaatgggttttcactggggtgctcaaaaaactggaggcaggtgttcggagatgaaaagaagtactggttattgcctattttcagcagtctcggggacggatgctcttttccgaccagactggtgggtatggaccctgaacaggctagcgtcacaaatcagaacgagtacgcccggtcaagcggttcaaaccagccatttcccattaagccattgtccgagtcaaagaaccggctgctggactccgagtcccagtggctggaaaacggggccgaggaagggattgtcaagtctggggtgtag

SEQ ID NO: 32067 - DNA, 798 bp, Artificial Sequence
  Description of Artificial Sequence: Synthetic coding sequence
atgggactgcgaattcatttcgtggtggacccacacggatggtgttgtatgggcctgattgtgttcgtgtggctttataacatcgtgctcattcccaaaatcgtgctcttcccccattacgaagaagggcacattccaggaattctgataatcattttctacggcatcagcattttttgccttgttgccctcgttagagcgagcatcaccgaccccgggcggttgccagagaacccaaaaatccctcacggtgagcgggagttttgggagttgtgtaacaaatgtaatctgatgcgtccaaaaaggtctcaccactgtagcagatgtgggcattgcgtcaggcgcatggaccaccattgtccctggatcaataactgcgtaggcgaggataaccattggctgtttctgcagctgtgcttctacaccgagctcctcacgtgctacgctctcatgttctcattttgtcactattattacttccttcctctgaagaagcgtaacctagacctgttcgttttccgacatgaactggcgattatgaggttggccgcctttatggggattactatgttggtgggaatcactggtctgttctatacacaactcatagggatcatcaccgacaccacttctattgagaaaatgagcaactgttgcgaagacatcagccgccctcgaaaaccctggcagcagacatttagcgaagtgtttggcacaagatggaaaatcctctggtttattcccttccgccagagacaacccctccgcgttccataccatttcgctaaccatgtttag

SEQ ID NO: 32068 - DNA, 792 bp, Artificial Sequence
  Description of Artificial Sequence: Synthetic coding sequence
atgctcgctttgaggctgttaaatgtagtggcccctgcctattttttgtgtatcagcctggtgaccttcgtcctgcagcttttcctttttctgccctcaatgcgcgaggaccctgcagccgcgcggttgttttctcccgcactcttgcacggagcactcttcctgtttttgtcagctaacgcactggggaattatgtgcttgttattcagaactcccctgacgacctgggggcatgccaaggagcatccgcacgaaaaactccttgcccgagtccctcaacacacttttgccgggtgtgtgcacgagtgaccttaagacatgatcatcattgcttctttaccggcaattgcattgggagcagaaacatgcgaaattttgtgctgttctgcctgtatacgagccttgcgtgcctgtactccatggtcgcaggggtggcatacatttccgcagttctgtctattagctttgcacaccccctagcttttctgaccctactgcccacgtcgataagccagttctttagcggcgcagtacttggttccgagatgtttgtcatcctcatgttgtatttgtggtttgccatcggtctggcctgtgcgggcttctgttgtcaccaacttcttcttatcttgcgggggcagacaagacaccaggtcagaaagggggtggctgtgcgcgcacggccatggaggaagaacttgcaggaagtgtttggcaagagatggctgcttggcctgctcgtaccgatgtttaacgttggatcagagtcatctaaacagcaggacaagtag

SEQ ID NO: 32069 - DNA, 126 bp, Artificial Sequence
  Description of Artificial Sequence: Synthetic coding sequence
atgctggccctgcgattactcaacgtggtggctccagcatacttcctttgtatcagtttggtgacgtttgtgttgcagcttttcctgttccttcctagtatgcgggaagatcctgccgccgcatag

SEQ ID NO: 32070 - DNA, 330 bp, Artificial Sequence
  Description of Artificial Sequence: Synthetic coding sequence
atgttggctcttcgactgctgaacgtggtggcacccgcttatttcctttgcatatccctggtgacatttgtgcttcagctgtttttgtttctccctagcatgcgtgaagatcccgctgccgccaggctcttctcgcctgcactactgcacggggccctcttcctctttctgtccgctaacgccttgggaaactatgttttagtaatccaaaactcccccgacgacctgggggcgtgtcagggggctagcgcgcggaaaactccatgccctagcccttccactcacttctgccgggtgtgcgcccgagtgaccctgcgacacgatcactag

SEQ ID NO: 32071 - DNA, 1230 bp, Artificial Sequence
  Description of Artificial Sequence: Synthetic coding sequence
atgacgcagaagggtagcatgaaacctgtgaaaaaaaagaagacagaggagccagagcttgagcccctgtgctgctgcgagtatatagaccggaacggcgagaagaaccacgtggcaacttgcctgtgtgactgtcaggatttagacgagggctgtgatagatggatcacatgcaagagcctgcagccagaaacttgtgaaaggatcatggacaccatcagcgatcggctgaggatcccctggttacggggtgccaagaaggtcaatatctcaatcatcccgccccttgtgttgctgcccgtgtttttgcacgtagcgtcctggcactttctcctcggcgtagtggttcttactagcctgccagtcttggcgctatggtattattacctgacacatcgaaggaaggagcaaacactcttcttcctctcacttggtcttttttcactggggtacatgtattacgtctttttgcaggaagtcgtaccaaagggccgggtgggaccagtccagctggctgtattaacttgtggactgttcctgatcctgctcgccctccatcgtgctaagaagaatcctgggtacctatccaatcctgcttccggcgacagaagcctgtcgagctcccaactggaatgcctcagccgcaagggtcaagagaaaacaaagggctttcctggcgctgacatgtctggcagcttgaacaatcgcacaactaaggatgatcccaaggggagttctaaaatgccagcgggatctcccactaaggctaaggaagactggtgtgcgaaatgccagttagtgaggccagccagagcatggcactgccgcatctgtgggatttgcgtaaggcggatggatcatcattgtgtatggataaactcatgcgtgggggaatccaaccaccaagctttcatcctagctcttctgatttttctactgaccagtgtgtatggcatcactttaactctcgatactatttgtcgcgaccgcagcgtttttaccgcactcttctactgtccaggggtctacgcaaactacagttccgccctgtcattcacatgcgtttggtacagtgtcattattaccgccggtatggcatacatttttctgattcagctcattaatatctcttataatgtcactgaaagagaagtgcagcaggctctccggcaaaagacaggtcgaagactcctatgcggactcattgtggatactggactcctgggctag

SEQ ID NO: 32072 - DNA, 447 bp, Artificial Sequence
  Description of Artificial Sequence: Synthetic coding sequence
atgacccaaaagggctcaatgaaacccgttaaaaaaaagaaaacagaggagccagaactcgagccactctgttgctgtgaatatatcgatagaaatggcgagaaaaatcatgtggccacatgcttatgcgattgtcaggatttagatgagggatgcgacagatggatcacctgtaagagcctgcagccagaaacttgcgagcgaatcatggacacgatcagcgacaggctgagaatcccttggcttagaggggcaaaaaaagtcaatatctccattattccccccctcgtgctcttacctgtttttctgcacgtggcatcatggcattttctgctgggcgtagtggtgttaacgagtctgccggtacttgctctctggtattactacctcacccaccgtagaaaggaacagaccctgttttttctttctctgggattgttttcctag

SEQ ID NO: 32073 - DNA, 855 bp, Artificial Sequence
  Description of Artificial Sequence: Synthetic coding sequence
atggggcagccctgggcagctggctctactgatggagccccagctcaattaccattggtgttgactgctttatgggctgccgccgtcgggcttgagctcgcttatgtgctcgtgctaggcccaggcccaccccctctgggtcccctggctcgagctctccaactggcactcgctgccttccagctcctcaacctgctcggaaacgtgggactgtttcttcggagtgatcccagtataaggggcgtcatgctggctgggagagggctgggtcagggttgggcttattgttatcagtgccagagccaagttcccccacgatccgggcactgctcagcctgccgagtgtgcatactcagacgcgaccatcattgcagacttctagggcgttgcgtgggcttcgggaattatcgcccctttctttgtctgctgttgcacgcagccggagtgctgctgcacgtgagcgtgctgttagggcccgccctctctgccctgctccgtgctcatacccctctgcatatggcagcattgctcttgctgccctggctgatgctgctcactggccgcgtctccttggctcagtttgctctggcctttgttacagatacttgtgtggccggcgcactgctgtgcggggccgggttgctgttccacgggatgctgctgttgcgggggcagaccacctgggaatgggctagaggacaacacagctatgatctgggcccctgccacaatctgcaagcagccctgggaccaagatgggccttggtctggctgtggcccttcctggcaagtcctctgcccggcgacgggatcacgttccagacaactgccgacgtaggccacacagcctcctag

SEQ ID NO: 32074 - DNA, 984 bp, Artificial Sequence
  Description of Artificial Sequence: Synthetic coding sequence
atgatgctcatcccaacccaccacttcagaaatattgaaaggaagcccgaatatctgcaacctgaaaagtgtgtgcccccgccgtacccaggcccagtgggaacaatgtggtttattagggacggctgtggaattgcctgcgcaatcgtaacatggtttctggtgctgtacgctgaatttgtggtgcttttcgtgatgctgataccatcccgggattacgtgtactccatcatcaatggcattgtcttcaaccttttggcctttctggctctggcatcgcactgcagggctatgctgaccgatcctggcgctgttcccaaggggaacgcgactaaggagtttatcgaatcccttcaacttaagccaggccaagtggtgtataaatgtcctaagtgctgttccatcaaaccagaccgcgcgcatcattgcagtgtgtgtaaacgttgcattcgcaaaatggaccatcactgtccctgggtgaacaattgtgtcggtgagaataaccaaaagtatttcgttctgtttactatgtacatcgccctcatctccttgcatgccctgatcatggttggtttccactttctgcattgtttcgaagaggactggaccacctatggactgaatcgtgaggagatggcagaaaccgggatctcactgcatgaaaaaatgcagcctcttaattttagctcaactgagtgcagctccttcagtcctcccactacagtcattcttctgattctgctttgcttcgaggggctgctgtttctgatctttacgtctgttatgttcggcactcaggtgcactccatatgcacagacgagaccggcatcgagcagctgaaaaaggaagaacgccgatgggccaaaaagaccaaatggatgaatatgaaggcagttttcggacatccgtttagccttgggtgggcatcgcctttcgccaccccagatcaaggaaaggctgacccttaccagtatgtggtctag

SEQ ID NO: 32075 - DNA, 588 bp, Artificial Sequence
  Description of Artificial Sequence: Synthetic coding sequence
attaagcccgatcgcgctcaccattgtagtgtgtgcaagaggtgcattcgtaaaatggatcatcactgtccctgggtgaacaactgcgtaggagagaacaatcaaaagtatttcgtgctgtttacaatgtacattgcactgattagcctgcacgcgctgatcatggtcggctttcacttcttgcattgctttgaggaggattggactaaatgtagctctttctcaccccctacaactgtgatactgctgatactcctctgtttcgaaggacttttatttttgatctttacatctgtgatgtttggcacccaggtgcattcaatttgtaccgacgaaaccggtattgaaagactgaaaagaaaaaaccagcctagggagcatatgggttcatggcagtcggtgaaagagacatttggaggggacttcagcttgaattggtttaacccctttagccgcccatgccagcccgagatcccatctgataaggacatggtcagacaagtaacttccctaagcgatacagaaacaatggaggatcccagtgaagaaacgaaggatgaagactccgttgaggtgaccgacgaatag

SEQ ID NO: 32076 - DNA, 900 bp, Artificial Sequence
  Description of Artificial Sequence: Synthetic coding sequence
atgatgcttatacctacccatcactttagaaacatcgagaggaaaccagaataccttcagccagagaagtgtgtgcctccaccgtatcccggacccgtcgggactatgtggttcattcgagatggatgtggcatagcctgtgctatagtaacatggtttttggttttatacgcagagttcgtggtactcttcgtgatgctgattcccagccgggattacgtgtactctatcattaacggaatagttttcaatctactggcctttttggcactggcatctcactgtcgtgcaatgcttacggaccccggcgctgttccaaaaggaaacgcaaccaaggaattcattgaatctctgcaacttaaacctgggcaggtcgtgtacaaatgcccaaaatgctgtagcattaagcctgatcgtgcccatcattgcagtgtatgtaaaagatgtattcggaagatggatcaccattgtccctgggttaataactgcgtaggcgaaaacaaccagaagtattttgtgctgttcaccatgtatattgcactaatctccctgcatgccttaatcatggttggcttccacttcctgcactgctttgaggaagattggaccaagtgtagctccttttccccacctactactgttattcttctcatattgctgtgcttcgagggactactgtttctgatcttcaccagtgtcatgtttggaactcaggtgcactcgatctgtacggacgagaccgggatcgagcagttaaaaaaagaggaacgccgctgggcgaagaagacaaagtggatgaacatgaaggcagttttcggccatcccttttctcttgggtgggccagcccctttgctactccggatcagggtaaggccgacccataccagtacgttgtctag

SEQ ID NO: 32077 - DNA, 1035 bp, Artificial Sequence
  Description of Artificial Sequence: Synthetic coding sequence
atggattttctggtcttgttcctgttttacttggcatcagtgctgatgggattggtgctcatttgtgtgtgctctaaaactcacagtcttaaggggctggctcgcggcggcgcacagatcttctcatgcatcattccagagtgcctccagcgggcagttcatggtctcctacattacctttttcacactcgcaaccacacttttatcgtgctccatctggtcttgcagggcatggtatatacagagtatacttgggaggtgttcggttattgccaggagctggaactgtccttgcactacctgctgctcccttatttgctactgggcgtaaatttattcttcttcaccttaacatgtggcaccaatccaggcattataacgaaggccaatgagctgctatttctgcacgtttatgagttcgacgaagttatgtttccaaaaaacgttcgctgttcgacttgtgacttaaggaaacctgcccgctctaagcactgttcagtttgcaactggtgtgtacatcgctttgaccaccactgcgtctgggtgaacaattgcattggtgcttggaacatccggtacttcctgatctatgtgctgacattaacagcttcggctgcaacagtggccatcgtgtctacaaccttcctcgtccaccttgtggtgatgtctgacttgtatcaggagacctacattgatgacttgggacacctgcacgttatggacacagtcttcctaattcagtatctgttcctgaccttccctcgaatcgtctttatgctgggatttgtggtcgtcctcagttttttgctaggcggatatctgctttttgtactctacttggcagcaactaatcagacaaccaatgaatggtaccgcggtgactgggcatggtgtcaacgctgtccactggttgcatggccaccctctgctgagccccaggtccacaggaacattcacagccatgggctccgcagcaacttgcaggagattttcttgcccgcttttccttgccacgaacgaaagaaacaggagtag

SEQ ID NO: 32078 - DNA, 1035 bp, Artificial Sequence
  Description of Artificial Sequence: Synthetic coding sequence
atggatttcctggtactgttcttgttctacctagcatccgtgcttatgggcttggtgctgatctgtgtatgttccaagactcactcattgaagggcctggcaagaggaggggcgcagattttttcctgcatcatacccgagtgcttacaacgcgccgtacatgggcttcttcactacctctttcacacgcgcaatcacaccttcatcgtcctccacctggtgttgcaaggcatggtgtatacggaatatacgtgggaggtgttcggctactgccaggaattagagttatccctgcattatctgctccttccctacttgctgctaggagtgaacctgtttttctttactctcacctgcggcacaaaccccggcataattaccaaggcaaacgagttgctcttcctgcacgtgtatgaattcgacgaagtaatgttccctaagaatgtgcgatgttctacctgcgatctgaggaagcctgccaggtcaaagcattgcagcgtgtgtaactggtgcgtgcatcgctttgaccaccattgtgtgtgggtgaacaactgcattggagcttggaatatcaggtacttcttaatatacgtgctgactttgactgcctccgccgccaccgtggcgatagtgagcaccacgttccttgtccatctcgttgtgatgtccgatttgtaccaggagacatacatagacgatctcggccacctccatgtgatggatacagtgtttctgattcagtatctgttcctgacgtttccccgtatagtcttcatgctcgggtttgttgtggttctcagcttcctccttggaggctacctattgttcgtactctacctggcagctactaatcagacgactaacgaatggtaccgcggggactgggcttggtgtcagagatgccctctggtcgcctggcccccatctgccgaaccacaggtgcatagaaatatccacagccacggcctgagatctaacttgcaggagatcttcctccccgctttcccatgtcacgaacgtaaaaagcaggagtag

SEQ ID NO: 32079 - DNA, 1035 bp, Artificial Sequence
  Description of Artificial Sequence: Synthetic coding sequence
atggattttctcgttctgttcttattttatcttgcctctgtgctcatgggcttagtgttgatctgtgtatgttcaaagacccacagcctgaaaggactcgcgagggggggggcgcagatcttttcttgtataattcctgagtgcctccagcgcgcagttcacggtctgttgcactatttgttccacactagaaaccacacctttatcgtgctccacctggtgctgcaagggatggtgtacacagagtatacctgggaagtttttgggtactgccaagaactggaactctcgctacattatttgctcttaccctatctcctccttggggtgaatctttttttcttcaccctgacctgtggcacaaatcctggcattattaccaaggcaaacgagttgctttttctgcatgtatacgaattcgacgaggtgatgtttcctaagaacgttagatgtagcacctgcgatctgagaaaaccagcccggagtaagcattgcagcgtctgcaactggtgtgtgcaccgattcgaccatcactgtgtgtgggtgaataactgcattggggcctggaacatcagatacttcttaatttatgtgcttaccctcacagcatctgcagctactgtggccatcgtgagcaccacctttcttgtgcaccttgttgtaatgtccgatctgtaccaagagacctacatcgacgatctaggacacctccacgttatggacacggtttttctgatacaatacctgtttttgacattcccaagaattgtttttatgttgggcttcgttgtggtgctgagttttctgctgggaggatatcttttgtttgtcctctacctggccgcaacaaaccaaactactaacgaatggtacagaggtgactgggcctggtgtcaaagatgtccgctcgtggcttggccccctagcgcagagccacaggtccacagaaatatccactctcatggattaagaagtaacttgcaggagatatttcttcccgcatttccttgccacgaacggaaaaaacaggaatag

SEQ ID NO: 32080 - DNA, 1035 bp, Artificial Sequence
  Description of Artificial Sequence: Synthetic coding sequence
atggatttcctggttctctttctcttctacctggcatctgtcctgatgggtctggtgttgatctgtgtatgttccaagacccacagtctcaaaggattggctcggggcggggcccagattttctcttgtattatcccagaatgtctccagagagctgttcatgggctgcttcactacctgtttcatacaaggaaccacacatttattgtgttacacttggtcctgcagggtatggtctacacagagtatacctgggaggtttttggctactgccaagagctggaacttagccttcactatctgttgttgccctatcttctcctcggagtaaatctgtttttctttactctcacctgtggcacaaaccccggaatcattactaaggccaatgaactgctatttcttcatgtgtacgagtttgacgaagtgatgtttcctaaaaacgtgcgatgcagtacgtgtgatttaagaaagcctgcccgttcaaaacactgtagcgtgtgcaactggtgtgtgcaccgctttgatcaccactgtgtgtgggttaataactgcatcggggcttggaacatccggtattttcttatatatgtgctaacgctgaccgcgtctgccgcaaccgttgccattgtttctaccacgtttcttgtgcacctggtggtgatgagcgatctgtatcaggagacgtacatagatgatttgggccacctgcacgtgatggatactgtctttctgatacaatacctctttttgacatttcccaggatagtgtttatgttggggttcgtggtagtgctcagctttctcctcggtggctacctgctgtttgtactctatcttgcggctaccaatcagaccaccaacgagtggtatcggggcgactgggcttggtgtcagcgttgcccccttgtagcatggcctccttccgccgaaccacaagttcacagaaacatccatagtcatggcctgcgtagtaatctgcaggaaattttcctgcccgcgttcccatgccacgagcgaaagaaacaggagtag

SEQ ID NO: 32081 - DNA, 1035 bp, Artificial Sequence
  Description of Artificial Sequence: Synthetic coding sequence
atggattttctcgtgttgttcctgttttacctggcatcggtactgatgggtcttgtcctgatctgtgtatgctccaaaactcacagtttgaaagggcttgccagggggggcgcccagattttttcctgcatcataccggagtgcttgcagcgagccgtccacgggctcttgcattacctgttccacacgcgcaatcatacatttatagtgctccatcttgtgcttcaaggaatggtgtacaccgagtatacctgggaagtgtttggctattgtcaggagctagaactgagtctccattacttactgctcccttatctccttttgggggtcaacctcttttttttcacattgacctgcggaactaaccctggaattattacgaaagcaaacgagctgttgtttctgcatgtgtacgagtttgatgaggtcatgtttcccaagaatgtgcgctgctccacttgcgacctgagaaaacctgccaggagcaagcattgcagcgtgtgcaactggtgcgtgcacagatttgaccaccactgcgtgtgggtgaacaattgtatcggcgcttggaatatccgatattttctcatttacgtgctgactctgacagcgagcgcggccacagtggcgattgtcagcacgacatttctagtgcaccttgtggtgatgtctgatttataccaagagacatatattgacgatctgggtcatctccatgtgatggacaccgttttccttatccagtatttgtttctcacttttccgcgaatagtatttatgttggggtttgttgtcgttctgagctttctgctcggcggatatctgctctttgtgctctatctggcggcaaccaaccaaaccaccaatgagtggtataggggtgattgggcttggtgtcaaagatgccccctcgtagcctggccaccaagtgccgagccacaggtgcatcgcaacatacactctcacggcctccggtctaatctgcaggagatttttctgccagcattcccttgccatgagaggaaaaagcaggagtag

SEQ ID NO: 32082 - DNA, 1035 bp, Artificial Sequence
  Description of Artificial Sequence: Synthetic coding sequence
atggatttcctcgtgctgtttttgttttatcttgcctccgttctcatggggcttgtcctgatctgcgtctgctcaaaaacccattccttaaagggcttggctcgcggaggggcgcagatatttagctgcataatccccgaatgtctacagcgagcagtgcatgggctgctgcattatctcttccatactcggaatcacaccttcattgttttacatctagtgcttcaggggatggtgtatacagagtatacttgggaagtgtttgggtactgccaagagctcgagctgagtctgcactacctgctgcttccctatttgctcctgggagtgaatctctttttctttaccttgacctgtggcacaaacccaggaattattactaaagctaatgagctactgtttttgcacgtttatgagttcgatgaggttatgttccccaagaacgtgagatgcagcacctgcgacctgcgaaaaccagcccggtctaagcattgttctgtatgcaattggtgcgtgcacaggttcgatcatcactgcgtatgggtgaacaactgcataggtgcctggaacattcgttatttcctgatttacgtgctgacactcaccgcgtccgccgcaacggtggctattgtctcaactacattcctcgttcacttggttgtcatgtctgacctgtaccaagagacttacatcgacgacctaggccacctccacgtcatggacaccgtattcctgatccagtacctctttttaacgtttcctcggatcgtatttatgctgggattcgtggttgtactgtccttcttactcggggggtacttgctgttcgtgttgtaccttgctgccaccaatcagactaccaatgaatggtacaggggagactgggcctggtgtcaaaggtgtccactagtggcctggccaccttcagcggagcctcaggtccacaggaacatccacagccacggtctaaggagtaacctgcaggaaatcttcctcccagccttcccttgccacgagaggaagaaacaagagtag

SEQ ID NO: 32083 - DNA, 498 bp, Artificial Sequence
  Description of Artificial Sequence: Synthetic coding sequence
atggacttcctggtcctgttcctcttttacctggcctctgtgctcatgggactggtgcttatatgtgtttgttcaaaaacgcacagcctaaaaggccttgcccggggcggtgcccagatctttagctgcatcatcccagagtgcctgcagagggccgttcacgggctgctgcactacctgttccacacaagaaaccataccttcatcgtgctacaccttgtgctgcagggaatggtatacactgaatatacatgggaagtgttcggttactgtcaagaattggaattatcactgcactatctcctcctgccctacctgctactgggagtgaacctctttttcttcaccctcacatgtggaactaacccaggaattatcacaaaggcaaacgagctcttatttttgcatgtatatgagtttgacgaagtgatgtttcccaaaaacgttcgctgcagcacgtgcgatctgagaaagcctgctaggtctaaacattgctag

SEQ ID NO: 32084 - DNA, 2148 bp, Artificial Sequence
  Description of Artificial Sequence: Synthetic coding sequence
atgccagcggagagtggcaaacggttcaagcctagcaagtatgtccctgtttcggctgcggccatttttctggtcggagccactacactcttcttcgcttttacttgccccggattgtctctgtacgtcagtccagccgtccccatctataatgccattatgtttctcttcgtgctggcgaacttcagcatggctacgttcatggaccccggcatctttccaagggcagaagaagatgaagacaaagaagatgacttccgtgctcccttatacaaaacagtagagattaaaggtattcaagtgagaatgaagtggtgtgccacttgcaggttctatcggcccccgcggtgttcccattgttccgtctgtgacaattgtgtcgaagaattcgaccaccattgtccttgggttaataattgtattggcagacgcaattacagatatttctttttatttctgctgtctctgaccgcacatatcatgggcgtttttggcttcggactactgtatgtgctttatcatattgaggagctgagtggcgtccgtacagcagtgacaatggcggtgatgtgcgtggccggcctgttctttattcccgttgcgggacttacgggattccacgtcgtcctggtcgctagaggaaggaccactaatgaacaggtgactggaaagttcagagggggggtcaatccatttaccaatggctgttgtaacaacgtgagtcgggtgttatgttcaagccctgccccccggtaccttggacgccctaagaaggagaagacgatagtgattcgaccccctttcctgcggcccgaggtgtctgacgggcagatcactgtgaagatcatggataacggaatccagggcgaactcaggcgaaccaagtccaaggggtctctcgaaattactgagagccagagcgccgacgctgaacctcctcctccccccaaaccggacctctctcgatacactgggcttaggacccaccttggtctggcaaccaatgaagattccagcttactagcgaaggatagccctcctacacccactatgtacaagtaccgacctggctattccagttctagcacctcggcagccatgccacactcatcgagcgcaaaactcagcagaggcgacagcctaaaggaacccacgtctattgccgagtcctcacggcatccttcttaccgctccgagccttctttggaacctgagtcgttcaggagtcctaccttcggcaagagcttccacttcgatccactgtctagcggatccaggtccagtagcctgaagtccgcacaaggcactggctttgagctgggccagctgcaaagtattcggtccgaaggtacaacttcaaccagctacaagagtctggccaaccagactcgcaacggaagcttatcctacgatagtctgttgaccccaagcgattctcctgactttgagtctgttcaggcagggcctgagccggatccgccactcggatacacctctccatttttgagcgctagactggcccagcagcgcgaggcggagaggcatccaaggctcgtcccaacagggcctacccaccgagaacctagccccgtaagatacgacaatctgtcacgtcatatagtggcaagtctgcaagaacgcgaaaagctactgcgacagtcaccacccctcccaggccgggaggaggagcctggcctgggtgactccggcattcagtcaacacctgggtccgggcacgcccccaggacttcttcgtcatccgacgactcaaagcgttcacccctcggtaaaactccactaggtcgcccagctgtgccccggttcggaaagccagacggcctgagaggtcgtggggtaggcagtcctgaacctgggcctacagccccatatttgggacgatctatgagctactccagccagaaggcgcagccgggggtgagcgagaccgaggaagtcgccctgcagccgctactgacacccaaggacgaagtgcaactaaagacaacgtactcgaaaagcaacggacagcccaaatccttgggatccgcaagccctggacctggtcagccacccctgtcgtcgcctaccagagggggagtcaagaaggtgtcgggagtaggcggaacgacttacgaaatatccgtctag

SEQ ID NO: 32085 - DNA, 1989 bp, Artificial Sequence
  Description of Artificial Sequence: Synthetic coding sequence
atgttcctttttgttctagccaacttctccatggctacctttatggatccaggcatttttccacgggccgaagaagatgaggacaaggaagatgactttagggcgccattatacaagacggtggagatcaaaggcattcaggtgagaatgaagtggtgcgctacctgtaggttctatagaccccctagatgttcccattgttctgtgtgcgataattgcgtagaggagtttgatcaccactgcccttgggtcaacaattgcatcggcagacgaaactaccgatacttctttctgttcttgctatccctgaccgcacacataatgggcgtgttcgggttcggcctgctatacgttctctatcacattgaagaactgagcggagtccgcactgcagtcacaatggcagttatgtgtgtcgccggtctgttttttatacccgttgcaggactcacagggttccacgtcgttttggtcgctagaggccgcactactaacgagcaggtaacgggcaagttccggggcggcgtgaacccatttaccaacggatgctgcaacaacgtatcaagggtgctgtgcagtagtccggccccacgatatctgggcaggccaaagaaggagaagacgatcgttattcgaccacctttcctacgcccagaagtctcagatggacagatcacggtgaagatcatggacaacggcattcagggcgagctcaggaggaccaagagtaagggctctctcgaaattaccgagagccagagtgcagatgctgaaccacccccaccccccaagcccgacctgagccgatacactggactgcgaacccatctgggcctagccaccaatgaggacagcagtttactggcaaaggactcaccccctaccccaacaatgtacaagtaccggcccgggtactcgtcctcttctacatcagccgccatgcctcattcgtcatcagccaagctttcgcgtggcgacagtttgaaggaaccaacgagcattgcagaaagtagtcgccacccatcctatcgaagtgagccatccctggagccggaatcatttcggagccccacctttgggaagagtttccatttcgatccactcagcagcggcagcagatcaagttcactcaagagtgcccagggtacaggattcgaattgggccaactgcagtccatccgctccgaagggacaactagtacgtcctataagtccttggctaaccaaactaggaacgggtcactcagctacgacagcctactgacaccctctgattcccccgattttgagtcagtgcaggctggaccagaaccagacccccccctggggtatacgtcaccattcctttccgcacgccttgcacaacagcgggaagcagagcgccacccacgcttggtcccgaccgggcccacccaccgcgaaccttcacctgttcggtatgataatttgtcaaggcacatcgtggcctctttgcaggaaagggaaaagctgctgcgtcagtcgccccccctccccgggcgcgaggaagaacccggcctgggagattctgggatccaaagcacccccggatctggacatgcgccaaggacctcgtcgtccagtgatgattctaagcggtcacctcttgggaagaccccactcggcagaccagcagtgcccagatttggaaagccagacggactcagaggccgtggagttgggtcgccagagcccggtccgacggccccataccttggtaggagcatgtcgtattccagccagaaggctcagccgggggtctccgagaccgaggaggtggctttgcaaccgctgcttacccctaaggatgaggtccagctaaagacaacttacagcaagagcaatgggcagccaaagtctctagggtccgccagccccgggccaggccagcccccacttagcagtcctacaagggggggcgtgaaaaaggtatctggcgttggagggaccacgtacgagattagcgtgtag

SEQ ID NO: 32086 - DNA, 1230 bp, Artificial Sequence
  Description of Artificial Sequence: Synthetic coding sequence
atgggtaccttctgctctgttatcaaatttgagaaccttcaggagcttaagcggctttgccattgggggccaatcatcgccttgggcgtcatcgcaatttgttcgactatggccatgatcgatagcgtgttatggtattggccgcttcataccaccggtgggtccgtcaacttcatcatgcttattaactggacagtgatgatcctctacaattattttaatgcaatgttcgttggtcctggctttgttccacttggttggaagccggataccatgtatcttcagtattgcaaagtttgccaggcctacaaggctccacggagtcaccactgcaggaagtgtaaccgatgcgtcatgaagatggatcaccattgtccttggatcaacaattgctgcggctaccagaatcacgctagcttcacattatttctgctgctcgccccgttaggctgcattcatgctgcattcatcttcgtgatgaccatgtatacacagctctatcacagattgagttttgggtggaatacagtgaaaatcgatatgtctgccgcccgccgagaccctctgcccattgtaccatttggtttggcagcttttgctaccacactgtttgctcttggcctagccctggggaccaccatagcagtcgggatgctgttctttattcagatgaagattattctcagaaataagacaagtatcgagtcatggatcgaagagaaagccaaagatcgcatacagtactaccaactggacgaggtgttcgtgtttccgtatgacatggggagccgttggagaaacttcaagcaggtctttacttggtctggagttcctgaaggcgatggcctggagtggccggtacgagagggctgccatcaatattctctcactattgagcagctcaaacaaaaagccgataaacgcgtccggtctgttagatacaaggtgattgaagactacagtggagcctgttgcccactcaacaagggcatcaagacctttttcacatccccttgtactgaagagccccgcattcaattgcagaaaggtgagttcatcctggctactaggggactgcgttactggttgtacggcgacaagatcttggacgactcattcattgagggggtaagtcgaatacgcggttggttccctcggaagtgcgtagagaagtgcccgtgtgacgcagaaaccgaccaggcccccgaaggcgagaagaagaatcgctag

SEQ ID NO: 32087 - DNA, 1242 bp, Artificial Sequence
  Description of Artificial Sequence: Synthetic coding sequence
atggggacattttgctctgtgattaaattcgaaaatctacaggagttaaaacgtctctgtcactggggtccgatcattgcactaggagtcattgccatctgtagcacgatggcaatgattgacagcgttctatggtattggccactgcacactacaggaggcagcgtcaattttatcatgctgatcaattggaccgtgatgatcttgtacaattactttaatgcaatgttcgtggggccgggctttgtgccccttggttggaagccggaaatcagtcaagacaccatgtacctgcaatactgcaaggtctgtcaggcttacaaggcccccaggtctcatcattgtcgcaagtgtaatcgctgcgtaatgaagatggatcaccactgtccgtggattaataattgctgcggttatcagaaccacgccagttttaccctgttcctcctactagctcccttaggatgtatccacgccgcctttatctttgtcatgaccatgtacacccagctgtaccatcggctgtcgtttggctggaataccgtcaagatagatatgtccgccgcccgcagagatcccctgcccattgtgccattcggcctggctgctttcgccactaccctttttgctctggggcttgctctggggacaacaatcgctgtcggtatgctgttcttcattcagatgaaaatcatcctacgcaacaagaccagcatcgagtcatggattgaagagaaagccaaagatcggatccaatactaccagctagacgaggtctttgtgttcccgtacgacatggggtctagatggcgaaattttaagcaggttttcacatggagcggagtgcccgaaggggacggcctggagtggcctgttcgcgagggatgccaccaatattcgctaacgattgagcagcttaaacaaaaagctgataagagagtgcgttccgtgcgatataaggtcatcgaggattactcaggggcatgctgtcccttgaacaaaggaataaaaacattttttacttcaccgtgcacagaagagcctagaatccagttgcagaaaggagaatttattctagctacacggggtctccgctactggctgtatggtgacaagatcctggatgactccttcatcgagggggtctccaggatacggggctggttccctagaaaatgcgtggaaaagtgtccttgtgacgccgaaaccgaccaggcgccggagggtgaaaagaagaacagatag

SEQ ID NO: 32088 - DNA, 927 bp, Artificial Sequence
  Description of Artificial Sequence: Synthetic coding sequence
atgcagccttctggtcatcgtctacgggatgtcgaacatcaccccctgcttgcggaaaacgataattatgactcaagctcaagttcaagcagcgaggccgatgtggcggaccgggtctggttcatacgggatgggtgtggtatgatctgcgctgtgatgacatggctgttggtagcttatgccgacttcgtggtcactttcgtgatgctcctcccctcaaaagatttttggtatagtgtcgttaacggcgtgatatttaactgccttgctgttcttgctctgtcttcacacttacgcactatgctgacagatccaggtgccgtcccaaaggggaatgccactaaagaatacatggagagcctgcagctcaagcctggagaggttatctacaagtgccctaagtgctgctgcatcaaaccagagcgcgcgcaccactgctcaatatgtaagaggtgcatccgaaagatggaccaccattgcccatgggtcaataactgcgtcggagaaaagaatcagagattcttcgtgctgttcacaatgtacatcgcactgtccagtgtccacgcacttattctttgcggatttcagttcatcagttgtgtacgtggccagtggactgaatgctccgacttcagcccgcctattactgtaatcttgctgatattcctatgcctcgagggactactttttttcacattcaccgcagtaatgttcgggacccagattcactccatatgcaatgatgaaaccgagattgaacggctcaagtccgagaagccaacctgggagcgtaggctgcgctgggaagggatgaaatccgtgttcggaggacccccttccctgctatggatgaaccctttcgttgggttcaggttccgcaggttgccaacgcgcccaagaaagggagggcctgaattcagcgtgtag

SEQ ID NO: 32089 - DNA, 1038 bp, Artificial Sequence
  Description of Artificial Sequence: Synthetic coding sequence
atgcagccctctggacaccgcttacgcgacgtcgaacatcacccactccttgccgaaaacgacaactatgactcctcatcatcaagtagctcagaggccgacgtcgcagatcgcgtgtggtttatacgggatgggtgtggaatgatatgtgccgtgatgacctggctgttggtcgcatacgccgactttgttgtcacattcgtcatgttgctcccttccaaagatttttggtactccgtagtgaatggcgtgattttcaactgcctggcggttcttgctctatcttcacacctgcgtactatgcttaccgacccagaaaagagctcagattgccggccttcagcgtgtacagtgaagacagggttggatcctaccctggttgggatttgtggcgaggggactgagtctgtacaaagcctactgctgggtgctgtacctaaaggcaatgccacgaaggagtacatggagagcctacagctgaagccgggagaagtcatttacaagtgccctaaatgttgctgcatcaaacctgagagggcacaccattgttctatctgcaaacggtgtatccgtaagatggaccaccattgtccatgggtgaacaactgcgttggtgagaagaatcagaggttttttgttctttttacaatgtatatcgcactgtctagcgtacacgcgcttatcctgtgcggatttcagtttatctcatgtgtgagaggtcaatggactgagtgcagtgacttctctccaccaattacagtcatccttctcatctttttgtgtctggaaggcttattgttttttaccttcaccgcagtgatgtttggaacccagatacactccatctgcaatgatgaaacagaaatcgaaaggcttaaaagcgagaaaccgacttgggaacggcgcttgagatgggagggcatgaaaagcgttttcggcgggcccccttcattactctggatgaacccattcgtcgggtttcgctttaggagactgcccacccggcctagaaaaggaggccctgagttcagcgtctag

SEQ ID NO: 32090 - DNA, 4620 bp, Artificial Sequence
  Description of Artificial Sequence: Synthetic coding sequence
atggatagctacttcaaggccgcagtgtccgacctggataagctgttggatgacttcgaacagaaccctgacgagcaggactacctgcaggatgtgcaaaacgcttatgacagcaatcattgttccgtctccagcgaactggccagttcccagagaacatccttgctgccgaaggaccaggagtgcgtcaattcatgtgcctcttccgaaacaagctatggaacaaatgagagttccctgaacgaaaagaccttgaagggtttgacaagtattcaaaacgagaagaacgtgacagggctggatctcttgagcagtgttgatggaggaactagcgacgaaatccagcctctctacatgggccggtgttctaagcccatttgcgaccttataagcgatatgggcaacctggtgcacgctaccaatagcgaagaagacattaaaaaactgctccccgatgattttaagtccaatgcggactcactgattggactggacctgagtagtgtatctgataccccgtgtgtcagctctacagatcacgactctgacacagtccgagaacaacagaatgatatcagttcagaactgcagaaccgcgagatcggaggcatcaaggaactgggcattaaagttgacaccacactaagtgatagttataactactccggaactgagaacctcaaggataaaaaaatcttcaaccagttagagtcaatagttgactttaatatgtcatcggcactgacacgccagtcttccaagatgttccacgcaaaggacaaactgcagcataagtcacagccatgcggcctgcttaaggatgttggcctggtgaaagaggaagtggacgtggccgtgattaccgcagccgaatgcctgaaggaggagggtaagacaagcgcactcacctgctcgctgccaaaaaacgaggatctgtgcctgaatgatagcaattcacgggacgagaacttcaagctgccagacttctcttttcaggaggacaagacagtgatcaaacagagtgctcaggaggacagcaaaagcctcgacctcaaggacaatgatgtcattcaagactccagctccgccctgcatgtgtcctcaaaggatgtgccatcatcactgagttgccttcccgccagtggctccatgtgcggctcccttattgagagcaaggccaggggtgatttcttaccacagcacgaacacaaagataacatccaggacgcagtgactatccacgaagagatccaaaattcagtagtcctgggaggggagcccttcaaggagaatgacctcctgaagcaggagaagtgcaaatcgatcctgctgcagtctcttatcgaaggaatggaggataggaagatcgacccagatcaaactgtgatccgagccgaatctttggatgggggagacacgtcttccaccgtggtggagagccaggagggcctctccggtactcacgtccctgaaagttcagactgctgcgaggggtttataaacaccttctcctccaacgacatggacggccaggatctggactattttaacatcgacgagggtgccaagtctggcccacttattagcgatgctgagctcgacgcattcctgaccgaacagtaccttcagacaacaaacatcaagagctttgaagagaatgtgaacgatagcaagtcacagatgaaccagatagatatgaagggcttggatgacgggaatatcaacaacatatacttcaacgcagaggctggtgccattggggaatcgcacgggatcaacattatttgcgaaatcgttgataagcagaacactattgagaacggcctcagtttaggcgaaaaatccacgattcccgttcagcaggggctgcctacttccaaaagtgagattaccaatcaactgagcgtctctgacataaacagccagtccgtcggcggggccaggcctaagcaactgttctctttgccaagtcggacacgatcttccaaggacttgaataagcccgatgtgccagacaccattgagtcagagccttccaccgcggatactgtggtgccaataacctgtgcgatcgattcaaccgcagatccccaagtgtccttcaattctaactacattgacattgagagcaacagcgagggtggttccagttttgtgaccgccaacgaagacagcgtgcctgaaaatacatgcaaagagggcttggtcctcggacagaagcagcccacttgggtccccgactccgaagcccctaactgcatgaattgccaggtcaagtttacatttacgaagcgaaggcatcattgcagggcttgtggcaaggtgttctgcggagtatgttgtaatagaaaatgcaagctgcagtatctcgaaaaagaggcccgcgtctgcgtggtgtgctacgagaccatatctaaggcccaggcgttcgagaggatgatgtcccccactgggagcaacctgaagagtaaccactcagatgagtgcaccacagtgcagcctcctcaagagaaccaaacgtccagtattccttctcctgcgaccctgcccgtctctgccttgaagcagcctggcgtggagggcttgtgcagcaaagagcaaaagagagtatggtttgctgatggcattctcccaaacggagaggtagctgatacaaccaagctgtcctccggctccaagcgctgctctgaggatttctcacccttgagccctgacgtgcccatgactgtgaataccgtggaccatagccattctacgaccgtggaaaagccaaataacgagaccggagatattactcggaatgagattattcagtcccccatctcgcaggtgccgtcagtagaaaaactgagtatgaacaccgggaacgagggacttccaacaagtggatcctttactttagatgatgatgtatttgccgaaaccgaagaaccaagctccccgaccggggtgctggtcaactccaatctgccaatcgcatctatcagtgactacagattgctttgcgacattaacaaatacgtatgcaataagatttctctccttccaaatgatgaggactctctgccccccttattggtggcctctggggaaaaaggctccgtgcctgtcgtggaggaacacccatcgcacgagcaaatcatcctgctactcgaaggggaaagttttcaccccgtcacctttgttcttaacgccaacctactggtgaacgtcaagttcattttttacagctccgataagtattggtacttttctactaacgggctgcacgggctcggtcaggctgagataatcatacttctactttgtctgccaaacgaggataccatccccaaggacatattccgcctgttcataaccatctataaggacgccttaaaggggaaatacatcgaaaatctggacaatatcactttcaccgagagcttcctgtcaagcaaggaccatgggggatttctgttcatcacccctacttttcagaagctggatgacctgtctctcccttctaatccctttctctgcgggattttaattcagaaactggaaattccatgggctaaagtgttccccatgaggctcatgttacgactcggcgcagagtataaagcctaccctgcccccttgacgtccatacgcggccgcaagcctttgtttggggaaatcggccatacaattatgaacttgcttgtggatcttagaaattaccagtacacgctgcacaatatcgaccagttactcatacatatggagatggggaaaagctgtattaagatacctaggaagaagtactccgatgtaatgaaagttctgaattcctctaatgagcacgtcatttccatcggagcgagcttcagtaccgaagcagactcacaccttgtgtgtattcagaatgatggcatttacgagacccaggctaactcagccaccgggcatcctcgcaaagttactggtgctagctttgtggtcttcaatggcgcacttaaaactagttctgggttcctcgcaaaatcatccatagtggaggacgggctcatggtacaaatcacccctgagactatgaacggactgagattggccttgagggagcagaaggattttaagattacttgtggtaaggttgacgcagtggacttgcgagagtacgtcgacatttgctgggtcgatgccgaggagaaaggtaacaagggagtgatctccagtgtggacggtataagtcttcagggattcccttcagagaagattaaactggaggccgacttcgaaacggacgagaaaatcgtgaagtgcaccgaagtattttacttcctaaaggatcaggacttatccatcctctccacctcttatcaattcgccaaagagatcgcaatggcctgcagcgccgcattatgcccccatctgaagaccctgaagtcaaacggcatgaacaagattgggctgcgcgtctctatcgatacagacatggtggaattccaggccgggagtgaagggcagctcctgccgcagcattatcttaacgacctcgattcagcccttatccccgtgatacatggaggtaccagcaattcttccctccccctggagattgaactagtcttctttatcatcgaacacctcttttag

SEQ ID NO: 32091 - DNA, 4620 bp, Artificial Sequence
  Description of Artificial Sequence: Synthetic coding sequence
atggactcttattttaaagctgcggtgagcgacctagacaagctccttgatgacttcgagcagaacccggatgaacaggactacttgcaggacgtacagaacgcgtatgactcaaaccactgctctgtttcctctgagctcgcctcatcccagcggacgtccctgctcccaaaagaccaggagtgtgtgaatagttgcgcttcatccgagacttcgtacggaaccaatgaatcatctctaaatgagaaaactctgaaaggtctgacatcaattcagaacgaaaagaacgtaacaggccttgacctactgtcttctgtcgatggggggacatctgatgagatccagcctttatacatgggaaggtgtagtaaacccatttgcgatttaattagcgacatgggtaacctggtgcacgctaccaatagtgaagaggatattaagaaactgttgccagacgattttaagagcaatgcagattccctcatcggtctcgatctaagtagcgtttcggacactccctgtgtgtcttccaccgaccacgattccgataccgtgcgcgaacagcagaatgacatctcctcagagctccagaaccgagagatcggcggaattaaggagttgggcatcaaggtcgataccactctctctgattcgtataattattcaggcaccgagaatctgaaagacaaaaaaatcttcaaccaactggagtccatcgtcgactttaacatgagctcagcactgaccagacagtcttctaaaatgtttcacgctaaagataagctccaacacaagtcccagccttgcggcctgttgaaagatgtggggttagtgaaggaggaagtcgatgtggctgtgataactgccgcagaatgtttaaaggaagaaggcaaaactagcgctctcacgtgttccttacccaaaaatgaggacctctgccttaatgactctaattcaagggatgagaactttaaactccccgacttttccttccaggaggacaaaacagtcatcaaacaaagcgcccaagaggattccaaaagccttgatctgaaagataacgatgtcattcaggactcttcttctgcactacacgtctcttctaaagacgtgccaagcagcttgagttgcctccccgcttctggtagcatgtgtgggagcctgatagaatctaaggccaggggtgattttctgcctcagcacgaacacaaggataatatccaggatgcagtgaccatccatgaagagatacagaactccgttgttctgggtggcgagcccttcaaggagaatgatctcctgaagcaggaaaagtgtaaaagtatcttattgcagtcgttgattgagggaatggaggataggaaaatcgatccggaccagaccgtgatacgcgccgagtctctggatggaggcgatacatcaagtactgtggttgaatcacaggaagggctgagtggcacccacgtgcctgagagtagcgattgttgcgaggggttcatcaatactttttcctccaacgacatggacggccaggatctggattacttcaatatcgatgaaggagccaagtcagggccgttgatatcagatgcagaactggacgcgttcctgactgagcaatatctgcaaactactaacataaagagctttgaggaaaacgtaaatgactccaaaagccagatgaaccagatcgatatgaagggcctcgatgacggcaacattaataatatatacttcaatgcagaggccggagccattggcgaatcacacggaattaacattatatgcgagatagtggataagcaaaatacaatcgagaacggcctgagcttaggagagaaaagcactattcctgtccagcaaggtcttcccaccagcaaaagcgaaattactaaccagctgtcagtctccgacatcaattcccagtccgtgggcggtgccaggccaaagcagctgttctcacttccatccagaactcgcagcagtaaggatctcaataagccggatgtgccagataccatcgagtctgagccatccactgctgacaccgtggtaccaattacgtgcgcaatcgactctacagctgacccacaggtatctttcaatagtaactacatcgacattgaaagcaattccgaaggcgggtcctccttcgtaaccgccaatgaagactccgttcctgagaacacctgcaaagaaggcctggttctcggccagaagcagccaacgtgggtgccagactccgaggctcctaactgtatgaactgccaggtcaagtttacctttaccaagcgcagacatcactgccgcgcctgtggaaaggtgttttgcggggtatgctgcaaccggaaatgtaaattgcagtacttagaaaaggaggcgcgggtatgcgtcgtttgttacgagaccatttccaaagctcaggcattcgaaaggatgatgtcgcccaccggatctaacctcaagagtaatcattccgacgaatgtaccacggtccagcctccccaggaaaaccagacgagttctatccctagccctgccactttgcctgtaagtgcactcaaacagccaggagtggagggactgtgttcgaaggaacaaaaacgggtttggttcgccgacggaatcttaccaaacggcgaggttgcagacacgactaagctctccagtggctctaaacggtgctcggaggatttttcccccctgtcccctgacgtcccaatgacagtaaacaccgtggaccactcccactcaactacagtggagaagcctaataatgagacgggagacatcacaagaaacgagataattcagtcacccatctctcaagtcccgagcgtggagaaattgtccatgaacaccgggaacgaaggccttcccacatccggatcctttaccctcgacgatgatgtgttcgccgagaccgaggaaccttccagccctacgggggttcttgtgaattctaacttaccaattgcatctatctctgattacagactgctgtgtgacattaacaaatatgtgtgtaataagatttcactccttcctaacgatgaagacagcttgcctcctcttctggtagcctctggtgagaaaggttccgtacccgtggtcgaagaacacccgtcccacgaacaaatcatccttctcttggaaggagagtcattccatcccgtgactttcgtgttgaacgctaacctcctcgttaacgtgaaattcatcttctatagcagtgataagtattggtatttttctactaatggtctccacggcctcggacaggcagagattattatcctcctgttgtgcctgcctaacgaggacactatccctaaagacatctttaggctgttcatcactatttacaaggatgccctcaaagggaaatatattgagaatttagacaatatcactttcacagagagtttcctgagctctaaggaccacggaggttttctgttcatcactcccacgttccagaagctcgatgaccttagcttgcccagcaatccatttttatgtggaattctgattcagaagctggaaatcccttgggcaaaagtcttccctatgagattaatgttgagactcggtgccgaatacaaggcctaccctgctccactgacttctataagaggcaggaagcccctctttggcgaaatcggccatactataatgaatttgcttgttgacctgcggaactaccagtatacactgcataacattgatcagctgctgatccacatggagatgggaaagtcttgcattaaaatccctagaaaaaaatatagtgatgttatgaaagtgcttaattcctcaaatgaacacgtcatttccatcggggcctcattctcaactgaggctgacagtcatttggtctgtatccaaaacgacgggatttatgagacgcaggctaatagtgccactgggcacccccgcaaagtaactggcgccagcttcgtggtgtttaacggcgcattgaaaacgtcatctggatttctggccaagtcgagtatcgttgaagacggtctgatggtgcaaataactcctgaaaccatgaatggcctgcggcttgcactgcgggagcagaaggacttcaaaataacgtgcggtaaggtggacgccgtggatctccgggagtacgtcgacatttgctgggttgatgctgaagaaaaggggaacaagggagtaatcagctccgtagacggcatctctttgcagggcttccccagcgaaaaaataaaactggaggcggacttcgaaaccgatgagaagattgttaagtgtaccgaggtgttctactttctgaaggaccaagacctctccattttgtccacatcgtatcagttcgctaaggagatcgcaatggcttgtagtgcggcactctgtcctcacttgaagacacttaagagtaacgggatgaataagattggtctaagagtgtcgattgacaccgacatggtggagttccaggctggatcggaggggcagttgttgccccagcactatcttaatgacctcgatagtgctctcattcctgtcattcatgggggcacctcaaacagctctctgcctctggagatcgagttggtatttttcatcattgagcacttattttag

SEQ ID NO: 32092 - DNA, 4620 bp, Artificial Sequence
  Description of Artificial Sequence: Synthetic coding sequence
atggactcttactttaaggctgcagtatccgacctggataaactactggatgactttgaacagaatcccgacgagcaggattacctacaagatgtgcagaacgcatatgattcaaatcattgctctgtatcttccgaattggcatcttcccagcggacttccctgctgcccaaggaccaggagtgcgttaacagctgcgccagctctgaaacttcttacggcacaaatgaatcctccttgaatgagaagactctaaaaggtttaaccagtatccagaacgaaaaaaatgtgactggattagatttgctgtcctctgtggacggtggtaccagcgacgaaatccagccgctgtatatgggccgctgctccaaaccaatatgtgatctgatttctgatatgggtaatctggtccacgctactaattctgaggaggatattaagaaacttctgccagacgatttcaagtccaacgcagattctctcatcgggttggatcttagctcagtctctgataccccttgcgtttccagcacggatcacgacagcgacaccgtgcgggaacagcagaacgacatttcctctgaactccagaatcgcgaaatcggcggcatcaaagaactgggcatcaaggttgacaccactcttagtgatagttacaattactcggggaccgagaacctcaaagacaaaaaaatcttcaatcagctggaatccattgtcgatttcaacatgtcctccgccctgactcgtcaaagcagtaagatgtttcatgctaaggacaaactgcaacacaagagccagccttgcggccttttgaaggacgtaggactcgtcaaggaagaggtggacgttgcagtgatcacggcggccgagtgcctgaaagaagaaggtaaaacaagcgcactgacctgctcattgcctaaaaacgaagacctgtgtctgaatgactctaacagtagagacgagaattttaagttgccagattttagcttccaggaagacaagaccgtcatcaaacagagcgctcaggaggacagtaagagtctggatctcaaggacaacgatgttatccaagactccagttctgcgctccacgtttcttccaaggatgtcccatcatcattatcttgtttacctgctagcggcagcatgtgtggttctctgatcgagtccaaagcacgaggagatttcctaccacagcacgagcacaaggataacattcaggatgctgtcacgatccacgaggaaatacagaattcagtggtgctgggaggcgagcctttcaaagagaatgatttactgaagcaagagaaatgtaagtcaattctcctgcaaagcctgatcgaggggatggaagatcgcaagatcgaccctgatcaaactgtcataagagctgagagcctggacgggggcgatacctcatcaaccgttgtggaaagccaggaaggcctgtcgggcacccatgttcccgagtcctctgactgttgcgagggattcatcaacactttttcttccaatgacatggacggccaagacctcgattactttaacatcgacgagggagccaaatcgggacccctcatcagcgatgccgaactggacgctttccttacagagcaatacctccaaaccaccaacatcaaaagcttcgaggagaatgtcaacgacagcaaatcccagatgaaccagatcgacatgaaagggctggatgacgggaacatcaataatatctacttcaatgctgaagcaggcgccatcggagagagtcatgggattaacatcatctgtgagatcgtcgacaagcagaacactatcgagaacggcttgagtctgggagagaagagcacaatcccagtgcaacaaggcctcccaacctctaaatcagagataactaaccagctgagtgtcagtgatatcaactcacagtctgtgggcggcgcgcggcccaaacagctgttctcgcttccgtctcgtacacgatctagcaaagatttgaataagcccgatgttcccgatacaatcgagtccgaaccttcaaccgcggatacggttgtacccataacctgcgctatcgactccacagcggacccacaggtaagctttaattccaattacattgacatcgagtccaatagcgaagggggctcgtcctttgttaccgccaatgaggattctgtacccgagaacacttgtaaggagggcctggtgctagggcagaagcagcccacttgggtgcctgatagtgaggctcccaattgcatgaactgccaggtgaaatttaccttcacgaaacggcgtcaccactgtcgagcatgtggaaaggtcttctgcggggtgtgctgcaaccgcaagtgtaaactgcagtacctggaaaaagaggcccgagtctgcgtggtctgctacgagaccatctctaaggcccaggcatttgagaggatgatgagtcccaccgggagcaacctaaagtcaaatcattctgatgagtgcacaaccgtccagcctccacaggagaaccaaacctctagtatcccttcccccgctacgcttcccgtctcagctctcaagcaacccggcgtggaggggttatgttcgaaggaacagaaacgcgtgtggtttgcagatggtattctcccgaatggggaggtcgctgatacaactaagctgtcttctggctccaagcggtgtagtgaagatttcagcccattgtcccctgacgtgcctatgactgtcaatacagtggatcactcgcactctaccaccgtcgagaaaccaaacaacgaaacaggcgatatcacaagaaatgaaattatccagtctcctattagccaggtcccaagcgttgagaaactgagtatgaacacgggtaatgaaggactgccaacaagcggatctttcaccctggacgacgatgtctttgccgagactgaagagccgagttccccgaccggggtgctggtgaactctaacctccccattgcctcaataagcgattataggctgttgtgcgacatcaataagtacgtgtgcaataagatttcactgttgcccaacgacgaggacagtctccccccactcctcgtcgcatctggggagaagggttccgtgccggtcgtggaagagcatccctcacacgaacagatcatactattattagagggggaatcattccatcccgtgacatttgtgctgaacgccaacctcttagttaacgttaaatttattttctattcgtccgataagtactggtactttagtacaaatggattgcacggtcttgggcaggcagagataatcatcctcctcctctgcctgccgaacgaggatacgattccaaaggatatatttcgcttgtttatcacaatttataaagacgctctaaaggggaaatacatcgagaacctggataacatcacattcacagagtcctttctgtccagcaaagatcatgggggtttcctctttataacacccaccttccagaagcttgacgatctctccctcccaagtaacccgtttttgtgcggaattttgatccagaagctggagattccctgggctaaagtgttccccatgcggcttatgttaaggttgggggccgaatacaaagcctaccccgcacccctcacttccatacgtggtcggaaaccattattcggcgaaataggccacactatcatgaacctcttggtggatctcaggaactaccagtacaccctacacaatatagaccaactgctgattcacatggaaatgggcaaatcttgtataaaaattccaagaaagaaatatagcgacgtgatgaaggtccttaactccagcaacgagcatgtgataagtataggcgcctctttctccacggaggcggatagtcacttagtgtgtatccagaatgacggcatctatgaaacgcaagctaattccgcaactggccatcccaggaaggtgacaggcgcttctttcgtggtgttcaacggggctctgaaaactagctccggattcctggcaaagagcagcatcgttgaagatggcctgatggtgcagattactccagagaccatgaacggcctgcgcctggcgctgagggaacagaaagattttaagatcacgtgtggtaaggtcgatgccgtcgacctgagagagtacgtggacatctgctgggtcgacgctgaggaaaaggggaacaaaggcgtcataagctctgtagatggcatttcacttcagggtttccccagtgaaaagataaaattggaggccgactttgagaccgacgaaaaaattgtgaaatgcacagaagtcttctatttcttgaaagatcaggatctgagtatcctttctaccagctatcaattcgcaaaagagatcgcgatggcttgttccgccgccctctgcccacacctcaaaactttgaagagtaacggcatgaataaaattggcctgagagtcagtatcgatacagatatggttgaatttcaggccgggtctgaagggcagcttctgccacagcattacttgaacgatctggactcagcattgattcccgtaatacatggaggcaccagtaactcatctctgcccctcgagatcgagttggtcttcttcattatagagcacctgttctag

SEQ ID NO: 32093 - DNA, 2355 bp, Artificial Sequence
  Description of Artificial Sequence: Synthetic coding sequence
atggcctccttagacgatcccggcgaggtgagggaagggtttctatgccccctgtgccttaaagacctgcagtcattttaccagctccacagccactacgaggaggagcatagtggtgaggatcgggacgttaagggacaaatcaagtccctggtccagaaggcaaaaaaagccaaggacagactgcttaaacgtgaaggcgacgaccgcgccgagagcggaacacagggctacgagagtttctcgtatggcggcgtggacccgtacatgtgggaaccccaggagctaggggctgtccgctctcacttgtccgattttaaaaagcatagagctgctcggattgaccactacgtagtagaagtcaacaaacttatcatacggctcgaaaaactgaccgcctttgaccgaacaaatacagaaagtgcaaaaatccgggctattgaaaagagcgtcgtaccatgggtaaacgaccaggatgtccctttctgtcctgactgcggtaacaagttttccatccgaaatcgtcgccaccactgtagactgtgtggttcgataatgtgcaaaaagtgtatggagctgatcagtcttcctctagctaataaacttacatcagcctcgaaagagagcctcagcacacacacttcaccgtctcaaagtccaaacagtgtgcacggctcccgaagaggttcaattagtagcatgtctagcgttagttccgtgcttgacgagaaggacgatgaccgaatccgatgttgcacccactgtaaggatacattgttgaagcgcgaacagcagatcgatgagaaagaacacacgcccgacattgtcaagctatacgaaaaacttcgcctgtgtatggagaaagtggatcagaaagcgccggagtatatacggatggctgctagcttaaacgctggggaaactacctacagcctcgagcacgcatcagacctcagggtggaagtacagaaagtgtatgagttgattgacgcgctgtcaaagaaaatcctgaccctgggcttgaatcaagaccctccgccacacccatctaacctgagacttcagcgcatgatccgatacagcgcgaccctttttgtacaagagaagctgttaggactgatgtcactgccaacgaaggagcaattcgaagaactaaaaaaaaaacgtaaggaggaaatggagcgcaagcgcgccgttgaaagacaagctgcgctcgagtcgcagcgccggttagaggaaaggcagtcagggcttgcatcccgagccgccaacggggaggtcgcttccctcagaagggggcccgcacctctgcggaaggctgagggatggttacctttgtcaggaggccaggggcaaagtgaggacagcgaccctctgctgcagcagattcacaacataacgtcctttatcaggcaggctaaggctgcgggtagaatggatgaagtgcggacactgcaggagaatcttcgccagttgcaggatgaatatgaccaacagcagacagaaaaggccatcgagctttcacggagacaagccgaagaagaggatctgcagagagaacagctacagatgcttcgagagcgggaattagaacgagagcgggagcagttcagggtggcatcactccacactaggacgcgtagtctagactttcgcgagatcgggccttttcaactcgagccaagccgggaaccacgtactcacctggcatatgcactcgatcttggcagttcacccgttccttcctcgacagccccaaaaaccccatctctttcatctacccagccaactagggtatggagcgggccaccagctgtcgggcaagagcggctcccccagtcctccatgccccagcagcatgaagggccaagtctaaacccctttgatgaggaggatctctcaagtccaatggaggaggcgaccaccggaccccctgccgctggcgtcagccttgatccctcagctaggattctgaaggaatacaatccctttgaggaggaggacgaggaggaagaggctgtggctggaaaccctttcattcagcctgacagccctgcgcctaatcctttcagcgaggaagacgagcatcctcagcagcggcttagttctcccctcgttccaggaaaccccttcgaggagcccacctgcattaacccattcgagatggatagcgattcaggcccggaagcggaagaaccaattgaggaggaactcctgcttcaacagatcgacaatatcaaggcctacatatttgacgccaagcagtgcggtaggctggatgaggtggaagtcctgactgagaatctcagagagcttaagcacactctcgccaaacagaagggcgggaccgattag

SEQ ID NO: 32094 - DNA, 438 bp, Artificial Sequence
  Description of Artificial Sequence: Synthetic coding sequence
atggccgcctcactgaatgcaggcgagacaacctactctctcgagcacgccagtgatctgcgagtagaagtgcagaaggtatatgaactgattgacgccctaagcaagaagatattgactctgggcctgaaccaggacccacccccacaccctagtaacctaaggttgcaacgaatgatcagatattctgcaacattattcgtgcaggagaagctcctggggctaatgagcttgccaaccaaagagcagttcgaggagcttaaaaaaaaaaggaaagaggagatggaacgcaagagggcagttgaacgacaagcagcccttgaatcccagagacgcctcgaagagcgacagagggcgtcacaccctccgtgcttatgttttggctccaggctgttcccaagcagcaaacagcatagcagccaggacccttttacctag

SEQ ID NO: 32095 - DNA, 627 bp, Artificial Sequence
  Description of Artificial Sequence: Synthetic coding sequence
atggcctctcttgatgatccaggggaggtgcgcgagggcttcctgtgcccgctgtgtctcaaagatctgcagagcttttaccaactgcattcacactatgaggaggagcattctggcgaggaccgcgatgtgaaaggacagataaagtccctcgtgcagaaagcgaaaaaggctaaggataggttactcaaacgagagggcgacgatcgcgcagagagcggaacacagggctatgagtccttcagttacggaggcgttgatccctacatgtgggagccccaggagctgggggcagtgaggagccaccttagtgatttcaagaaacaccgagctgcccggatagaccattacgtagttgaggtgaataaactgattatccgcttagaaaagcttacggcgttcgacagaactaacaccgagtctgctaaaattagggctatcgaaaagtccgtggttccttgggtcaatgatcaggatgttccattttgtcctgattgtggaaacaagttctccatacgcaacagacggcatcactgtcgtctttgcggctccattatgtgcaagaaatgcatggaactgatctctttgcccctggccaagattacgacgctccatggcgagagctag

SEQ ID NO: 32096 - DNA, 2355 bp, Artificial Sequence
  Description of Artificial Sequence: Synthetic coding sequence
atggccagtcttgacgatccgggtgaagtgcgggagggatttctgtgtcccctctgtttaaaggacctgcaatccttttatcagctgcatagccactacgaagaagaacacagtggtgaggacagagatgtcaaggggcagatcaagtctctggtgcagaaagcaaagaaagctaaggacagactgctgaaacgagaaggagacgacagagctgagagtggaacacaaggctatgaatccttttcctacgggggcgtggacccctacatgtgggaacctcaggagttaggggccgtgcggtcccatctctccgattttaagaaacatcgcgcagctaggatcgatcattacgtggtggaagtaaataagctgatcatacgactggaaaaattaactgcgtttgatagaacaaacacagaatcagccaagattcgagcgattgaaaagtctgtggtgccctgggttaacgatcaagacgtgcccttctgccccgactgcggcaacaaattcagtattcgcaaccgcaggcaccattgtagactttgcgggtctatcatgtgtaaaaaatgtatggagctgatctccctgccactagccaacaagctgacatccgcctctaaagagagtctgtccactcatacatcaccatcgcaaagccctaacagcgttcatggctcacggagaggcagtattagtagcatgtcaagcgtaagttcagtgttagatgaaaaggacgacgaccgcatccgctgctgtacacattgcaaggatacgctcctgaagcgcgagcagcaaatcgacgagaaagaacatacgcctgacattgtgaagctttacgaaaagctgcgactgtgcatggagaaggtggatcagaaagcccctgaatacattagaatggccgcttctctcaacgccggtgagacaacgtattcactcgagcacgcaagcgatctgcgagtcgaagttcagaaagtgtacgagctcatcgatgccctgtctaagaaaatattgacattaggcttgaaccaggaccccccaccccacccctcaaatttgcgtcttcaacgtatgatcaggtatagcgcgactttgttcgttcaggaaaaactgttggggctgatgagtttacctacaaaggagcaatttgaagaacttaaaaagaagaggaaggaggagatggagagaaagcgcgcagttgagagacaggccgcgctggagagccaaaggaggctggaggaaaggcaatcaggtctcgcttctagagccgccaacggtgaagttgcatccttgagaaggggcccggcccctctgagaaaggccgagggctggctcccccttagcggcggccagggccaatctgaagacagcgacccacttctgcaacagatccacaatataacaagcttcatccgccaggcgaaagctgctggccggatggatgaggtcaggacgttacaagagaacctgagacagttacaggacgagtatgaccaacagcaaactgagaaggccatcgagctatccaggcgacaagccgaagaggaggacttacaacgcgagcagctccagatgctgcgagaaagggagttggaaagggagcgggaacagttcagggtcgcatccctgcacactagaacaaggagtcttgattttcgggaaatcggcccattccagctggagccctctagagagcccagaacccatctggcatatgcgctcgatcttggatcttctcccgtgccctcttctaccgcaccaaagaccccctcattgagttctacccaaccaacgcgtgtttggtccgggccaccagccgtgggccaagagagactccctcaatccagcatgccacagcagcacgaaggcccctccctaaatccctttgacgaggaggacctcagctccccgatggaggaggcgaccaccggaccgccagccgccggggtgtctctcgaccccagcgcgcgtatattaaaggagtataaccctttcgaggaagaggatgaggaggaggaagcggtggcaggtaatccttttattcaacctgacagcccggccccgaatcctttctcggaagaggacgaacacccgcaacagagattgtctagcccgctcgtacctggaaatcccttcgaggagcctacttgcatcaatccatttgaaatggattcagactctggtcccgaagccgaggagcccatagaagaggagctcctcctgcagcaaatcgacaatattaaggcctatatattcgacgccaagcagtgtggccggctcgatgaggtagaagttcttaccgaaaacttgcgtgagttgaaacacacgttggcaaaacagaagggcggaaccgactag

SEQ ID NO: 32097 - DNA, 126 bp, Artificial Sequence
  Description of Artificial Sequence: Synthetic coding sequence
atggcttcactggatgaccctggcgaagttagagagggtttcctatgcccactgtgtctgaaggaccttcagagcttctaccagctgcattcccactatgaggaagagcactctggggaagattag

SEQ ID NO: 32098 - DNA, 4278 bp, Artificial Sequence
  Description of Artificial Sequence: Synthetic coding sequence
atggagaattattttcaggccgaagcctacaacctggataaagtactggatgaatttgagcagaacgaggacgagacagtgtcctctactctgctggataccaagtggaacaaaattttggatcccccgtcacatcgcctgtcatttaaccctactttggcaagcgtgaatgaatctgctgtgtcaaatgaaagccagcctcagttgaaagtgttctcgcttgcacactctgcacctctcacgaccgaagaagaggatcactgcgcaaacggacaggactgcaatcttaaccccgagattgccacaatgtggattgacgagaatgccgtcgcggaagaccagcttattaaacgcaattactcatgggatgaccagtgtagcgccgtagaagttggcgagaaaaagtgtggcaacctggcatgcctgcctgacgaaaagaatgtcctggtggtcgccgtaatgcataactgcgacaaacggaccctacagaacgacctgcaagattgcaataactacaactcccagtcgctaatggacgcattctcatgctcgctcgataacgaaaacaggcagactgatcagttttctttttctatcaacgagtctacagagaaggacatgaactccgagaagcagatggatccactgaataggccaaagacagaggggagatccgtcaatcatctgtgtccaacaagttccgatagtcttgcaagcgtgtgttctccctctcagcttaaagatgatggcagcatcggccgcgatccctcaatgagcgcaatcacaagcctgacagtggattcagtcataagctcccaaggcacagatggatgccctgcagtcaagaaacaggagaactatattcctgatgaggacctgacagggaagatctcaagcccacggaccgacctgggctcccccaatagcttctcacatatgagcgagggcatcctaatgaagaaagagcctgcagaagaatcaacaaccgaggagtcgttaagatcggggctccccctgcttcttaaaccggacatgcccaatggttctggacgcaacaacgactgcgaacggtgctctgattgtctggtgcctaacgaggtgagagccgacgagaatgaaggctacgaacacgaggagaccctggggaccaccgagtttctgaacatgacagagcactttagcgaaagccaggacatgacaaactggaaactcactaaactgaatgaaatgaacgattcacaggtaaacgaagaaaaggagaagttcctgcagattagtcaacccgaagacactaacggtgactctggagggcaatgcgtgggattggcagacgcgggactggatctgaaaggcacctgcatttccgaatccgaggagtgtgatttttctacagtcattgatactccagcagcgaattatctttccaacggatgcgattcttacggcatgcaggatcctggagtttcattcgtgcctaaaacccttccgtctaaggaggatagcgtgaccgaggaaaaggagattgaggagtccaagtcggaatgctactcaaacatttatgaacagagaggtaatgaggcaaccgagggttcgggtctgctgctgaacagcacgggagatctcatgaagaagaactatctgcacaacttttgctctcaggtaccatctgtcctcggacagagctctccaaaggttgtggcctccctgccctctatcagcgtcccattcggaggcgcccggccaaagcagccttctaatttaaagctccagatccccaagcctttgagcgatcatctacagaacgactttcctgctaactctgggaacaataccaagaacaagaatgacatcctgggaaaagccaagctgggggagaactctgccacgaacgtttgcagcccaagcctaggaaatataagtaatgtggatacaaatggcgagcatctggaatcatacgaggccgagatctccaccagaccctgtttggctctggccccagattcccccgacaatgacctgcgagctgggcagtttggtatctcagccaggaagccatttactacactgggggaggttgcgccagtgtgggtcccagattcacaagcccccaactgcatgaaatgcgaggctcgatttacatttaccaagcggagacatcactgccgggcttgcgggaaggtcttttgtgccagctgctgcagcctgaaatgtaaactcctttatatggatcgtaaggaggcccgcgtgtgtgtgatatgccactctgtcttaatgaatgctcaggcttgggagaacatgatgtccgcgtccagtcaaagccctaatcccaacaacccagctgaatactgttccacaattcctcctcttcagcaggcccaggcttcgggggcactgtcatcacccccacccactgttatggtgccagtgggggtacttaaacaccctggcgccgaggtagctcagccgcgggagcagaggcgggtgtggttcgccgatgggatcctcccaaacggagaagtggctgatgcagctaagctgaccatgaatggtaccagtagtgccggcacactggccgtctcccatgatccagttaaacccgtgaccaccagccccctgcccgccgagacggatatttgcctcttcagcggatcaatcacacaggtgggttcgccagttggctccgctatgaaccttattcctgaggacggactgcctcccattctgatctcaacaggggtaaagggggactatgcagtggaggaaaagccatcacaaatcagtgtgatgcagcagctggaggatggaggacccgatccactcgtgtttgtccttaacgccaacctgctgagtatggttaaaatcgtcaattatgtaaatagaaagtgttggtgttttacaaccaaggggatgcatgccgtaggacagagtgagattgttatactactccaatgcctcccagacgagaagtgcctgccaaaggatatctttaaccattttgtccagctttacagggatgctctggccggaaacgttgtgtcaaatttggggcactcattttttagccagtcattcctgggcagtaaggagcatgggggctttctgtacgtgacctccacttaccagtccctgcaggacctagtactgccaacacctccgtacttgtttggcatcctgatccagaagtgggaaaccccttgggcgaaagtctttcctatccggctgatgctgcggcttggcgctgaatataggctgtatccatgtccgctgttttcagtcagattccgcaagccgttgtttggcgagacgggacacaccatcatgaatctactcgccgacttcaggaactaccagtatacgttacccgtagtgcaggggctcgtcgtggatatggaggtgaggaaaactagtataaaaatcccctcaaatcggtataatgaaatgatgaaggctatgaacaagtctaatgagcacgtcctggcggggggcgcttgtttcaatgagaaggcggactcacatctggtctgtgtacagaacgacgacggaaactatcagactcaggcaatttctattcataatcaacctaggaaggtcactggcgcctctttttttgtcttctctggcgcccttaagagttcatctggatacttagctaaatcatctattgttgaggacggggtgatggtccaaatcaccgccgagaacatggactccctgaggcaggccctcagagagatgaaggacttcactatcacatgcggcaaggctgacgctgaagaaccccaggaacacattcacatccagtgggtcgatgatgacaaaaacgtttcaaagggcgtggtgtcgccaattgatgggaaaagcatggagacgataacaaatgtgaaaatctttcacggaagtgagtataaagctaacggaaaggtgattaggtggacagaggtttttttcttagagaacgatgatcagcacaattgcctgagcgacccggcagatcacagtaggctgaccgagcacgtggccaaggcattctgtctggcactctgtccacatcttaaactgctgaaggaagacggcatgaccaagctcggactgagagtgacacttgacagcgaccaggtggggtaccaagcgggatccaacggccagcctctaccaagtcagtatatgaatgacctcgatagcgccctggttcccgtgatacatggcggcgcgtgccaactaagcgaaggacccgtggtaatggagctaatcttctatatcttggaaaacattgtatag

SEQ ID NO: 32099 - DNA, 4101 bp, Artificial Sequence
  Description of Artificial Sequence: Synthetic coding sequence
atggaaaattacttccaggcagaggcgtataacctggacaaggtcttggatgaatttgagcagaatgaggacgagaccgtatcaagcaccttgctggatacaaagtggaacaaaattctggatccccccagtcaccggctcagcttcaacccaacactggcctctgtcaacgaaagtgccgtctctaacgagtcccagccacaactgaaagtgttctccctcgcgcattctgcacctctaactactgaggaggaggatcactgtgccaacggccaagactgtaacctcaatccagagatagcaacaatgtggatcgacgagaacgctgtcgcagaagaccagctcatcaaaaggaactatagttgggacgaccagtgctccgccgttgaggtcggggagaaaaagtgtgggaacttggcctgcctgccagatgagaaaaatgtgttggtggtggcggtgatgcataattgcgataaaaggaccctgcagaacgatctgcaggactgtaataattacaacagccagagcctcatggacgccttttcatgtagtttagataatgaaaaccggcaaactgatcaattcagcttctctatcaacgaatccactgagaaagacatgaatagcgagaagcagatggacccgctcaaccggcctaaaaccgagggtaggagtgtgaaccatctgtgcccaacatcctcagactctctggcctccgtctgctctccttctcagctgaaagatgatggcagcatcggacgagatccatctatgtcggcaatcacatccttgaccgtggattccgtgatatcgtcacaaggcacagacgggtgccctgccgttaaaaaacaggagaactatattcctgatgaagacctgaccgggaagatatccagccccagaacggatctcgggagccctaactctttctcccatatgagcgaggggatcttaatgaagaaggaacctgcagaagagagcacgactgaggaaagtctgagatccggtctgcccttgctgcttaagcccgatatgcccaacgggagcggtaggaacaatgactgtgaacgctgctccgattgcctggtcccaaatgaggttcgcgctgatgaaaacgagggatatgagcacgaagaaacactgggtaccactgagttccttaacatgacagagcacttctcagaatctcaggatatgactaactggaagttgacaaagcttaatgaaatgaacgactctcaggtgaatgaggaaaaggagaaatttttgcagatctcccagccggaggataccaatggtgatagcggtggccagtgtgtagggcttgcagacgccgggctggacctgaaggggacgtgcatcagtgaatcggaggaatgcgatttttctaccgtgatcgatacacccgcggccaattacctgtccaatggttgcgacagttatggaatgcaggatccaggcgtgtcgttcgtgccaaaaaccctcccctcgaaagaggactctgtgaccgaggagaaagagattgaggaaagtaagagtgaatgctattctaacatttacgaacagcggggaaatgaggcaacagaggggagcggactccttctcaattcaaccggcgatctgatgaagaagaattacctccacaacttttgcagccaggtcccgagcgtcctgggtcagtcctctcctaaagttgttgcttctctgccgtccatctctgtgccttttggcggggctcgccccaagcaaccctcaaatcttaagctgcaaattcccaagcccctctctgatcatttacaaaacgactttcctgcaaatagcgggaataacaccaagaacaaaaacgatattctcggcaaggcaaagctgggggagaatagcgctaccaatgtgtgtagtccctcattaggtaacatatcaaatgtggacactaatggtgagcaccttgaaagttatgaggccgagattagtactagaccctgcttggcactggcgccagattcacctgataacgacctcagagcaggacagttcggaattagtgctcgaaagccttttaccactctgggagaggttgctccagtgtgggtgcccgactcacaggcccctaattgcatgaaatgtgaggctcgctttactttcaccaagcggaggcaccactgtagagcctgcggcaaggtcttctgcgcctcttgctgttcactgaaatgcaagctgctgtatatggacagaaaggaagccagagtttgtgtcatatgtcacagtgtgctaatgaatgtggcccagccgagggaacagcggagagtgtggtttgcggacggtattctgcctaatggcgaggtcgccgacgcggccaagctcactatgaatgggacttctagcgcggggacactcgcagtgtcacatgacccagtcaaaccagtcaccaccagccctcttcccgccgagactgacatctgcttgttttccggatctataacacaagtgggttcaccagtgggctccgcgatgaatttgatcccagaggatggcctcccacccatcctgatatctaccggggttaagggagattacgcggtggaagagaaaccgagccagatcagcgtgatgcaacagctggaggacggcggccctgatccactcgtgtttgtcctcaacgctaacctactgagcatggtaaagatcgtgaactacgtgaatcggaaatgctggtgctttactactaagggcatgcacgctgtgggacaaagcgagatcgtcatcttgctccagtgtctgcccgatgagaaatgtctcccaaaagatatttttaaccacttcgtacagctgtaccgcgacgcattagctggaaacgttgtgagcaacctgggacatagctttttttcacagagctttttgggaagcaaggagcatgggggtttcctgtacgttacttctacctatcagagccttcaggacctggtgttgcccacccccccttacttgttcggaatcttaatccaaaaatgggaaaccccctgggcaaaggtgttccccatcagactgatgctgcggctaggggcagagtacaggctgtatccttgtccactttttagcgtcaggtttcggaaacctctctttggtgaaaccggtcacaccatcatgaaccttttagccgattttaggaactatcagtatacactgcctgtcgtgcagggtctcgtcgtcgatatggaagtaaggaaaacgtctatcaagatcccaagcaaccgctataatgagatgatgaaggccatgaacaagtctaatgagcatgtgctggcaggaggggcatgcttcaacgaaaaggccgatagtcatttggtatgtgtccaaaatgacgacggaaactaccagacccaagccataagcattcacaaccagcccagaaaggtaactggggcaagctttttcgtgttctccggtgccctgaaatccagtagtggctacctcgcaaaatcatcgattgtcgaggacggggtcatggttcagataacagcagaaaacatggatagcctacgacaggccttgagggaaatgaaggacttcaccatcacctgtgggaaggccgatgcagaggagcctcaggaacacatccatattcagtgggtcgatgatgataagaatgtgtccaagggggtagtctcacccatagatggcaagtcgatggaaacaatcaccaacgtgaagatctttcatggatctgaatataaggctaacgggaaggtaatccgctggactgaagtcttcttcctagagaacgatgaccaacataactgtctgtctgaccctgctgatcacagccgcttgacggagcacgtggccaaggccttctgcttggccctatgcccccatctgaagcttctaaaagaggacggcatgaccaagctgggacttagggtgacactggacagcgatcaggtgggatatcaggcaggatctaatggccagccgctcccatcccagtacatgaacgatttggatagtgccctagtacccgtcattcacggcggtgcctgccaattatctgagggacccgttgtgatggaacttatcttttatatcctggagaacatcgtgtag

SEQ ID NO: 32100 - DNA, 2289 bp, Artificial Sequence
  Description of Artificial Sequence: Synthetic coding sequence
atggaaaattacttccaggcagaagcctataacttggacaaggtgcttgatgagtttgaacagaacgaggatgagacagtaagttcgactctcttggataccaagtggaacaaaatacttgatcctcccagtcataggctgtctttcaatcctaccctggccagcgttaacgaaagcgcagtgtctaatgagagccagccccagttaaaggtcttttctttggcccactccgccccgctaaccactgaggaggaggaccactgcgctaatggccaggattgtaacctcaatcccgagatcgctaccatgtggatcgacgagaacgccgtggccgaagatcagcttattaagagaaattactcatgggatgaccagtgttcagccgtcgaagtgggggagaagaaatgcggcaatcttgcatgcctgccagacgaaaagaacgtcctggtagtcgcagtaatgcacaactgcgataaaaggacgctacaaaacgacctacaggactgtaacaattacaactctcaatccctgatggatgccttctcctgcagcctggataacgaaaatcgacagacagaccagttttcctttagcattaacgagagcactgagaaagacatgaattctgagaagcagatggatcctcttaacaggcccaaaacggagggacgtagtgtgaaccatctttgcccaaccagttccgacagccttgccagtgtctgttcacctagccaactaaaagacgatggttcgattgggcgtgatccttcgatgtcggctattacctctctcacagtggactctgttatcagctcccaaggtactgatggttgccctgccgtgaagaagcaagagaactatatccccgacgaggatctcaccgggaagatcagctctccacgaactgacctcgggtctccaaactccttctcccacatgagcgaggggatcctgatgaagaaggaacccgccgaggagtcgaccactgaggagtctctcagatctgggctgcctttgctcctgaaacccgatatgcctaatggctctggacgcaacaatgactgcgagcgttgttccgattgccttgtcccgaatgaggttcgggcagacgagaatgaaggctacgaacacgaggagacactcggaactacagagtttctgaatatgaccgagcatttcagtgagtctcaagatatgactaactggaagttaacaaaacttaacgagatgaacgacagccaggtaaatgaagaaaaagaaaagtttctgcaaattagtcagccagaagatactaatggagactccggtggacagtgcgtgggattggctgacgccggcttggaccttaagggcacgtgtatcagcgagagcgaggaatgcgacttcagcaccgtgattgatacaccggctgccaattatctgtccaatggctgtgattcctacggtatgcaggatccaggcgtgtcattcgtcccaaagactcttcctagtaaggaagattccgtcacggaagagaaggagatcgaagaaagtaagagtgaatgctatagtaacatctacgaacagagaggaaatgaagctacagaaggatccggacttctgcttaactcgacaggggacctgatgaaaaaaaactacctgcacaatttctgtagccaggtcccttccgtgctcggccagtcgtcccccaaagtggtggcttccctgccatctatcagtgtgccttttggtggagcccggccaaagcagcccagcaatctgaagctgcagattccaaagccactgtctgatcacctgcagaatgacttccctgcaaacagcggcaataacactaaaaataagaatgatatactcggaaaggccaagctgggagagaacagcgcaaccaacgtgtgtagtccaagcctcggaaacatttctaacgttgacaccaatggtgagcacctggagtcctacgaggcggaaatcagcacccgcccatgcctggctttagcacccgattcacccgataatgatctgcgcgctggacagtttggtatttcagcacggaagccttttaccacccttggagaggtggcccccgtgtgggttcccgacagccaagcccctaactgtatgaaatgcgaggctcgcttcacctttactaaaagaaggcatcattgtcgtgcttgcggaaaggtattttgcgcctcctgctgcagcctcaagtgtaaactgctatacatggacaggaaagaggccagggtttgtgtaatatgccacagcgtgctgatgaacggcaaatactag

SEQ ID NO: 32101 - DNA, 4278 bp, Artificial Sequence
  Description of Artificial Sequence: Synthetic coding sequence
atggagaattactttcaggcggaggcttacaacctggataaggtgctggatgagtttgagcaaaacgaggacgaaaccgtatcaagtaccctactcgatactaagtggaataaaatcctggatccaccctcccatagactcagtttcaatccaactctcgcgtccgtgaacgaatcggcggtgtcaaatgaaagccagccacagctcaaagtcttcagtcttgcacatagcgccccgcttacgaccgaagaggaggaccactgcgcgaatggtcaggactgtaacttaaacccggagattgctacaatgtggatagatgaaaacgctgttgcagaggatcagcttattaagcggaactattcctgggacgatcagtgttctgctgtggaagtgggcgagaagaagtgcggtaatctggcatgcctgccagacgagaaaaatgtcttagtggtggccgtgatgcataattgcgacaaacggacgctccagaatgacctgcaagattgcaataattacaattcccaaagccttatggatgcatttagttgtagccttgataatgagaatcgacagacggaccaattcagtttttcaatcaatgaaagcacagaaaaggacatgaactccgaaaagcaaatggatccactgaacaggcctaagaccgagggtagatccgtgaatcatctatgccctaccagcagtgattccctggctagcgtctgttcccccagtcagctgaaagatgacgggtcaatcgggcgagatccaagcatgagtgccatcacttctctgacagtggattccgttatctccagccagggcacggacggttgccctgctgtgaaaaagcaggaaaactacattcccgacgaggaccttactgggaagatcagctccccaagaaccgatctcgggagccctaattccttctctcacatgagcgagggcatcttgatgaagaaggagcccgccgaggagagcacaacagaggaaagcctacgctctgggttgccgctcctgttgaaacccgacatgcccaacggtagtggcaggaacaacgactgtgaaagatgcagcgattgcctggtgcccaatgaggtccgcgcggatgaaaatgagggatacgagcacgaagaaacactggggaccacggaattcctgaacatgactgagcatttttctgaaagccaagacatgactaattggaaacttaccaagcttaacgagatgaacgactctcaggtgaatgaagagaaggagaaattcctgcaaatatcacagcctgaggacaccaacggtgactccggaggacaatgcgtgggtctcgctgatgccggtttggacctgaaagggacctgcatatccgagtcggaagagtgcgacttcagtaccgtaattgatacgcccgcggctaattacctgagtaacggatgtgattcttatggcatgcaggaccccggtgtttccttcgtccctaagactctgccaagcaaagaagattctgttacggaggagaaagaaattgaagagtccaaatccgagtgttactccaacatctacgaacagcgcgggaatgaagccaccgagggttctggattgcttctgaacagcaccggcgatcttatgaagaaaaattatctccacaatttttgctcacaggtgccaagtgtgctgggacagtcgagcccaaaagtagtggcttcgcttcctagtatctctgtaccattcgggggcgctcgccctaagcagccttcgaacttgaagctgcagattcctaaaccgctgtccgaccacttacagaacgactttcctgccaacagcggaaataacacaaagaacaagaacgacatccttgggaaggccaagttaggagagaatagtgctaccaatgtgtgctccccgtcactgggaaacattagtaacgtggatactaacggtgaacatctagaaagttacgaggctgaaatcagcaccaggccgtgcttggcgcttgcacctgactctcctgataatgatctgcgggcgggacagtttggaatttccgcacggaagccctttacaacccttggcgaggtggccccagtatgggtgcctgactcccaggctcccaactgtatgaaatgcgaagcccggttcactttcaccaagcgcaggcaccattgtcgggcatgtgggaaggtgttttgcgcttcatgctgtagcctcaaatgcaagcttctgtatatggatcgcaaggaggcccgcgtctgtgtcatctgccactccgtcctgatgaatgctcaggcatgggagaacatgatgtcagcctcctcccagagccctaaccccaataaccccgccgagtactgctcaactataccacctctacagcaagcccaagctagtggtgccttgtcttctccacctccgacagtgatggtgcctgtgggggtcttgaagcaccctggcgcagaggtggctcaacccagagaacagcgcagagtgtggtttgcggatggcattctcccaaatggagaggtggcggacgccgccaagctgacaatgaatggcacgtcatccgccggtacactcgcggtgtcacacgacccagtgaaaccagttaccacatcaccactgcctgcagaaacggatatctgtctgttttcaggatccattacccaggtcggatctcccgtcgggtctgctatgaacctcattccggaggacggcctaccacccattctcatcagcactggcgtgaagggagattacgctgttgaggagaaacccagtcagatctcagtgatgcaacagctcgaggacggagggccagacccactggttttcgtcctgaatgcaaacctgctgtcgatggtgaagatagttaattatgtcaatcggaagtgttggtgcttcaccacaaaaggtatgcatgctgttggccagtctgaaattgtgatccttttacagtgcctgccagacgaaaagtgcctgcccaaagatattttcaatcactttgtgcagctctatcgcgacgcactggcaggcaacgtggtgtctaacctgggacactcattcttttcacagtcctttttgggctccaaggagcacggcggattcctctacgtcaccagcacctaccagtctctccaagatttagtgctgcctacccccccctatctgttcggcatcctgattcagaaatgggagacaccatgggccaaggtgttcccgatcaggcttatgctgaggttgggagctgaatatcgcctgtatccatgcccactgttctccgttcgatttcggaagccactgtttggagagaccgggcacacaattatgaacctgctggccgactttaggaactaccaatatactctccccgtggtgcaggggctggtcgtcgatatggaagtgaggaaaacatcgatcaagataccaagtaatcgatacaatgagatgatgaaggcaatgaataaaagcaacgaacatgtacttgctggaggagcttgctttaatgagaaggctgacagccacctggtctgcgtgcagaacgatgatgggaattatcagacccaagccatcagtatccacaaccagccgaggaaggtgacaggagcctccttcttcgtgttctccggcgctcttaagagctcctctgggtatctcgctaagagttcaatcgtcgaggacggtgtcatggttcaaattacagccgagaacatggatagtcttcgacaggcattgcgcgagatgaaggatttcaccattacgtgcggcaaagccgatgcggaagagccccaggagcacatccacatacagtgggtcgatgacgacaaaaacgtctcaaagggggttgtgagcccaatcgacggcaagtctatggaaacaataacaaacgtcaagatcttccatggttccgagtataaagccaatggtaaagtcatacgctggaccgaggtctttttcctggaaaatgacgaccagcacaactgtttaagtgatcccgcagaccacagcagacttaccgagcacgtggcaaaggcattttgccttgctttgtgtccacacctgaaactgcttaaggaggacgggatgaccaaactgggcttgagagtcacacttgattctgatcaagtgggataccaggcaggcagcaacggccaaccgctcccatcccaatatatgaatgatctcgactcggcactagtcccggtcattcatgggggtgcctgccagctgagtgaaggcccagtggttatggagctcattttttatattttagagaatattgtttag

SEQ ID NO: 32102 - DNA, 2514 bp, Artificial Sequence
  Description of Artificial Sequence: Synthetic coding sequence
atggctagcaagcggaagtccactactccttgtatggtgagaacctcacaggtggtggaacaggatgtcccggaagaagtggatcgcgcgaaggagaagggcataggcacaccacagcccgacgtcgccaaggacagctgggcagccgaattagaaaactcttcgaaagaaaatgaagtgatcgaggtgaaaagtatgggtgagtcccagagcaagaagctgcagggcggctacgaatgcaagtactgcccatattctacgcagaatctgaatgagtttaccgagcacgtagacatgcagcaccccaacgtcatcctgaatcctctgtatgtctgtgccgaatgcaacttcaccacaaaaaagtatgatagcctgagcgaccacaactcgaagttccaccccggtgaggccaacttcaagctgaagctgattaaacgcaacaaccaaactgttctcgagcagtctattgaaactactaaccacgtggtctcaattactacaagcggacccggtacaggagactccgactcaggtatatctgtgagcaagacgccgataatgaagccgggcaagccaaaggctgacgctaaaaaagttccaaagaaacccgaagagatcacacccgagaaccacgtcgaggggactgcaagactcgtgaccgacacagcagagattctgtcccgcttggggggcgtggagctacttcaggacactctcggtcacgttatgccgtcagtccagttgcctcccaatatcaatctggttcctaaagttcccgtcccattaaacaccaccaagtacaatagtgcgctggatactaatgccactatgatcaactcgtttaacaagtttccgtatccgactcaagccgagctttcctggctcacagccgccagcaagcaccctgaggaacacataaggatctggtttgctactcagaggttgaagcacggcatttcttggagccccgaggaggtcgaggaagccagaaaaaaaatgttcaatggtacaatccagagcgtgcccccaacaattactgtgctccctgcccagctggcacctacgaaggtcactcaaccgatcctgcagacagctttgccctgccagatcctgggtcagacatcgcttgtcctcacccaggttacctcaggctccacgaccgtgtcctgctctccaattacacttgccgtagccggggtgacgaatcatggacagaagaggccattggtgacacctcaagccgcccctgagccaaaacgacctcacattgcccaggttcctgagcctccacccaaggtcgcaaaccctcctctgacaccagctagcgataggaagaaaaccaaggagcagatcgcacatctgaaagcgtcatttttgcagagccagtttcccgacgacgccgaggtttaccgcttaatcgaggtcactggcctcgcaaggagtgagatcaaaaagtggttcagcgatcacagatatcgctgtcaacgggggatcgtgcacatcacatcagaaagcttagctaaggatcagctggcaatcgctgcaagcagacacgggcgtacataccatgcctacccagattttgcacctcagaaattcaaggaaaaaactcaggggcaggtgaagatattggaggattctttcctgaagtcttctttccctacgcaggcagagctggaccgtctgagagtggagaccaaactctctaggagagaaatcgattcctggttctcagagcggagaaagttgcgtgattcaatggaacaagcagtcttggactccatgggttccggcaagaaagggcaagacgtcggggctccaaatggcgctctgtccaggctggaccagttatcaggggcacagctgacatctagtcttccatccccaagccccgctattgctaaatcgcaagagcaggtgcatctgctgcggtcaacattcgcccgaacccagtggccaactcctcaggagtatgaccagttggctgcgaaaactggactggtgcgcaccgagatcgtccgctggttcaaggagaataggtgtctcctgaaaaccggcactgtcaagtggatggagcagtaccaacatcagcctatggcagacgatcatggttatgacgccgttgccaggaaagccacaaagccaatggccgagtcacccaaaaacggtggggacgtggtgccccaatactacaaagaccccaagaagctttgcgaggaggaccttgaaaaattggtgacaagggtgaaggtaggctctgagccagctaaagactgcctgccggccaaaccctctgaggctactagtgacaggtcagagggctcttcacgggacggccagggaagcgacgagaacgaggagagcagcgtagtcgactatgtcgaagtcacagtgggtgaggaagacgcaatcagtgatcgtagcgactcctggagtcaggctgccgccgaaggcgtgtctgaactcgccgagtcagacagcgattgcgtaccagccgaggctggtcaggcttag

SEQ ID NO: 32103 - DNA, 501 bp, Artificial Sequence
  Description of Artificial Sequence: Synthetic coding sequence
atggcatccaagcggaaatcaaccaccccctgtatggtccgcacatcacaggtcgttgagcaagatgtgcctgaggaagtcgaccgcgccaaggagaagggcatcggaaccccccaaccagacgttgccaaagactcgtgggcagctgagctcgagaattcctccaaggaaaacgaggtgatagaggtcaaaagtatgggggagtcccagagtaagaaactgcagggaggctatgaatgtaaatattgcccttactcgacgcagaacctgaatgaattcacagagcatgtggatatgcaacatcccaatgtgattctcaatcccctttacgtttgcgctgagtgtaattttactacaaaaaagtacgattcactgtcggaccataactccaagttccaccctggcgaagcaaattttaagctgaagctcattaagagaaacaaccagacagtcctggagcagtctatcgaaaccaccaatcacgtggtctctataacctag

SEQ ID NO: 32104 - DNA, 465 bp, Artificial Sequence
  Description of Artificial Sequence: Synthetic coding sequence
atggctctgctgttgtccgtgttaagggtgttacttggcggatttttcgcactcgtcggactcgctaaactctccgaggagatctctgccccagtttctgaacggatgaatgcattattcgttcaatttgcggaggtgttcccccttaaggtttttgggtaccagcctgatccactgaattaccagattgccgtaggatttcttgaactactggccggacttcttcttgtaatggggccccctatgcttcaagaaatatctaatctgttcctgattctgttgatgatgggagccatcttcacactcgccgctcttaaggagtctcttagcacttgtatcccagcaatcgtctgcctgggcttcttgttgttactgaacgtcggtcaactgttggcgcagaccaaaaaggtcgtgaggcccactaggaagaaaacactatcgacatttaaggaatcatggaagtag

SEQ ID NO: 32105 - DNA, 1296 bp, Artificial Sequence
  Description of Artificial Sequence: Synthetic coding sequence
atgatgctgagattctccatgtgcagaggcaacgatgaaggctttgctatggagcagatctggctgcttcttttgttgacaataagggtgctcccgggcagcgctcagtttaacggctacaactgcgacgctaatttgcactcacgcttcccagccgagagggatataagcgtgtattgcggagttcaggccatcacaatgaagatcaacttctgcaccgtcttattttctggctattccgagaccgacctcgccctcaacggccgacacggcgatagccactgtcgtggttttatcaacaacaatactttccctgccgtcgtgattttcatcatcaatttgtccaccctggaggggtgtggaaataacctggttgtgtctacaatccccggtgtgtccgcctacgggaatgccacctccgtgcaggtagggaacatttcaggatatattgatacgcccgaccctcccacgataatatcctacctgccagggctgctttacaagttttcctgcagttatccattggagtacttagtcaacaacacccagctggcatccagctcagcagcgatcagcgtgagggagaacaatggtacatttgtgagcacattaaatttgttgttatataacgatagtacctataaccagcaattaatcattccttcgatcgggctgcctctcaagaccaaggtgtttgcagcagtgcaggctacgaacctggatggacgatggaacgtcctgatggactactgctacaccacaccctccggaaatcctaatgatgatattcgatatgacctgttcctcagctgcgacaaagaccctcagaccacagttatcgagaacggtcggtcccaacggggccgcttttccttcgaggtttttagattcgtgaagcacaagaatcaaaaaatgtcaacagtgttcctccactgtgtgacaaaactctgcagagcagacgactgccctttcctgatgcctatatgttcccaccgcgagagaagggacgctgggaggcgcaccacatggagtcctcagtcctcttcaggctccgccgtgttatctgccggtccaatcataaccaggtctgacgagacgccgaccaacaacagccagctgggaagcccttccatgcccccttttcagctcaacgcgataacttccgcacttataagcggtatggttatattaggcgtgacgtccttttcattgcttctgtgttccctcgcgctcctgcacaggaagggtccaaccagccttgtcctgaacggtattaggaatcccgtgtttgattag

SEQ ID NO: 32106 - DNA, 1248 bp, Artificial Sequence
  Description of Artificial Sequence: Synthetic coding sequence
atggagcagatctggctcctgctcttgctcaccataagggtcctgcctggcagcgcccagttcaatggatataactgcgacgccaaccttcacagtcgctttcctgcagaaagagatatctctgtgtattgtggagtgcaggcgattacaatgaagattaacttctgtaccgtgttattttctggctatagtgaaaccgacctggccctgaacgggcggcacggcgattcccattgtcgcggttttataaacaataacacattccccgcagtcgtcattttcattattaatttgtccactcttgaggggtgtgggaataatctggtcgtcagcaccatacctggagtgagcgcttatgggaacgctacctcagtgcaagtaggtaacatctctggatatatagatacccccgaccctcctactatcataagttatctgccaggtcttctgtataaattctcatgctcatatccactggaatacttggtgaacaacacccaactggcaagtagttcagctgctatcagcgtcagggagaataacggaacattcgtttccaccctgaacctgttactttacaatgactctacgtacaatcagcagctgatcatcccgtcaataggcctgccacttaaaaccaaggtgttcgctgctgtccaggctaccaacttagatggccgctggaacgtgttgatggattactgctatactactcctagcggtaatcccaatgacgacatccgctatgatctttttctaagctgcgataaagacccacagaccaccgtgattgagaacggaagaagtcaacgggggcggttcagctttgaggtgttccgcttcgttaagcataagaaccagaagatgagcactgtgtttctgcactgtgtgacaaaactttgcagggctgatgattgccctttccttatgccgatttgttcccaccgagaaagacgtgatgccggccggagaacaacctggtccccacagtcatcgagtggtagcgctgttctctcggccggccccatcatcactcggtccgatgagacccccaccaacaacagccagttagggtccccgtcaatgcccccctttcaactaaacgcgatcacttctgcgctgataagtggcatggtgatactcggagtgacctcctttagcctgctgttatgttcgcttgcactgctgcaccgcaagggtccaacgtccctcgttctgaacggcatacgcaatcctgtcttcgattag

SEQ ID NO: 32107 - DNA, 1248 bp, Artificial Sequence
  Description of Artificial Sequence: Synthetic coding sequence
atggaacagatctggctgctgctgctgctcactataagggtattacctggatcagctcagttcaacggctacaactgtgacgctaacctgcattcaaggttccctgccgaacgtgacatttctgtctactgtggcgtccaggcaattacaatgaaaatcaatttctgcactgtccttttcagcgggtattccgaaactgatcttgctctgaatgggcgacacggggattctcattgtcgcggattcatcaataacaatactttcccggccgtagttattttcatcatcaacctgtccacgttagaaggctgcggaaataatctggtggtttctaccattcctggtgttagcgcttacggcaacgcaaccagtgtgcaggtaggtaacatctcaggctacattgatacccccgacccccctactattattagctatctgccaggtcttctatacaaattttcttgttcttatccgttggagtatctggttaataatactcaactggcctcaagctccgcagccatctcagtgcgggaaaacaacggtacctttgtgagcaccctaaaccttctactgtacaatgattccacctacaaccagcagctgatcattccttctattggattgccgctgaagaccaaagtatttgcagcggtccaggccacaaacttggacgggaggtggaatgtgctgatggattactgttataccactcctagtggcaaccccaatgacgatatccggtacgatttattcctatcttgtgataaagacccccagaccaccgtcatcgaaaacggaaggtcccagcgcggaaggttctcatttgaggtgtttagatttgtgaagcacaagaatcaaaaaatgtctaccgtgtttctgcattgcgtaactaaactgtgtcgcgccgacgattgtccattcctgatgcctatttgctcccacagagagcgccgagacgccggccgtcgtacgacctggagtcctcagagctcgtccggttccgccgtgctcagcgcaggccctattattacaaggagtgacgagaccccaaccaataactcacaactaggttctccctccatgccaccatttcagttgaacgcaattacttccgctctgatctcagggatggtcattttgggggtcactagtttctcattgctgctgtgctcactggccctcctacacagaaagggcccgaccagcctggtgttgaatggtattcgcaaccccgtgtttgattag

SEQ ID NO: 32108 - DNA, 1131 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtggcctgtgtccaagcagctgtacagaaggctgaactgccgcctggcctacagcctgtggagccagctggtgatgctgctggagtggtggagctgcacagagtgcaccctcttcacagaccaggccaccgtggagagatttgggaaggagcacgccgtcatcatcctgaaccacaactttgaaattgacttcctgtgtggctggaccatgtgtgagcgcttcggcgtgctgggcagcagcaaggtgctggccaagaaggagctgctgtatgtgcccctcatcggctggacctggtacttcctggagatcgtgttctgcaagaggaagtgggaggaggaccgggacacagtggtggagggcctgcggcggctgagtgactacccagagtacatgtggttcctgctgtactgtgagggcacccgcttcacagagaccaagcaccgggtgtccatggaggtggccgccgccaagggcctgcctgtgctgaagtaccacctgctgcccaggaccaagggcttcaccacagctgtgaagtgcctgcggggcaccgtggccgctgtgtatgatgtgaccctgaacttccggggcaacaagaaccccagcctgctgggcatcctgtatggcaagaagtatgaagctgacatgtgtgtgcggcgcttccccctggaggacatccccctggatgagaaggaggccgcccagtggctgcacaagctgtaccaggagaaggatgccctgcaggagatctacaaccagaagggcatgtttcctggagagcagttcaagccagcccggcggccctggaccctgctgaacttcctgtcctgggccaccatcctgctgagccccctcttctcctttgtgctgggcgtgtttgccagcggcagccccctgctgatcctgaccttcctgggctttgtgggcgccgccagctttggagtgagaagactcatcggcgtgacagaaattgagaagggcagcagctatggcaaccaggagttcaagaagaaggagtag

SEQ ID NO: 32109 - DNA, 1131 bp, Artificial Sequence; identical to SEQ ID NO: 32108
  Description of Artificial Sequence: Synthetic coding sequence

SEQ ID NO: 32110 - DNA, 1131 bp, Artificial Sequence; identical to SEQ ID NO: 32108
  Description of Artificial Sequence: Synthetic coding sequence

SEQ ID NO: 32111 - DNA, 1131 bp, Artificial Sequence; identical to SEQ ID NO: 32108
  Description of Artificial Sequence: Synthetic coding sequence

SEQ ID NO: 32112 - DNA, 1131 bp, Artificial Sequence; identical to SEQ ID NO: 32108
  Description of Artificial Sequence: Synthetic coding sequence

SEQ ID NO: 32113 - DNA, 768 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtggcctgtgtccaagcagctgtacagaaggctgaactgccgcctggcctacagcctgtggagccagctggtgatgctgctggagtggtggagctgcacagagtgcaccctcttcacagaccaggccaccgtggagagatttgggaaggagcacgccgtcatcatcctgaaccacaactttgaaattgacttcctgtgtggctggaccatgtgtgagcgcttcggcgtgctgggcagcagcaaggtgctggccaagaaggagctgctgtatgtgcccctcatcggctggacctggtacttcctggagatcgtgttctgcaagaggaagtgggaggaggaccgggacacagtggtggagggcctgcggcggctgagtgactacccagagtacatgtggttcctgctgtactgtgagggcacccgcttcacagagaccaagcaccgggtgtccatggaggtggccgccgccaagggcctgcctgtgctgaagtaccacctgctgcccaggaccaagggcttcaccacagctgtgaagtgcctgcggggcaccgtggccgctgtgtatgatgtgaccctgaacttccggggcaacaagaaccccagcctgctgggcatcctgtatggcaagaagtatgaagctgacatgtgtgtgtag

SEQ ID NO: 32114 - DNA, 1113 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtggcctgtgtccaagcagctgtacagaaggctgaactgccgcctggcctacagcctgtggagccagctggtgatgctgctggagtggtggagctgcacagagtgcaccctcttcacagaccaggccaccgtggagagatttgggaaggagcacgccgtcatcatcctgaaccacaactttgaaattgacttcctgtgtggctggaccatgtgtgagcgcttcggcgtgctgggcagcagcaaggtgctggccaagaaggagctgctgtatgtgcccctcatcggctggacctggtacttcctggagatcgtgttctgcaagaggaagtgggaggaggaccgggacacagtggtggagggcctgcggcggctgagtgactacccagagtacatgtggttcctgctgtactgtgagggcacccgcttcacagagaccaagcaccgggtgtccatggaggtggccgccgccaagggcctgcctgtgctgaagtaccacctgctgcccaggaccaagggcttcaccacagctgtgaagtgcctgcggggcaccgtggccgctgtgtatgatgtgaccctgaacttccggggcaacaagaaccccagcctgctgggcatcctgtatggcaagaagtatgaagctgacatgtgtgtgcggcgcttccccctggaggacatccccctggatgagaaggagggccactgctggcctgtggcccctgtgacccaccctgagcccggggccaccctggaggccccccggcgggagggccctggccccccaactggagtgtggcctgtgaagctgcctgcctgggccgtggtgtcctggggccgccgctggccacccagcctgggccctggggcccgctgccacggcgtgtcctgccccagcagccagggctgccactgctgcctgcaccggctgcccccctgtgagaccctggtggtgtggtacagcgccaccgtgtaccagaccaggaccctgtgtgaggtgctgtag

SEQ ID NO: 32115 - DNA, 387 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtggcctgtgtccaagcagctgtacagaaggctgaactgccgcctggcctacagcctgtggagccagctggtgatgctgctggagtggtggagctgcacagagtgcaccctcttcacagaccaggccaccgtggagagatttgggaaggagcacgccgtcatcatcctgaaccacaactttgaaattgacttcctgtgtggctggaccatgtgtgagcgcttcggcgtgctgggcagcagcaaggtgctggccaagaaggagctgctgtactag

SEQ ID NO: 32116 - DNA, 240 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtggcctgtgtccaagcagctgtacagaaggctgaactgccgcctggcctacagcctgtggagccagctggtgatgctgctggagtggtggagctgcacagagtgcaccctcttcacagaccagtag

SEQ ID NO: 32117 - DNA, 117 bp, Artificial Sequence
  Description of Artificial Sequence: Synthetic coding sequence
atgggcctgctggccttcctgaagacccagtttgtgctgcacctgctggtgggctttgtgtttgtggtgtctggcctggtgatcaactttgtgcagctgtgcaccctggccctgtag

SEQ ID NO: 32118 - DNA, 768 bp, Artificial Sequence; identical to SEQ ID NO: 32113
  Description of Artificial Sequence: Synthetic coding sequence

SEQ ID NO: 32119 - DNA, 1131 bp, Artificial Sequence; identical to SEQ ID NO: 32108
  Description of Artificial Sequence: Synthetic coding sequence

SEQ ID NO: 32120 - DNA, 1137 bp, Artificial Sequence
  Description of Artificial Sequence: Synthetic coding sequence
atggacctggccggcctgctgaagagccagttcctgtgccacctggtgttctgctacgtgttcatcgccagcggcctcatcatcaacaccatccagctgttcaccctgctgctgtggcccatcaacaagcagctgttcaggaagatcaactgccgcctgagctactgcatcagcagccagctggtgatgctgctggagtggtggagcggcacagagtgcaccatcttcacagacccccgggcctacctgaagtatggcaaggaaaatgccatcgtggtgctgaaccacaagtttgaaattgacttcctgtgtggctggagcctgtctgagcgcttcggcctgctgggcggcagcaaggtgctggccaagaaggagctggcctacgtgcccatcatcggctggatgtggtacttcacagagatggtgttctgcagcaggaagtgggagcaggacaggaagacagtggccaccagcctgcagcacctgcgggactacccagagaagtacttcttcctgatccactgtgagggcacccgcttcacagagaagaagcatgagatctccatgcaggtggcccgggccaagggcctgccccggctgaagcaccacctgctgcccaggaccaagggctttgccatcaccgtgcgcagcctgagaaatgtggtgtctgctgtgtatgactgcaccctgaacttcagaaataatgaaaaccccaccctgctgggcgtgctgaatggcaagaagtaccacgccgacctgtatgtgcggcgcatccccctggaggacatcccagaagatgatgatgaatgttctgcctggctgcacaagctgtaccaggagaaggatgccttccaggaggagtactacagaacaggcaccttccctgagacccccatggtgcccccaagaagaccctggaccctggtgaactggctgttctgggccagcctggtgctgtaccccttcttccagttcctggtgtccatgatccgcagcggcagcagcctgaccctggccagcttcatcctggtgttctttgtggcctctgtgggcgtgcgctggatgattggagtgacagaaattgacaagggcagcgcctacggcaacagcgacagcaagcagaagctgaatgactag

SEQ ID NO: 32121 - DNA, 480 bp, Artificial Sequence
  Description of Artificial Sequence: Synthetic coding sequence
atggacctggccggcctgctgaagagccagttcctgtgccacctggtgttctgctacgtgttcatcgccagcggcctcatcatcaacaccatccagctgttcaccctgctgctgtggcccatcaacaagcagctgttcaggaagatcaactgccgcctgagctactgcatcagcagccagctggtgatgctgctggagtggtggagcggcacagagtgcaccatcttcacagacccccgggcctacctgaagtatggcaaggaaaatgccatcgtggtgctgaaccacaagtttgaaattgacttcctgtgtggctggagcctgtctgagcgcttcggcctgctgggcgtgtcccagaagtgcatccccccctgcctgacccacttcagcggcagcgccccacccctggtgttcctgctgctggtgatccagaacctgcagaagaaccagcagagcttctacctgatgaagtggagctag

SEQ ID NO: 32122 - DNA, 375 bp, Artificial Sequence
  Description of Artificial Sequence: Synthetic coding sequence
atgctgctggagtggtggagcggcacagagtgcaccatcttcacagacccccgggcctacctgaagtatggcaaggaaaatgccatcgtggtgctgaaccacaagtttgaaattgacttcctgtgtggctggagcctgtctgagcgcttcggcctgctgggcggcagcaaggtgctggccaagaaggagctggcctacgtgcccatcatcggctggatgtggtacttcacagagatggtgttctgcagcaggaagtgggagcaggacaggaagacagtggccaccagcctgcagcacctgcgggactacccagagaagtactttgtgtgccgccaccagagcagctgtgtgccccgggccccagctggcctgtag

SEQ ID NO: 32123 - DNA, 402 bp, Artificial Sequence
  Description of Artificial Sequence: Synthetic coding sequence
atggacctggccggcctgctgaagagccagttcctgtgccacctggtgttctgctacgtgttcatcgccagcggcctcatcatcaacaccatccagctgttcaccctgctgctgtggcccatcaacaagcagctgttcaggaagatcaactgccgcctgagctactgcatcagcagccagctggtgatgctgctggagtggtggagcggcacagagtgcaccatcttcacagacccccgggcctacctgaagtatggcaaggaaaatgccatcgtggtgctgaaccacaagtttgaaattgacttcctgtgtggctggagcctgtctgagcgcttcggcctgctgggctttgacctgctgcacgtggcctgcatgcccctggagctgggcctcttctcctag

SEQ ID NO: 32124 - DNA, 357 bp, Artificial Sequence
  Description of Artificial Sequence: Synthetic coding sequence
atggacctggccggcctgctgaagagccagttcctgtgccacctggtgttctgctacgtgttcatcgccagcggcctcatcatcaacaccatccagctgttcaccctgctgctgtggcccatcaacaagcagctgttcaggaagatcaactgccgcctgagctactgcatcagcagccggctgcagggccctggccaggagagagctggcctgtgccccaactaccgcctggatgtggtgctgcacagagatggcctgctgtttgcccaggtgggcgccggcagccaggacggctgccaccagtttgctgcccctcctggcctgccccgggaggtgttcttcccagacagcctgtag

SEQ ID NO: 32125 - DNA, 318 bp, Artificial Sequence
  Description of Artificial Sequence: Synthetic coding sequence
tgaagtgctgtgtatgactgcaccctgaacttcaggaacaatgaaaaccccaccctgctgggcgtgctgaatggcaagaagtaccacgccgacctgtatgtgcggcgcatccccctggaggacatcccagaagatgatgatgagtgcagcgcctggctgcacaagctgtaccaggagaagggctggggagacacagagttcagcaagcagtatgtgtctgtgtccaggcctggccgcctggccctgtgccccagcgagaagattgctgagcagcaggtggaggtggtgcacggcttcagcaagcagagcggggagtag

SEQ ID NO: 32126 - DNA, 651 bp, Artificial Sequence
  Description of Artificial Sequence: Synthetic coding sequence
atggacctggccggcctgctgaagagccagttcctgtgccacctggtgttctgctacgtgttcatcgccagcggcctcatcatcaacaccatccagctgttcaccctgctgctgtggcccatcaacaagcagctgttcaggaagatcaactgccgcctgagctactgcatcagcagcctgtctgctgtgtatgactgcaccctgaacttcagaaataatgaaaaccccaccctgctgggcgtgctgaatggcaagaagtaccacgccgacctgtatgtgcggcgcatccccctggaggacatcccagaagatgatgatgaatgttctgcctggctgcacaagctgtaccaggagaaggatgccttccaggaggagtactacagaacaggcaccttccctgagacccccatggtgcccccaagaagaccctggaccctggtgaactggctgttctgggccagcctggtgctgtaccccttcttccagttcctggtgtccatgatccgcagcggcagcagcctgaccctggccagcttcatcctggtgttctttgtggcctctgtgggcgtgcgctggatgattggagtgacagaaattgacaagggcagcgcctacggcaacagcgacagcaagcagaagctgaatgactag

SEQ ID NO: 32127 - DNA, 1095 bp, Artificial Sequence
  Description of Artificial Sequence: Synthetic coding sequence
atgctgctgagcctggtgctgcacacctacagcatgagatacctgctgcccagcgtggtgctgctgggcacagcccccacctacgtgctggcctggggcgtgtggaggctgctgagcgccttcctgcctgcccgcttctaccaggccctggatgaccggctgtactgtgtgtaccagagcatggtgctcttcttctttgagaactacacaggagtgcagatcctgctgtatggagacctgcccaagaacaaggagaacatcatctacctggccaaccaccagagcacagtggactggatcgtggccgacatcctggccatccggcagaatgccctgggccacgtgcgctacgtgctgaaggagggcctgaagtggctgcccctgtatggctgctactttgcccagcacggcggcatctacgtgaagaggtctgccaagttcaatgagaaggagatgaggaacaagctgcagagctatgtggatgctggcacccccatgtacctggtgatcttccctgagggcacccgctacaaccctgagcagaccaaggtgctgagcgccagccaggcctttgctgcccagaggggcctggccgtgctgaagcacgtgctgaccccccgcatcaaggccacccacgtggcctttgactgcatgaagaactacctggatgccatctatgatgtgacagtggtgtatgagggcaaggatgatggcggccagaggcgggagagccccaccatgacagagttcctgtgcaaggagtgccccaagatccacatccacatcgacagaattgacaagaaggatgtgcctgaggagcaggagcacatgaggcgctggctgcacgagagatttgagatcaaggacaagatgctgattgagttctatgagagcccagaccctgagaggaggaagcgcttccctgggaagtctgtgaacagcaagctgagcatcaagaagaccctgcccagcatgctgatcctgagcggcctgacagctggcatgctgatgacagatgctggcaggaagctgtatgtgaacacctggatctacggcaccctgctgggctgcctgtgggtgaccatcaaggcctag

SEQ ID NO: 32128 - DNA, 564 bp, Artificial Sequence
  Description of Artificial Sequence: Synthetic coding sequence
atgggcggcctcttctggaggtctgccctgcggggcctgcgctgtggcccccgggcccctggccccagcctgctggtgcgccacggcagcggcggccccagctggacccgggagaggaccctggtggccgtgaagccagatggagtgcagaggcggctggtgggagatgtgatccagagatttgaaagaagaggcttcaccctggtgggcatgaagatgctgcaggcccctgagagcgtgctggccgagcactaccaggacctgcggaggaagcccttctacccagccctgatccgctacatgagcagcggccctgtggtggccatggtgtgggagggctacaacgtggtgcgggccagccgggccatgattggccacacagattctgctgaggccgcccctggcaccatccggggggacttctctgtgcacatcagcagaaatgtcatccacgccagtgacagcgtggagggcgcccagcgggagatccagctgtggttccagagcagcgagctggtgtcctgggcagatggcggccagcacagcagcatccacccagcctag

SEQ ID NO: 32129 - DNA, 636 bp, Artificial Sequence
  Description of Artificial Sequence: Synthetic coding sequence
atggcccagcccccaccagatgtggagggagatgactgcctgcctgcctaccgccacctgttctgcccagacctgctgcgggacaaggtggccttcatcaccggcggcggcagcggcatcggcttcagaattgctgagatcttcatgagggccagcgaggaccagatgggccactgcagcagcagcggcacctgcctggccggcgtggccaccttcatggtgattgtgggcaagcagccccccaaccagaagagccgggagaccaaggagcagggccggcagatcccctttgtgtgtgtgcgccacggctgccacacagtcatcgccagccgcagcctgccccgggtgctgacagctgccaggaagctggccggggccactggaagacgctgcctgcccctgtccatggatgtgcgggcccctcctgctgtgatggctgctgtggaccaggccctgaaggagtttggaagaattgacatcctgatcaactgcagcagcagcagctgtggcctgcccttctgccgctgtggccgggagctgcctgtgccccgctggaggctggtgctgcagaggctgcaggacagagatggccaccgctaccagaggcacctgcagtgtgtgtcctgtgccctgtag

SEQ ID NO: 32130 - DNA, 813 bp, Artificial Sequence
  Description of Artificial Sequence: Synthetic coding sequence
atgccccgggacaacatggccagcctcatccagagaattgcccggcaggcctgcctgaccttccggggcagcggcggcggccgcggggccagtgacagagatgctgccagcggccctgaggcccccatgcagcccggcttccctgagaacctgagcaagctgaagagcctgctgacccagctgcgggcagaggacctgaacatcgcccccaggaaggccaccctgcagcccctgccccccaacctgccccctgtgacctacatgcacatctatgaaacagatggcttcagcctgggcgtcttcctgctgaagagcggcaccagcatccccctgcatgaccaccctggcatgcacggcatgctgaaggtgctgtatggaacagtgcgcatcagctgcatggacaagctggatgctgggggcggccagaggccccgggccctgcccccagagcagcagtttgagccccccctgcagccccgggagcgggaggccgtgcggcctggggtgctgcggagcagagctgagtacacagaggccagcggcccctgcatcctgaccccccaccgggacaacctgcaccagattgatgctgtggagggccctgctgccttcctggacatcctggccccaccctatgaccctgatgatggccgggactgccactactacagagtgctggagcctgtgcggcccaaggaggccagcagcagcgcctgtgacctgccccgggaggtgtggctgctggagaccccccaggctgatgacttctggtgtgagggggagccctacccaggccccaaggtgttcccctag

SEQ ID NO: 32131 - DNA, 1032 bp, Artificial Sequence
  Description of Artificial Sequence: Synthetic coding sequence
atgctggccacccggctgagccggcccctgagccggctgcccgggaagaccctgagcgcctgtgaccgggagaatggagcccggcggcccctgctgctgggcagcaccagcttcatccccatcggccgccgcacctacgccagcgctgctgagcctgtgggcagcaaggctgtgctggtgacaggctgtgacagcggcttcggcttcagcctggccaagcacctgcacagcaagggcttcctggtgtttgctggctgcctgatgaaggacaagggccatgatggagtgaaggagctggacagcctgaacagcgaccggctgaggacagtgcagctgaatgtgtgcagcagcgaggaggtggagaaggtggtggagatcgtgcgcagcagcctgaaggaccctgagaagggcatgtggggcctggtgaacaatgccggcatcagcaccttcggggaggtggagttcaccagcctggagacctacaagcaggtggccgaggtgaacctgtggggcaccgtgaggatgaccaagagcttcctgcccctcatccggcgggccaagggccgggtggtgaacatcagctccatgctgggccgcatggccaacccagcccggagcccctactgcatcaccaagtttggagtggaggccttcagtgactgcctgcgctatgagatgtaccccctgggcgtgaaggtgtctgtggtggagcccggcaacttcatcgccgccaccagcctgtacagccctgagagcatccaggccatcgccaagaagatgtgggaggagctgcctgaggtggtgaggaaggactatggcaagaagtactttgatgagaagatcgccaagatggagacctactgcagcagcggcagcacagacaccagccctgtgattgatgctgtgacccacgccctgacagccaccaccccctacacccgctaccaccccatggactactactggtggctgaggatgcagatcatgacccacctgcccggggccatcagtgacatgatctacatcagatag

SEQ ID NO: 32132 - DNA, 1032 bp, Artificial Sequence; identical to SEQ ID NO: 32131
  Description of Artificial Sequence: Synthetic coding sequence

SEQ ID NO: 32133 - DNA, 1032 bp, Artificial Sequence; identical to SEQ ID NO: 32131
  Description of Artificial Sequence: Synthetic coding sequence

SEQ ID NO: 32134 - DNA, 270 bp, Artificial Sequence
  Description of Artificial Sequence: Synthetic coding sequence
atgctggccacccggctgagccggcccctgagccggctgcccgggaagaccctgagcgcctgtgaccgggagaatggagcccggcggcccctgctgctgggcagcaccagcttcatccccatcggccgccgcacctacgccagcgctgctgagcctgtgggcagcaaggctgtgctggtgacaggctgtgacagcggcttcggcttcagcctggccaagcacctgcacagcaagggcttcctggtgtttgctggctgcctgatgaagtag

SEQ ID NO: 32135 - DNA, 771 bp, Artificial Sequence
  Description of Artificial Sequence: Synthetic coding sequence
atgaaggacaagggccatgatggagtgaaggagctggacagcctgaacagcgaccggctgaggacagtgcagctgaatgtgtgcagcagcgaggaggtggagaaggtggtggagatcgtgcgcagcagcctgaaggaccctgagaagggcatgtggggcctggtgaacaatgccggcatcagcacctttggagaggtggagttcaccagcctggagacctacaagcaggtggccgaggtgaacctgtggggcaccgtgaggatgaccaagagcttcctgcccctcatcagaagagccaagggccgggtggtgaacatcagctccatgctgggccgcatggccaacccagcccggagcccctactgcatcaccaagtttggagtggaggccttcagtgactgcctgcgctatgagatgtaccccctgggcgtgaaggtgtctgtggtggagcccggcaacttcatcgccgccaccagcctgtacagccctgagagcatccaggccatcgccaagaagatgtgggaggagctgcctgaggtggtgaggaaggactatggcaagaagtactttgatgagaagatcgccaagatggagacctactgcagcagcggcagcacagacaccagccctgtgattgatgctgtgacccacgccctgacagccaccaccccctacacccgctaccaccccatggactactactggtggctgaggatgcagatcatgacccacctgcccggggccatcagtgacatgatctacatcagatag

SEQ ID NO: 32136 - DNA, 153 bp, Artificial Sequence
  Description of Artificial Sequence: Synthetic coding sequence
atgctggccacccggctgagccggcccctgagccggctgcccgggaagaccctgagcgcctgtgaccgggagaatggagcccggcggcccctgctgctgggcagcaccagcttcatccccatcggccgccgcacctacgccagcgctgcctag

SEQ ID NO: 32137 - DNA, 1011 bp, Artificial Sequence
  Description of Artificial Sequence: Synthetic coding sequence
atggccgccagcctgcggctgctgggcgccgccagcggcctgcgctactggagccggcggctgcggcctgctgctggcagctttgctgctgtgtgcagccgctctgtggccagcaagacccctgtgggcttcatcggcctgggcaacatgggcaaccccatggccaagaacctgatgaagcacggctaccccctcatcatctatgatgtgtttcctgatgcctgcaaggagttccaggatgctggggagcaggtggtgagcagccctgcagatgtggccgagaaggctgaccgcatcatcaccatgctgcccaccagcatcaatgccatcgaggcctacagcggggccaacggcatcctgaagaaggtgaagaagggcagcctgctgattgacagcagcaccattgatcctgctgtgtccaaggagctggccaaggaggtggagaagatgggcgctgtgttcatggatgcccctgtgtctgggggcgtgggcgccgcccggagcggcaacctgaccttcatggtgggcggcgtggaggatgaatttgctgctgcccaggagctgctgggctgcatgggcagcaatgtggtgtactgtggggctgtgggcaccggccaggccgccaagatctgcaacaacatgctgctggccatctccatgattggaacagctgaggccatgaacctgggcatccggctgggcctggaccccaagctgctggccaagatcctgaacatgagcagcggccgctgctggagcagtgacacctacaaccctgtgcctggggtgatggatggagtgcccagcgccaacaactaccagggcggcttcggcaccaccctgatggccaaggacctgggcctggcccaggacagcgccaccagcaccaagagccccatcctgctgggcagcctggcccaccagatctacaggatgatgtgtgccaagggctacagcaagaaggacttcagctctgtgttccagttcctgcgggaggaggagaccttctag

SEQ ID NO: 32138 - DNA, 1554 bp, Artificial Sequence
  Description of Artificial Sequence: Synthetic coding sequence
atggccgccctgcggctgctggcctctgtgctgggccggggcgtgcctgctgggggcagcggcctggccctgagccagggctgtgcccgctgctttgccaccagcccccggctgcgggccaagttctacgccgaccctgtggagatggtgaaggacatcagtgatggagccaccgtgatgattggaggcttcggcctgtgtggcatccctgagaacctgattgctgccctgctgcggaccagggtgaaggacctgcaggtggtgagcagcaatgtgggcgtggaggactttggcctgggcctgctgctggccgcccggcaggtgagaagaattgtgtgcagctatgtgggggagaacaccctgtgtgagagccagtacctggccggggagctggagctggagctgaccccccagggcaccctggccgagcgcatccgggccggcggggccggcgtgcctgccttctacacccccaccggctacggcaccctggtgcaggagggcggggcccccatccgctacaccccagatggccacctggccctgatgagccagccccgggaggtgcgggagttcaatggagaccacttcctgctggagcgggccatccgggctgactttgccctggtgaagggctggaaggctgacagagctggaaatgtggtgttccgccgcagcgccaggaacttcaacgtgcccatgtgcaaggccgcagatgtgacagctgtggaggtggaggagatcgtggaggtgggcgccttccccccagaggacatccacgtgcccaacatctacgtggacagagtcatcaagggccagaagtatgagaagagaattgagcggctgaccatcctgaaggaggaggatggagatgctgggaaggaggaggatgcccggacccgcatcatccggcgggccgccctggagtttgaagatggcatgtatgccaacctgggcatcggcatccccctgctggccagcaacttcatcagccccagcatgacagtgcacctgcacagtgaaaatggcatcctgggcctgggccccttccccacagaagatgaggtggatgctgacctgatcaatgccggcaagcagacagtgacagtgctgcccggcggctgcttctttgccagtgatgacagctttgccatgatccggggcggccacatccagctgaccatgctgggcgccatgcaggtgtccaagtacggggacctggccaactggatgatccctgggaagaaggtgaagggcatgggcggggccatggacctggtgagcagccagaagaccagggtggtggtgaccatgcagcactgcaccaaggacaacacccccaagatcatggagaagtgcaccatgcccctgaccgggaagagatgtgtggaccgcatcatcacagagaaggctgtgtttgatgtgcacaggaagaaggagctgaccctgcgggagctgtgggagggcctgactgtggatgacatcaagaagagcacaggctgtgcctttgctgtgagccccaacctgcggcccatgcagcaggtggccccctag

SEQ ID NO: 32139 - DNA, 798 bp, Artificial Sequence
  Description of Artificial Sequence: Synthetic coding sequence
atggccgccctgcggctgctggcctctgtgctgggccggggcgtgcctgctgggggcagcggcctggccctgagccagggctgtgcccgctgctttgccaccagcccccggctgcgggccaagttctacgccgaccctgtggagatggtgaaggacatcagtgatggagccaccgtgatgattggaggcttcggcctgtgtggcatccctgagaacctgattgctgccctgctgcggaccagggtgaaggacctgcaggtggtgagcagcaatgtgggcgtggaggactttggcctgggcctgctgctggccgcccggcaggtgagaagaattgtgtgcagctatgtgggggagaacaccctgtgtgagagccagtacctggccggggagctggagctggagctgaccccccagggcaccctggccgagcgcatccgggccggcggggccggcgtgcctgccttctacacccccaccggctacggcaccctggtgcaggagggcggggcccccatccgctacaccccagatggccacctggccctgatgagccagccccgggaggtgcgggagttcaatggagaccacttcctgctggagcgggccatccgggctgactttgccctggtgaagggctggaaggctgacagagctggaaatgtggtgttccgccgcagcgccaggaacttcaacgtgcccatgtgcaaggccgcagatgtgacagctgtggaggtggaggagatcgtggaggtgggcgccagcccccagaagaccagcaccttcctgaccttcatgtag

SEQ ID NO: 32140 - DNA, 984 bp, Artificial Sequence
  Description of Artificial Sequence: Synthetic coding sequence
atgctgggcccccaggtgtggagctctgtgcggcagggcctgagccgcagcctgagcagaaatgtgggcgtgtgggccagcggggagggcaagaaggtggacattgctggcatctacccacctgtgaccacccccttcaccgccacagctgaggtggactatggcaagctggaggagaacctgcacaagctgggcaccttccccttccggggctttgtggtgcagggcagcaatggagagttccccttcctgaccagcagcgagcggctggaggtggtgtcccgggtgcggcaggccatgcccaagaaccggctgctgctggccggcagcggctgtgagagcacccaggccaccgtggagatgacagtgtccatggcccaggtgggcgcagatgctgccatggtggtgaccccctgctactaccggggccgcatgagcagcgctgccctgatccaccactacaccaaggtggccgacctgagccccatccctgtggtgctgtacagcgtgcctgccaacacaggcctggacctgcctgtggatgctgtggtgaccctgagccagcaccccaacatcgtgggcatgaaggacagcggaggagatgtgaccagaattggcctcatcgtgcacaagaccaggaagcaggacttccaggtgctggccggcagcgctggcttcctgatggccagctatgccctgggcgctgtgggcggcgtgtgtgccctggccaacgtgctgggcgcccaggtgtgccagctggagcggctgtgctgcaccggccagtgggaggatgcccagaagctgcagcaccggctgattgagcccaatgctgctgtgaccaggagatttggcatccctggcctgaagaagatcatggactggtttggctactacggcggcccctgccgggcccccctgcaggagctgagccctgctgaggaggaggccctgaggatggacttcaccagcaatggctggctgtag

SEQ ID NO: 32141 - DNA, 495 bp, Artificial Sequence
  Description of Artificial Sequence: Synthetic coding sequence
atgctgggcccccaggtgtggagctctgtgcggcagggcctgagccgcagcctgagcagaaatgtgggcgtgtgggccagcggggagggcaagaaggtggacattgctggcatctacccacctgtgaccacccccttcaccgccacagctgaggtggactatggcaagctggaggagaacctgcacaagctgggcaccttccccttcagaggagctgtgggcggcgtgtgtgccctggccaacgtgctgggcgcccaggtgtgccagctggagcggctgtgctgcaccggccagtgggaggatgcccagaagctgcagcacaggctcatcgagcccaatgctgctgtgacccggcgcttcggcatccctggcctgaagaagatcatggactggtttggctactatggaggcccctgccgggcccccctgcaggagctgagccctgctgaggaggaggccctgaggatggacttcaccagcaatggctggctgtag

SEQ ID NO: 32142 - DNA, 612 bp, Artificial Sequence
  Description of Artificial Sequence: Synthetic coding sequence
atggctgctgctgctgtgagcagcgccaagaggagcctgcggggggagctgaagcagaggctgcgggccatgtctgctgaggagcggctgcggcagagccgggtgctgagccagaaggtgattgcccacagcgagtaccagaagagcaagaggatcagcatcttcctgtccatgcaggatgaaattgaaacagaggagatcatcaaggacatcttccagaggggcaagatctgcttcatcccccgctaccgcttccagagcaaccacatggacatggtgagaattgagagccctgaggagatcagcctgctgcccaagacctcctggaacatcccccagcccggggagggagatgtgcgggaggaggccctgagcactggaggcctggacctgatcttcatgcctggcctgggctttgacaagcacggcaaccggctgggccggggcaagggctactatgatgcctacctgaagcgctgcctgcagcaccaggaggtgaagccctacaccctggccctggccttcaaggagcagatctgcctgcaggtgcctgtgaatgaaaatgacatgaaggtggatgaggtgctgtatgaggacagcagcacagcctag

SEQ ID NO: 32143 - DNA, 1392 bp, Artificial Sequence
  Description of Artificial Sequence: Synthetic coding sequence
atgcacaggagcttcctgcaggcccggcgcagcaggaacaccaccaggcctgccctgctgcggctgagtgactacctgctgaccaactacaggaagggcgtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaacccagaagattttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccatccaggacatcaacatcagcctgtggaggctgcctgagaaggtgaagagtgacaggagcgtcttcatgaaccagggcgagtgggagctgctgggcgtgctgccctacttccgggagttctccatggagagcagcaactactatgcagagatgaagttctacgtggtgatcagaagaagacccctcttctacgtggtgtccctgctgctgcccagcatcttcctgatggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctcatcggcgtgtactttgtggtgtgcatggccctgctggtgatcagcctggccgagaccatcttcatcgtgcggctggtgcacaagcaggacctgcagcagcctgtgcctgcctggctgcggcacctggtgctggagcgcatcgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32144 - DNA, 1551 bp, Artificial Sequence
  Description of Artificial Sequence: Synthetic coding sequence
atgctgggcaagctggccatgctgctgtgggtgcagcaggccctgctggccctgctgctgcccaccctgctggcccagggcgaggcccggcgcagcaggaacaccaccaggcctgccctgctgcggctgagtgactacctgctgaccaactacagaaaaggagtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaaccctgaggactttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccatccaggacatcaacatcagcctgtggaggctgcctgagaaggtgaagagtgacagatctgtgttcatgaaccagggcgagtgggagctgctgggcgtgctgccctacttccgggagttctccatggagagcagcaactactatgcagagatgaagttctacgtggtgatcagaagaagacccctcttctacgtggtgtccctgctgctgcccagcatcttcctgatggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctgattggcaaggcccctcctggcagccgggcccagagcggggagaagccagcccccagccacctgctgcacgtgtccctggccagcgccctgggctgcacaggagtgtactttgtggtgtgcatggccctgctggtgatcagcctggccgagaccatcttcatcgtgcggctggtgcacaagcaggacctgcagcagcctgtgcctgcctggctgcggcacctggtgctggagagaattgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32145 - DNA, 1455 bp, Artificial Sequence
  Description of Artificial Sequence: Synthetic coding sequence
atgctgggcaagctggccatgctgctgtgggtgcagcaggccctgctggccctgctgctgcccaccctgctggcccagggcgaggcccggcgcagcaggaacaccaccaggcctgccctgctgcggctgagtgactacctgctgaccaactacagaaaaggagtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaaccctgaggactttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccatccaggacatcaacatcagcctgtggaggctgcctgagaaggtgaagagtgacagatctgtgttcatgaaccagggcgagtgggagctgctgggcgtgctgccctacttccgggagttctccatggagagcagcaactactatgcagagatgaagttctacgtggtgatcagaagaagacccctcttctacgtggtgtccctgctgctgcccagcatcttcctgatggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctgattggagtgtactttgtggtgtgcatggccctgctggtgatcagcctggccgagaccatcttcatcgtgcggctggtgcacaagcaggacctgcagcagcctgtgcctgcctggctgcggcacctggtgctggagagaattgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32146 - DNA, 1437 bp, Artificial Sequence
  Description of Artificial Sequence: Synthetic coding sequence
atgctgctgtgggtgcagcaggccctgctggccctgctgctgcccaccctgctggcccagggcgaggcccggcgcagcaggaacaccaccaggcctgccctgctgcggctgagtgactacctgctgaccaactacagaaaaggagtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaaccctgaggactttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccatccaggacatcaacatcagcctgtggaggctgcctgagaaggtgaagagtgacagatctgtgttcatgaaccagggcgagtgggagctgctgggcgtgctgccctacttccgggagttctccatggagagcagcaactactatgcagagatgaagttctacgtggtgatcagaagaagacccctcttctacgtggtgtccctgctgctgcccagcatcttcctgatggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctgattggagtgtactttgtggtgtgcatggccctgctggtgatcagcctggccgagaccatcttcatcgtgcggctggtgcacaagcaggacctgcagcagcctgtgcctgcctggctgcggcacctggtgctggagagaattgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32147 - DNA, 1533 bp, Artificial Sequence
  Description of Artificial Sequence: Synthetic coding sequence
atgctgctgtgggtgcagcaggccctgctggccctgctgctgcccaccctgctggcccagggcgaggcccggcgcagcaggaacaccaccaggcctgccctgctgcggctgagtgactacctgctgaccaactacagaaaaggagtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaaccctgaggactttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccatccaggacatcaacatcagcctgtggaggctgcctgagaaggtgaagagtgacagatctgtgttcatgaaccagggcgagtgggagctgctgggcgtgctgccctacttccgggagttctccatggagagcagcaactactatgcagagatgaagttctacgtggtgatcagaagaagacccctcttctacgtggtgtccctgctgctgcccagcatcttcctgatggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctgattggcaaggcccctcctggcagccgggcccagagcggggagaagccagcccccagccacctgctgcacgtgtccctggccagcgccctgggctgcacaggagtgtactttgtggtgtgcatggccctgctggtgatcagcctggccgagaccatcttcatcgtgcggctggtgcacaagcaggacctgcagcagcctgtgcctgcctggctgcggcacctggtgctggagagaattgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32148 - DNA, 717 bp, Artificial Sequence
  Description of Artificial Sequence: Synthetic coding sequence
atgctgctgtgggtgcagcaggccctgctggccctgctgctgcccaccctgctggcccagggcgaggcccggcgcagcaggaacaccaccaggcctgccctgctgcggctgagtgactacctgctgaccaactacagaaaaggagtgcggcctgtgcgggactggaggaagcccaccaccgtgtccattgatgtgattgtgtatgccatcctgaatgtggatgagaagaaccaggtgctgaccacctacatctggtaccggcagtactggacagatgagttcctgcagtggaaccctgaggactttgacaacatcaccaagctgagcatccccacagacagcatctgggtgcctgacatcctgatcaatgaatttgtggatgtgggcaagagccccaacatcccctacgtgtacatccgccaccagggcgaggtgcagaactacaagcccctgcaggtggtgacagcctgcagcctggacatctacaacttcccctttgatgtgcagaactgcagcctgaccttcacctcctggctgcacaccagcggccaccccccagctgcccccctgctgtgtggccagcctgccacagcccagcacctgccccacggccacggccaccggggcctgctgcctgccccccagcagtggagggagggcctcttccaggactacaccccacctggcctgctgggcctgcctgaccaccgcttctag

SEQ ID NO: 32149 - DNA, 669 bp, Artificial Sequence
  Description of Artificial Sequence: Synthetic coding sequence
atggtgatggacatcgtgggcttctacctgccccccaacagcggggagcgggtgtccttcaagatcaccctgctgctgggctacagcgtcttcctgatcatcgtgtctgacaccctgcctgccacagccatcggcacccccctgattggagtgtactttgtggtgtgcatggccctgctggtgatcagcctggccgagaccatcttcatcgtgcggctggtgcacaagcaggacctgcagcagcctgtgcctgcctggctgcggcacctggtgctggagagaattgcctggctgctgtgcctgcgggagcagagcaccagccagaggcccccagccaccagccaggccaccaagacagatgactgcagcgccatgggcaaccactgcagccacatgggcggcccccaggactttgagaagagcccccgggaccgctgcagccccccacctccaccccgggaggccagcctggccgtgtgtggcctgctgcaggagctgagcagcatccggcagttcctggagaagagagatgagatccgggaggtggcccgggactggctgcgggtgggctctgtgctggacaagctgctcttccacatctacctgctggccgtgctggcctacagcatcaccctggtgatgctgtggagcatctggcagtatgcctag

SEQ ID NO: 32150 - DNA, 5349 bp, Artificial Sequence
  Description of Artificial Sequence: Synthetic coding sequence
atgggcgccggcagcagcacagagcagaggagccctgagcagcccccagagggcagcagcaccccagctgagcctgagcccagcggcggcggccccagcgctgaggccgccccagacaccacagctgaccctgccatcgccgccagtgaccctgccaccaagctgctgcagaagaatggccagctgagcaccatcaacggggtggccgagcaggatgagctgagcctgcaggagggggacctgaatggccagaagggggccctgaatggccagggcgccctgaacagccaggaggaggaggaggtgattgtgacagaggtgggccagagggacagtgaagatgtgtccaagagggacagcgacaaggagatggccaccaagtctgctgtggtgcatgacatcacagatgatggccaggaggagaccccagagatcatcgagcagatccccagcagcgagagcaacctggaggagctgacccagcccacagagagccaggccaatgacatcggcttcaagaaggtgttcaagtttgtgggcttcaagttcaccgtgaagaaggacaagacagagaagccagacacagtgcagctgctgactgtgaagaaggatgaaggagagggcgccgccggggccggggaccacaaggaccccagcctgggcgctggggaggccgccagcaaggagagcgagcccaagcagagcacagagaagccagaggagaccctgaagcgggagcagagccacgccgagatcagccccccagctgagagcggccaggccgtggaggagtgcaaggaggagggggaggagaagcaggagaaggagcccagcaagtctgctgagagccccaccagccctgtgaccagcgagaccggcagcaccttcaagaagttcttcacccagggctgggccggctggaggaagaagaccagcttcaggaagcccaaggaggatgaggtggaggccagcgagaagaagaaggagcaggagcctgagaaggtggacacagaagaagatggcaaggccgaggtggccagcgagaagctgacagccagcgagcaggcccacccccaggagcctgctgagagcgcccacgagccccggctgtctgcagaatatgagaaggtggagctgcccagcgaggagcaggtgtctggcagccagggccccagcgaggagaagccagcccccctggccacagaggtgtttgatgagaagattgaggtgcaccaggaggaggtggtggccgaggtgcacgtgtccacagtggaggagaggacagaggagcagaagacagaggtggaggagacagctggctctgtgcctgctgaggagctggtggagatggatgctgagccccaggaggccgagcccgccaaggagctggtgaagctgaaggagacctgtgtgtctggagaggaccccacccagggcgctgacctgagcccagatgagaaggtgctgagcaagcccccagagggcgtggtgtctgaggtggagatgctgagcagccaggagaggatgaaggtgcagggcagccccctgaagaagctgttcaccagcacaggcctgaagaagctgagcggcaagaagcagaagggcaagaggggcggcggagatgaggagagcggggagcacacccaggtgcctgctgacagcccagacagccaggaggagcagaagggggagagcagcgccagcagccctgaggagcctgaggagatcacctgcctggagaagggcctggccgaggtgcagcaggatggagaggccgaggagggcgccaccagtgatggagagaagaagcgggagggcgtgaccccctgggccagcttcaagaagatggtgacccccaagaagagggtgcggcggcccagcgagagtgacaaggaggatgagctggacaaggtgaagagcgccaccctgagcagcacagagagcacagccagcgagatgcaggaggagatgaagggctctgtggaggagcccaagccagaggagcccaagaggaaggtggacacctctgtgtcctgggaggccctgatctgtgtgggcagcagcaagaagagggcccggcggggcagcagcagtgatgaggagggcggccccaaggccatgggcggggaccaccagaaggcagatgaagctgggaaggacaaggagactggaacagatggcatcctggccggcagccaggagcatgaccccggccagggcagcagcagccctgagcaggccggcagccccacagaaggagaaggagtgtccacctgggagagcttcaagaggctggtgacccccaggaagaagagcaagagcaagctggaggagaagtcagaagattccattgctggcagcggcgtggagcacagcaccccagacacagagcccgggaaggaggagagctgggtgtccatcaagaagttcatccctggccgcaggaagaagaggccagatggcaagcaggagcaggcccctgtggaggatgctggccccaccggggccaatgaagatgacagtgatgtgcctgctgtggtgcccctgtctgaatatgatgctgtggagcgggagaagatggaggcccagcaggcccagaagtctgctgagcagcctgagcagaaggccgccacagaggtgtccaaggagctgtctgagagccaggtgcacatgatggctgctgctgtggctgatggcacccgggccgccaccatcatcgaggagaggagccccagctggatcagcgcctctgtgacagagcccctggagcaggtggaggccgaggccgccctgctgacagaggaggtgctggagcgggaggtgattgctgaggaggagcccccaacagtgacagagcccctgcctgagaaccgggaggcccggggggacacagtggtgtctgaggccgagctgaccccagaggccgtgacagctgctgagacagctggccccctgggcgctgaggagggcacagaggccagcgctgctgaggagaccacagagatggtgtctgctgtgtcccagctgacagacagcccagacaccacagaggaggccacccctgtgcaggaggtggagggcggcgtgcctgacatcgaggagcaggagaggaggacccaggaggtgctgcaggccgtggccgagaaggtgaaggaggagagccagctgcccggcactggaggcccagaagatgtgctgcagcctgtgcagagagctgaggccgagaggcctgaggagcaggccgaggccagcggcctgaagaaggagacagatgtggtgctgaaggtggatgcccaggaggccaagacagagcccttcacccagggcaaggtggtgggccagaccaccccagagagctttgagaaggccccccaggtgacagagagcattgagagcagcgagctggtgaccacctgccaggccgagaccctggccggcgtgaagagccaggagatggtgatggagcaggccatccccccagacagcgtggagacccccacagattctgaaacagatggcagcacccctgtggccgactttgatgcccctggcaccacccagaaggatgaaattgtggagatccatgaagaaaatgaggtggccagcggcacccagagcggcggcacagaagctgaggccgtgcctgcccagaaggagcggcccccagcccccagcagctttgtgttccaggaggagaccaaggagcagagcaagatggaggacaccctggagcacacagacaaggaggtgtctgtggagaccgtgtccatcctgagcaagacagagggcacccaggaggccgaccagtatgcagatgagaagaccaaggatgtgcccttctttgagggcctggagggcagcattgacaccggcatcaccgtgtcccgggagaaggtgacagaggtggccctgaagggggagggcacagaggaggccgagtgcaagaaggatgatgccctggagctgcagagccacgccaagagcccccccagccctgtggagcgggagatggtggtgcaggtggagcgggagaagacagaggccgagcccacccacgtgaatgaggagaagctggagcacgagacagctgtgacagtgtctgaggaggtgtccaagcagctgctgcagacagtgaatgtgcccatcattgatggagccaaggaggtgagcagcctggagggcagccccccaccctgcctgggccaggaggaggccgtgtgcaccaagatccaggtgcagagcagcgaggccagcttcaccctgacagctgctgctgaggaggagaaggtgctgggggagacagccaacatcctggagaccggggagaccctggagcctgctggggcccacctggtgctggaggagaagagcagcgagaagaatgaagattttgctgcccaccctggagaagatgctgtgcccactggaccagactgccaggccaagagcacccctgtgattgtgtctgccaccaccaagaagggcctgagcagtgacctggagggggagaagaccaccagcctgaagtggaagagtgatgaggtggatgagcaggtggcctgccaggaggtgaaggtgtctgtggccatcgaggacctggagccagaaaatggcatcctggagctggagaccaagagcagcaagctggtgcagaacatcatccagacagctgtggaccagtttgtgaggacagaggagacagccacagagatgctgaccagcgagctgcagacccaggcccacgtgatcaaggctgacagccaggatgctggccaggagacagagaaggagggggaggagccccaggccagcgcccaggatgagacccccatcaccagcgccaaggaggagagcgagagcacagctgtgggccaggcccacagcgacatcagcaaggacatgtctgaggccagcgagaagaccatgacagtggaggtggagggcagcacagtgaatgaccagcagctggaggaggtggtgctgcccagcgaggaggagggcggcggggccggcaccaagtctgtgcctgaagatgatggccacgccctgctggccgagcgcatcgagaagagcctggtggagcccaaggaggatgagaagggagatgatgtggatgatcctgagaaccagaacagcgccctggccgacacagatgccagcggcggcctgaccaaggagagcccagacaccaacggccccaagcagaaggagaaggaggatgcccaggaggtggagctgcaggagggcaaggtgcacagcgagagtgacaaggccatcaccccccaggcccaggaggagctgcagaagcaggagcgggagagcgccaagtctgagctgacagagagctag

SEQ ID NO: 32151 - DNA, 5055 bp, Artificial Sequence
  Description of Artificial Sequence: Synthetic coding sequence
atgctgggcaccatcaccatcaccgtgggccagagggacagtgaagatgtgtccaagagggacagcgacaaggagatggccaccaagtctgctgtggtgcatgacatcacagatgatggccaggaggagaccccagagatcatcgagcagatccccagcagcgagagcaacctggaggagctgacccagcccacagagagccaggccaatgacatcggcttcaagaaggtgttcaagtttgtgggcttcaagttcaccgtgaagaaggacaagacagagaagccagacacagtgcagctgctgactgtgaagaaggatgaaggagagggcgccgccggggccggggaccacaaggaccccagcctgggcgctggggaggccgccagcaaggagagcgagcccaagcagagcacagagaagccagaggagaccctgaagcgggagcagagccacgccgagatcagccccccagctgagagcggccaggccgtggaggagtgcaaggaggagggggaggagaagcaggagaaggagcccagcaagtctgctgagagccccaccagccctgtgaccagcgagaccggcagcaccttcaagaagttcttcacccagggctgggccggctggaggaagaagaccagcttcaggaagcccaaggaggatgaggtggaggccagcgagaagaagaaggagcaggagcctgagaaggtggacacagaagaagatggcaaggccgaggtggccagcgagaagctgacagccagcgagcaggcccacccccaggagcctgctgagagcgcccacgagccccggctgtctgcagaatatgagaaggtggagctgcccagcgaggagcaggtgtctggcagccagggccccagcgaggagaagccagcccccctggccacagaggtgtttgatgagaagattgaggtgcaccaggaggaggtggtggccgaggtgcacgtgtccacagtggaggagaggacagaggagcagaagacagaggtggaggagacagctggctctgtgcctgctgaggagctggtggagatggatgctgagccccaggaggccgagcccgccaaggagctggtgaagctgaaggagacctgtgtgtctggagaggaccccacccagggcgctgacctgagcccagatgagaaggtgctgagcaagcccccagagggcgtggtgtctgaggtggagatgctgagcagccaggagaggatgaaggtgcagggcagccccctgaagaagctgttcaccagcacaggcctgaagaagctgagcggcaagaagcagaagggcaagaggggcggcggagatgaggagagcggggagcacacccaggtgcctgctgacagcccagacagccaggaggagcagaagggggagagcagcgccagcagccctgaggagcctgaggagatcacctgcctggagaagggcctggccgaggtgcagcaggatggagaggccgaggagggcgccaccagtgatggagagaagaagcgggagggcgtgaccccctgggccagcttcaagaagatggtgacccccaagaagagggtgcggcggcccagcgagagtgacaaggaggatgagctggacaaggtgaagagcgccaccctgagcagcacagagagcacagccagcgagatgcaggaggagatgaagggctctgtggaggagcccaagccagaggagcccaagaggaaggtggacacctctgtgtcctgggaggccctgatctgtgtgggcagcagcaagaagagggcccggcggggcagcagcagtgatgaggagggcggccccaaggccatgggcggggaccaccagaaggcagatgaagctgggaaggacaaggagactggaacagatggcatcctggccggcagccaggagcatgaccccggccagggcagcagcagccctgagcaggccggcagccccacagaaggagaaggagtgtccacctgggagagcttcaagaggctggtgacccccaggaagaagagcaagagcaagctggaggagaagtcagaagattccattgctggcagcggcgtggagcacagcaccccagacacagagcccgggaaggaggagagctgggtgtccatcaagaagttcatccctggccgcaggaagaagaggccagatggcaagcaggagcaggcccctgtggaggatgctggccccaccggggccaatgaagatgacagtgatgtgcctgctgtggtgcccctgtctgaatatgatgctgtggagcgggagaagatggaggcccagcaggcccagaagtctgctgagcagcctgagcagaaggccgccacagaggtgtccaaggagctgtctgagagccaggtgcacatgatggctgctgctgtggctgatggcacccgggccgccaccatcatcgaggagaggagccccagctggatcagcgcctctgtgacagagcccctggagcaggtggaggccgaggccgccctgctgacagaggaggtgctggagcgggaggtgattgctgaggaggagcccccaacagtgacagagcccctgcctgagaaccgggaggcccggggggacacagtggtgtctgaggccgagctgaccccagaggccgtgacagctgctgagacagctggccccctgggcgctgaggagggcacagaggccagcgctgctgaggagaccacagagatggtgtctgctgtgtcccagctgacagacagcccagacaccacagaggaggccacccctgtgcaggaggtggagggcggcgtgcctgacatcgaggagcaggagaggaggacccaggaggtgctgcaggccgtggccgagaaggtgaaggaggagagccagctgcccggcactggaggcccagaagatgtgctgcagcctgtgcagagagctgaggccgagaggcctgaggagcaggccgaggccagcggcctgaagaaggagacagatgtggtgctgaaggtggatgcccaggaggccaagacagagcccttcacccagggcaaggtggtgggccagaccaccccagagagctttgagaaggccccccaggtgacagagagcattgagagcagcgagctggtgaccacctgccaggccgagaccctggccggcgtgaagagccaggagatggtgatggagcaggccatccccccagacagcgtggagacccccacagattctgaaacagatggcagcacccctgtggccgactttgatgcccctggcaccacccagaaggatgaaattgtggagatccatgaagaaaatgaggtggccagcggcacccagagcggcggcacagaagctgaggccgtgcctgcccagaaggagcggcccccagcccccagcagctttgtgttccaggaggagaccaaggagcagagcaagatggaggacaccctggagcacacagacaaggaggtgtctgtggagaccgtgtccatcctgagcaagacagagggcacccaggaggccgaccagtatgcagatgagaagaccaaggatgtgcccttctttgagggcctggagggcagcattgacaccggcatcaccgtgtcccgggagaaggtgacagaggtggccctgaagggggagggcacagaggaggccgagtgcaagaaggatgatgccctggagctgcagagccacgccaagagcccccccagccctgtggagcgggagatggtggtgcaggtggagcgggagaagacagaggccgagcccacccacgtgaatgaggagaagctggagcacgagacagctgtgacagtgtctgaggaggtgtccaagcagctgctgcagacagtgaatgtgcccatcattgatggagccaaggaggtgagcagcctggagggcagccccccaccctgcctgggccaggaggaggccgtgtgcaccaagatccaggtgcagagcagcgaggccagcttcaccctgacagctgctgctgaggaggagaaggtgctgggggagacagccaacatcctggagaccggggagaccctggagcctgctggggcccacctggtgctggaggagaagagcagcgagaagaatgaagattttgctgcccaccctggagaagatgctgtgcccactggaccagactgccaggccaagagcacccctgtgattgtgtctgccaccaccaagaagggcctgagcagtgacctggagggggagaagaccaccagcctgaagtggaagagtgatgaggtggatgagcaggtggcctgccaggaggtgaaggtgtctgtggccatcgaggacctggagccagaaaatggcatcctggagctggagaccaagagcagcaagctggtgcagaacatcatccagacagctgtggaccagtttgtgaggacagaggagacagccacagagatgctgaccagcgagctgcagacccaggcccacgtgatcaaggctgacagccaggatgctggccaggagacagagaaggagggggaggagccccaggccagcgcccaggatgagacccccatcaccagcgccaaggaggagagcgagagcacagctgtgggccaggcccacagcgacatcagcaaggacatgtctgaggccagcgagaagaccatgacagtggaggtggagggcagcacagtgaatgaccagcagctggaggaggtggtgctgcccagcgaggaggagggcggcggggccggcaccaagtctgtgcctgaagatgatggccacgccctgctggccgagcgcatcgagaagagcctggtggagcccaaggaggatgagaagggagatgatgtggatgatcctgagaaccagaacagcgccctggccgacacagatgccagcggcggcctgaccaaggagagcccagacaccaacggccccaagcagaaggagaaggaggatgcccaggaggtggagctgcaggagggcaaggtgcacagcgagagtgacaaggccatcaccccccaggcccaggaggagctgcagaagcaggagcgggagagcgccaagtctgagctgacagagagctag

SEQ ID NO: 32152 - DNA, 5034 bp, Artificial Sequence
  Description of Artificial Sequence: Synthetic coding sequence
atggtgggccagagggacagtgaagatgtgtccaagagggacagcgacaaggagatggccaccaagtctgctgtggtgcatgacatcacagatgatggccaggaggagaccccagagatcatcgagcagatccccagcagcgagagcaacctggaggagctgacccagcccacagagagccaggccaatgacatcggcttcaagaaggtgttcaagtttgtgggcttcaagttcaccgtgaagaaggacaagacagagaagccagacacagtgcagctgctgactgtgaagaaggatgaaggagagggcgctgctggagctggggaccacaaggaccccagcctgggcgctggggaggccgccagcaaggagagcgagcccaagcagagcacagagaagccagaggagaccctgaagcgggagcagagccatgctgagatcagccccccagctgagagcggccaggccgtggaggagtgcaaggaggagggggaggagaagcaggagaaggagcccagcaagtctgctgagagccccaccagccctgtgaccagcgagaccggcagcaccttcaagaagttcttcacccagggctgggccggctggaggaagaagaccagcttcaggaagcccaaggaggatgaggtggaggccagcgagaagaagaaggagcaggagcctgagaaggtggacacagaggaggatggcaaggccgaggtggccagcgagaagctgacagccagcgagcaggcccacccccaggagcctgctgagagcgcccacgagccccggctgtctgcagaatatgagaaggtggagctgcccagcgaggagcaggtgtctggcagccagggccccagcgaggagaagccagcccccctggccacagaggtgtttgatgagaagattgaggtgcaccaggaggaggtggtggccgaggtgcacgtgtccacagtggaggagaggacagaggagcagaagacagaggtggaggagacagctggctctgtgcctgctgaggagctggtggagatggatgctgagccccaggaggccgagcccgccaaggagctggtgaagctgaaggagacctgtgtgtctggagaggaccccacccagggcgctgacctgagcccagatgagaaggtgctgagcaagcccccagagggcgtggtgtctgaggtggagatgctgagcagccaggagaggatgaaggtgcagggcagccccctgaagaagctgttcaccagcacaggcctgaagaagctgagcggcaagaagcagaagggcaagagaggaggaggagatgaggagagcggggagcacacccaggtgcctgctgacagcccagacagccaggaggagcagaagggggagagcagcgccagcagccctgaggagcctgaggagatcacctgcctggagaagggcctggccgaggtgcagcaggatggagaggccgaggagggcgccaccagtgatggagagaagaagcgggagggcgtgaccccctgggccagcttcaagaagatggtgacccccaagaagagggtgagaagacccagcgagagtgacaaggaggatgagctggacaaggtgaagagcgccaccctgagcagcacagagagcacagccagcgagatgcaggaggagatgaagggctctgtggaggagcccaagccagaggagcccaagaggaaggtggacacctctgtgtcctgggaggccctgatctgtgtgggcagcagcaagaagagggcccggcggggcagcagcagtgatgaggagggcggccccaaggccatgggcggggaccaccagaaggcagatgaggccggcaaggacaaggagaccggcacagatggcatcctggccggcagccaggagcatgaccccggccagggcagcagcagccctgagcaggccggcagccccacagaaggagagggcgtgtccacctgggagagcttcaagaggctggtgacccccaggaagaagagcaagagcaagctggaggagaagtctgaggacagcattgctggcagcggcgtggagcacagcaccccagacacagagcccgggaaggaggagagctgggtgtccatcaagaagttcatccctggaagaaggaagaagaggccagatggcaagcaggagcaggcccctgtggaggatgctggccccactggagccaatgaagatgacagtgatgtgcctgctgtggtgcccctgtctgaatatgatgctgtggagcgggagaagatggaggcccagcaggcccagaagtctgctgagcagcctgagcagaaggccgccacagaggtgtccaaggagctgtctgagagccaggtgcacatgatggctgctgctgtggctgatggcaccagggctgccaccatcatcgaggagaggagccccagctggatcagcgcctctgtgacagagcccctggagcaggtggaggccgaggccgccctgctgacagaggaggtgctggagcgggaggtgattgctgaggaggagccccccaccgtgacagagcccctgcctgaaaatcgggaggcccggggggacacagtggtgtctgaggccgagctgaccccagaggccgtgacagctgctgagacagctggccccctgggcgctgaggagggcacagaggccagcgctgctgaggagaccacagagatggtgtctgctgtgtcccagctgacagacagcccagacaccacagaggaggccacccctgtgcaggaggtggagggcggcgtgcctgacatcgaggagcaggagaggaggacccaggaggtgctgcaggccgtggccgagaaggtgaaggaggagagccagctgcccggcaccggcggcccagaagatgtgctgcagcctgtgcagagagctgaggccgagaggcctgaggagcaggccgaggccagcggcctgaagaaggagacagatgtggtgctgaaggtggatgcccaggaggccaagacagagcccttcacccagggcaaggtggtgggccagaccaccccagagagctttgagaaggccccccaggtgacagagagcattgagagcagcgagctggtgaccacctgccaggccgagaccctggccggcgtgaagagccaggagatggtgatggagcaggccatccccccagattctgtggagacccccacagacagcgagacagatggcagcacccctgtggccgactttgatgcccctggcaccacccagaaggatgagatcgtggagatccacgaggagaatgaggtggccagcggcacccagagcggcggcacagaggccgaggccgtgcctgcccagaaggagcggcccccagcccccagcagctttgtgttccaggaggagaccaaggagcagagcaagatggaggacaccctggagcacacagacaaggaggtgtctgtggagaccgtgtccatcctgagcaagacagagggcacccaggaggccgaccagtatgcagatgagaagaccaaggatgtgcccttctttgagggcctggagggcagcattgacaccggcatcaccgtgtcccgggagaaggtgacagaggtggccctgaagggggagggcacagaggaggccgagtgcaagaaggatgatgccctggagctgcagagccacgccaagagcccccccagccctgtggagcgggagatggtggtgcaggtggagcgggagaagacagaagctgagcccacccacgtgaatgaggagaagctggagcatgaaacagctgtgacagtgtctgaggaggtgtccaagcagctgctgcagacagtgaatgtgcccatcattgatggagccaaggaggtgagcagcctggagggcagccccccaccctgcctgggccaggaggaggccgtgtgcaccaagatccaggtgcagagcagcgaggccagcttcaccctgacagctgctgctgaggaggagaaggtgctgggggagacagccaacatcctggagactggagagaccctggagcctgctggggcccacctggtgctggaggagaagagcagcgagaagaatgaagattttgctgcccaccctggagaagatgctgtgcccaccggccctgactgccaggccaagagcacccctgtgattgtgtctgccaccaccaagaagggcctgagcagtgacctggagggggagaagaccaccagcctgaagtggaagagtgatgaggtggatgagcaggtggcctgccaggaggtgaaggtgtctgtggccatcgaggacctggagccagaaaatggcatcctggagctggagaccaagagcagcaagctggtgcagaacatcatccagacagctgtggaccagtttgtgaggacagaggagacagccacagagatgctgaccagcgagctgcagacccaggcccacgtgatcaaggctgacagccaggatgctggccaggagacagagaaggagggggaggagccccaggccagcgcccaggatgagacccccatcaccagcgccaaggaggagagcgagagcacagctgtgggccaggcccacagcgacatcagcaaggacatgtctgaggccagcgagaagaccatgacagtggaggtggagggcagcacagtgaatgaccagcagctggaggaggtggtgctgcccagcgaggaggagggcggcggggccggcaccaagtctgtgcctgaagatgatggccacgccctgctggccgagagaattgagaagagcctggtggagcccaaggaggatgagaagggagatgatgtggatgatcctgagaaccagaacagcgccctggccgacacagatgccagcggcggcctgaccaaggagagcccagacaccaacggccccaagcagaaggagaaggaggatgcccaggaggtggagctgcaggagggcaaggtgcacagcgagagtgacaaggccatcaccccccaggcccaggaggagctgcagaagcaggagcgggagagcgccaagtctgagctgacagagagctag

SEQ ID NO: 32153 - DNA, 5349 bp, Artificial Sequence; identical to SEQ ID NO: 32150
  Description of Artificial Sequence: Synthetic coding sequence

SEQ ID NO: 32154 - DNA, 1284 bp, Artificial Sequence
  Description of Artificial Sequence: Synthetic coding sequence
atggagaccaccatcagcgagatccacgtggagaacaaggatgagaagaggtctgctgagggcagccctggagctgagcggcagaaggagaaggcctccatgctgtgcttcaagaggaggaagaaggccgccaaggccctgaagcccaaggccggcagcgaggccgcagatgtggccaggaaatgtccccaggaggccggggccagtgaccagcctgagcccaccaggggggcctgggccagcctgaagaggctggtgaccaggaggaagaggtctgagagcagcaagcagcagaagcccctggagggggagatgcagcctgccatcaatgcagaagatgctgacctgagcaagaagaaggccaagagccggctgaagatcccctgcatcaagttcccccggggccccaagaggagcaaccacagcaagatcatcgaggacagcgactgcagcatcaaggtgcaggaggaggccgagatcctggacatccagacccagacccccctgaatgaccaggccaccaaggccaagagcacccaggacctgtctgagggcatcagcaggaaggatggagatgaggtgtgtgagagcaatgtgagcaacagcaccaccagcggggagaaggtgatctctgtggagctgggcctggacaatggccacagcgccatccagacaggcaccctcatcctggaggagattgagaccatcaaggagaagcaggatgtgcagccccagcaggccagccccctggagaccagcgagacagaccaccagcagcctgtgctgagtgatgtgccccccctgcctgccatcccagaccagcagatcgtggaggaggccagcaacagcaccctggagagcgcccccaacgggaaggactatgagagcacagaaattgtggccgaggagaccaagcccaaggacacagagctgagccaggagagtgacttcaaggaaaatggcatcacagaggagaagagcaagtctgaggagagcaagaggatggagcccatcgccatcatcatcacagacacagagatcagcgagtttgatgtgaccaagagcaagaatgtgcccaagcagttcctgatctctgcagaaaatgagcaggtgggcgtgtttgccaatgacaatggatttgaggacaggaccagcgagcagtatgagaccctgctgattgaaacagccagcagcctggtgaagaatgccatccagctgagcattgagcagctggtgaatgagatggccagtgatgacaacaagatcaacaacctgctgcagtag

SEQ ID NO: 32155 - DNA, 1284 bp, Artificial Sequence; identical to SEQ ID NO: 32154
  Description of Artificial Sequence: Synthetic coding sequence

SEQ ID NO: 32156 - DNA, 6960 bp, Artificial Sequence
  Description of Artificial Sequence: Synthetic coding sequence
atgctgaccatgtctgtgaccctgagccccctgcggagccaggacctggaccccatggccacagatgccagccccatggccatcaacatgacccccaccgtggagcagggcgagggggaggaggccatgaaggacatggacagcgaccagcagtatgagaagcccccacccctgcacactggagctgactggaagatcgtgctgcacctgcctgagattgagacctggctgaggatgaccagcgagcgggtgcgggacctgacctacagcgtgcagcaggacagcgacagcaagcacgtggatgtgcacctggtgcagctgaaggacatctgtgaggacatcagtgaccacgtggagcagatccacgccctgctggagacagagttcagcctgaagctgctgagctacagcgtgaatgtgattgtggacatccatgctgtgcagctgctgtggcaccagctgcgggtgtctgtgctggtgctgcgggagcgcatcctgcagggcctgcaggatgccaatggaaactacacccggcagacagacatcctgcaggccttcagcgaggagaccaaggagggccgcctggacagcctgacagaggtggatgacagcggccagctgaccatcaagtgcagccagaactacctgagcctggactgtggcatcacagcctttgagctgagtgactacagccccagcgaggacctgctgagcggcctgggggacatgaccagcagccaggtgaagaccaagccctttgacagctggagctacagcgagatggagaaggagttccctgagctgatccgctctgtgggcctgctgactgtggccgctgacagcatcagcaccaatggaagtgaagctgtgacagaggaggtgtcccaggtgtccctgtctgtggatgacaagggcggctgtgaagaagataatgccagcgctgtggaggagcagcccggcctgaccctgggcgtgagcagcagcagtggagaggccctgaccaatgctgcccagcccagcagcgagaccgtgcagcaggagagcagcagcagcagccaccatgatgccaagaaccagcagcctgtgccctgtgaaaatgccacccccaagaggaccatccgggactgcttcaactacaatgaagacagccccacccagcccaccctgcccaagaggggcctcttcctgaaggaggagaccttcaagaatgacctgaagggaaatggaggcaagaggcagatggtggacctgaagccagagatgagccgcagcacccccagcctggtggaccccccagacaggagcaagctgtgcctggtgctgcagagcagctaccccaacagccccagcgctgccagccagagctatgaatgtctgcacaaggtgggcaatggaaacctggagaacacagtgaagttccacatcaaggagatcagcagcagcctgggccgcctgaatgactgctacaaggagaagagccggctgaagaagccccacaagaccagcgaggaggtgcccccctgcaggacccccaagaggggcactggaagtggcaagcaggccaagaacaccaagagcagcgctgtgcccaatggagagctgagctacaccagcaaggccatcgagggcccccagaccaacagcgccagcaccagcagcctggagccctgcaaccagaggtcctggaatgccaagctgcagctgcagagcgagaccagcagcagccctgccttcacccagagcagcgagagctctgtgggcagtgacaacatcatgagccctgtgcccctgctgagcaagcacaagagcaagaagggccaggccagcagccccagccacgtgaccagaaatggagaggtggtggaggcctggtacggcagtgatgagtacctggccctgcccagccacctgaagcagacagaggtgctggccctgaagctggagaacctgaccaagctgctgccccagaagcccagaggagagaccatccagaacattgatgactgggagctgtctgagatgaacagcgacagcgagatctaccccacctaccacgtgaagaagaagcacacccggctgggccgggtgagccccagcagcagcagtgacatcgccagcagcctgggggagagcattgagagcggccccctgagtgacatcctgagtgatgaggagagctccatgcccctggccggcatgaagaagtatgcagatgagaagtctgagcgggccagcagcagcgagaagaatgaaagccacagcgccaccaagagcgccctgatccagaagctgatgcaggacatccagcaccaggacaactatgaggccatctgggagaagattgagggctttgtgaacaagctggatgagttcatccagtggctgaatgaggccatggagaccacagagaactggaccccacccaaggccgagatggatgacctgaagctgtacctggagacccacctgtccttcaagctgaatgtggacagccactgtgccctgaaggaggccgtggaggaggagggccaccagctgctggagctgattgccagccacaaggccggcctgaaggacatgctgaggatgattgccagccagtggaaggagctgcagaggcagatcaagaggcagcacagctggatcctgcgggccctggacaccatcaaggccgagatcctggccacagatgtgtctgtggaggatgaggagggcaccggcagccccaaggccgaggtgcagctgtgctacctggaggcccagagagatgctgtggagcagatgagcctgaagctgtacagcgagcagtacaccagcagcagcaagaggaaggaggagtttgctgacatgagcaaggtgcacagcgtgggcagcaatggcctgctggactttgacagcgagtaccaggagctgtgggactggctgattgacatggagagcctggtgatggacagccatgacctgatgatgtctgaggagcagcagcagcacctgtacaagcgctacagcgtggagatgagcatccgccacctgaagaagacagagctgctgagcaaggtggaggccctgaagaagggcggcgtgctgctgcccaatgacctgctggagaaggtggacagcatcaatgagaagtgggagctgctgggcaagaccctgggggagaagatccaggacaccatggccggccacagcggcagcagcccccgggacctgctgagccctgagagcggcagcctggtgcggcagctggaggtgcgcatcaaggagctgaagggctggctgcgggacacagagctgttcatcttcaacagctgcctgcggcaggagaaggagggcaccatgaacacagagaagcagctgcagtacttcaagagcctgtgccgggagatcaagcagaggcggcggggcgtggccagcatcctgcggctgtgccagcacctgctggatgaccgggagacctgcaacctgaatgctgaccaccagcccatgcagctgatcatcgtgaacctggagcggcgctgggaggccatcgtgatgcaggccgtgcagtggcagacccggctgcagaagaagatgggcaaggagagcgagaccctgaatgtcatcgaccccggcctgatggacctgaatggcatgtctgaagatgccctggagtgggatgagatggacatcagcaacaagctgatcagcctgaatgaggagagcaatgacctggaccaggagctgcagcccgtcatccccagcctgaagctgggggagaccagcaatgaagatcctggctatgatgaggaggccgacaaccacggcggcagccagtatgccagcaacatcacagcccccagcagcccccacatctaccaggtgtacagcctgcacaacgtggagctgtatgaggacaaccacatgcccttcctgaagaacaaccccaaggtgacaggcatgacccagcccaacgtgctgaccaagagcctgagcaaggacagcagcttcagcagcaccaagagcctgcctgacctgctgggcggcagcaacctggtgaagccctgtgcctgccacggcggggacatgagccagaacagcggcagcgagagcggcatcgtgtctgagggggacacagagaccaccaccaacagcgagatgtgcctgctgaatgctgtggatggcagccccagcaacctggagacagagcacctggacccccagatgggagatgctgtgaatgtgctgaagcagaagttcacagatgaaggagagagcatcaagctgcccaacagcagccagagcagcatcagccctgtgggctgtgtgaatggcaaggtgggggacctgaacagcatcaccaagcacaccccagactgcctgggggaggagctgcagggcaagcatgatgtgttcaccttctatgactacagctacctgcagggcagcaagctgaagctgcccatgatcatgaagcagagccagagcgagaaggcccacgtggaggaccccctgctgcggggcttctactttgacaagaagagctgcaagagcaagcaccagaccacagagctgcagccagatgtgccccctcatgagcgcatcctggccagcgccagccatgagatggaccgcatctcctacaagagcggcaacatcgagaagaccttcaccggcatgcagaatgccaagcagctgagcctgctgagccacagcagcagcattgagagcctgagccctggaggagacctgtttggcctgggcatcttcaagaatggaagtgacagcctgcagaggagcaccagcctggagagctggctgaccagctacaagagcaatgaagatctcttcagctgccacagcagcggggacatctctgtgagcagcggctctgtgggggagctgagcaagaggaccctggacctgctgaaccggctggagaacatccagagccccagcgagcagaagatcaagaggtctgtgtctgacatcaccctgcagagcagcagccagaagatgtccttcaccggccagatgagcctggacatcgccagcagcatcaatgaagacagcgctgccagcctgacagagctgagcagcagtgatgagctgagcctgtgcagcgaggacatcgtgctgcacaagaacaagatccctgagagcaatgccagcttcaggaagaggctgaccaggtctgtggctgatgaaagtgatgtgaatgtgtccatgattgtgaatgtgtcctgcaccagcgcctgcacagatgatgaagatgacagcgacctgctgagcagcagcaccctgaccctgacagaggaggagctgtgcatcaaggatgaagatgatgacagcagcatcgccacagatgatgagatctatgaggactgcaccctgatgagcggcctggactacatcaagaatgagctgcagacctggatccggcccaagctgagcctgacccgggacaagaagcgctgcaatgtgtctgatgagatgaagggcagcaaggacatcagcagcagcgagatgaccaaccccagcgacaccctgaacatcgagaccctgctgaatggatctgtgaagagggtgtctgagaacaatggaaatggcaagaacagcagccacacccatgagctgggcaccaagcgggagaacaagaagaccatcttcaaggtgaacaaggacccctacgtggccgacatggagaatggaaatattgagggcatccctgagcggcagaagggcaagcccaacgtgaccagcaaggtgtctgagaacctgggcagccacggcaaggagatcagcgagagcgagcactgcaagtgcaaggccctgatggacagcctggatgacagcaacacagctgggaaggagtttgtgtcccaggatgtgcgccacctgcccaagaagtgccccaaccaccaccactttgagaaccagagcacagccagcacccccacagagaagagcttcagcgagctggccctggagacccgcttcaacaaccggcaggacagtgatgccctgaagagcagtgatgatgcccccagcatggccggcaagtctgctggctgctgcctggccctggagcagaatggaacagaagaaaatgccagcatcagcaacatcagctgctgcaactgtgagccagatgtgttccaccagaaggatgctgaggactgcagcgtgcacaactttgtgaaggagatcatcgacatggccagcacagccctgaagagcaagagccagccagaaaatgaggtggccgcccccaccagcctgacccagatcaaggagaaggtgctggagcacagccaccggcccatccagctgaggaagggggacttctacagctacctgagcctgagcagccatgacagcgactgtggggaggtgaccaactacatcgaggagaagagcagcacccccctgcccctggacaccacagacagcggcctggatgacaaggaggacatcgagtgcttctttgaggcctgtgtggagggggacagtgatggagaggagccctgcttcagcagcgcccccccaaatgaatctgctgtgcccagcgaggccgccatgcccctgcaggccacagcctgcagcagcgagttcagtgacagcagcctgtctgcagatgatgctgacacagtggccctgagcagccccagcagccaggagcgggcagaggtgggcaaggaggtgaatggcctgccccagaccagcagcggctgtgccgagaacctggagttcacccccagcaagctggacagcgagaaggagagcagcggcaagccaggagagagcggcatgcctgaggagcacaatgctgccagcgccaagagcaaggtgcaggacctgagcctgaaggccaaccagcccacagacaaggccgccctgcaccccagccccaagaccctgacctgtgaggagaacctgctgaacctgcacgagaagaggcacaggaacatgcacaggtag

SEQ ID NO: 32157 - DNA, 327 bp, Artificial Sequence
  Description of Artificial Sequence: Synthetic coding sequence
atgctgaccatgtctgtgaccctgagccccctgcggagccaggacctggaccccatggccacagatgccagccccatggccatcaacatgacccccaccgtggagcagggcgagggggaggaggccatgaaggacatggacagcgaccagcagtatgagaagcccccacccctgcacactggagctgactggaagatcgtgctgcacctgcctgagattgagacctggctgaggatgaccagcgagcgggtgcgggacctgacctacagcgtgcagcaggacagcgacagcaagcacgtggatgtgcacctggtgcagctgaagtag

SEQ ID NO: 32158 - DNA, 246 bp, Artificial Sequence
  Description of Artificial Sequence: Synthetic coding sequence
atgggccagctgtgctgcttccccttcagcagagatgagggcaagatcagcgagaagaatggaggagagccagatgatgctgagctggtgcggctgagcaagaggctggtggagaatgctgtgctgaaggctgtgcagcagtacctggaggagacccagaacaagaacaagccaggagagggcagctctgtgaagacagaggccgctgaccagaatggaaatgacaatgaaaacaacaggaagtag

SEQ ID NO: 32159 - DNA, 981 bp, Artificial Sequence
  Description of Artificial Sequence: Synthetic coding sequence
atgtctgaggagtttgaggccaacaccatggacagcctggtggacatgccctttgccaccgtggacatccaggatgactgtggcatcacagatgagccccagatcaacctgaagaggagccaggagaatgagtgggtgaagagtgaccaggtgaagaagaggaagaagaagaggaaggactaccagcccaactacttcctgagcatccccatcaccaacaaggagatcatcaagggcatcaagatcctgcagaatgccatcatccagcaggatgagcggctggccaaggccatggtgtctgatggcagcttccacatcaccctgctggtgatgcagctgctgaatgaagatgaggtgaacattggaattgatgccctgctggagctgaagcccttcatcgaggagctgctgcagggcaagcacctgaccctgcccttccagggcatcggcaccttcggcaaccaggtgggctttgtgaagctggccgagggggaccacgtgaacagcctgctggagattgctgagacagccaacagaaccttccaggagaagggcatcctggtgggggagagccgctccttcaagccccacctgaccttcatgaagctgagcaagagcccctggctgaggaagaatggagtgaagaagattgatcctgacctgtatgagaagttcatcagccacagatttggagaggagatcctgtacagaattgacctgtgcagcatgctgaagaagaagcagagcaatggctactaccactgtgagagcagcatcgtgattggagagaagaatggaggagagccagatgatgctgagctggtgcggctgagcaagaggctggtggagaatgctgtgctgaaggctgtgcagcagtacctggaggagacccagaacaagaacaagccaggagagggcagctctgtgaagacagaagctgctgaccagaatggaaatgacaatgaaaacaacaggaagtag

SEQ ID NO: 32160 - DNA, 1047 bp, Artificial Sequence
  Description of Artificial Sequence: Synthetic coding sequence
atggagaggcctgaggccggcggcatcaacagcaatgaatgtgaaaatgtgtccaggaagaagaagatgtctgaggagtttgaggccaacaccatggacagcctggtggacatgccctttgccaccgtggacatccaggatgactgtggcatcacagatgagccccagatcaacctgaagaggagccaggagaatgagtgggtgaagagtgaccaggtgaagaagaggaagaagaagaggaaggactaccagcccaactacttcctgagcatccccatcaccaacaaggagatcatcaagggcatcaagatcctgcagaatgccatcatccagcaggatgagcggctggccaaggccatggtgtctgatggcagcttccacatcaccctgctggtgatgcagctgctgaatgaagatgaggtgaacattggaattgatgccctgctggagctgaagcccttcatcgaggagctgctgcagggcaagcacctgaccctgcccttccagggcatcggcaccttcggcaaccaggtgggctttgtgaagctggccgagggggaccacgtgaacagcctgctggagattgctgagacagccaacagaaccttccaggagaagggcatcctggtgggggagagccgctccttcaagccccacctgaccttcatgaagctgagcaagagcccctggctgaggaagaatggagtgaagaagattgatcctgacctgtatgagaagttcatcagccacagatttggagaggagatcctgtacagaattgacctgtgcagcatgctgaagaagaagcagagcaatggctactaccactgtgagagcagcatcgtgattggagagaagaatggaggagagccagatgatgctgagctggtgcggctgagcaagaggctggtggagaatgctgtgctgaaggctgtgcagcagtacctggaggagacccagaacaagaacaagccaggagagggcagctctgtgaagacagaagctgctgaccagaatggaaatgacaatgaaaacaacaggaagtag

SEQ ID NO: 32161 - DNA, 315 bp, Artificial Sequence
  Description of Artificial Sequence: Synthetic coding sequence
atgggccagctgtgctgcttccccttcagcagagatgagggcaagatcagcgagctggagagcagcagcagcgctgtgctgcagcgctacagcaaggacatccccagctggagcagtggagagaagaatggaggagagccagatgatgctgagctggtgcggctgagcaagaggctggtggagaatgctgtgctgaaggctgtgcagcagtacctggaggagacccagaacaagaacaagccaggagagggcagctctgtgaagacagaagctgctgaccagaatggaaatgacaatgaaaacaacaggaagtag

SEQ ID NO: 32162 - DNA, 684 bp, Artificial Sequence
  Description of Artificial Sequence: Synthetic coding sequence
atggccccagactatggagtgatgggcatgcagggcgccggcggctatgacagcaccatgccctacggctgcggccgcagccagcccaggatgagggaccgggaccggcccaagagaagaggatttgacagatttggaccagatggcaccggcaggaagaggaagcagttccagctgtatgaggagccagacaccaagctggcccgggtggacagcgagggggacttctctgaaaatgatgatgctgctggggacttccgctctggagatgaggagttcaagggggaggatgagctgtgtgacagcggccggcagagaggagagaaggaggatgaagatgaagatgtgaagaagagaagagagaagcagaggagaagagacaggacccgggacagagctgctgaccgcatccagtttgcctgcagcgtgtgcaagttccgcagctttgatgatgaggagatccagaagcacctgcagagcaagttccacaaggagaccctgcgcttcatcagcaccaagctgcctgacaagacagtggagttcctgcaggagtacatcgtgaacagaaacaagaagattgagaagaggcggcaggagctgatggagaaggagacagccaagcccaagccagaccccttcaagggggagctgagcagccaggatgagtgcttccctggctggtag

SEQ ID NO: 32163 - DNA, 2079 bp, Artificial Sequence
  Description of Artificial Sequence: Synthetic coding sequence
atggaccagggctatggaggctacggggcctggagcgctggccctgccaacacccagggcgcctacggcaccggggtggcctcctggcagggctatgagaactacaactactacggggcccagaacacctctgtgaccactggagccacctacagctatggccctgcctcctgggaggccgccaaggccaatgatggcggcctggccgccggggccccagccatgcacatggccagctatggccctgagccctgcacagacaacagcgacagcctgattgccaagatcaaccagaggctggacatgatgagcaaggagggcggccggggcggcagcggcggcggcggggagggcatccaggaccgggagagcagcttccgcttccagccctttgagagctatgacagccggccctgcctgcctgagcacaacccctaccggcccagctacagctatgactatgaatttgacctgggcagtgacagaaatggcagctttggaggccagtacagcgagtgccgggaccctgcccgggagcggggcagcctggatggcttcatgaggggccggggccagggccgcttccaggacaggagcaaccctggcaccttcatgagaagtgacccctttgtgcccccagctgccagcagcgagcccctgagcaccccctggaatgagctgaactacgtgggcggccggggcctgggcggccccagccccagccggcccccacccagcctcttcagccagagcatggccccagactatggagtgatgggcatgcagggcgctgggggctatgacagcaccatgccctacggctgcggccgcagccagcccaggatgagggaccgggaccggcccaagaggcggggctttgaccgcttcggcccagatggcactggaaggaagaggaagcagttccagctgtatgaggagccagacaccaagctggcccgggtggacagcgagggggacttctctgaaaatgatgatgctgctggggacttccgctctggagatgaggagttcaagggagaagatgagctgtgtgacagcggccggcagagaggagagaaggaggatgaagatgaagatgtgaagaagaggcgggagaagcagaggcggcgggacaggacccgggacagagctgctgaccgcatccagtttgcctgcagcgtgtgcaagttccgcagctttgatgatgaggagatccagaagcacctgcagagcaagttccacaaggagaccctgcgcttcatcagcaccaagctgcctgacaagacagtggagttcctgcaggagtacatcgtgaacagaaacaagaagattgagaagaggcggcaggagctgatggagaaggagacagccaagcccaagccagaccccttcaagggcatcggccaggagcacttcttcaagaagattgaggccgcccactgcctggcctgtgacatgctgatcccagcccagccccagctgctgcagaggcacctgcacagcgtggaccacaaccacaacagaaggctggccgctgagcagttcaagaagaccagcctgcacgtggccaagtctgtgctgaacaacagacacatcgtgaagatgctggagaagtacctgaagggggaggaccccttcaccagcgagaccgtggaccctgagatggagggagatgacaacctgggcggggaggacaagaaggagaccccagaggaggtggccgcagatgtgctggccgaggtgatcacagctgctgtgcgggctgtggatggagagggcgccccagcccctgagagcagcggggagccagcagaagatgagggccccacagacacagctgaggccggcagtgacccccaggccgagcagctgctggaggagcaggtgccctgtggcacagcccacgagaagggcgtgcccaaggcccggtctgaggccgctgaggccggaaatggagctgagaccatggctgctgaggccgagagcgcccagaccagggtggccccagccccagctgctgctgatgctgaggtggagcagacagatgctgagagcaaggatgctgtgcccacagaatag

SEQ ID NO: 32164 - DNA, 1881 bp, Artificial Sequence
  Description of Artificial Sequence: Synthetic coding sequence
atggtggccccctggagggtgtctgtgcgggtgtgcctgagccacctgcgctgctttgagctgcggcagggcctgagcctgctgcggcccagcgagtgccccagagatgcccggctgtgctggctgctgctgggcaccctgcccaaggtggtgtccctgtgtggagatgtgggggagggcgccccagatgtgctgagcagaagaagagtgcgctgcagcggggccgccggggccggccctgctgagagcctgcccagggctggccccctgggcggcgtcttcctgcacctgcggctgtggctgcgggccggggccctgctggtgaagttcttccccctgctgctgctgtaccccctgacctacctggcccccagcgtgtccaccctgtggctgcacctgctgctgaaggccacagagaccagcggccccacctacatcaagctgggccagtgggccagcacccggcgggacctcttcagcgaggccttctgtgcccagttcagcaagctgcacgtgcgggtgaccccccacccctggacccacacagagcgcttcctgcggcaggcctttggagatgactggggcagcatcctgagctttgaaaatcgggagcctgtgggcagcggctgtgtggcccaggtgtacaaggcctatgccaacacagccttcctggagacagacagcgtgcagaggctgggccgggccagctgcctgccccccttcagccacactggagctgtgggcggcctgcgggagctgtttggctacctgggcaatggaaggaagcccccagagaacctggccgaccagagcttcctggagcggctgctgctgcccaaggctgacctggtgggcagcaatgctggggtgtcccgggcccaggtgcccggccaccagcctgaggccaccaacctgatctctgtggccgtgaaggtgctgcaccctggcctgctggcccaggtgcacatggacctgctgctgatgaagattggcagccgggtgctgggcgtgctgcccggcatcaagtggctgagcctgcctgagatcgtggaggagtttgagaagctgatggtgcagcagattgacctgcgctatgaggcccagaacctggagcacttccaggtgaacttcagaaatgtgaaggctgtgaagttccccacccccctgcggccctttgtgacccgggaggtgctggtggagacctatgaggagagcgtgcctgtgagcagctaccagcaggccggcatccctgtggacctgaagaggaagatcgcccggctgggcatcaacatgctgctgaagatgatctttgtggacaactttgtgcacgccgacctgcaccctggcaacatcctggtgcagggcgccaacggcctgagcagcagccaggaggcccagctgcagcaggccgacatctgtgacaccctggtggtggccgtgcccagcagcctgtgccccctgcggctggtgctgctggatgctggcatcgtggccgagctgcaggccccagacctgaggaacttccgggctgtgttcatggctgtggtgatgggccagggccagagggtggccgagctgatcctgcaccacgcccgggcctctgaatgtagagatgtggagggcttcaagacagagatggccatgctggtgacccaggccaggaagaacaccatcaccctggagaagctgcacgtgagcagcctgctgagctctgtgttcaagctgctgatgacccacaaggtgaagctggagagcaactttgccagcatcgtgtttgccatcatggtgctggagggcctgggccgcagcctggaccccaagctggacatcctggaggccgcccggcccttcctgctgaccggccctgtgtgccccccatag

SEQ ID NO: 32165 - DNA, 1512 bp, Artificial Sequence
  Description of Artificial Sequence: Synthetic coding sequence
atgtggctgaaggtgggcggcctgctgcggggcaccggcggccagctgggccagacagtgggctggccctgtggggccctgggccctggcccccaccgctggggcccctgtggcggctcctgggcccagaagttctaccaggacggccctggccggggcctgggggaggaggacatccggcgggcccgggaggcccggcccaggaagaccccccggccccagctgagtgacaggagccgggagaggaaggtgcctgccagccgcatcagccggctggccaactttggaggcctggccgtgggcctgggcctgggcgtgctggccgagatggccaagaagtccatgcctgggggccgcctgcagagcgacaacagcttcatcagcccccagctgcagcacatctttgagcgggtgcggcagagcgctgacttcatgccccgctggcagatgctgcgggtgctggaggaggagctgggccgggactggcaggccaaggtggccagcctggaggaggtgccctttgctgctgccagcatcggccaggtgcaccagggcctgctgagagatggaacagaggtggccgtgaagatccagtacccaggcatcgcccagagcatccagagtgatgtgcagaacctgctggccgtgctgaagatgtctgctgccctgcctgctggcctgtttgctgagcagagcctgcaggccctgcagcaggagctggcctgggagtgtgactacagaagagaggccgcctgtgcccagaacttccggcagctgctggccaatgaccccttcttccgggtgcctgctgtggtgaaggagctgtgcaccaccagggtgctgggcatggagctggccggcggcgtgcccctggaccagtgccagggcctgagccaggacctgaggaaccagatctgcttccagctgctgaccctgtgcctgcgggagctgtttgagttccgcttcatgcagacagaccccaactgggccaacttcctgtatgatgccagcagccaccaggtgaccctgctggactttggagccagccgggagtttggaacagagttcacagaccactacatcgaggtggtgaaggctgctgctgatggagaccgggactgtgtgctgcagaagagccgggacctgaagttcctgaccggctttgagaccaaggccttcagtgatgcccacgtggaggccgtgatgatcctgggggagccctttgccacccagggcccctatgactttggcagcggggagacagcccggcgcatccaggacctgatccctgtgctgctgcggcaccggctgtgccccccacctgaggagacctacgccctgcacaggaagctggccggggccttcctggcctgtgcccacctgcgggcccacatcgcctgccgggacctcttccaggacacctaccaccgctactgggccagccggcagccagatgctgccacagctggcagcctgcccaccaagggggacagctgggtggaccccagctag
